(12) United States Patent
Moussaoui et al.

(10) Patent No.: US 12,344,895 B2
(45) Date of Patent: Jul. 1, 2025

(54) LONG NON-CODING RNAS (LNCRNAS) FOR THE DIAGNOSIS AND THERAPEUTICS OF BRAIN DISORDERS, IN PARTICULAR COGNITIVE DISORDERS

(71) Applicant: AMONETA DIAGNOSTICS SAS, Huningue (FR)

(72) Inventors: Saliha Moussaoui, Bartenheim (FR); Hueseyin Firat, Huningue (FR); Eric Schordan, Wentzwiller (FR)

(73) Assignee: AMONETA DIAGNOSTICS SAS, Huningue (FR)

( * ) Notice: Subject to any disclaimer, the term of this patent is extended or adjusted under 35 U.S.C. 154(b) by 1089 days.

(21) Appl. No.: 17/274,019

(22) PCT Filed: Sep. 5, 2019

(86) PCT No.: PCT/EP2019/073775
§ 371 (c)(1),
(2) Date: Mar. 5, 2021

(87) PCT Pub. No.: WO2020/049135
PCT Pub. Date: Mar. 12, 2020

(65) Prior Publication Data
US 2021/0269881 A1 Sep. 2, 2021

Related U.S. Application Data

(60) Provisional application No. 62/727,210, filed on Sep. 5, 2018.

(51) Int. Cl.
*C12Q 1/6883* (2018.01)
(52) U.S. Cl.
CPC ..... *C12Q 1/6883* (2013.01); *C12Q 2600/158* (2013.01); *C12Q 2600/178* (2013.01)
(58) Field of Classification Search
None
See application file for complete search history.

(56) References Cited

U.S. PATENT DOCUMENTS

| 6,703,212 B1 | 3/2004 | Janoshazi et al. |
| 7,897,786 B2 | 3/2011 | Ulrich et al. |
| 9,377,472 B2 | 6/2016 | Mbebi-Liegeois et al. |

FOREIGN PATENT DOCUMENTS

| EP | 1 716 227 A2 | 11/2006 |
| WO | WO 2015/031958 | 3/2015 |

OTHER PUBLICATIONS

Zhou et al. Int J Clin Exp Med. 2015. 8(4): 4862-4883 (Year: 2015).*
Soreq et al PLoS Comput Biol. Mar. 20, 2014. 10(3): e1003517, 22 pages, and and Table S3B (Year: 2014).*
Chi et al Hindawi Parkinson's Disease. Feb. 2019. Article ID 6078251, 7 pages (Year: 2019).*
Strausberg et al. NCBI GenBank No. BI259848, Jan. 11, 2011, National Center for Biotechnology Information, National Library of Medicine, NIH, Bethesda, MD, available via url: <ncbi.nlm.nih.gov/nuccore/BI259848.1/> (Year: 2011).*
Bang et al., Lancet, vol. 386, No. 10004, Oct. 24, 2015 (Oct. 24, 2015), pp. 1672-1682.
Breiman L: "Random forests", Machine Learnin, vol. 45, No. 1, 2001, pp. 5-32, XP019213368, doi:10.1023/A:1010933404324.
C. Trapnell et al., Nat Protoc, vol. 7, No. 3, 2012, pp. 562-578.
Carlson et al., Alzheimers Dement (AMST, vol. 2, 2016, pp. 75-85.
Cummings et al., Expert Rev Clin Pharmacol, vol. 7, No. 2, 2014, pp. 161-165.
Desmarais P et al., J Neurol Neurosurg Psychiatry, vol. 90, 2019, pp. 412-423.
Dobin A. et al.: "Star: ultrafast universal RNA-seq aligner", Bioinforma. Oxf. Engl., vol. 29, 2013, pp. 15-21, XP055500895, doi:10.1093/bioinformatics/bts635.
Dubois et al., Lancet Neurol, vol. 13, No. 6, 2014, pp. 614-629.
Frisoni et al., Nat Rev Neurol, vol. 6, No. 2, 2010, pp. 67-77.
Gael Chetelat et al., NeuroImage Clinical, vol. 2, 2013, pp. 356-365.
Gotz et al., Br J Pharmacol, vol. 165, No. 5, 2012, pp. 1246-1259.
L. Wang L. et al., Nucleic Acids Res, vol. 41, No. 6, 2013, pp. e74.
Liang Feng et al: "Plasma long non-coding RNA BACE1 as a novel biomarker for diagnosis of Alzheimer disease", BMC Neurology, vol. 18, No. 1, Jan. 9, 2018 (Jan. 9, 2018), XP055636641, DOI: 10.1186/s12883-017-1008-x.
Lilach Soreq et al: "Long Non-Coding RNA and Alternative Splicing Modulations in Parkinson's Leukocytes Identified by RNA Sequencing", PLOS Computational Biology, vol. 10, No. 3, Mar. 20, 2014 (Mar. 20, 2014), pp. e1003517, XP055334570, DOI: 10.1371/journal.pcbi.1003517.
Luo et al., Clin Interv Aging, vol. 11, 2016, pp. 867-872.
Marcus et al., J Neurogenet, vol. 25, No. 4, 2011, pp. 127-133.
Pertea M. et al., Nat Biotechnol, vol. 33, No. 3, 2015, pp. 290-295.
Rama Shankar et al: "Transcriptome analysis in different rice cultivars provides novel insights into desiccation and salinity stress responses", Scientific Reports, vol. 6, No. 1, Mar. 31, 2016 (Mar. 31, 2016), XP055636000, DOI: 10.1038/srep23719.
Siemer et al., Alzheimers Dement, vol. 12, No. 2, 2016, pp. 110-120.
Slawski Mdaumer Mboulesteix al: "CMA: a comprehensive Bioconductor package for supervised classification with high dimensional data", BMC Bioinformatics, vol. 9, 2008, pp. 439, XP021047481, doi:10.1186/1471-2105-9-439.
Sun Z. et al., Scientific Reports, vol. 7, No. 1, 2017, pp. 14196.
Sunderland et al., JAMA, vol. 289, No. 16, 2003, pp. 2094-2103.
Tahmasian et al., J Nucl Med., vol. 57, No. 3, 2016, pp. 410-415.
Xing Y. et al.: "An expectation-maximization algorithm for probabilistic reconstructions of full-length isoforms from splice graphs", Nucleic Acids Res., vol. 34, 2006, pp. 3150-3160, XP002734295, doi:10.1093/nar/gk1396.

(Continued)

Primary Examiner — Carla J Myers
(74) *Attorney, Agent, or Firm* — Hoxie & Associates LLC

(57) ABSTRACT

The present invention describes a method for the therapeutic treatment and/or for the diagnosis of a brain disorder including but not limited to cognitive disorders such as mild cognitive impairment, Alzheimer disease, frontotemporal dementia, dementia with Lowy body in a subject at risk of having or developing a brain disorder such as cognitive disorder, using long non-coding RNA (lncRNA).

3 Claims, 19 Drawing Sheets
Specification includes a Sequence Listing.

(56) References Cited

OTHER PUBLICATIONS

Yanyao Deng et al: "Plasma long noncoding RNA 51A as a stable biomarker of Alzheimer's disease", Int J Clin Exp Pathol, Apr. 1, 2017 (Apr. 1, 2017), pp. 4694-4699, XP055636042, Retrieved from the Internet <URL:http://www.ijcep.com/files/ijcep0047807.pdf> [retrieved on Oct. 25, 2019].

Yaxing Gui et al: "Altered microRNA profiles in cerebrospinal fluid exosome in Parkinson disease and Alzheimer disease", Oncotarget, Nov. 10, 2015 (Nov. 10, 2015), United States, pp. 37043, XP055278437, Retrieved from the Internet <URL:https://www.ncbi.nlm.nih.gov/pmc/articles/PMC4741914/pdf/oncotarget-06-37043.pdf> DOI: 10.18632/oncotarget.6158.

Wang H.Y., et al. "Quantamatrix Multiplexed Assay Platform system for direct detection of bacteria and antibiotic resistance determinants in positive blood culture bottles," *Clin Microbiol Infect.* May 2017; 23(5):333.e1-333.e7.

Yang, et al., "Distinct Hippocampal Expression Profiles of Long Non-coding RNAs in an Alzheimer's Disease Model", *Mol. Neurobiol.*, vol. 54, No. 7, pp. 4833-4846, (2016).

Yaohui, et al., "Investigation of Long Non-coding RNA Expression Profiles in the Substantia Nigra of Parkinson's Disease", *Cell Mol. Neurobiol.*, vol. 37, No. 2, pp. 329-338, (2016).

Zhang, et al., "Preparation and application of streptavidin magnetic particles", *Sci. China Ser. B-Chem.*, vol. 50, No. 1, pp. 127-134, (2007).

\* cited by examiner

| lncRNA | Rank |
|---|---|
| lnc-TPPP-1:2 | 1 |
| LINC02345:11 | 2 |
| lnc-ZNF273-4:4 | 3 |
| lnc-TACC2-8:6 | 4 |
| LINC01206:20 | 5 |
| lnc-C5orf67-3:1 | 6 |
| HAND2-AS1:58 | 7 |
| lnc-PRDM9-20:1 | 8 |
| lnc-CLK1-1:7 | 9 |
| lnc-DNALI1-5:4 | 10 |
| RORB-AS1:6 | 11 |
| lnc-TPPP-1:3 | 12 |
| lnc-BMS1-2:1 | 13 |
| lnc-ADRB1-4:1 | 14 |
| lnc-XXYLT1-5:1 | 15 |
| MIR99AHG:104 | 16 |
| LINC01748:17 | 17 |
| lnc-AKR1E2-15:1 | 18 |

| Accuracy | 0.917 |
|---|---|
| Sensitivity | 0.833 |
| Specificity | 1.000 |
| Positive Predictive value | 1.000 |
| Negative Predictive value | 0.857 |

| lncRNA | Rank |
|---|---|
| PCBP1-AS1:302 | 1 |
| STARD7-AS1:5 | 2 |
| lnc-NID1-4:4 | 3 |
| RBM26-AS1:1 | 4 |
| LEF1-AS1:1 | 5 |
| lnc-CA6-8:1 | 6 |
| lnc-CA6-8:2 | 7 |
| lnc-OCM-3:4 | 8 |
| lnc-AFG1L-7:1 | 9 |
| lnc-LASP1-5:1 | 10 |
| lnc-GCGR-1:2 | 11 |

| Accuracy | 0,934 |
|---|---|
| Sensitivity | 0.65 |
| Specificity | 0.983 |

To achieve 100X coverage with targeted sequencing, only 8 Millions of reads are needed compared to more than 500M with regular sequencing

LONG NON-CODING RNAS (LNCRNAS) FOR THE DIAGNOSIS AND THERAPEUTICS OF BRAIN DISORDERS, IN PARTICULAR COGNITIVE DISORDERS

CROSS-REFERENCE TO RELATED APPLICATIONS

This application is a U.S. National Stage Application filed under 35 U.S.C. § 371 of International Application No. PCT/EP2019/073775, filed Sep. 5, 2019, which claims the benefit and priority of U.S. Provisional Application No. 62/727,210, filed on Sep. 5, 2018, the contents of each of which are hereby incorporated by reference in their entireties.

FIELD OF THE INVENTION

The present invention relates to the field of human medicine and specifically to the diagnostic and therapeutic of brain disorders and particularly cognitive disorders including those with mild cognitive impairment, Alzheimer disease, dementia with Lewy body and frontotemporal dementia. This invention relates to a biomarker for brain disorders, such as cognitive disorders, consisting in long non-coding RNAs (lncRNAs) in a peripheral circulating body fluid such as plasma or blood and/or expressed in brain tissue and/or whole blood and representing a therapeutic target for brain disorders, or non-invasive method for diagnosing brain disorders such as cognitive disorders, in particular Alzheimer's disease or for monitoring its development or progression using this biomarker. It further relates to associated kits, methods, protocols and transmittable forms of information for diagnosis purposes and/or for other human medicine applications including the patient stratification in clinical trials and/or monitoring the efficacy of therapeutic strategies using this biomarker and peripheral body fluids or whole blood from patients. The invention further consists in brain specific lncRNAs altered in patient with brain disease in particular cognitive disorder and representing a diagnostic or therapeutic candidate for their treatment. The present invention will thus have a strong impact on the quality of life of patients and a significant impact on the healthcare system and economy.

BACKGROUND ART

Alzheimer's disease (AD) is a chronic neurodegenerative disease characterized by progressive loss of cognitive function. Mild cognitive impairment (MCI) is a major first symptom and evolves progressively into mild, moderate and severe AD stages. Early-onset AD occurs between a 30s to mid-60s and represents less than 10% of all people with AD and is caused by a mutation in APP or PSEN1 or PSEN2 genes. Most people with AD have the late-onset form with onset of symptoms in the mid-60s and later. The causes of late-onset AD are not yet completely understood, but most documented genetic risk factor is the apolipoprotein E (APOE) gene allele ε4. All AD forms, whether early-onset familial or sporadic forms, are pathologically characterized by two typical hallmarks, extracellular deposition of amyloid-beta peptide (Aβ) (a metabolite of APP protein encoded by APP gene) in amyloid plaques and intracellular deposition of hyper-phosphorylated tau protein (encoded by MAPT gene) in neurofibrillary tangles in the brain, associated with progressive neuronal degeneration (Marcus et al. J Neurogenet. 2011; 25 (4): 127-33; Gotz et al, Br J Pharmacol. 2012; 165 (5): 1246-59).

AD is the most common form of dementia. Approximately 46.8 million people worldwide currently live with AD or other type of dementia. With an ageing population, this number is estimated to increase to 131.5 million by 2050 (World Alzheimer Report, 2015). As such, AD is becoming an increasingly important burden on the affected individuals and their families as well as economic and social costs on medical and healthcare resources in both developed and emerging countries.

Dementia with Lewy bodies (DLB) and Parkinson's disease dementia (PDD), both called Lewy body dementias, are the second most common type of degenerative dementia in patients older than 65 years and their brain pathological hallmarks are α-synuclein neuronal inclusions (Lewy bodies, and Lewy neurites), accompanied by neuronal loss (Lancet. 2015 Oct. 24; 386 (10004): 1683-97). Variants in three genes APOE, SNCA, and GBA have been associated with an increased risk of dementia with Lewy bodies, but in most cases, the cause is unknown.

Frontotemporal dementia (FTD) is the third most common dementia across all age groups and the $1^{st}$ or the $2^{nd}$ (after AD) prevalent dementia in the 45-64 years age group. The most common form is known as behavioral variant frontotemporal dementia (bvFTD), which is characterized (in its early stages) by changes in personality, behavior, and judgment. Other disorders under the "frontotemporal disorders" umbrella include Pick's disease, primary progressive aphasia, primary non-fluent aphasia, semantic dementia, corticobasal degeneration (CBD) syndrome, progressive supranuclear palsy (PSP), frontotemporal dementia (FTD) with parkinsonism, and FTD with amyotrophic lateral sclerosis (ALS).

There are overlapping clinical features between the classic clinical phenotypes of FTD spectrum disorders, thus complicating the clinical diagnostic picture. FTD spectrum disorders also share common underlying molecular pathology with findings of frontotemporal lobar degeneration, with neuronal and astrocytic inclusions of tau protein, TAR DNA-binding protein 43 (TDP-43), and rarely RNA-binding protein fused in sarcoma (FUS). bvFTD and PPA_language variants are associated with tau, TDP-43 or FUS proteinopathies, and PSP syndrome is often associated with tau proteinopathy. While CBD syndrome pathology comprises tauopathy in the form of CBD or PSP, but also beta-amyloidopathy/tauopathy (typical of AD), prionopathy, TDP-43 proteinopathy and alpha-synucleinopathy. As many as 40% of patients with FTD have a family history of the disease. 10%-20% of all cases attributed to mutations in or near the 3 genes: C9orf72 (encoding protein C9orf72), GRN (encoding progranulin) and MAPT (encoding tau). More rare, other causing genetic mutations have been identified in familial FTD: VCP, TARDBP, TIA1, TBK1 and CCNF genes for cases of FTD due to TDP proteinopathy, and in CHMP2B and FUS for cases of FTD due to tau-negative, TDP-negative, ubiquitin-positive pathology (Lancet. 2015 Oct. 24;386 (10004): 1672-82; Desmarais P, et al. J Neurol Neurosurg Psychiatry 2019; 90:412-423).

Currently, there is no cure for AD, nor for any of the other non-AD dementia types. Symptomatic treatments exist for these diseases, all trying to counterbalance neurotransmitter's disturbance. Although a number of new potential disease-modifying therapeutic candidates are currently being studied in clinical trials in AD, none has been approved yet. From 2002 to 2012, there was a failure of 99.6% of AD clinical trials that were 289 Phases 2 and 3 trials on symptomatic agents (36.6%), disease-modifying small molecules (35.1%) and disease-modifying immunotherapies (18%) (Cummings et al., Expert Rev Clin Pharmacol. 2014; 7 (2): 161-5). Among the strategies proposed by worldwide experts in the AD field and by pharmaceutical industries to improve the success rate for AD drug development, are: a) intervening earlier in the disease process before neurodegeneration begins, b) identifying and developing accurate biomarkers for early diagnosis, non-invasive and suitable for stratification of subject populations and for longitudinal monitoring of drug efficacy in clinical trials.

The AD pathological features are defined in post-mortem histopathological analysis. The presence of both types of lesions (amyloid plaques and tangles) in the brain remains an absolutely required feature for the definitive diagnosis of AD.

Current diagnosis of the disease remains uncertain (Dubois et al Lancet Neurol. 2014; 13 (6): 614-29) and it is based on combination of battery of clinical and neuropsychological tests and neuroimaging, such as structural imaging using Magnetic Resonance Imaging (MRI) and/or glucose metabolism using ositron emission tomography (PET) of fluorodeoxyglucose F18 ($^{18}$F-FDG), with an accuracy of less than 70%-85% depending on the method and the severity stage of the disease (Frisoni et al., Nat Rev Neurol. 2010; 6 (2): 67-77; Tahmasian et al., J Nucl Med. 2016; 57 (3): 410-5).

Sometimes, detection of AD-associated biomarkers Aβ42 and tau or phosphorylated-tau in cerebrospinal fluid (CSF) is additionally performed (Sunderland et al., JAMA. 2003; 289 (16): 2094-2103), but CSF tests request a lumbar puncture, which is an invasive procedure and often requires hospitalization of subjects and therefore used only in a small proportion of subjects and at a too-late-stage of AD.

Longitudinal confirmatory diagnosis test is essential for applications to early detection of the preclinical stages of AD and mild cognitive impairment (MCI; defined as an early stage during which the first subtle symptoms manifest) and thus detecting early and calculating the risk of conversion of MCI into AD. Due to its limits (invasive), a CSF test is not routinely used as a biomarker for early diagnosis in preclinical AD stages before symptoms appear, nor it is suitable as a companion biomarker repeatedly practiced at several time points in same subjects recruited in longitudinal clinical trials.

Recently, specific neuroimaging methods relevant for AD pathology are being developed, notably with radioactive ligands for in vivo amyloid-beta (Aβ) ligands for Positron Emission Tomography (PET) neuroimaging including F-18 florbetapir and F-18 flutemetamol which have been approved by FDA and/or EMA (Choi et al., 2009 and Wong et al., 2010). However, their practice is costly and very limited (available only in some hospitals of large cities, still mainly for clinical research purposes as not reimbursed by health insurances) and their diagnosis accuracy is still under studies for further understanding. Thus, the use of these AB PET neuroimaging methods remains very limited and the vast majority of patients do not profit from such tests even in rich countries.

There is a need for better definition of AD patient population to be included for the drug-development trials: PET imaging using Aβ ligands showed that up to 30% of subjects diagnosed with AD show a negative Aβ scan and that up to 35% of subjects with normal cognition status show a positive Aβ scan (Gaël Chételat et al, NeuroImage Clinical 2013; 2:356-65). Thus, PET Aβ scan is being used to guide for recruitment of subjects in the desired cohorts in some clinical trials by the large pharmaceutical companies. Anti-Aβ antibody e.g. Solanezumab tested in patients with mixed mild to moderate AD failed to show clear efficacy. In mild AD patients selected based on CSF biomarker profile, the results showed a first promising efficacy (Carlson et al., Alzheimers Dement (Amst). 2016; 2:75-85; Siemers et al., Alzheimers Dement. 2016; 12 (2): 110-20). However, the use of CSF biomarker is invasive, dramatically limiting its use as a biomarker for drug development. For example, it is not suitable for repeated use to monitor the stability and/or the progression of the disease, nor it is suitable to monitor in clinical longitudinal trials the efficacy of disease-modifying therapeutic drug candidates or preventive strategies in routine clinical practice use.

Overall, the existing tests either lack an easy accessibility and simplicity for use for diagnosis of the large AD population and/or lack accuracy (sensitivity and specificity). This represents a major impediment and bottleneck to develop reliable and rapid diagnosis test for AD. Another impediment is the identification of a biomarker that does not require invasive sample collecting, such as a spinal tap. The lack of such an accessible, sensitive and specific biomarker that could be validated by cellular, animal model, pre-clinical models, and human testing impedes the development of therapies and drugs for AD or for the studies on pathological processes triggering AD or involved in the progression of AD.

Today, clearly there is a high unmet medical need for efficient preventive or disease-modifying therapeutic treatment, as well as for an accurate and non-invasive peripheral biomarker test for early diagnosis of AD including preclinical and early MCI and for applications in drug development (patient stratification and repeated monitoring drug efficacy in clinical trials) and to monitor the efficacy and adjust the dosing novel future therapies once approved.

Likewise, for non-AD dementia, including DLB and for many FTD related neurodegenerative disorders, there is a high unmet medical need for efficient preventive or disease-modifying therapeutic treatment, and for an accurate and non-invasive peripheral biomarker test for diagnosis in particular of their early forms.

lncRNAs are typically defined as transcripts longer than 200 nucleotides and among the RNA families, lncRNAs seem to be the most tissue-specifically expressed. In the brain, lncRNAs can regulate gene expression at epigenetic, transcriptional, and posttranscriptional levels of proteins with diverse functions including neuronal transmission and synaptic plasticity. Recent studies identified a few lncRNA candidates in AD postmortem brain tissue; some lncRNA candidates have been shown in in vitro experiments or animal models to directly or indirectly regulate the formation of the neurotoxic Aβ, synaptic activity or the neuronal DNA repair (for review: Luo K and Chen Y, Clin Interv Aging 2016; 11:867-872).

We previously showed that the lncRNAs expressed or highly enriched in tissues such as cardiac tissue or brain tissue, can be released into the peripheral circulation and be easily quantifiable by classical RT-PCR in different peripheral samples (PCT/EP2018/065492). In addition of the RT-PCR, we performed also total RNA sequencing on peripheral samples and quantified significant proportion of lncRNAs in the peripheral samples such as serum, plasma and Paxgene-RNA-tube collected whole blood (PCT/EP2018/065492).

According to the invention, new lncRNA signatures specific of brain diseases, in particular mild cognitive impairment (MCI) and Alzheimer or another cognitive disorder have been identified, using a method set up combining most recent technologies and samples collected in non-invasively manner, including Paxgene whole blood tube, serum and plasma.

SUMMARY OF THE INVENTION

In the present invention, 1091 novel brain lncRNAs have been sequenced and identified for the first time in human postmortem brain tissue, in particular meditotemporal cortex of AD patients and cognitively intact healthy controls. Brain lncRNAs including novel brain lncRNAs with differential expression in the brain of AD patients when compared to the brain of healthy controls have been identified. Furthermore, new lncRNA signatures comprising the already sequenced and newly sequenced have been identified as differentially expressed in samples collected in non-invasively manner, including whole blood collected in Paxgene RNA tube and plasma derived from blood of patients suffering MCI, AD, DLB or FTD when compared to healthy controls, as well as panels that detect specifically MCI and/or one of the dementia type (AD or DLB or FTD) when compared to the other dementia types studied. Furthermore, brain-enriched lncR-NAs including novel brain-enriched lncRNAs have been identified. These brain-enriched lncRNAs include circulating lncRNAs detectable in the peripheral body fluids plasma and whole blood Paxgene RNA samples.

In an aspect, the lncRNAs including novel lncRNAs identified as having deficient expression in AD brain represent novel therapeutic candidates for development as lncRNA molecule-enhancing therapeutic approaches, and the novel brain lncRNAs identified as having an over expression in AD brain represent novel therapeutic candidates for development as lncRNA molecule-silencing therapeutic approaches, both for treatment of brain disorders in particular Alzheimer's disease and other cognitive disorders.

In another aspect, the plasma and whole blood lncRNAs panels, identified as differentially expressed in patients suffering cognitive disorders are potential therapeutic targets and/or biomarkers for the prediction and/or the diagnosis and/or the differential diagnosis of brain disorders, in particular cognitive disorders in a subject at risk to develop AD, FTD, DLB and/or another cognitive disorder or dementia type.

In another aspect, the brain-enriched lncRNAs panels identified represent therapeutic and diagnostic targets for brain disorders, including but not limited to cognitive disorders such as MCI, AD, FTD, DLB.

The novel lncRNAs, the newly identified brain-enriched lncRNAs panels we called BrainLinc, the new lncRNAs panels identified as differentially expressed in the peripheral body fluids including the common to brain and plasma (or to brain and blood) lncRNAs identified can be quantified in the peripheral samples of patients using the innovative Celemics technology with significantly higher sensitivity, precision and/or accuracy that would not have been realized using other currently existing technologies. Monitoring of large number of lncRNAs targets by Cemelics and for quantification of small number of lncRNAs by qPCR and Quantamatrix are preferred methods to other existing methods such as NGS and HTG.

Figure 1:
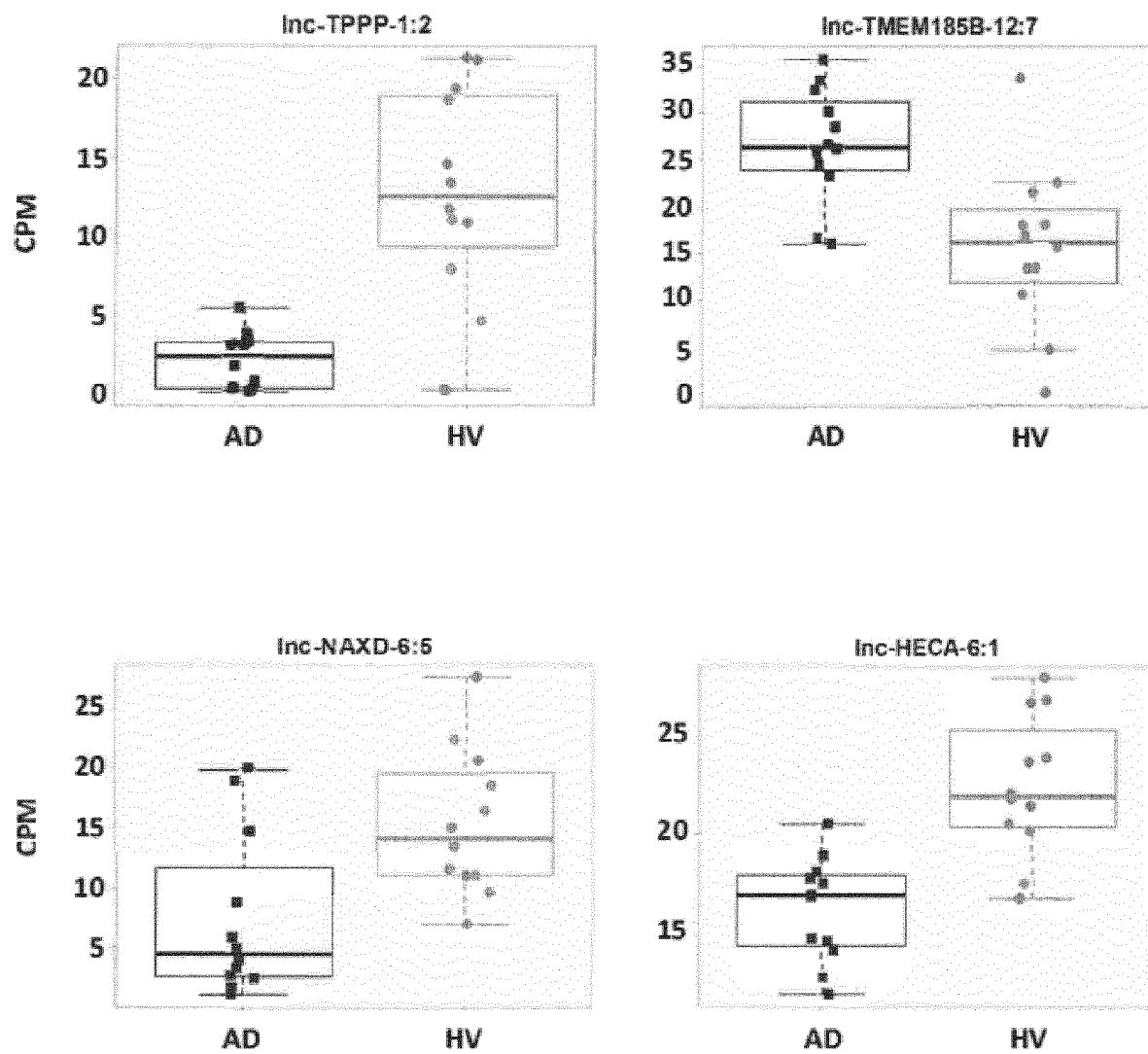
FIG. 1 shows the expression level of lncRNA candidates lnc-TPPP-1:2, lnc-TMEM185B-12:7, lnc-NAXD-6:5 and lnc-HECA-6:1 on human serum samples from patients with early to moderate Alzheimer (AD) and age-matched healthy controls. Y axis: mean+/−standard error of the mean of concentration of the lncRNAs in CPM (count per million). X axis: AD: Alzheimer patient group, HV: Healthy control group.
Figure 2:
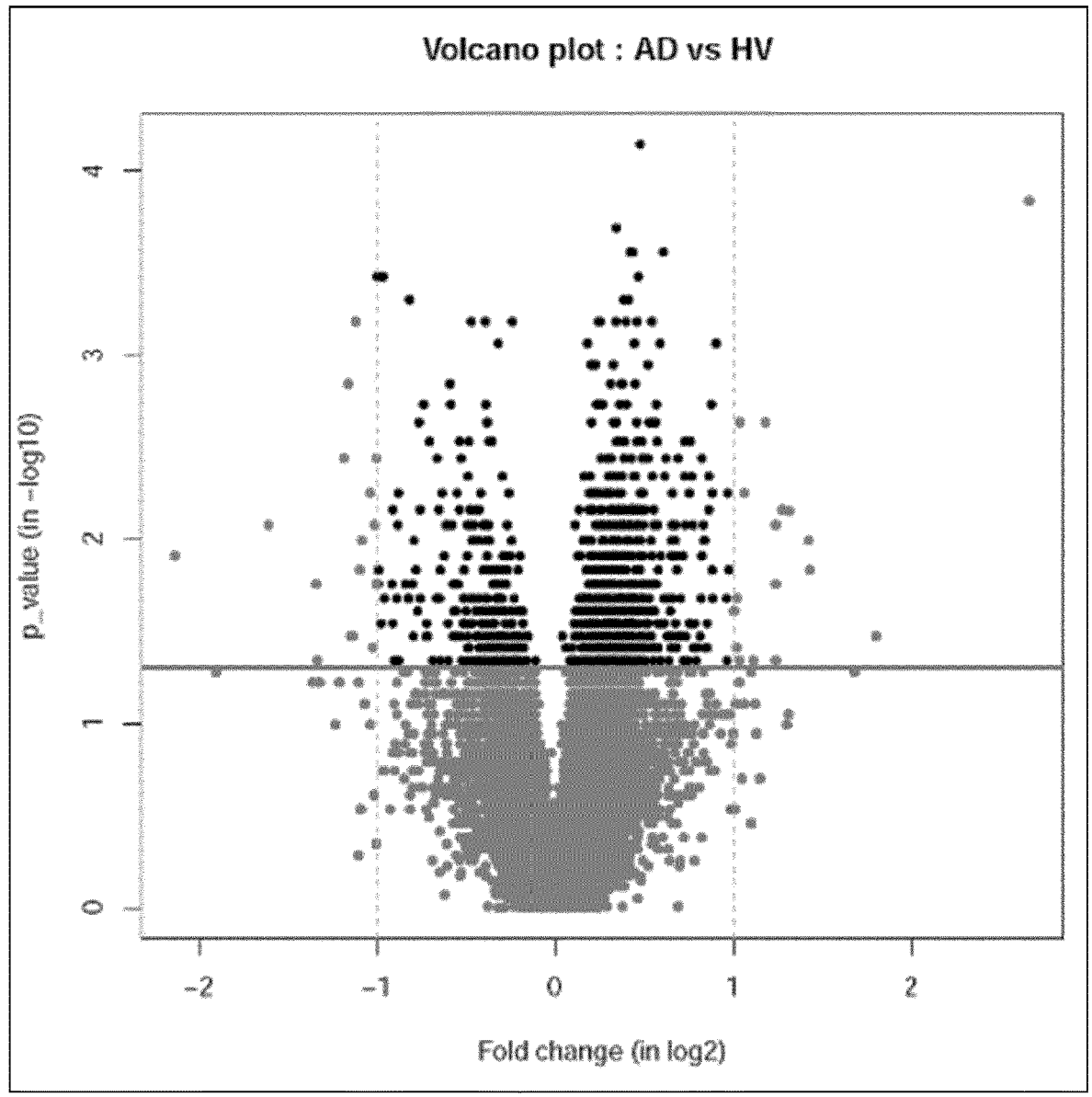
FIG. 2 shows Volcano plot of the comparison. The volcano plot shows the serum 1008 lncRNAs that are differentially expressed in AD group versus HV (healthy control) group with statistically significance (p<0.05) above the line. 33 lncRNAs show both p value of <0.05 and fold change of ≥2 or <0.5. The lncRNAs that are differentially expressed but do not reach a statistically significance are shown below the line.
Figure 3:
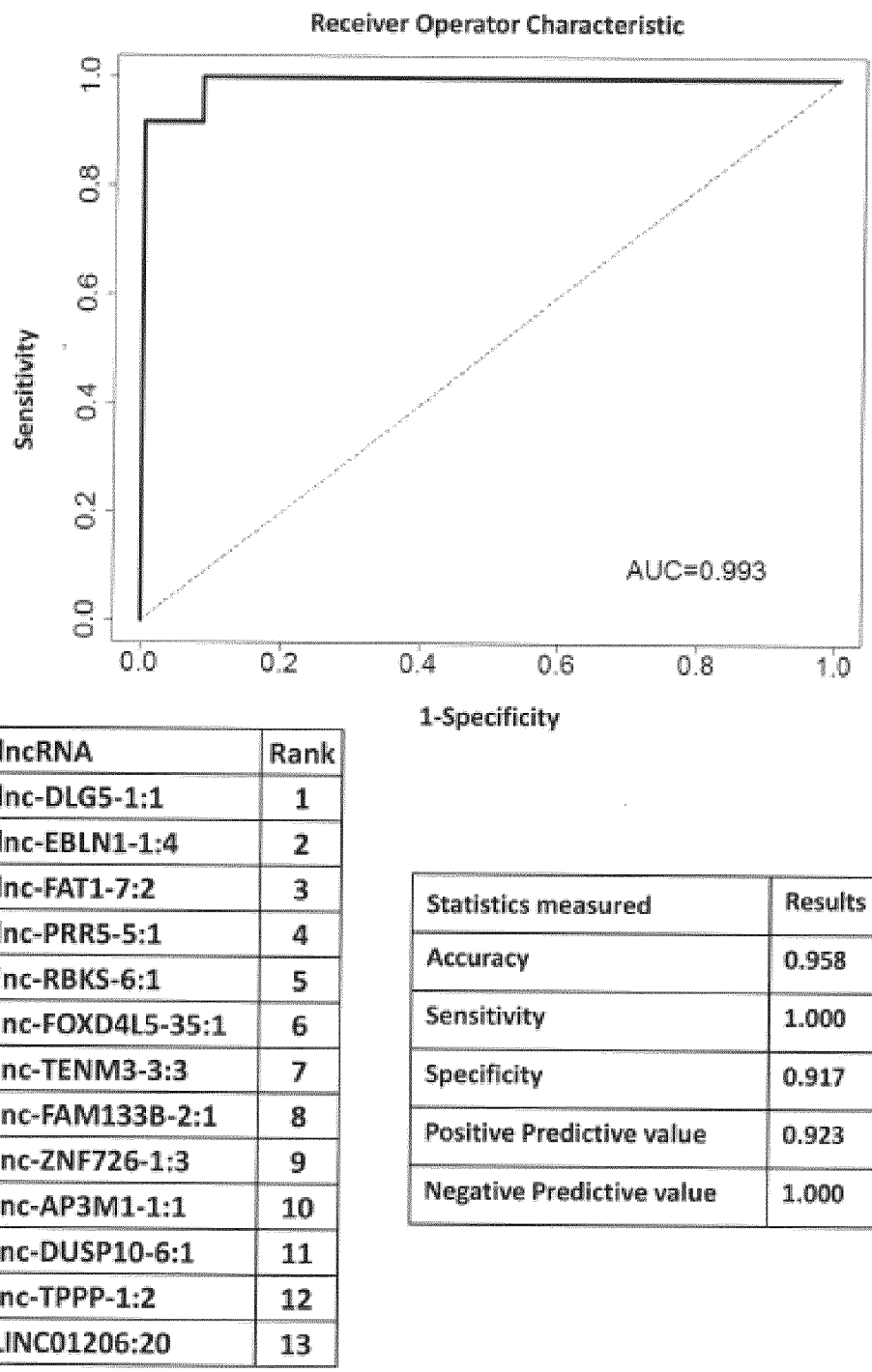
FIG. 3 shows a predictive modelling based on the random forest algorithm enabling the identification of the signature of the 13-top ranked serum lncRNAs candidates selected out of 19867 lncRNAs.
Figure 4:
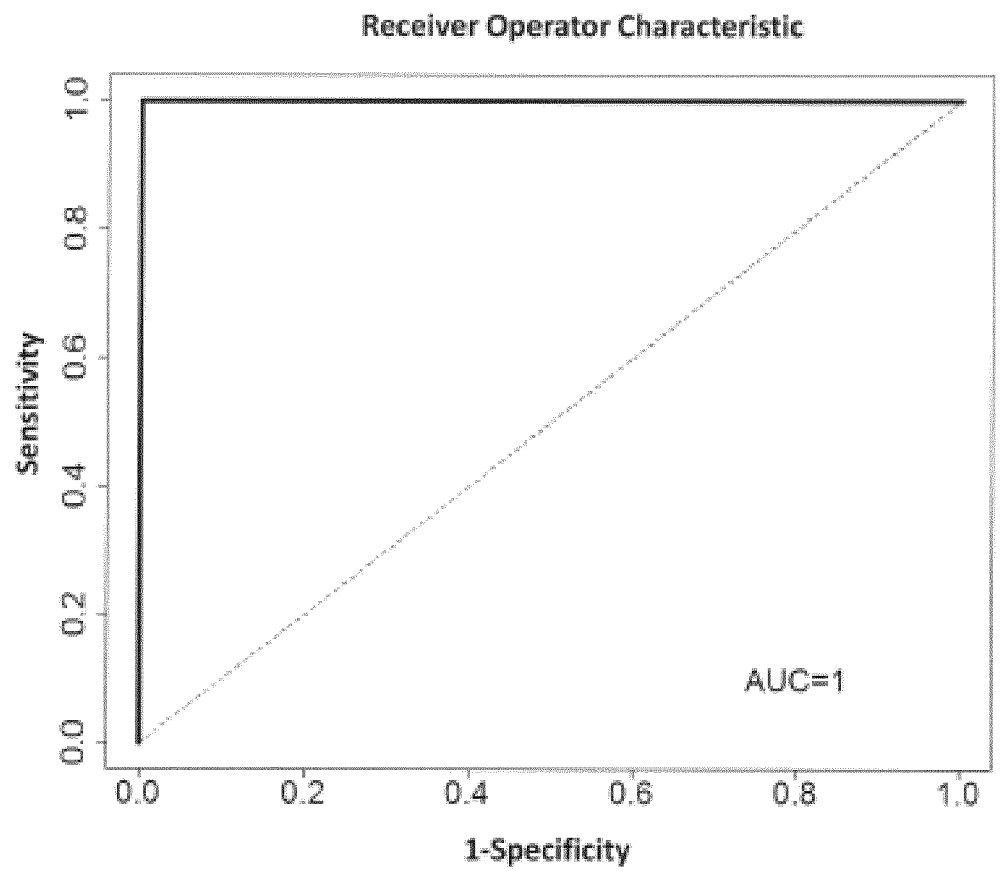
FIG. 4 shows a predictive modelling based on the random forest algorithm enabling the identification of the signature of the 7-top ranked serum lncRNAs candidates out of 90 lncRNAs with a p value of <0.05 and fold change of ≥2 or <0.5 or an AUC of ≥0.85 or ≤0.15.
Figure 5:
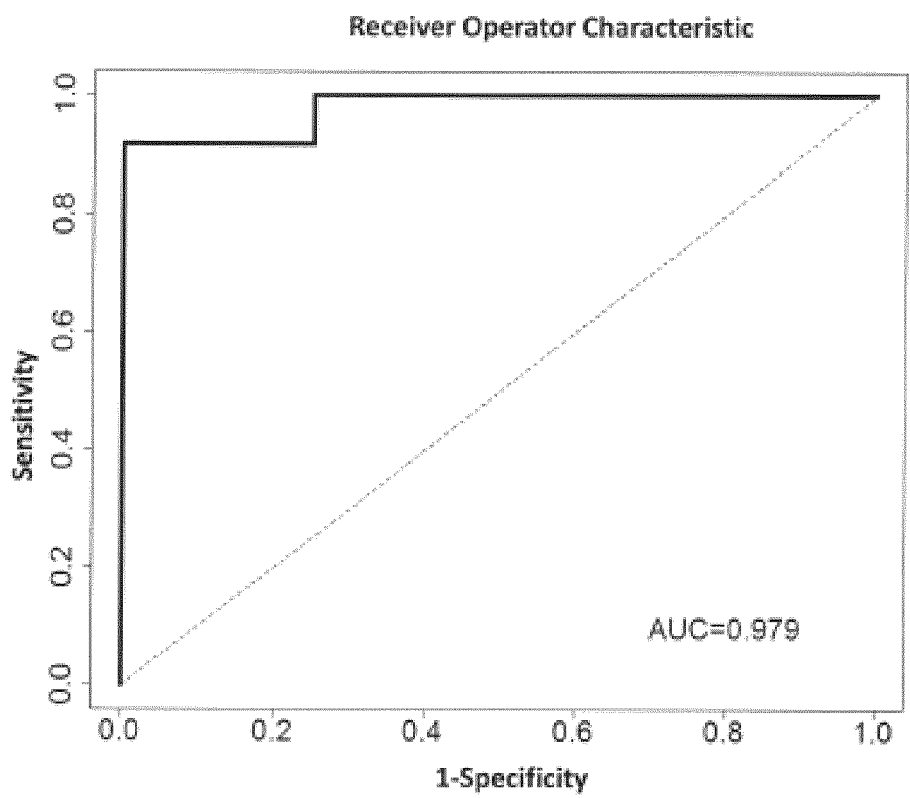
FIG. 5 shows a predictive modelling based on the random forest algorithm enabling identification of the signature of the 12 top serum lncRNAs candidates selected out of the 90 lncRNAs (with a p value of <0.05 and fold change of ≥1,6 or ≤0.6 and an AUC of ≥0.85 or ≤0.15.
Figure 6:
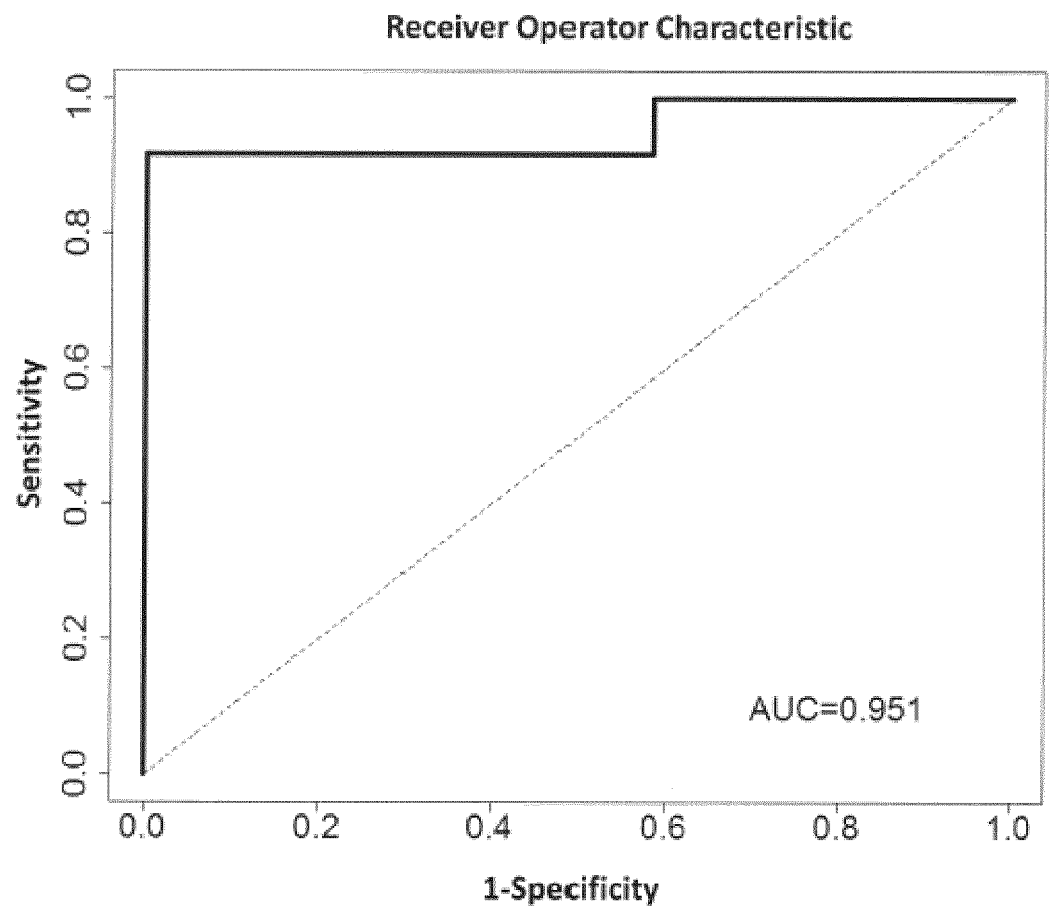
FIG. 6 shows a predictive modelling based on the random forest algorithm enabling identification of the signature of the 3 top serum lncRNA candidates selected out of the lncRNAs with a p value of <0.05 and a good correlation (Pearson) with scores of neurocognitive tests including MMSE and/or MoCA out of 7 neuropsychological tests performed.
Figure 7:
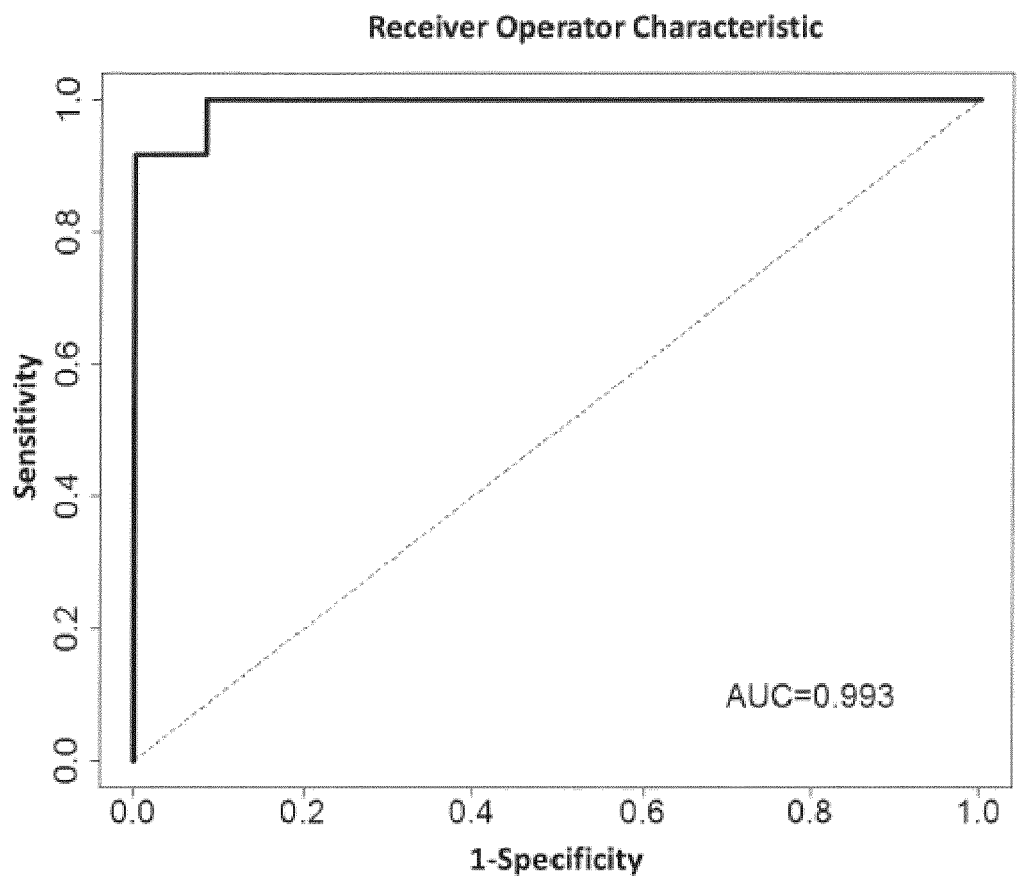
FIG. 7 shows a predictive modelling based on the random forest algorithm enabling the identification of the signature of the 7 top lncRNA candidates selected out of serum lncRNAs with a p value of <0.05 and a good correlation (Pearson) with neuroimaging scores (volume of brain structures of relevance for cognition and memory such as the meditotemporal area, left and right hippocampus, left and right amygdala, entorhinal cortex out of more than 120 structures measured.
Figure 8:
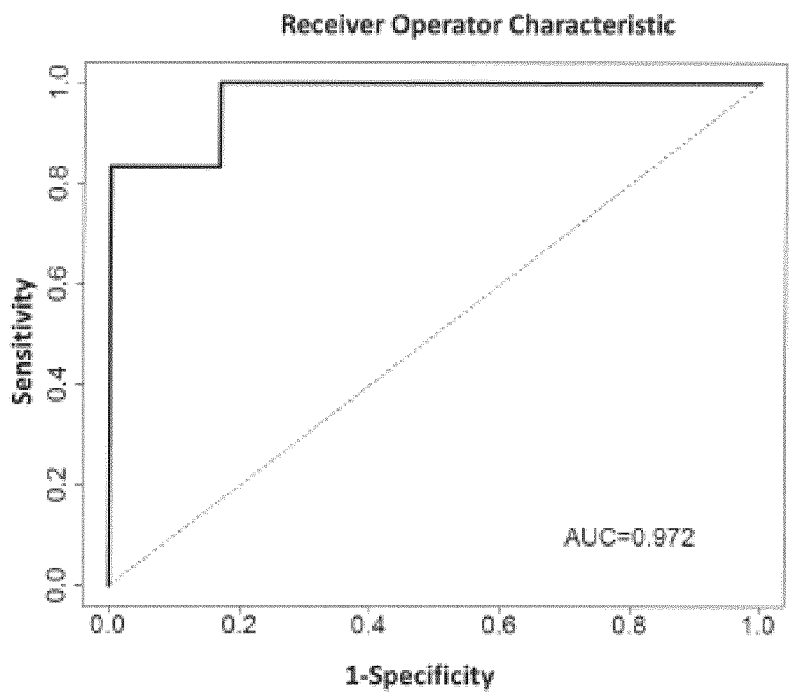
FIG. 8 shows a predictive modelling based on the random forest algorithm enabling the identification of the signature of the 18 top serum lncRNA candidates selected out of lncRNAs that show a p value of <0.05 and a good correlation (Pearson) with CSF biomarkers Aβ42 and tau (total tau or phosphorylated tau).
Figure 9:
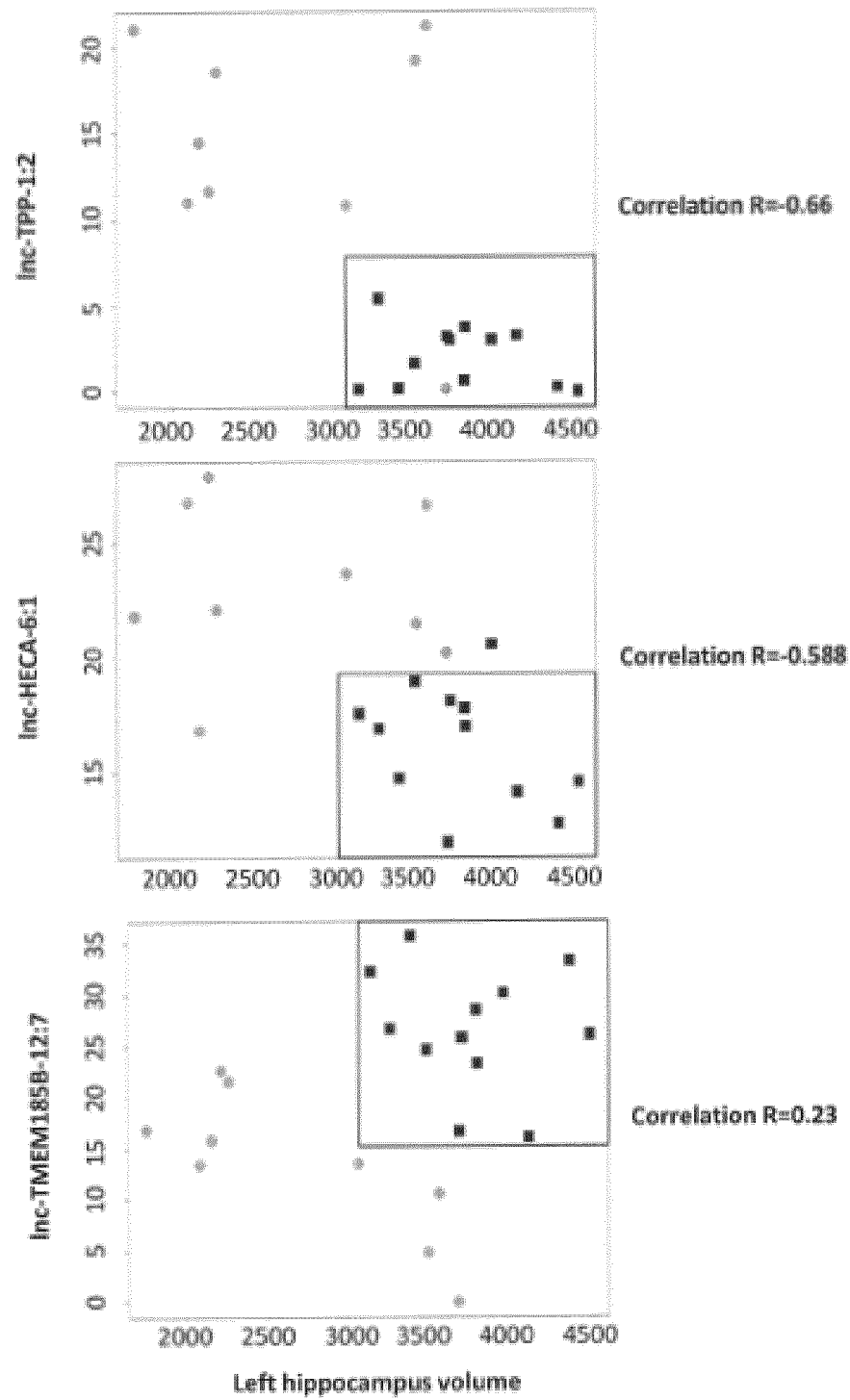
FIG. 9 shows examples of results on correlation between the level of serum lncRNAs and the volumetric neuroimaging score of brain structures implicated in cognition such as the meditotemporal area and the hippocampus.
Figure 10:
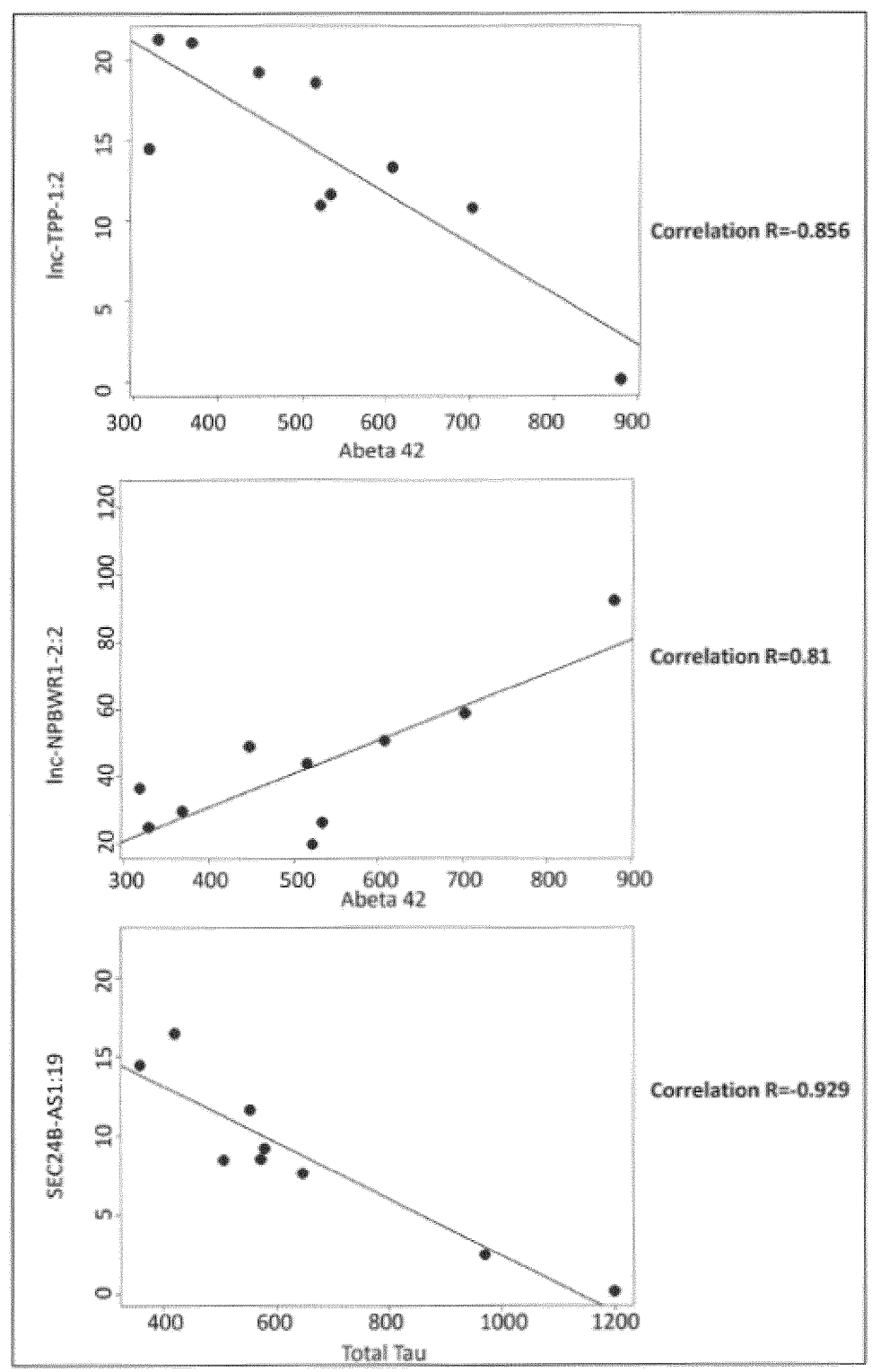
FIG. 10 shows examples of results on correlation between serum lncRNAs and CSF biomarkers Aβ42 or Tau.
Figure 11:
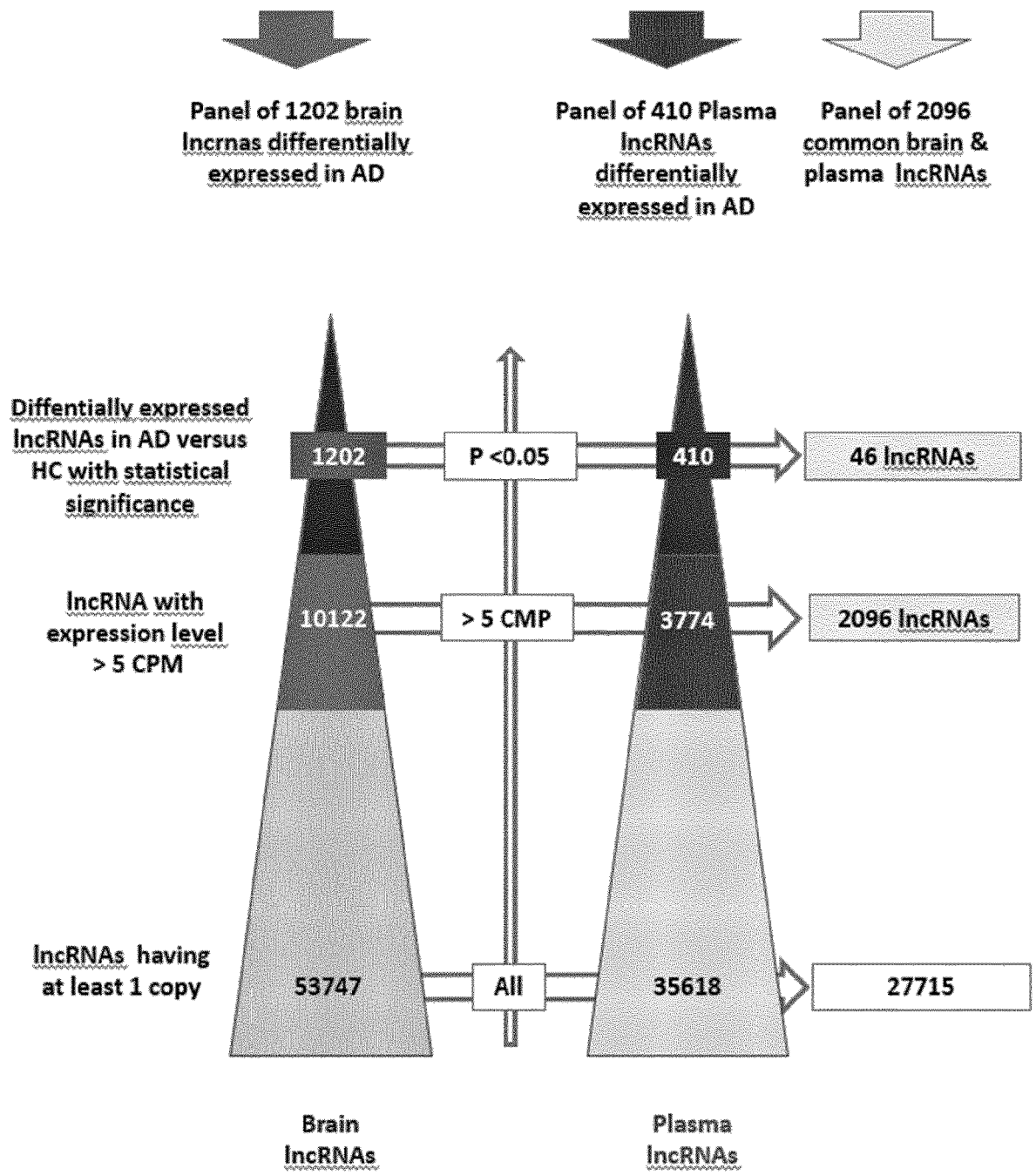
FIG. 11 shows the scheme of identifying brain and plasma lncRNAs.
Figure 12:
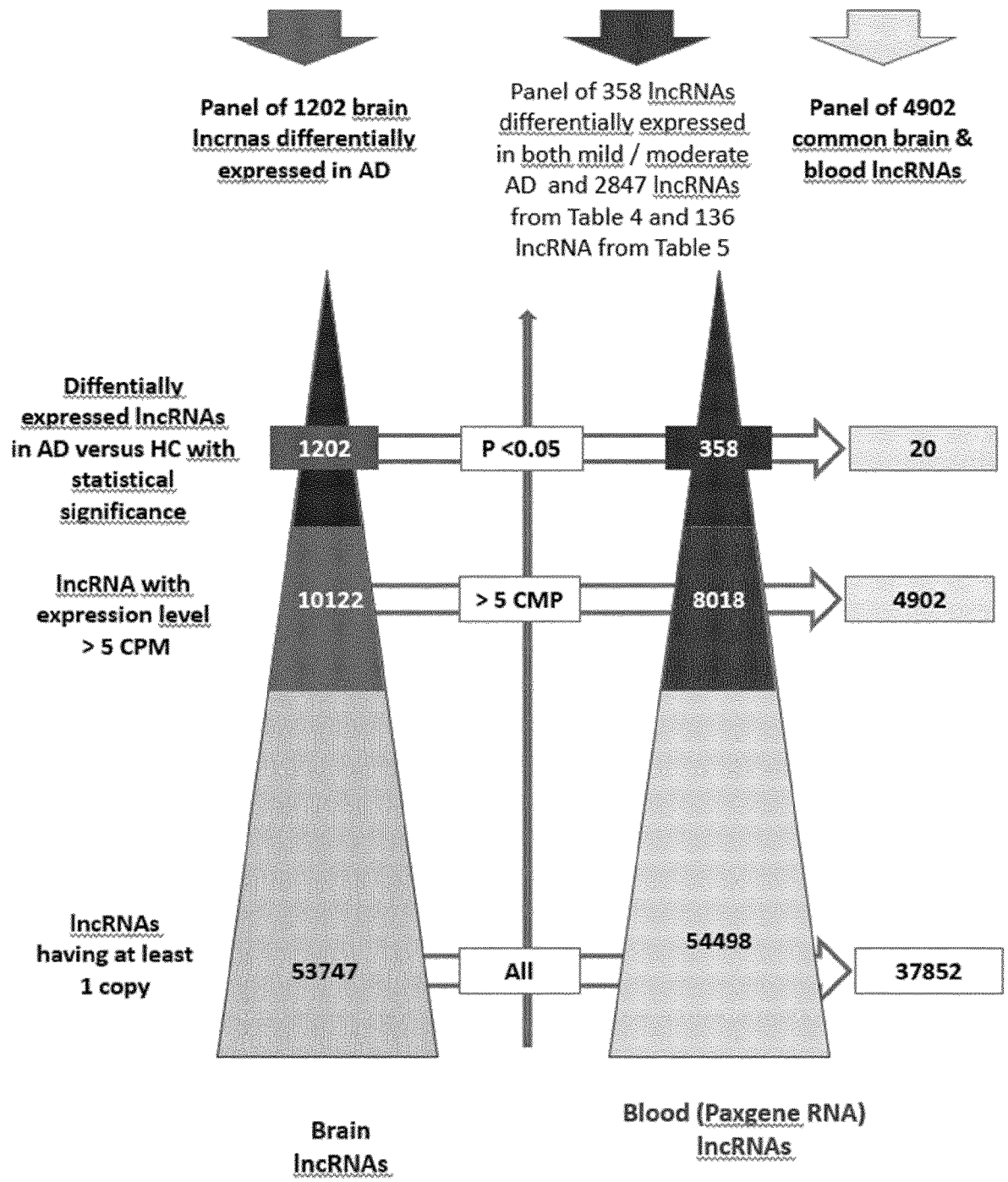
FIG. 12 shows the scheme of identifying brain and blood (Paxgene RNA) lncRNAs.
Figure 13:
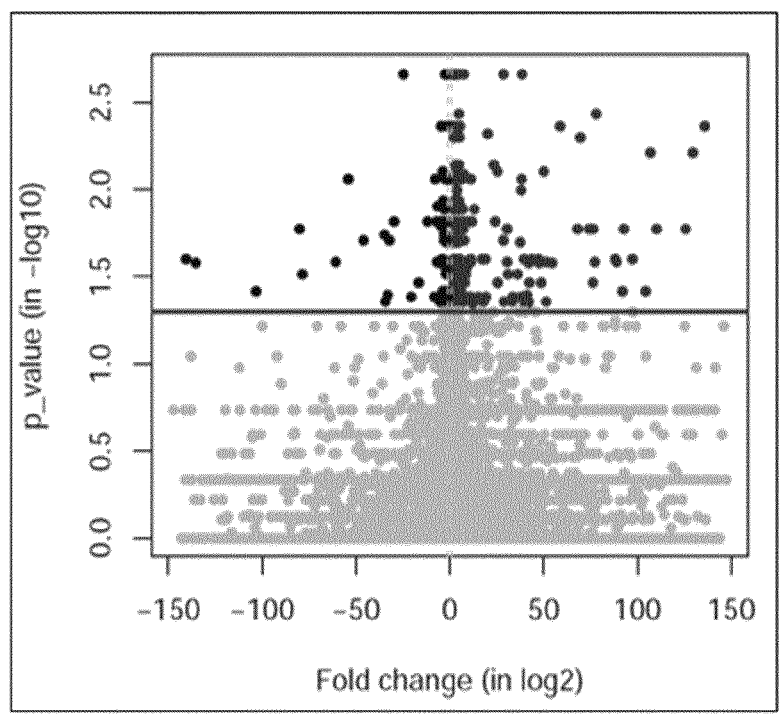
FIG. 13 shows Volcano plot of plasma lncRNAs obtained when comparing 6 Alzheimer's patients (AD) and 6 healthy control subjects (HC) and boxplot of plasma lncRNA LRRC10-1:1 and and its ROC curve showing its AUC=1. The volcano plot shows the lncRNAs that are differentially expressed with statistically significance (p<0.05, Wilcoxon test) above the line. The lncRNAs that are differentially expressed but did not reach a statistically significance, are shown below the line.
Figure 13:
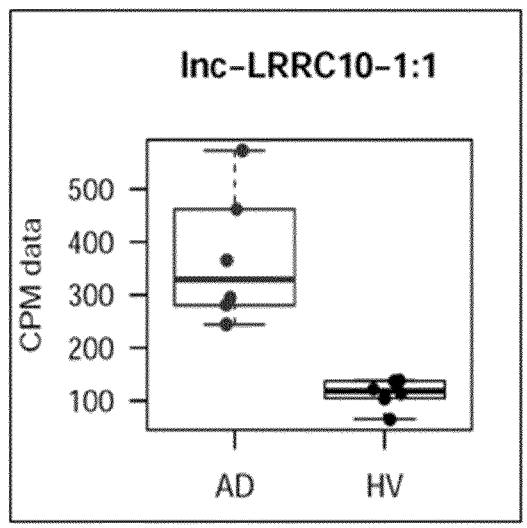
Figure 13:
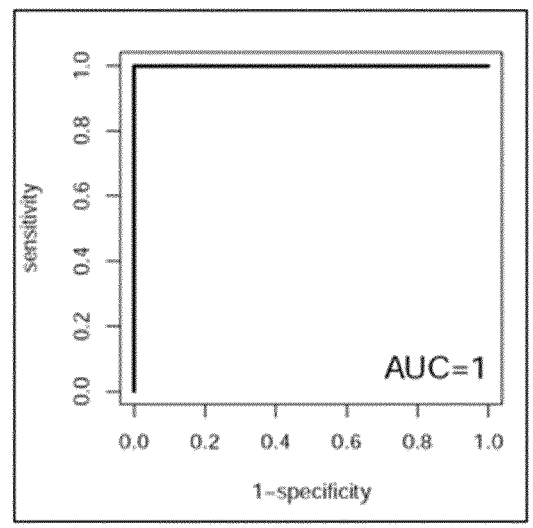
Figure 14:
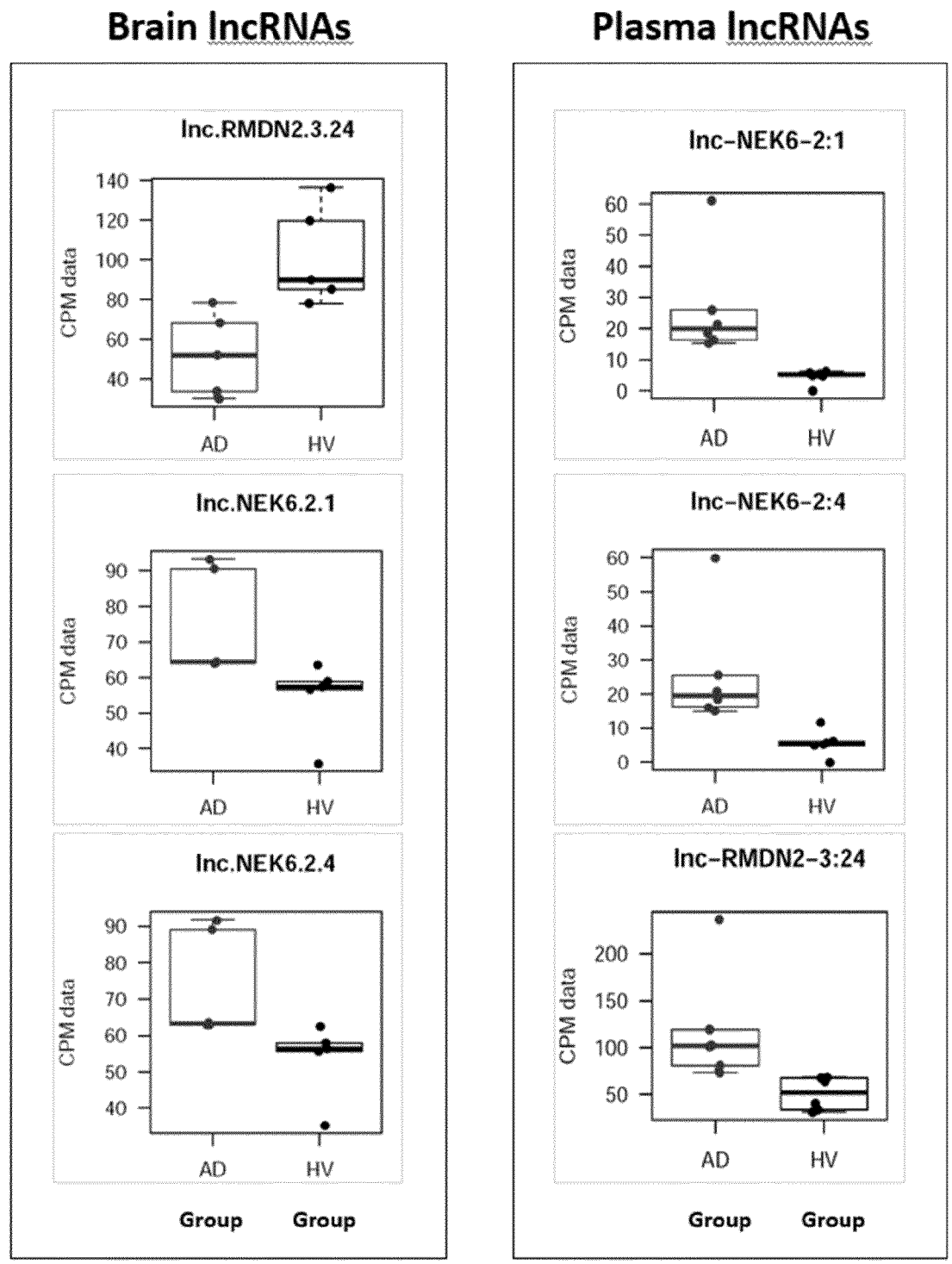
FIG. 14 shows example of 3 brain lncRNAs differentially expressed in the brain of 5 Alzheimer's patients as compared to brain of 5 healthy control subjects that are also identified as circulating plasma lncRNAs and as differentially expressed candidates in plasma of 6 Alzheimer patients as compared to 6 healthy control subjects.
Figure 15:
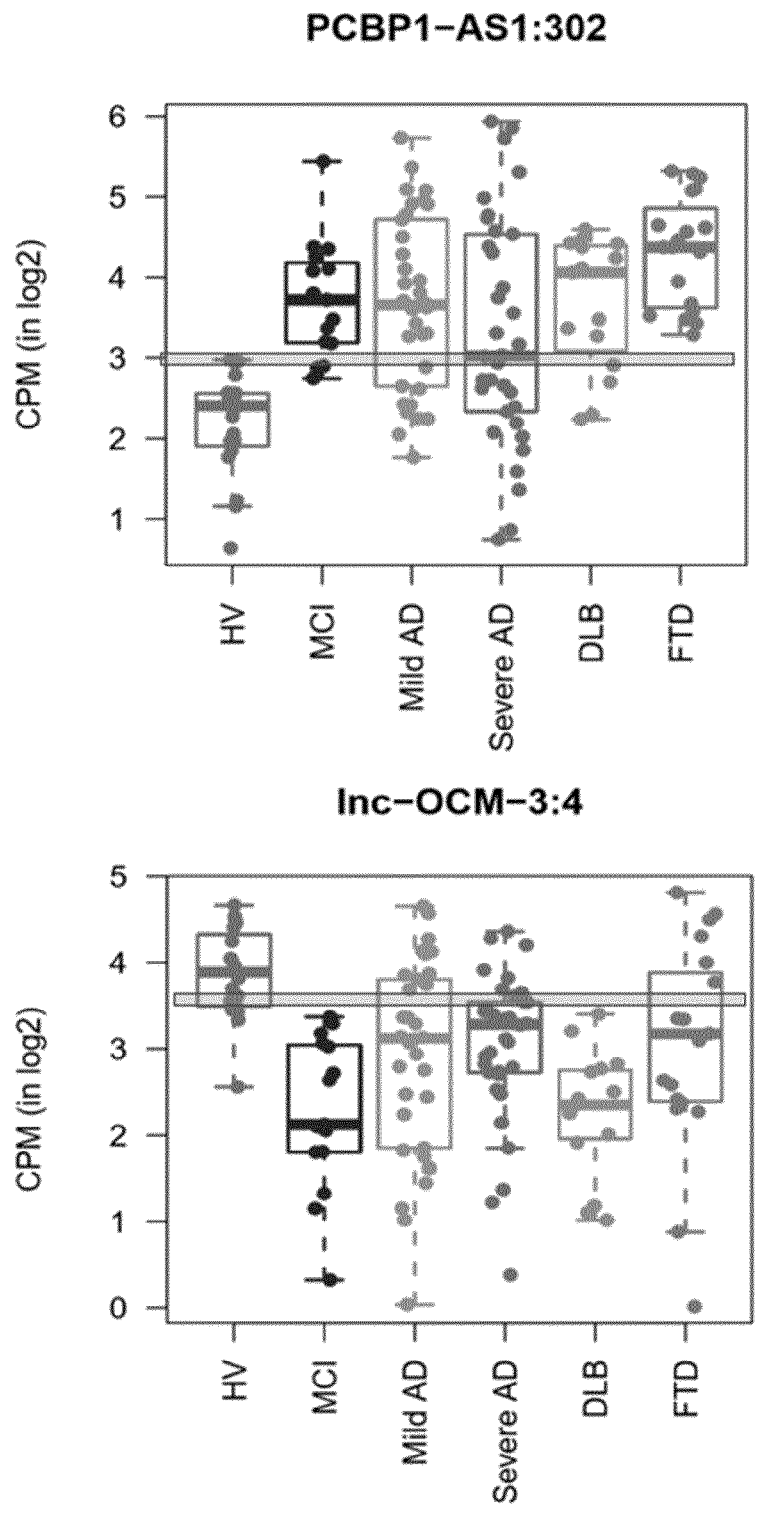
FIG. 15 shows boxplots of 2 whole blood lncRNAs: one overexpressed, the other down-expressed in MCI group and dementia groups (AD, DLB, FTD) when compared to healthy control group.
Figure 16:
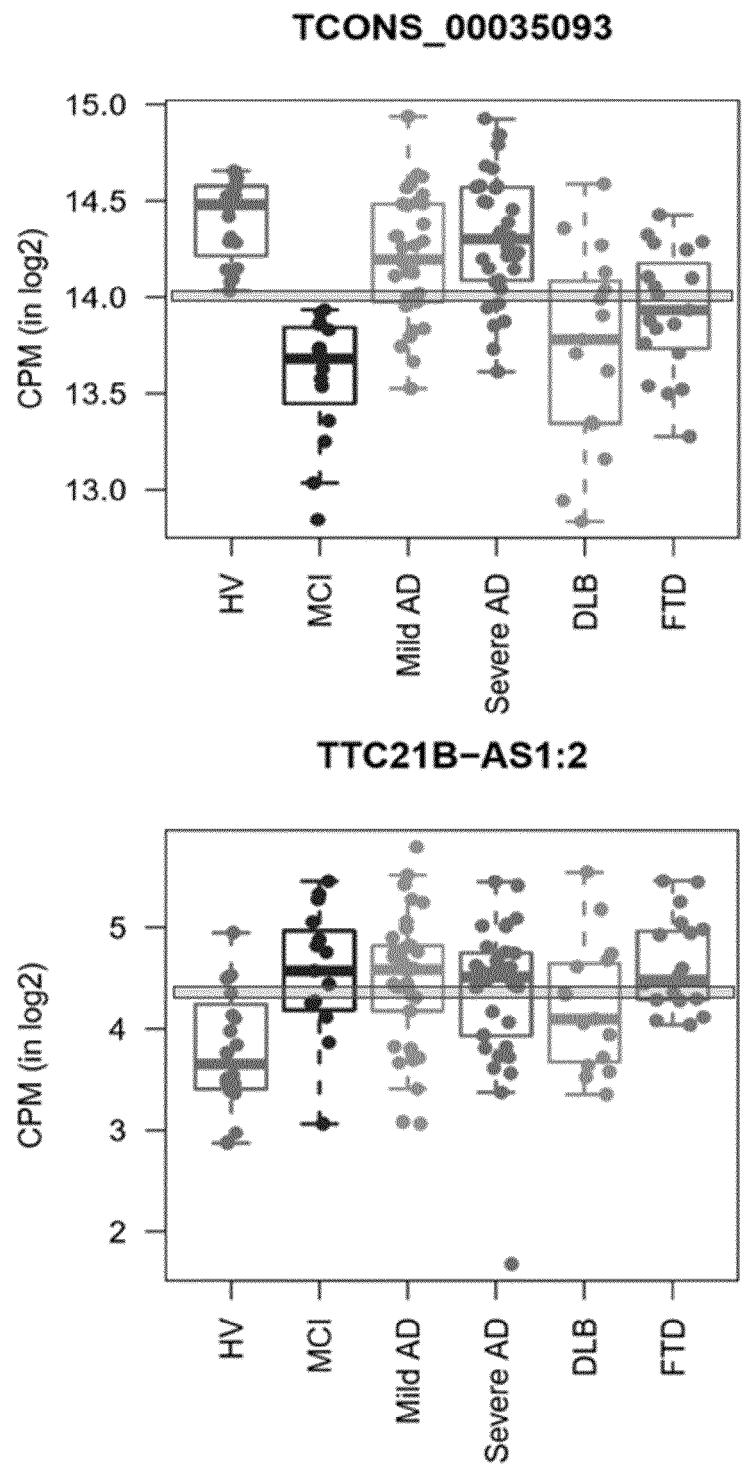
FIG. 16 shows boxplots of 2 whole blood lncRNAs differentially expressed in at least one of the patient groups as compared to healthy control group. The lncRNA TCONS_00035093 shows decreased expression in all MCI patients as compared to healthy controls. The lncRNA TTC21B-AS1:2 shows increased expression in most patients with MCI and AD patients.
Figure 17:
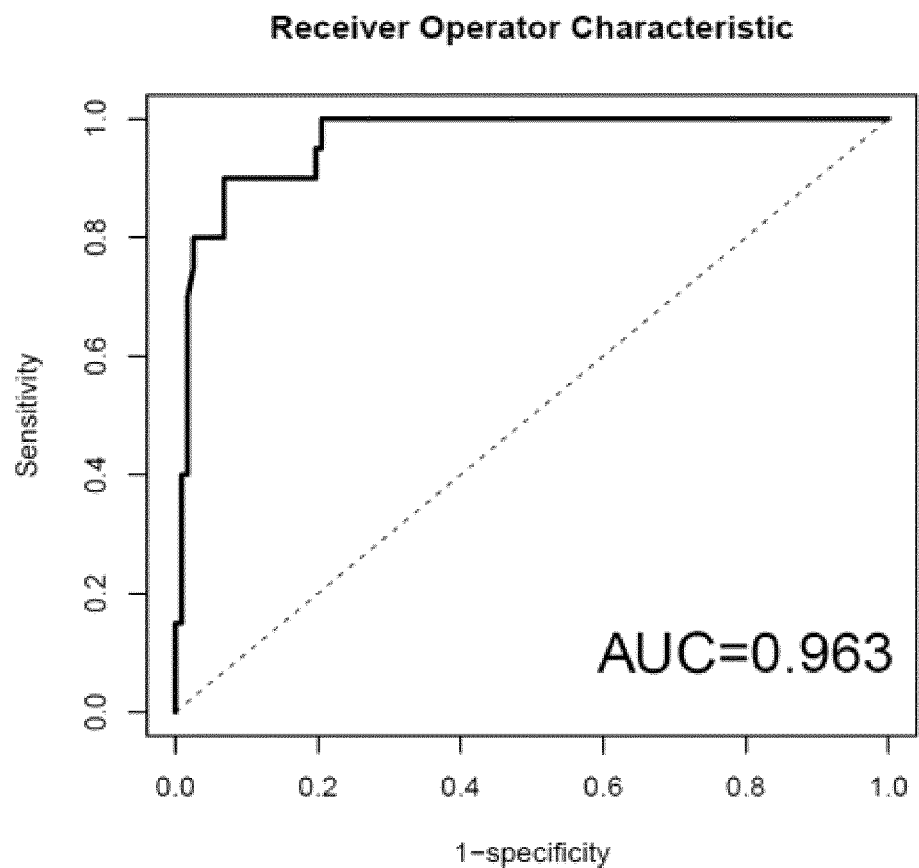
FIG. 17 shows an example of a panel of whole blood lncRNAs discriminating between HC group versus all the other groups with an accuracy 93.4%.
Figure 18:
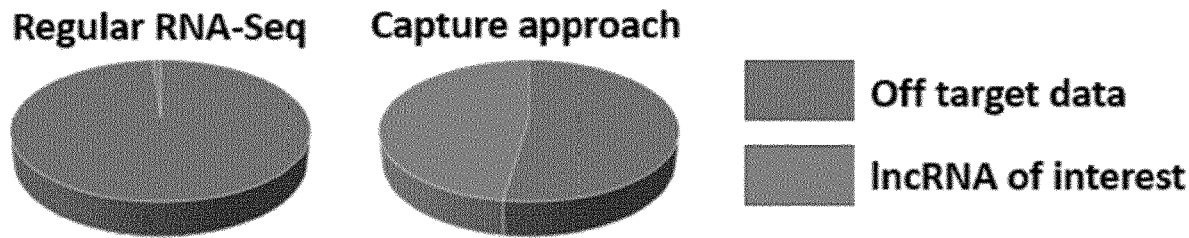
FIG. 18 shows targeted sequencing approach which shows a better efficiency to quantify precisely the selected lncRNAs. As an example, the use of FIMICS show an enrichment of 60× of the sequence of interest, representing less than 1% of the total sequences in global sequencing giving more difficult results to analyze. Only 8M of reads were needed to achieve a coverage of 100× allowing higher precision that regular RNA-Seq experiments.
Figure 18:
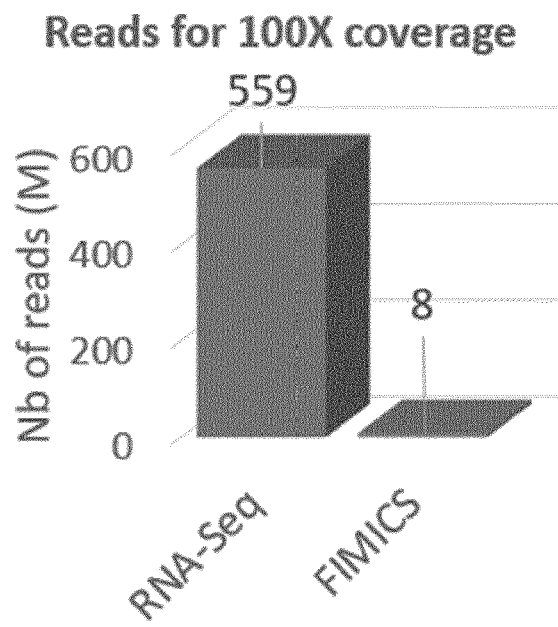
Figure 19:
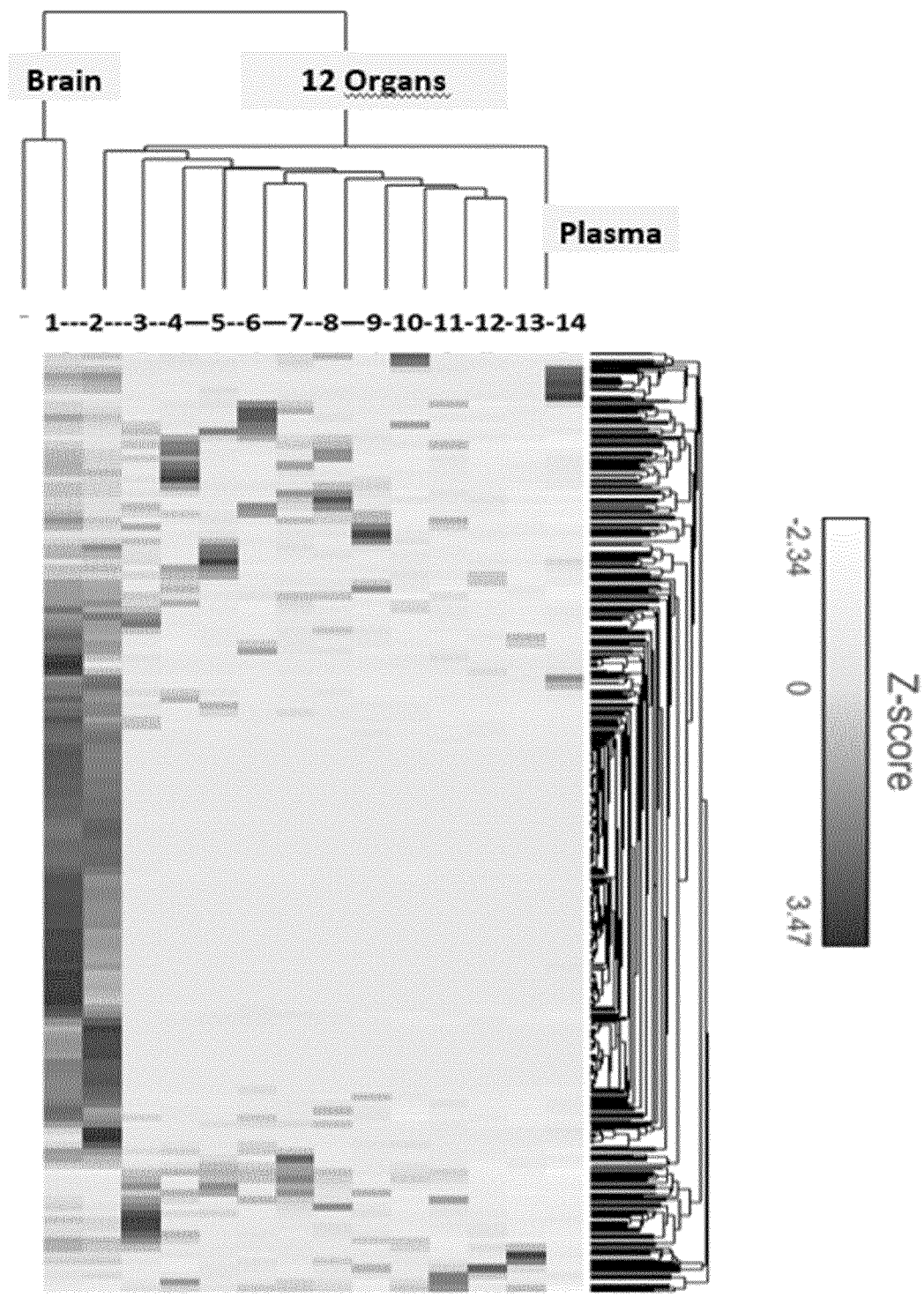
FIG. 19 shows Heat map showing that many identified brain-enriched lncRNAs that are expressed in the brain of AD and/or non-AD human subjects (columns 1,2) but not or poorly expressed in the organs tested (columns 2 to 13). Interestingly out of these brain-enriched lncRNAs, some are circulating brain-enriched lncRNAs as expressed in the plasma. 1: AD brain; 2: Non-AD brain; 3: Lung; 4: Ovary; 5: Colon; 6: Prostate; 7: Breast; 8: Liver; 9: Bladder; 10: Kidney; 11: Skin; 12: Heart; 13: Muscle; 14: Plasma.

DESCRIPTION OF THE INVENTION lncRNAs, including the 1091 novel lncRNAs identified for the first time in the present invention, that are disclosed in this disclosure may be involved in the pathogenesis of primary and secondary brain disorders including but not limited to neurodegenerative diseases, in particular Alzheimer's disease and cognitive disorders, neuropsychiatric disorders such as depression and anxiety, autism, neurological disorders such as multiple sclerosis, motoneuron disorders, stroke or implicated in systemic disorders, cardiovascular metabolic disorders indirectly involving the nervous system. Thus, these lncRNAs with altered expression represent novel targets for therapeutic and diagnostic applications. The novel brain lncRNAs identified as having an altered expression in AD brain may represent novel therapeutic candidates for development as lncRNA molecule-silencing therapeutic approaches for treatment of brain disorders in particular Alzheimer's disease and other cognitive disorders.

In addition, drug candidates or other medicinal products may induce cerebral toxicities such as autism or other syndromes. The lncRNAs identified in the present invention might be used to diagnose, predict or monitor their toxicity or efficacy.

In an aspect, the invention relates to lncRNAs for use in the treatment of brain diseases, in particular mild cognitive impairment (MCI) and Alzheimer or another cognitive disorder in a subject at risk of having or developing mild cognitive impairment or a cognitive disorder, wherein the treatment comprises administering to the subject an effective amount of a pharmaceutical agent modulating (inducing or inhibiting) the expression of the lncRNAs in the brain and/or in the periphery. The pharmaceutical agents may be specifically designed molecules such as small chemical entities or biological medicinal compounds, including but not limited to monoclonal antibodies, recombinant proteins, recombinant vector driven-therapeutics including but not limited to AV or AAV recombinant vectors, other RNA-related therapeutic means. In some embodiments, the pharmaceutical agent is administered to the subject with at least one pharmaceutically acceptable excipient. In some embodiments, the pharmaceutical agent is single or repeatedly administered to the subject as an oral, intravenous or subcutaneous or intra-cerebral treatment.

In some embodiments, the lncRNAs for use in the treatment of brain diseases are at least one novel lncRNA identified for the first time in the present invention (1091 novel lncRNAs listed in Table 7). In some embodiments, the lncRNAs are at least one novel lncRNA selected from 922 lncRNAs (430 lncRNAs with Fold change<0.9 and 492 lncRNAs with Fold change >1.1 listed in Table 7). In a preferred embodiment, the lncRNAs are at least one lncRNAs selected from the below group, which is referred as "lncRNA signature 12" in this disclosure:

| Novel lncRNA |
|---|
| TCONS_00050539 |
| TCONS_00062555 |
| TCONS_00024916 |
| TCONS_00059198 |
| TCONS_00066462 |
| TCONS_00033653 |
| TCONS_00040878 |
| TCONS_00000634 |
| TCONS_00050178 |
| TCONS_00055496 |
| TCONS_00033736 |
| TCONS_00023309 |
| TCONS_00027765 |
| TCONS_00062602 |
| TCONS_00005325 |
| TCONS_00011974 |
| TCONS_00023240 |
| TCONS_00023401 |
| TCONS_00066358 |
| TCONS_00062306 |
| TCONS_00027438 |

In some embodiments, the lncRNAs for use in the treatment of brain diseases are at least one LINCipedia-based lncRNAs that are sequenced in the brain and identified by the present invention to be differentially deficient or overexpressed in Alzheimer or dementia brain as compared to healthy control brain. In some embodiments, the lncRNAs are at least one lncRNAs selected from 681 lncRNAs with decreased level of expression in AD brain and 521 lncRNAs overexpressed in AD brain listed in Table 8. In a preferred embodiment, the lncRNAs are at least one lncRNAs selected from the below group, which is referred as "lncRNA signature 13" in this disclosure:

| lncRNA | lnc-PMM2-6:2 | |
|---|---|---|
| LINC-PINT:16 | MALAT1:23 | lnc-LTBP3-2:3 |

-continued

| | | |
|---|---|---|
| lnc-ATP6V1C1-12:1 | MALAT1:48 | MALAT1:11 |
| lnc-GABBR1-1:2 | lnc-LTBP3-2:6 | lnc-LTBP3-2:2 |

In another embodiment, the lncRNAs are at least one lncRNAs selected from the below group, which is referred as "lncRNA signature 42" in this disclosure:

| | |
|---|---|
| LncRNAs | lnc-FEM1B-4:1 |
| lnc-NEK6-2:1 | lnc-GNA14-3:1 |
| lnc-PMM2-6:4 | lnc-PINK1-2:1 |
| UGDH-AS1:10 | lnc-PRSS27-4:24 |
| lnc-RMDN2-3:24 | lnc-SLC25A3-7:1 |
| lnc-EIF1AD-1:1 | lnc-FEM1B-4:1 |
| lnc-FANCL-4:1 | NORAD:2 |
| lnc-FAAP100-2:1 | NORAD:8 |
| TCONS_00011974 | CACTIN-AS1:5 |

In some embodiments, the lncRNAs for use in the treatment of brain diseases are at least one brain-enriched lncR-NAs identified as detectable in the brain while not expressed or at least 2-fold less expressed in peripheral organ biopsies: lung, ovary, colon, prostate, breast, liver, bladder, kidney, skin, heart, muscle. In some embodiments, the lncRNAs are at least one lncRNAs selected from 860 lncRNAs listed in Table 12. In a preferred embodiment, the lncRNAs are at least one lncRNAs selected from the below group, which is referred as "lncRNA signature 14" in this disclosure:

| | | |
|---|---|---|
| TCONS_00035022 | TCONS_00035024 | lnc-ENC1-5:1 |
| TCONS_00035023 | TCONS_00035091 | lnc-SNAP25-3:1 |
| TCONS_00035094 | TCONS_00012059 | lnc-HMGA1-2:4 |
| TCONS_00035093 | TCONS_00035092 | PEG3-AS1:1 |
| TCONS_00035021 | TCONS_00012060 | lnc-UNC80-1:1 |
| TCONS_00035090 | TCONS_00050014 | |

In some embodiments, the lncRNAs for use in the treatment of brain diseases are at least one lncRNA selected from a lncRNA signature selected from lncRNA signatures 1 to 42. lncRNA signatures 1 to 42 are defined below in this disclosure.

In an aspect, the invention relates to lncRNA signatures for use in the diagnosis of brain diseases, in particular mild cognitive impairment (MCI) and Alzheimer or another cognitive disorder or for use in the diagnosis and differential diagnosis for brain disorders types, in particular dementia types, including but not limited to Alzheimer, dementia with Lewy bodies and frontotemporal dementia. lncRNA signatures comprising the already sequenced lncRNAs and newly sequenced lncRNAs that are differentially expressed in samples collected in non-invasively manner, including whole blood collected in Paxgene RNA tube and plasma derived from blood in patients suffering MCI, AD, DLB and/or FTD when compared to healthy controls, as well as panels that detect specifically MCI and one of the dementia type (AD or DLB or FTD) when compared to the other dementia types studied may be used. In some embodiments, the lncRNA signature is selected from the below group:

| lncRNA signature | lncRNAs included in the lncRNA signature |
|---|---|
| lncRNA signature 1 | 68 lncRNAs (TCONS_00050539, TCONS_00062555, TCONS_00024916, TCONS_00059198, TCONS_00066462, TCONS_00033653, LINC-PINT: 16, lnc-ATP6V1C1-12:1, lnc-GABBR1-1:2, lnc-PMM2-6:2, MALAT1:23, MALAT1:48, lnc-LTBP3-2:6, lnc-LTBP3-2:3, lnc-ANAPC11-2:8, lnc-CLLU1-2:6, lnc-KLHL36-2:2, lnc-LRRC10-1:1, lnc-RMDN2-3:24, lnc-SMN2-4:2, lnc-SPRYD3-1:17, lnc-USP47-2:1, lnc-ZC3H12B-1:5, TCONS_00019798, TSPOAP1-AS1:39, TCONS_00035093, lnc-OCM-3:4, lnc-KIF14-1:2, PCBP1-AS1:302, lnc-CA6-8:1, NEAT1:22, lnc-CA6-8:2, STARD7-AS1:5, lnc-IL31RA-1:1, lnc-ANKRD36-1:4, lnc-ATP6AP2-13:1, lnc-SOCS6-10:1, lnc-CDIPT-2:1, lnc-USP47-2:1, RBM26-AS1:1, MIR181A2HG:1, TTC21B-AS1:2, LEF1-AS1:1, lnc-SLC35E3-8:1, lnc-ZCCHC13-4:1, lnc-NEMF-1:4, TCONS_00011994, lnc-EVX1-15:1, lnc-REC8-2:1, OIP5-AS1:36, MYLK-AS1:13, lnc-PCP4L1-3:2, lnc-CGREF1-2:1, ZC3H12B-11:1, PSMB8-AS1:14, lnc-STX10-2:1, lnc-TCFL5-6:1, lnc-UQCC3-2:1, lnc-ZNF516-14:1, lnc-PDGFA-6:2, lnc-FOXD4L5-16:1, lnc-SAMD11-12:4, lnc-ADAD1-3:1, lnc-SLC35E3-8:2, lnc-NID1-4:4, FTX:19, TCONS_00017372, lnc-GRAP-1:2) |
| lncRNA signature 2 | 54 lncRNAs (lnc-ANAPC11-2:8, lnc-CLLU1-2:6, lnc-KLHL36-2:2, lnc-LRRC10-1:1, lnc-RMDN2-3:24, lnc-SMN2-4:2, lnc-SPRYD3-1:17, lnc-USP47-2:1, lnc-ZC3H12B-1:5, TCONS_00019798, TSPOAP1-AS1:39, TCONS_00035093, lnc-OCM-3:4, lnc-KIF14-1:2, PCBP1-AS1:302, lnc-CA6-8:1, NEAT1:22, lnc-CA6-8:2, STARD7-AS1:5, lnc-IL31RA-1:1, lnc-ANKRD36-1:4, lnc-ATP6AP2-13:1, lnc-SOCS6-10:1, lnc-CDIPT-2:1, lnc-USP47-2:1, RBM26-AS1:1, MIR181A2HG:1, TTC21B-AS1:2, LEF1-AS1:1, lnc-SLC35E3-8:1, lnc-ZCCHC13-4:1, lnc-NEMF-1:4, TCONS_00011994, lnc-EVX1-15:1, lnc-REC8-2:1, OIP5-AS1:36, MYLK-AS1:13, lnc-PCP4L1-3:2, lnc-CGREF1-2:1, ZC3H12B-11:1, PSMB8-AS1:14, lnc-STX10-2:1, lnc-TCFL5-6:1, lnc-UQCC3-2:1, lnc-ZNF516-14:1, lnc-PDGFA-6:2, lnc-FOXD4L5-16:1, lnc-SAMD11-12:4, lnc-ADAD1-3:1, lnc-SLC35E3-8:2, lnc-NID1-4:4, FTX: 19, TCONS_00017372, lnc-GRAP-1:2) |
| lncRNA signature 3 | 6 lncRNAs (lnc-ANAPC11-2:8, lnc-CLLU1-2:6, lnc-KLHL36-2:2, lnc-LRRC10-1:1, lnc-RMDN2-3:24, lnc-ZC3H12B-1:5) |
| lncRNA signature 4 | 11 lncRNAs (lnc-ANAPC11-2:8, lnc-CLLU1-2:6, lnc-KLHL36-2:2, lnc-LRRC10-1:1, lnc-RMDN2-3:24, lnc-SMN2-4:2, lnc-SPRYD3-1:17, lnc-USP47-2:1, lnc-ZC3H12B-1:5, TCONS_00019798, TSPOAP1-AS1:39) |
| lncRNA signature 5 | 43 lncRNAs (TCONS_00035093, lnc-OCM-3:4, lnc-KIF14-1:2, PCBP1-AS1:302, lnc-CA6-8:1, NEAT1:22, lnc-CA6-8:2, STARD7-AS1:5, lnc-IL31RA-1:1, lnc-ANKRD36-1:4, lnc-ATP6AP2-13:1, lnc-SOCS6-10:1, lnc-CDIPT-2:1, lnc-USP47-2:1, RBM26-AS1:1, MIR181A2HG:1, TTC21B-AS1:2, LEF1-AS1:1, lnc-SLC35E3-8:1, lnc-ZCCHC13-4:1, lnc-NEMF-1:4, TCONS_00011994, lnc-EVX1-15:1, lnc-REC8-2:1, OIP5-AS1:36, MYLK-AS1:13, lnc-PCP4L1-3:2, lnc-CGREF1-2:1, ZC3H12B-11:1, PSMB8-AS1:14, lnc-STX10-2:1, lnc-TCFL5-6:1, lnc-UQCC3-2:1, |

-continued

| lncRNA signature | lncRNAs included in the lncRNA signature |
|---|---|
| | lnc-ZNF516-14:1, lnc-PDGFA-6:2, lnc-FOXD4L5-16:1, lnc-SAMD11-12:4, lnc-ADAD1-3:1, lnc-SLC35E3-8:2, lnc-NID1-4:4, FTX:19, TCONS_00017372, lnc-GRAP-1:2) |
| lncRNA signature 6 | 6 lncRNAs (TCONS_00045364, TCONS_00035023, TCONS_00035091, TCONS_00035022, TCONS_00035092, TCONS_00035093) |
| lncRNA signature 7 | 14 lncRNAs (TCONS_00050539, TCONS_00062555, TCONS_00024916, TCONS_00059198, TCONS_00066462, TCONS_00033653, LINC-PINT:16, lnc-ATP6V1C1-12:1, lnc-GABBR1-1:2, lnc-PMM2-6:2, MALAT1:23, MALAT1:48, lnc-LTBP3-2:6, lnc-LTBP3-2:3) |
| lncRNA signature 8 | 2 lncRNAs (TCONS_00035093, lnc-OCM-3:4) |
| lncRNA signature 9 | 7 lncRNAs (lnc-KIF14-1:2, PCBP1-AS1:302, lnc-CA6-8:1, NEAT1:22, lnc-CA6-8:2, STARD7-AS1:5, lnc-IL31RA-1:1) |
| lncRNA signature 10 | 6 lncRNAs (lnc-CA6-8:2, lnc-ANKRD36-1:4, lnc-ATP6AP2-13:1, lnc-SOCS6-10:1, lnc-CDIPT-2:1, lnc-USP47-2:1) |
| lncRNA signature 11 | 7 lncRNAs (lnc-CA6-8:2, lnc-CA6-8:1, RBM26-AS1:1, PCBP1-AS1:302, MIR181A2HG:1, TTC21B-AS1:2, lnc-SOCS6-10:1) |
| lncRNA signature 12 | 21 lncRNAs (TCONS_00050539, TCONS_00062555, TCONS_00024916, TCONS_00059198, TCONS_00066462, TCONS_00033653, TCONS_00040878, TCONS_00000634, TCONS_00050178, TCONS_00055496, TCONS_00033736, TCONS_00023309, TCONS_00027765, TCONS_00062602, TCONS_00005325, TCONS_00011974, TCONS_00023240, TCONS_00023401, TCONS_00066358, TCONS_00062306, TCONS_00027438) |
| lncRNA signature 13 | 10 lncRNAs (LINC-PINT:16, lnc-ATP6V1C1-12:1, lnc-GABBR1-1:2, lnc-PMM2-6:2, MALAT1:23, MALAT1:48, lnc-LTBP3-2:6, lnc-LTBP3-2:3, MALAT1:11, lnc-LTBP3-2:2) |
| lncRNA signature 14 | 17 lncRNAs (TCONS_00035022, TCONS_00035023, TCONS_00035094, TCONS_00035093, TCONS_00035021, TCONS_00035090, TCONS_00035024, TCONS_00035091, TCONS_00012059, TCONS_00035092, TCONS_00012060, TCONS_00050014, lnc-ENC1-5:1, lnc-SNAP25-3:1, lnc-HMGA1-2:4, PEG3-AS1:1, lnc-UNC80-1:1) |
| lncRNA signature 15 | 2 lncRNAs (lnc-OCM-3:4, lnc-SLC35E3-8:1) |
| lncRNA signature 16 | 3 lncRNAs (lnc-ZCCHC13-4:1, PCBP1-AS1:302, lnc-NEMF-1:4) |
| lncRNA signature 17 | 6 lncRNAs (lnc-STAT3-1:2, lnc-NEMF-1:4, lnc-EPN2-3:2, lnc-SLC25A39-2:1, lnc-ARF6-1:1, lnc-CCNYL1-2:1) |
| lncRNA signature 18 | 5 lncRNAs (ANKRD44-IT1:1, APOBEC3B-AS1:2, ADAMTSL4-AS1:2, AGAP2-AS1:2, A1BG-AS1:14) |
| lncRNA signature 19 | 3 lncRNAs (LEF1-AS1:1, PCBP1-AS1:302, lnc-CA6-8:2) |
| lncRNA signature 20 | 5 lncRNAs (lnc-CGREF1-2:1, PSMB8-AS1:14, lnc-STX10-2:1, lnc-TCFL5-6:1, ZC3H12B-11:1) |
| lncRNA signature 21 | 3 lncRNAs (TCONS_00011994, lnc-EVX1-15:1, lnc-REC8-2:1) |
| lncRNA signature 22 | 3 lncRNAs (OIP5-AS1:36, MYLK-AS1:13, lnc-PCP4L1-3:2) |
| lncRNA signature 23 | 11 lncRNAs (PCBP1-AS1:302, STARD7-AS1:5, lnc-NID1-4:4, RBM26-AS1:1, LEF1-AS1:1, lnc-CA6-8:1, lnc-CA6-8:2, lnc-OCM-3:4, lnc-AFG1L-7:1, lnc-LASP1-5:1, lnc-GCGR-1:2) |
| lncRNA signature 24 | 7 lncRNAs (lnc-CA6-8:2, lnc-ANKRD36-1:4, lnc-ATP6AP2-13:1, lnc-SOCS6-10:1, lnc-CDIPT-2:1, lnc-USP47-2:1, lnc-UXS1-3:1) |
| lncRNA signature 25 | 3 lncRNAs (lnc-OCM-3:4, lnc-SLC35E3-8:1, LINC-PINT:11) |
| lncRNA signature 26 | 2 lncRNAs (lnc-ZCCHC13-4:1, PCBP1-AS1:302) |
| lncRNA signature 27 | 5 lncRNAs (lnc-JUNB-1:1, lnc-RARB-4:1, lnc-ZNF284-1:1, TCONS_00035093, lnc-TELO2-3:3) |
| lncRNA signature 28 | 5 lncRNAs (lnc-CGREF1-2:1 PSMB8-AS1:14 lnc-STX10-2:1 lnc-TCFL5-6:1 lnc-ZC3H12B-11:1) |
| lncRNA signature 29 | 13 lncRNAs (lnc-DLG5-1:1, lnc-EBLN1-1:4, lnc-FAT1-7:2, lnc-PRR5-5:1, lnc-RBKS-6:1, lnc-FOXD4L5-35:1, lnc-TENM3-3:3, lnc-FAM133B-2:1, lnc-ZNF726-1:3, lnc-AP3M1-1:1, lnc-DUSP10-6:1, lnc-TPPP-1:2, LINC01206:20) |
| lncRNA signature 30 | 7 lncRNAs (LINC02345:11, lnc-EBLN1-1:4, lnc-TPPP-1:2, lnc-TENM3-3:3, lnc-FAT1-7:2, lnc-DKK1-5:3, lnc-TACSTD2-2:4) |
| lncRNA signature 31 | 12 lnc RNAs (lnc-TPPP-1:2, ARRDC3-AS1:7, lnc-TENM3-3:5, lnc-TENM3-3:4, lnc-QRFP-5:1, lnc-CRYBB1-1:1, lnc-MGST3-1:3, lnc-FAM49B-8:1, HAND2-AS1:70, lnc-TMEM185B-12:7, lnc-CNDP1-7:1, lnc-C21orf58-1:2) |
| lncRNA signature 32 | 3 lncRNAs (lnc-TENM3-3:3, lnc-MARCH4-2:7, and lnc-LRRC1-5:2) |
| lncRNA signature 33 | 7 lncRNAs (lnc-TPPP-1:2, lnc-TENM3-3:3, lnc-TMEM185B-12:7, lnc-NAXD-6:5, lnc-HECA-6:1, lnc-COMMD6-10:1, and MIR29B2CHG:46) |
| lncRNA signature 34 | 18 lncRNAs (lnc-TPPP-1:2, LINC02345:11, lnc-ZNF273-4:4, lnc-TACC2-8:6, LINC01206:20, lnc-C5orf67-3:1, HAND2-AS1:58, lnc-PRDM9-20:1, lnc-CLK1-1:7, lnc-DNALI1-5:4, RORB-AS1:6, lnc-TPPP-1:3, lnc-BMS1-2:1, lnc-ADRB1-4:1, lnc-XXYLT1-5:1, MIR99AHG:104, LINC01748:17, lnc-AKR1E2-15:1) |

| lncRNA signature | lncRNAs included in the lncRNA signature |
|---|---|
| lncRNA signature 35 | 922 lncRNAs (430 lncRNAs with Fold change < 0.9 and 492 lncRNAs with Fold change > 1.1 listed in Table 7) |
| lncRNA signature 36 | 681 lncRNAs with decreased level of expression in AD brain and 521 lncRNAs overexpressed in AD brain listed in Table 8 |
| lncRNA signature 37 | 860 lncRNAs listed in Table 12 |
| lncRNA signature 38 | 410 lncRNAs listed in Table 9 |
| lncRNA signature 39 | 2847 lncRNAs listed in Table 10 and 136 lncRNAs listed in Table 11 |
| lncRNA signature 40 | 410 lncRNAs listed in Table 9, 2847 lncRNAs listed in Table 10 and 136 lncRNAs listed in Table 11 |
| lncRNA signature 41 | lncRNA signature 6 plus 8 lncRNAs listed in both Tables 9 and 12 or 55 lncRNAs listed in both Table 10 or 11 and Table 12 |
| lncRNA signature 42 | 17 lncRNAs (lnc-NEK6-2:1, lnc-PMM2-6:4, UGDH-AS1:10, lnc-RMDN2-3:24, lnc-EIF1AD-1:1, lnc-FANCL-4:1, lnc-FAAP100-2:1, TCONS_00011974, lnc-FEM1B-4:1, lnc-GNA14-3:1, lnc-PINK1-2:1, lnc-PRSS27-4:24, lnc-SLC25A3-7:1, lnc-FEM1B-4:1, NORAD:2, NORAD:8, CACTIN-AS1:5) |

The above 42 lncRNA signatures can be used in all methods or uses disclosed in this disclosure.

In an aspect, the invention relates to a method for the diagnosis of a brain disorder including but not limited to cognitive disorder such as mild cognitive impairment (MCI), Alzheimer disease, frontotemporal dementia and/or dementia with Lewy body in a subject at risk of having or developing mild cognitive impairment or a cognitive disorder, comprising:

(a) isolating a biological sample from the subject;
(b) detecting a level of expression in a lncRNA signature, the lncRNA signature comprising or consisting of at least one lncRNA selected from lncRNAs listed in Tables 7-12, in the biological sample from said subject;
(c) comparing the level of expression of lncRNA in the sample to a level of expression in a reference, wherein an increased or decreased level of expression in the sample compared to the level in the reference identifies the subject having a cognitive disorder or being at risk of developing a cognitive disorder.

In some embodiments, the method further comprises a step of designing the therapeutic treatment according to the said identified brain disorder such as a cognitive disorder after step (c). In some embodiments, the biological sample is whole blood, serum or plasma.

In some embodiments, the lncRNA signature comprises or consist of at least one lncRNA selected from lncRNA signature 6 plus 8 lncRNAs listed in both Tables 9 and 12 or 55 lncRNAs listed in both Table 10 or 11 and Table 12 ("lncRNA signature 41"). In some embodiments, the lncRNA signature comprises or consist of at least one lncRNA selected from brain-enriched lncRNAs circulating in plasma sample including novel brain-enriched lncRNAs circulating in plasma. In some embodiments, the lncRNA signature comprises or consist of at least one lncRNA selected from 6 lncRNAs (TCONS_00045364, TCONS_00035023, TCONS_00035091, TCONS_00035022, TCONS_00035092, TCONS_00035093) ("lncRNA signature 6"). In some embodiments, the lncRNA signature is or comprises lncRNA signature 6.

In some embodiments, the lncRNA signature comprises or consist of at least one lncRNA selected from 410 lncRNAs listed in Table 9, 2847 lncRNAs listed in Table 10 and 136 lncRNAs listed in Table 11 ("lncRNA signature 40"). In some embodiments, the lncRNA signature comprises or consist of at least one lncRNA selected from 54 lncRNAs (lnc-ANAPC11-2:8, lnc-CLLU1-2:6, lnc-KLHL36-2:2, lnc-LRRC10-1:1, lnc-RMDN2-3:24, lnc-SMN2-4:2, lnc-SPRYD3-1:17, lnc-USP47-2:1, lnc-ZC3H12B-1:5, TCONS_00019798, TSPOAP1-AS1:39, TCONS_00035093, lnc-OCM-3:4, lnc-KIF14-1:2, PCBP1-AS1:302, lnc-CA6-8:1, NEAT1:22, lnc-CA6-8:2, STARD7-AS1:5, lnc-IL31RA-1:1, lnc-ANKRD36-1:4, lnc-ATP6AP2-13:1, lnc-SOCS6-10:1, lnc-CDIPT-2:1, lnc-USP47-2:1, RBM26-AS1:1, MIR181A2HG:1, TTC21B-AS1:2, LEF1-AS1:1, lnc-SLC35E3-8:1, lnc-ZCCHC13-4:1, lnc-NEMF-1:4, TCONS_00011994, lnc-EVX1-15:1, lnc-REC8-2:1, OIP5-AS1:36, MYLK-AS1:13, lnc-PCP4L1-3:2, lnc-CGREF1-2:1, ZC3H12B-11:1, PSMB8-AS1:14, lnc-STX10-2:1, lnc-TCFL5-6:1, lnc-UQCC3-2:1, lnc-ZNF516-14:1, lnc-PDGFA-6:2, lnc-FOXD4L5-16:1, lnc-SAMD11-12:4, lnc-ADAD1-3:1, lnc-SLC35E3-8:2, lnc-NID1-4:4, FTX:19, TCONS_00017372, lnc-GRAP-1:2) ("lncRNA signature 2"). In some embodiments, the lncRNA signature is or comprises lncRNA signature 2.

In some embodiments, the lncRNA signature comprises or consist of at least one lncRNA selected from a lncRNA signature selected from lncRNA signatures 1 to 42. In some embodiments, the lncRNA signature is or comprises a lncRNA signature selected from lncRNA signatures 1 to 42.

In an aspect, the invention relates to a method for the diagnosis of a brain disorder including but not limited to cognitive disorder such as mild cognitive impairment (MCI), Alzheimer disease, frontotemporal dementia and/or dementia with Lewy body in a subject at risk of having or developing mild cognitive impairment or a cognitive disorder, comprising:

(a) isolating a biological sample from the subject, wherein the biological sample is plasma;
(b) detecting a level of expression in a lncRNA signature, the lncRNA signature comprising or consisting of at least one lncRNA selected from 410 plasma lncRNAs listed in Table 9 ("lncRNA signature 38"), in the biological sample from said subject;
(c) comparing the level of expression of lncRNA in the sample to a level of expression in a reference, wherein an increased or decreased level of expression in the sample compared to the level in the reference identifies the subject having a cognitive disorder or being at risk of developing a cognitive disorder.

In some embodiments, the method further comprises a step of designing the therapeutic treatment according to the said identified brain disorder such as a cognitive disorder after step (c).

In some embodiments, the lncRNA signature comprises or consist of at least one lncRNA selected from 6 lncRNAs (lnc-ANAPC11-2:8, lnc-CLLU1-2:6, lnc-KLHL36-2:2, lnc-LRRC10-1:1, lnc-RMDN2-3:24, lnc-ZC3H12B-1:5) "lncRNA signature 3". In a preferred embodiment, the lncRNA signature is or comprises lncRNA signature 3.

In some embodiments, the lncRNA signature comprises or consist of at least one lncRNA selected from 11 lncRNAs (lnc-ANAPC11-2:8, lnc-CLLU1-2:6, lnc-KLHL36-2:2, lnc-LRRC10-1:1, lnc-RMDN2-3:24, lnc-SMN2-4:2, lnc-SPRYD3-1:17, lnc-USP47-2:1, lnc-ZC3H12B-1:5, TCONS_00019798, TSPOAP1-AS1:39)) "lncRNA signature 4". In a preferred embodiment, the lncRNA signature is or comprises lncRNA signature 4.

In an aspect, the invention relates to a method for the diagnosis of a brain disorder including but not limited to cognitive disorder such as mild cognitive impairment (MCI), Alzheimer disease, frontotemporal dementia and/or dementia with Lewy body in a subject at risk of having or developing mild cognitive impairment or a cognitive disorder, comprising:
  (a) isolating a biological sample from the subject, wherein the biological sample is whole blood;
  (b) detecting a level of expression in a lncRNA signature, the lncRNA signature comprising or consisting of at least one lncRNA selected from 2847 lncRNAs listed in Table 10 and 136 lncRNAs listed in Table 11 ("lncRNA signature 39"), in the biological sample from said subject;
  (c) comparing the level of expression of lncRNA in the sample to a level of expression in a reference,
  wherein an increased or decreased level of expression in the sample compared to the level in the reference identifies the subject having a cognitive disorder or being at risk of developing a cognitive disorder.

In some embodiments, the method further comprises a step of designing the therapeutic treatment according to the said identified brain disorder such as a cognitive disorder after step (c).

In some embodiments, the lncRNA signature comprises or consist of at least one lncRNA selected from 43 lncRNAs (TCONS_00035093, lnc-OCM-3:4, lnc-KIF14-1:2, PCBP1-AS1:302, lnc-CA6-8:1, NEAT1:22, lnc-CA6-8:2, STARD7-AS1:5, lnc-IL31RA-1:1, lnc-ANKRD36-1:4, lnc-ATP6AP2-13:1, lnc-SOCS6-10:1, lnc-CDIPT-2:1, lnc-USP47-2:1, RBM26-AS1:1, MIR181A2HG:1, TTC21B-AS1:2, LEF1-AS1:1, lnc-SLC35E3-8:1, lnc-ZCCHC13-4:1, lnc-NEMF-1:4, TCONS_00011994, lnc-EVX1-15:1, lnc-REC8-2:1, OIP5-AS1:36, MYLK-AS1:13, lnc-PCP4L1-3:2, lnc-CGREF1-2:1, ZC3H12B-11:1, PSMB8-AS1:14, lnc-STX10-2:1, lnc-TCFL5-6:1, lnc-UQCC3-2:1, lnc-ZNF516-14:1, lnc-PDGFA-6:2, lnc-FOXD4L5-16:1, lnc-SAMD11-12:4, lnc-ADAD1-3:1, lnc-SLC35E3-8:2, lnc-NID1-4:4, FTX:19, TCONS_00017372, lnc-GRAP-1:2) ("lncRNA signature 5"). In a preferred embodiment, the lncRNA signature is or comprises lncRNA signature 5.

In an aspect, the invention relates to a method for the diagnosis of a brain disorder including but not limited to cognitive disorder such as mild cognitive impairment (MCI), Alzheimer disease, frontotemporal dementia and/or dementia with Lewy body in a subject at risk of having or developing mild cognitive impairment or a cognitive disorder, comprising:
  (a) isolating two or more biological samples (such as both plasma and whole blood) from the subject;
  (b) detecting a level of expression in a lncRNA signature, the lncRNA signature comprising or consisting of at least one lncRNA selected from 410 lncRNAs listed in Table 9, 2847 lncRNAs listed in Table 10 and 136 lncRNAs listed in Table 11 ("lncRNA signature 40"), in the biological samples from said subject;
  (c) comparing the level of expression of lncRNA in the sample to a level of expression in a reference,
  wherein an increased or decreased level of expression in the sample compared to the level in the reference identifies the subject having a cognitive disorder or being at risk of developing a cognitive disorder.

In some embodiments, the method further comprises a step of designing the therapeutic treatment according to the said identified brain disorder such as a cognitive disorder after step (c). In some embodiments, the two or more biological samples are plasma and whole blood.

In some embodiments, the lncRNA signature comprises or consist of at least one lncRNA selected from 54 lncRNAs (lnc-ANAPC11-2:8, lnc-CLLU1-2:6, lnc-KLHL36-2:2, lnc-LRRC10-1:1, lnc-RMDN2-3:24, lnc-SMN2-4:2, lnc-SPRYD3-1:17, lnc-USP47-2:1, lnc-ZC3H12B-1:5, TCONS_00019798, TSPOAP1-AS1:39, TCONS_00035093, lnc-OCM-3:4, lnc-KIF14-1:2, PCBP1-AS1:302, lnc-CA6-8:1, NEAT1:22, lnc-CA6-8:2, STARD7-AS1:5, lnc-IL31RA-1:1, lnc-ANKRD36-1:4, lnc-ATP6AP2-13:1, lnc-SOCS6-10:1, lnc-CDIPT-2:1, lnc-USP47-2:1, RBM26-AS1:1, MIR181A2HG:1, TTC21B-AS1:2, LEF1-AS1:1, lnc-SLC35E3-8:1, lnc-ZCCHC13-4:1, lnc-NEMF-1:4, TCONS_00011994, lnc-EVX1-15:1, lnc-REC8-2:1, OIP5-AS1:36, MYLK-AS1:13, lnc-PCP4L1-3:2, lnc-CGREF1-2:1, ZC3H12B-11:1, PSMB8-AS1:14, lnc-STX10-2:1, lnc-TCFL5-6:1, lnc-UQCC3-2:1, lnc-ZNF516-14:1, lnc-PDGFA-6:2, lnc-FOXD4L5-16:1, lnc-SAMD11-12:4, lnc-ADAD1-3:1, lnc-SLC35E3-8:2, lnc-NID1-4:4, FTX:19, TCONS_00017372, lnc-GRAP-1:2) ("lncRNA signature 2"). In some embodiments, the lncRNA signature is or comprises lncRNA signature 2.

In an aspect, the invention also relates to a method for diagnosis and differential diagnosis for brain disorders types, in particular dementia types, including but not limited to Alzheimer, dementia with Lewy bodies and frontotemporal dementia in a subject suffering from a brain disorder such as loss or impairment of cognitive function or dementia of subtype to be diagnosed, said method comprising:
  (a) isolating two or more biological samples (such as both plasma and whole blood) from the subject;
  (b) detecting a level of expression in a lncRNA signature, the lncRNA signature comprising or consisting of at least one lncRNA selected 410 lncRNAs listed in Table 9, 2847 lncRNAs listed in Table 10 and 136 lncRNAs listed in Table 11 ("lncRNA signature 40"), in the biological samples from said subject;
  (c) comparing the level of expression of lncRNA in the sample to a level of expression in a reference,
  wherein an increased or decreased level of expression in the sample compared to the level in the reference identifies the subject having a cognitive disorder or being at risk of developing a cognitive disorder.

In some embodiments, the method further comprises a step of designing the therapeutic treatment according to the said identified brain disorder such as a cognitive disorder after step (c). In some embodiments, the biological sample is plasma or whole blood.

In some embodiments, the lncRNA signature comprises or consist of at least one lncRNA selected from 54 lncRNAs (lnc-ANAPC11-2:8, lnc-CLLU1-2:6, lnc-KLHL36-2:2, lnc-LRRC10-1:1, lnc-RMDN2-3:24, lnc-SMN2-4:2, lnc-SPRYD3-1:17, lnc-USP47-2:1, lnc-ZC3H12B-1:5, TCONS_00019798, TSPOAP1-AS1:39, TCONS_00035093, lnc-OCM-3:4, lnc-KIF14-1:2, PCBP1-AS1:302, lnc-CA6-8:1, NEAT1:22, lnc-CA6-8:2, STARD7-AS1:5, lnc-IL31RA-1:1, lnc-ANKRD36-1:4, lnc-ATP6AP2-13:1, lnc-SOCS6-10:1, lnc-CDIPT-2:1, lnc-USP47-2:1, RBM26-AS1:1, MIR181A2HG:1, TTC21B-AS1:2, LEF1-AS1:1, lnc-SLC35E3-8:1, lnc-ZCCHC13-4:1, lnc-NEMF-1:4, TCONS_00011994, lnc-EVX1-15:1, lnc-REC8-2:1, OIP5-AS1:36, MYLK-AS1:13, lnc-PCP4L1-3:2, lnc-CGREF1-2:1, ZC3H12B-11:1, PSMB8-AS1:14, lnc-STX10-2:1, lnc-TCFL5-6:1, lnc-UQCC3-2:1, lnc-ZNF516-14:1, lnc-PDGFA-6:2, lnc-FOXD4L5-16:1, lnc-SAMD11-12:4, lnc-ADAD1-3:1, lnc-SLC35E3-8:2, lnc-NID1-4:4, FTX:19, TCONS_00017372, lnc-GRAP-1:2) ("lncRNA signature 2"). In some embodiments, the lncRNA signature is or comprises lncRNA signature 2.

In an aspect, the invention relates to a method for monitoring the development or progression of brain disorders including but not limited to cognitive disorder such as mild cognitive impairment, Alzheimer disease, dementia with Lewy bodies frontotemporal dementia in a subject suffering from a brain disorder including loss or impairment of cognitive function or dementia, said method comprising the following steps:
  (a) isolating a biological sample from the subject;
  (b) detecting a level of expression in a lncRNA signature, the lncRNA signature comprising or consisting of at least one lncRNA selected from 410 lncRNAs listed in Table 9, 2847 lncRNAs listed in Table 10 and 136 lncRNAs listed in Table 11 ("lncRNA signature 40"), in the biological sample from said subject;
  (c) comparing the level of expression of lncRNA in the sample to a level of expression in a reference, wherein an increased or decreased level of expression in the sample compared to the level in the reference identifies the subject having a cognitive disorder or being at risk of developing a cognitive disorder.

In some embodiments, the method further comprises a step of designing the therapeutic treatment according to the said identified brain disorder such as a cognitive disorder after step (c). In some embodiments, the biological sample is plasma or whole blood.

In some embodiments, the lncRNA signature comprises or consist of at least one lncRNA selected from 54 lncRNAs (lnc-ANAPC11-2:8, lnc-CLLU1-2:6, lnc-KLHL36-2:2, lnc-LRRC10-1:1, lnc-RMDN2-3:24, lnc-SMN2-4:2, lnc-SPRYD3-1:17, lnc-USP47-2:1, lnc-ZC3H12B-1:5, TCONS_00019798, TSPOAP1-AS1:39, TCONS_00035093, lnc-OCM-3:4, lnc-KIF14-1:2, PCBP1-AS1:302, lnc-CA6-8:1, NEAT1:22, lnc-CA6-8:2, STARD7-AS1:5, lnc-IL31RA-1:1, lnc-ANKRD36-1:4, lnc-ATP6AP2-13:1, lnc-SOCS6-10:1, lnc-CDIPT-2:1, lnc-USP47-2:1, RBM26-AS1:1, MIR181A2HG:1, TTC21B-AS1:2, LEF1-AS1:1, lnc-SLC35E3-8:1, lnc-ZCCHC13-4:1, lnc-NEMF-1:4, TCONS_00011994, lnc-EVX1-15:1, lnc-REC8-2:1, OIP5-AS1:36, MYLK-AS1:13, lnc-PCP4L1-3:2, lnc-CGREF1-2:1, ZC3H12B-11:1, PSMB8-AS1:14, lnc-STX10-2:1, lnc-TCFL5-6:1, lnc-UQCC3-2:1, lnc-ZNF516-14:1, lnc-PDGFA-6:2, lnc-FOXD4L5-16:1, lnc-SAMD11-12:4, lnc-ADAD1-3:1, lnc-SLC35E3-8:2, lnc-NID1-4:4, FTX:19, TCONS_00017372, lnc-GRAP-1:2) ("lncRNA signature 2"). In some embodiments, the lncRNA signature is or comprises lncRNA signature 2.

A biological sample may be a small part of a subject obtained from a body fluid, e.g. blood, plasma, serum, saliva, urine, tear or cerebrospinal fluid or organ tissue. Suitably the biological sample are plasma or serum or whole blood (Paxgene-RNA-tube).

By brain disorder is meant e.g. a cognitive disorder such as a dementia type, a neurodegenerative disease, neurological or neuropsychatric disorder or systemic disorder involving the brain from the below example of brain disease list):
  Dementia types and subtypes are numerous and include e.g.
    Alzheimer (AD) and MCI of AD type
    Frontotemporal dementia (FTD) and MCI of FTD type
    Progressive supranuclear palsy (PSP)
    Corticobasal degeneration (CBD)
    Dementia with Lewy body (DLB) and MCI of DLB type
    Parkinson's disease dementia (PDD) and MCI of PDD type
    Vascular dementia and related MCI
    Stroke-related MCI and dementia
    Other dementia types,
  Neurodegenerative and neurological and neuropsychiatric disorders with a cognitive impairment often occurring early or at later stages of the disease progression:
    Parkinson disease
    Huntington disease
    Autism
    Amyotrophic lateral sclerosis
    Motoneuron diseases
    Multiple sclerosis
    Neuropathies
    Major depressive disorder
    Anxiety
  Systemic disorders with brain involvement and negative impact on the brain health such as brain cognitive impairment, including metabolic disorders such as diabetes, cardiovascular such as stroke, autoimmune and inflammatory disorders.

For Diagnosis of Brain Disorder Including Cognitive Impairment or Dementia:

The "reference" may be suitable control sample such as for example a sample from a normal, healthy subject having no brain disorder or cognitive impairment symptoms and no abnormal neuroimaging findings and being age-matched to the patient to be diagnosed with the method of the present invention. The reference may be a sample from the same subject prior to demonstration of disorder or disease symptoms or prior to diagnosis of the brain disorder or the impairment or loss of cognitive function or dementia. The reference may be a standardized sample, e.g. a sample comprising material or data from several samples of healthy subjects who have no brain or cognitive impairment symptoms and no abnormal neuroimaging findings.

For Therapeutics, Diagnosis or Differential Diagnosis of a Specific Dementia Type or its Mild Cognitive Impairment (MCI) Versus Other Dementia Types and their MCI:

Brain disorders and subtypes are numerous and include cognitive disorders with dementia types and subtypes:
  Dementia types and subtypes are numerous and include e.g.
    Alzheimer (AD) and MCI of AD type
    Frontotemporal dementia (FTD) and MCI of FTD type Progressive supranuclear palsy (PSP)
Corticobasal degeneration (CBD)
Dementia with Lewy body (DLB) and MCI of DLB type
Parkinson's disease dementia (PDD) and MCI of PDD type
Vascular dementia and related MCI
Stroke-related MCI and dementia
Other dementia types,
Neurodegenerative and neurological and neuropsychiatric disorders with a cognitive impairment often occurring early or at later stages of the disease progression:
Parkinson disease
Huntington disease
Amyotrophic lateral sclerosis
Autism Multiple sclerosis
Motoneuron diseases
Neuropathies
Major depressive disorder
Anxiety Systemic disorders with brain involvement and negative impact on the brain health such as brain cognitive impairment, including metabolic disorders such as diabetes, cardiovascular such as stroke, autoimmune and inflammatory disorders.

For differential diagnosis of one brain disorder the reference sample may be sample(s) from patient(s) suffering another brain disorder of the same class of disorders (for example for differential diagnosis of a dementia subtype, the reference sample may be sample(s) from patient(s) suffering dementia of other type(s)). and/or to reference value obtained on samples from subject(s) who may suffer another disease but have no symptom similar to the targeted brain disorder (for example for differential diagnosis of a dementia, reference sample(s) may be from a patient having no cognitive impairment or dementia).

The invention also relates to a method of diagnosing a brain disorder including but not limited to cognitive disorder such as Alzheimer disease, frontotemporal dementia, dementia with Lewy bodies and monitoring its development or progression in a subject suffering from progressive impairment or loss of cognitive function or dementia, comprising:
(a) determining the presence of a brain disorder such as a cognitive disorder using a biological sample of the said subject using a method according to the invention, and
(b) adapting a therapeutic treatment in function of the results of step (a).

The invention also relates to a method of diagnosing a brain disorder including but not limited to cognitive disorder such early MCI and very mild Alzheimer disease in a subject with no apparent and/or no measurable symptoms when using the available methods to detect clinical symptoms (such as MMSE, MoCA and other neurocognitive tests for cognitive disorder), but with abnormal changes of biomarkers of the present invention preceding the symptoms, comprising:
(a) determining the risk of developing a cognitive disorder using a biological sample of the said subject using a method according to the invention, and
(b) adapting a therapeutic treatment in function of the results of step (a).

The invention also relates to a method of future improved diagnosing a brain disorder including but not limited to a cognitive disorder such as early MCI and very mild Alzheimer disease in a subject by measuring the biomarkers of the present invention in combination with risk factors, such as genotypes including but not limited to ApoE gene alleles, cardiovascular, metabolic, inflammatory biomarkers, comprising:
(a) determining the risk of developing a cognitive disorder using a biological sample of the said subject using a method according to the invention in combination with one of the above-mentioned risk factors, and
(b) adapting a therapeutic treatment in function of the results of step (a).

The invention further relates to a method of predictive diagnosing a brain disorder including but not limited to a cognitive disorder such as early MCI and early stages of Alzheimer disease or frontotemporal dementia or dementia with Lewy bodies in a subject with no apparent and/or no measurable abnormality by neuroimaging methods as MRI and/or CT scans, comprising:
(a) determining the risk of developing a cognitive disorder using a biological sample of the said subject using a method according to the invention, and
(b) adapting a therapeutic treatment in function of the results of step (a).

The invention further relates to a method of predictive diagnosing a cognitive disorder including but not limited to early MCI and early stages of Alzheimer disease or frontotemporal dementia or dementia with Lewy bodies in a subject with no apparent and/or no measurable abnormality by molecular neuroimaging methods, such as but not limited to amyloid or tau or dopaminergic or synucleinergic PET scan, comprising:
(a) determining the risk of developing a cognitive disorder using a biological sample of the said subject using a method according to the invention, and
(b) adapting a therapeutic treatment in function of the results of step (a).

The invention further relates to a method of diagnosing or differential diagnosing or monitoring a cognitive disorder including but not limited to early MCI and early stages of Alzheimer disease or frontotemporal dementia or dementia with Lewy bodies in a subject using combination(s) of biomarkers of the present invention with a neuroimaging method including molecular neuroimaging methods, comprising:
(a) determining the risk of developing a cognitive disorder using a biological sample of the said subject using a method according to the invention, and
(b) adapting a therapeutic treatment in function of the results of step (a).

The invention also relates to a method for treating a subject suffering from a progressive impairment or loss of cognitive function or dementia, said method comprising:
(a) diagnosing the cognitive disorder associated to the progressive impairment or loss of cognitive function or dementia in said patient using the method according to the invention, and
(b) adapting the therapeutic treatment to the results obtained in step (a).

Examples of therapeutic treatment of cognitive disorders may comprise the administration of:
a drug already approved for treatment of brain disorder for example, for a drug already approved for treatment of Alzheimer's disease, among cholinesterase inhibitors, donenepezil, rivastigmine or galantamine, or a NMDA receptor antagonist, memantine, or a combination of, e.g. donepezil and memantine, and/or
a therapeutic candidate or combination under clinical development for example as currently tested in Alzheimer patients in the anti-amyloid field, e.g. beta-secretase inhibitors and anti-beta-amyloid monoclonal antibodies, and anti-tau approaches, or as currently tested in the anti-tau field, e.g. modulators of kinases or phosphatases that regulate tau phosphorylation status and anti-tau antibodies, drug and drug candidates modulating the molecular pathways of neurodegeneration, oxidative stress, autophagy, mitochondrial dysfunction and immuno-inflammation, and/or a novel therapeutic approach derived from the present invention.

In an aspect, the invention also provides a kit for diagnosing and/or monitoring a brain disorder including but not limited to cognitive disorders such as MCI, AD, FTD, DLB, comprising at least one reagent for the determination of a lncRNA expression profile comprising or consisting of at least one lncRNA selected from 410 lncRNAs listed in Table 9, 2847 lncRNAs listed in Table 10 and 136 lncRNAs listed in Table 11 ("lncRNA signature 40"). In some embodiments, the lncRNA expression profile comprises or consist of at least one lncRNA selected from 54 lncRNAs (lnc-ANAPC11-2:8, lnc-CLLU1-2:6, lnc-KLHL36-2:2, lnc-LRRC10-1:1, lnc-RMDN2-3:24, lnc-SMN2-4:2, lnc-SPRYD3-1:17, lnc-USP47-2:1, lnc-ZC3H12B-1:5, TCONS_00019798, TSPOAP1-AS1:39, TCONS_00035093, lnc-OCM-3:4, lnc-KIF14-1:2, PCBP1-AS1:302, lnc-CA6-8:1, NEAT1:22, lnc-CA6-8:2, STARD7-AS1:5, lnc-IL31RA-1:1, lnc-ANKRD36-1:4, lnc-ATP6AP2-13:1, lnc-SOCS6-10:1, lnc-CDIPT-2:1, lnc-USP47-2:1, RBM26-AS1:1, MIR181A2HG:1, TTC21B-AS1:2, LEF1-AS1:1, lnc-SLC35E3-8:1, lnc-ZCCHC13-4:1, lnc-NEMF-1:4, TCONS_00011994, lnc-EVX1-15:1, lnc-REC8-2:1, OIP5-AS1:36, MYLK-AS1:13, lnc-PCP4L1-3:2, lnc-CGREF1-2:1, ZC3H12B-11:1, PSMB8-AS1:14, lnc-STX10-2:1, lnc-TCFL5-6:1, lnc-UQCC3-2:1, lnc-ZNF516-14:1, lnc-PDGFA-6:2, lnc-FOXD4L5-16:1, lnc-SAMD11-12:4, lnc-ADAD1-3:1, lnc-SLC35E3-8:2, lnc-NID1-4:4, FTX:19, TCONS_00017372, lnc-GRAP-1:2) ("lncRNA signature 2"). In some embodiments, the lncRNA expression profile comprises or consist of at least one lncRNA selected from a lncRNA signature selected from lncRNA signatures 1 to 42. In some embodiments, the lncRNA expression profile comprises or consists of a lncRNA signature selected from lncRNA signatures 1 to 42. In some embodiments, the lncRNA expression profile is or comprises lncRNA signature 2.

The kit of the invention allows performing the measurement of the lncRNA signature of the invention, wherein the kit comprises at least one reagent for measuring at least one lncRNA selected from the lncRNAs as indicated above.

By "reagent" is also meant a reagent which specifically allows the determination of the lncRNA expression profile, i.e. a reagent specifically intended for the specific determination of the expression level of the lncRNA present in the lncRNA expression profile. Examples include e.g. amplification primer pairs (forward and reward) and/or probes specific for the lncRNA present in the lncRNA expression profile. This definition excludes generic reagents useful for the determination of the expression level of any other lncRNA.

In some embodiments, the kit for diagnosing and/or monitoring a brain disorder including but not limited to cognitive disorders such as MCI, AD, FTD, DLB comprises one or more oligonucleotide probes specific for lncRNAs of interest and a reagent for purifying the probe-target nucleic acid complexes. The oligonucleotide probes comprise a sequence complementary to a region of the lncRNAs of interest. The oligonucleotide probes may be DNA or RNA. The oligonucleotide probes are preferably DNA. The length of oligonucleotide probes specific for lncRNAs may be from 30 to 80 nucleotides, e.g., from 40 to 70, from 40 to 60, or about 50 nucleotides. In a preferred embodiment, the oligonucleotide probes are biotinylated and the reagent for purifying the probe-target complexes is a streptavidin-coated substrate, e.g., a streptavidin-coated magnetic particle, e.g., T1 streptavidin coated magnetic bead.

A further embodiment of the invention relates to a targeted sequencing panel for next generation sequencing, comprising nucleic acids specific for at least one lncRNA selected from 68 lncRNAs (TCONS_00050539, TCONS_00062555, TCONS_00024916, TCONS_00059198, TCONS_00066462, TCONS_00033653, LINC-PINT:16, lnc-ATP6V1C1-12:1, lnc-GABBR1-1:2, lnc-PMM2-6:2, MALAT1:23, MALAT1:48, lnc-LTBP3-2:6, lnc-LTBP3-2:3, lnc-ANAPC11-2:8, lnc-CLLU1-2:6, lnc-KLHL36-2:2, lnc-LRRC10-1:1, lnc-RMDN2-3:24, lnc-SMN2-4:2, lnc-SPRYD3-1:17, lnc-USP47-2:1, lnc-ZC3H12B-1:5, TCONS_00019798, TSPOAP1-AS1:39, TCONS_00035093, lnc-OCM-3:4, lnc-KIF14-1:2, PCBP1-AS1:302, lnc-CA6-8:1, NEAT1:22, lnc-CA6-8:2, STARD7-AS1:5, lnc-IL31RA-1:1, lnc-ANKRD36-1:4, lnc-ATP6AP2-13:1, lnc-SOCS6-10:1, lnc-CDIPT-2:1, lnc-USP47-2:1, RBM26-AS1:1, MIR181A2HG:1, TTC21B-AS1:2, LEF1-AS1:1, lnc-SLC35E3-8:1, lnc-ZCCHC13-4:1, lnc-NEMF-1:4, TCONS_00011994, lnc-EVX1-15:1, lnc-REC8-2:1, OIP5-AS1:36, MYLK-AS1:13, lnc-PCP4L1-3:2, lnc-CGREF1-2:1, ZC3H12B-11:1, PSMB8-AS1:14, lnc-STX10-2:1, lnc-TCFL5-6:1, lnc-UQCC3-2:1, lnc-ZNF516-14:1, lnc-PDGFA-6:2, lnc-FOXD4L5-16:1, lnc-SAMD11-12:4, lnc-ADAD1-3:1, lnc-SLC35E3-8:2, lnc-NID1-4:4, FTX:19, TCONS_00017372, lnc-GRAP-1:2) ("lncRNA signature 1"). In some embodiments, the at least one lncRNA is selected from a lncRNA signature selected from lncRNA signatures 1 to 42. In some embodiments, the at least one lncRNA comprises or consists of a lncRNA signature selected from lncRNA signatures 1 to 42. In a preferred embodiment, the at least one lncRNA is or comprises lncRNA signature 1.

The invention also relates to the applications of the method for development of new therapeutic strategies (drug candidates) tested in clinical trials for the treatment of a brain disorder including but not limited to a cognitive disorder such as Alzheimer disease, dementia with lewy bodies, frontotemporal dementia wherein the method can be used (a) before starting the treatment for the selection of patients who would then be recruited in clinical trial; thus the test will enhance the likelihood for treating patient population that benefits from the tested therapeutic strategy (ies) while avoiding recruitment of patient subpopulation patients who do not benefit from this tested new drug candidate(s) and/or (b) for monitoring the response(s) including efficacy of the tested therapeutic strategy(ies) once treatment with the new tested drug candidate starts.

In a further aspect, the invention also relates to methods of detection. For example, the invention contemplates a method for the detection of one or more lncRNAs. In one aspect the method comprises:

(a) isolating a biological sample from the subject;
(b) detecting a level of expression in a lncRNA signature, the lncRNA signature comprising or consisting of at least one lncRNA selected from 68 lncRNAs (TCONS_00050539, TCONS_00062555, TCONS_00024916, TCONS_00059198, TCONS_00066462, TCONS_00033653, LINC-PINT:16, lnc-ATP6V1C1-12:1, lnc-GABBR1-1:2, lnc-PMM2-6:2, MALAT1:23, MALAT1:48, lnc-LTBP3-2:6, lnc-LTBP3-2:3, lnc-ANAPC11-2:8, lnc-CLLU1-2:6, lnc-KLHL36-2:2, lnc-LRRC10-1:1, lnc-RMDN2-3:24, lnc-SMN2-4:2, lnc-SPRYD3-1:17, lnc-USP47-2:1, lnc-ZC3H12B-1:5, TCONS_00019798, TSPOAP1-AS1:39, TCONS_00035093, lnc-OCM-3:4, lnc-KIF14-1:2, PCBP1-AS1:302, lnc-CA6-8:1, NEAT1:22, lnc-CA6-8:2, STARD7-AS1:5, lnc-IL31RA-1:1, lnc-ANKRD36-1:4, lnc-ATP6AP2-13:1, lnc-SOCS6-10:1, lnc-CDIPT-2:1, lnc-USP47-2:1, RBM26-AS1:1, MIR181A2HG:1, TTC21B-AS1:2, LEF1-AS1:1, lnc-SLC35E3-8:1, lnc-ZCCHC13-4:1, lnc-NEMF-1:4, TCONS_00011994, lnc-EVX1-15:1, lnc-REC8-2:1, OIP5-AS1:36, MYLK-AS1:13, lnc-PCP4L1-3:2, lnc-CGREF1-2:1, ZC3H12B-11:1, PSMB8-AS1:14, lnc-STX10-2:1, lnc-TCFL5-6:1, lnc-UQCC3-2:1, lnc-ZNF516-14:1, lnc-PDGFA-6:2, lnc-FOXD4L5-16:1, lnc-SAMD11-12:4, lnc-ADAD1-3:1, lnc-SLC35E3-8:2, lnc-NID1-4:4, FTX:19, TCONS_00017372, lnc-GRAP-1:2).

In some embodiments, the lncRNA signature comprises or consist of at least one lncRNA selected from a lncRNA signature selected from lncRNA signatures 1 to 42. In some embodiments, the lncRNA signature is or comprises a lncRNA signature selected from lncRNA signatures 1 to 42. In a preferred embodiment, the lncRNA signature is or comprises lncRNA signature 1.

The expression level of lncRNAs may be determined by any technology known by a man skilled in the art. In particular, the expression level of lncRNAs is determined by measuring the amount of nucleic acid transcripts of each lncRNAs. The amount of nucleic acid transcripts can be measured by any technology known by a man skilled in the art. The measure may be carried out directly on an extracted RNA sample or on retrotranscribed complementary DNA (cDNA) prepared from extracted RNA by technologies well-known in the art. From the RNA or cDNA sample, the amount of nucleic acid transcripts may be measured using any technology known by a man skilled in the art, including nucleic acid microarrays, quantitative PCR, sequencing (e.g., next generation sequencing), FIMAP quantification, and hybridization with a labeled probe.

In some embodiments, the expression level of lncRNAs is determined using sequencing, e.g., next generation sequencing. Sequencing may be carried out after converting extracted RNA to cDNA using reverse transcriptase or RNA molecules may be directly sequenced. In a particular embodiment, which should not be considered as limiting the scope of the invention, the measurement of the expression level using next generation sequencing may be performed as follows. Briefly, RNA is extracted from a sample (e.g., blood sample). After removing rRNA, RNA samples are then reverse transcribed into cDNA. To ensure strand specificity, single stranded cDNA is first synthetized using Super-Script II reverse transcriptase and random primers in the presence of Actinomycin D, and then converted to double stranded cDNA with the second strand marking mix that incorporates dUTP in place of dTTP. Resulting blunt ended cDNA are purified using AMPure XP magnetic beads. After a 3'end adenylation step, adaptor is attached to cDNA. So obtained cDNA (sequencing library) may be amplified by PCR. The sequencing libraries can be sequenced by any next generation sequencing technology known by a man skilled in the art.

In some embodiments, the measurement of the expression level of lncRNAs, e.g., by sequencing (e.g., next generation sequencing), is facilitated by capturing and enriching nucleic acids (RNA or cDNA) corresponding to ncRNAs of interest prior to the measurement. As used herein, enrichment refers to increasing the percentage of the nucleic acids of interest in the sample relative to the initial sample by selectively purifying the nucleic acids of interest. The enrichment of nucleic acids corresponding to lncRNAs of interest can be carried out on extracted RNA sample or cDNA sample prepared from extracted RNA. In some embodiments, nucleic acids corresponding to lncRNAs of interest are captured and enriched by hybridizing RNA or cDNA sample to oligonucleotide probes specific for lncRNAs of interest (e.g. oligonucleotide probes comprising a sequence complementary to a region of lncRNAs of interest) under conditions allowing for hybridization of the probes and target nucleic acids to form probe-target nucleic acid complexes. Probes may be DNA or RNA, preferably DNA. The length of probes specific for lncRNAs may be from 30 to 80 nucleotides, e.g., from 40 to 70, from 40 to 60, or about 50 nucleotides. The probe-target nucleic acid complexes can be purified by any technology known by a man skilled in the art. In a preferred embodiment, probes are biotinylated. The biotinylated probe-target nucleic acid complexes can be purified by using a streptavidin-coated substrate, e.g, a streptavidin-coated magnetic particle, e.g., T1 streptavidin coated magnetic bead.

In some embodiments, the expression level of lncRNAs may be determined using quantitative PCR. Quantitative, or real-time, PCR is a well known and easily available technology for those skilled in the art and does not need a precise description. In a particular embodiment, which should not be considered as limiting the scope of the invention, the determination of the expression profile using quantitative PCR may be performed as follows. Briefly, the real-time PCR reactions are carried out using the TaqMan Universal PCR Master Mix (Applied Biosystems). 6 µl cDNA is added to a 9 µl PCR mixture containing 7.5 µl TaqMan Universal PCR Master Mix, 0.75 µl of a 20× mixture of probe and primers and 0.75 µl water. The reaction consists of one initiating step of 2 min at 50 deg. C, followed by 10 min at 95 deg. C, and 40 cycles of amplification including 15 sec at 95 deg. C and 1 min at 60 deg. C. The reaction and data acquisition can be performed using the ABI 7900HT Fast Real-Time PCR System (Applied Biosystems). The number of template transcript molecules in a sample is determined by recording the amplification cycle in the exponential phase (cycle threshold or $C_Q$ or $C_T$), at which time the fluorescence signal can be detected above background fluorescence. Thus, the starting number of template transcript molecules is inversely related to $C_T$.

In some embodiments, the expression level of lncRNAs may be determined by the use of a nucleic acid microarray. A nucleic acid microarray consists of different nucleic acid probes that are attached to a substrate, which can be a microchip, a glass slide or a microsphere-sized bead. A microchip may be constituted of polymers, plastics, resins, polysaccharides, silica or silica-based materials, carbon, metals, inorganic glasses, or nitrocellulose. Probes can be nucleic acids such as cDNAs ("cDNA microarray") or oligonucleotides ("oligonucleotide microarray"). To determine the expression profile of a target nucleic acid sample, said sample is labelled, contacted with the microarray in hybridization conditions, leading to the formation of complexes between target nucleic acids that are complementary to probe sequences attached to the microarray surface. The presence of labelled hybridized complexes is then detected. Many variants of the microarray hybridization technology are available to the man skilled in the art.

In some embodiments, the expression level of lncRNAs may be determined by FIMAP quantification. Briefly, lncRNAs are amplified by PCR using primers with the same sequences as for qPCR that are chemically modified. Forward primers are phosphorylated in 5' and Reverse primers biotinylated in 5'. PCR products are digested with exonuclease to eliminate the phosphorylated strand and keep only the biotinylated ones. Biotinylated PCR products are incubated with coded silica microdisks coated with oligos complementary to the RNAs of interest (one code per target oligo), and hybridized products are revealed by addition of a fluorescent streptavidin conjugate. The expression level of lncRNAs is determined by measuring fluorescence signal.

In a still further aspect, the method of detection contemplates the use of a reagent to measure or detect the one or more lncRNA. By "reagent" is meant a reagent that specifically allows the determination of the lncRNA expression profile, i.e. a reagent specifically intended for the specific determination of the expression level of the lncRNA present in the lncRNA expression profile. Examples include e.g. amplification primer pairs (forward and reward) and/or or the lncRNA present in the lncRNA expression profile. This definition excludes generic reagents useful for the determination of the expression level of any other lncRNA.

In yet a further aspect, the method of detection comprises detecting one or more lncRNA from a biological sample, wherein the biological sample is selected from blood, plasma, serum, urine, cerebrospinal fluid, tear, saliva. In some embodiments, the biological sample is blood.

By "treating" or "treatment" of a subject being at risk to develop or having a cognitive disorder, particularly a progressive impairment or loss of cognitive function or dementia, e.g. AD, FTD, DLB, is meant administering or administration of a regimen to the subject in need thereof such that at least one symptom of the disorder or disease is cured, alleviated, remedied or improved. According to the present invention, depending on the diagnosing results, the subject is submitted to an adapted therapeutic treatment and is further monitored. The monitoring of the subject based on the lncRNA signature of the invention allows to further adapt or modify the therapeutic treatment, e.g. increasing the drug amount, administering a combination of drugs to obtain a synergy effect, or replacing the drug by an effective amount of another drug.

The invention also relates to the modification of a therapeutic strategy in subjects suffering from brain disorder such as a cognitive disorder who have been diagnosed and/or monitored using a method for (in vitro) diagnosis or monitoring of a progressive brain function such as impairment or loss of cognitive function or dementia according to the invention. According to the invention, the lncRNAs of the invention may be used in combination with one or more biomarkers currently used for diagnosing a cognitive disorder including but not limited to MCI, AD, FTD, DLB. Examples of such biomarkers include without any limitation the biomarkers as disclosed in U.S. Pat. Nos. 9,377,472, 7,897,786 and in U.S. Pat. No. 6,703,212, PCT/EP2018/073905/PCT/EP2018/073905), the contents thereof being included herein by reference. The method of the invention combining the lncRNAs of the invention with one or more known biomarkers may allow enhanced accuracy of diagnosis; or differential diagnosis; and a more efficient and successful drug development, e.g. enhanced accuracy for patient stratification before recruitment in clinical trials and monitoring of the efficacy of approved therapies or novel drugs under development.

According to the invention, the lncRNAs of the invention may be used in combination with one or more tests currently used for diagnosing a cognitive disorder including but not limited to AD, FTD, DLB and/or for differential diagnostic purposes. Examples of such tests include without any limitation the neuropsychological tests, such as MMSE, MoCA, FCSRT tests, and the neuroimaging methods, in particular volumetric MRI and molecular neuroimaging PET methods using a ligand specific to amyloid, Tau, alpha-synucelin or other molecules to visualize in the brain a proteinopathy. The method of the invention combining the lncRNAs of the invention with one or more known biomarkers may allow enhanced accuracy of diagnosis; or differential diagnosis; and a more efficient and successful drug development, e.g. enhanced accuracy for patient stratification before recruitment in clinical trials and monitoring of the efficacy of approved therapies or novel drugs under development.

According to the invention, novel therapeutic approaches consisting in normalizing the expression and/or amount of the lncRNAs identified for the first time by the invention in the brain may be used as treatment (alone or in combination with existing and novel other therapies) of brain disorders characterized by an altered expression or amount of such novel lncRNAs identified by the invention.

According to the invention, the identified brain-enriched lncRNAs, the identified circulating lncRNAs in the plasma, serum, blood or another body fluid may be used for the design and development of novel therapeutic treatment and for diagnosis applications for brain disorders characterized by an altered expression or amount of such circulating lncRNAs identified by the invention.

According to the invention, the altered lncRNAs identified by the invention as differentially expressed in a brain disorder such as a cognitive disorder (MCI, AD, DLB and/or FTD) in the brain or in peripheral body fluids may be used for the design and development of novel therapeutic treatment and for diagnosis applications for brain disorders characterized by an altered expression or amount of such lncRNAs identified by the invention as differentially expressed in the brain or peripheral body fluids.

To identify lncRNA signatures involved specifically in the pathogenesis of AD and mild cognitive impairment (MCI) of AD type, a total of 127802 lncRNAs in samples from different groups, including a group of patients with AD or MCI of AD type and group of cognitively intact healthy controls with no brain imaging abnormalities, have been screened. Subsequently lncRNA profiling in all samples, 19867 lncRNAs have been detected above the threshold. By comparison of lncRNA-expression levels measured in the samples of the different groups, the lncRNA differentially expressed in the samples of the control group as compared to the expression level in the samples of patient group diagnosed as having AD or cognitive impairment of AD type (at the Neurology department of clinical sites, based on neurocognitive and neuropsychological tests and neuroimaging tests and on cerebrospinal fluid biomarkers: beta-amyloid peptide 1-42 (Aβ42) and tau (total and/or phosphorylated) were identified as lncRNA biomarker candidates.

Expression levels were analyzed using a two-tailed Welch t test and/or Wilcoxon Mann-Whitney test between two groups. Significant differential expression was identified as $p<0.05$. Fold change and AUC (Area Under the Curve) are calculated for each lncRNA and for each tested condition.

Serum lncRNA candidates were also selected when differential expression was determined based on fold-changes ≥1.6 (or ≤0.6) and/or an AUC ≥0.80 (or <0.20), are indicated in Tables 2 and 3.

Random Forest algorithm (Breimann 2001, Breiman and Cutler 2001) was used to build the model and also used to select the top lncRNAs. A predictive model based on the combination of the top 2-20 lncRNAs enables to predict the disease with an accuracy of ≥80%.

Out of the 127802 serum lncRNAs sequenced, 19867 lncRNAs were selected based on their threshold expression level for statistical analysis. The comparison of the AD patient with healthy control populations showed that 1008 lncRNAs are differentially expressed with a statistical significance (p value <0.05, Wilcoxon test) (Table 1). The sequences of these 1008 lncRNAs are shown in the sequence listing included in this application.

TABLE 1

The Sequence number, p value, mean +/− SD, fold change and AUC of the 1008 serum lncRNAs with differential expression in AD group versus healthy control group (p value <0.05, Wilcoxon test)

| lncRNA | SEQ | p value | Fold change | AUC |
| --- | --- | --- | --- | --- |
| ADAMTS9-AS2:12 | SEQ 0397 | 0.02049 | 0.852 | 0.778 |
| ADNP-AS1:12 | SEQ 0340 | 0.01727 | 0.809 | 0.785 |
| ADPGK-AS1:7 | SEQ 0858 | 0.0449 | 1.225 | 0.257 |
| APTR:17 | SEQ 0260 | 0.01209 | 1.147 | 0.201 |
| ARF4-AS1:8 | SEQ 0859 | 0.0449 | 1.143 | 0.257 |
| ARRDC3-AS1:7 | SEQ 0050 | 0.00232 | 0.441 | 0.854 |
| BISPR:24 | SEQ 0566 | 0.02842 | 0.579 | 0.764 |
| BLACAT1:3 | SEQ 0300 | 0.01449 | 1.717 | 0.208 |
| BLACAT1:5 | SEQ 0341 | 0.01727 | 0.424 | 0.785 |
| CALML3-AS1:9 | SEQ 0136 | 0.00681 | 1.567 | 0.181 |
| CASC15:51 | SEQ 0567 | 0.02842 | 1.273 | 0.236 |
| CASC20:2 | SEQ 0860 | 0.0449 | 0.765 | 0.743 |
| CERS3-AS1:5 | SEQ 0301 | 0.01449 | 1.251 | 0.208 |
| CFAP58-AS1:4 | SEQ 0109 | 0.00556 | 1.464 | 0.174 |
| CLRN1-AS1:1 | SEQ 0475 | 0.02418 | 0.793 | 0.771 |
| CPB2-AS1:18 | SEQ 0476 | 0.02418 | 0.682 | 0.771 |
| CYTOR:18 | SEQ 0062 | 0.00291 | 1.278 | 0.153 |
| DARS-AS1:47 | SEQ 0178 | 0.00829 | 2.015 | 0.188 |
| DDX11-AS1:5 | SEQ 0861 | 0.0449 | 1.256 | 0.257 |
| DLEU2:26 | SEQ 0862 | 0.0449 | 1.076 | 0.257 |
| DLEU2:45 | SEQ 0863 | 0.0449 | 0.882 | 0.743 |
| DLGAP2-AS1:18 | SEQ 0656 | 0.03324 | 0.789 | 0.757 |
| DPH6-AS1:3 | SEQ 0342 | 0.01727 | 2.004 | 0.215 |
| EGFR-AS1:4 | SEQ 0093 | 0.00451 | 0.81 | 0.833 |
| EGOT:11 | SEQ 0110 | 0.00556 | 1.195 | 0.174 |
| EIF3J-AS1:21 | SEQ 0261 | 0.01209 | 0.87 | 0.799 |
| ERICH3-AS1:4 | SEQ 0864 | 0.0449 | 0.888 | 0.743 |
| EXTL3-AS1:16 | SEQ 0568 | 0.02842 | 0.739 | 0.764 |
| FAM66B:14 | SEQ 0063 | 0.00291 | 0.604 | 0.847 |
| FLG-AS1:14 | SEQ 0752 | 0.03872 | 1.18 | 0.25 |
| FLVCR1-AS1:13 | SEQ 0137 | 0.00681 | 0.413 | 0.819 |
| FRG1-DT:6 | SEQ 0865 | 0.0449 | 0.873 | 0.743 |
| GAS1RR:11 | SEQ 0302 | 0.01449 | 0.848 | 0.792 |
| GAS6-AS2:9 | SEQ 0303 | 0.01449 | 0.787 | 0.792 |
| GPC5-AS1:7 | SEQ 0753 | 0.03872 | 0.623 | 0.75 |
| GPR158-AS1:1 | SEQ 0398 | 0.02049 | 0.775 | 0.778 |
| GRM5-AS1:1 | SEQ 0138 | 0.00681 | 0.83 | 0.819 |
| HAND2-AS1:58 | SEQ 0094 | 0.00451 | 0.587 | 0.833 |
| HAND2-AS1:59 | SEQ 0111 | 0.00556 | 0.592 | 0.826 |
| HAND2-AS1:70 | SEQ 0039 | 0.00183 | 0.543 | 0.861 |
| HAND2-AS1:71 | SEQ 0076 | 0.00364 | 0.565 | 0.84 |
| HCG23:5 | SEQ 0754 | 0.03872 | 0.813 | 0.75 |
| KAZN-AS1:4 | SEQ 0399 | 0.02049 | 0.732 | 0.778 |
| KCNQ1-AS1:3 | SEQ 0569 | 0.02842 | 0.848 | 0.764 |
| KCNQ1OT1:8 | SEQ 0139 | 0.00681 | 0.908 | 0.819 |
| LACTB2-AS1:1 | SEQ 0755 | 0.03872 | 1.206 | 0.25 |
| LINC00158:5 | SEQ 0570 | 0.02842 | 0.748 | 0.764 |
| LINC00200:6 | SEQ 0064 | 0.00291 | 1.29 | 0.153 |
| LINC00276:2 | SEQ 0866 | 0.0449 | 0.846 | 0.743 |
| LINC00354:4 | SEQ 0867 | 0.0449 | 1.284 | 0.257 |
| LINC00458:19 | SEQ 0571 | 0.02842 | 0.789 | 0.764 |
| LINC00460:13 | SEQ 0868 | 0.0449 | 0.752 | 0.743 |
| LINC00472:21 | SEQ 0140 | 0.00681 | 1.389 | 0.181 |
| LINC00554:2 | SEQ 0756 | 0.03872 | 0.766 | 0.75 |
| LINC00554:4 | SEQ 0757 | 0.03872 | 0.766 | 0.75 |
| LINC00574:13 | SEQ 0112 | 0.00556 | 0.771 | 0.826 |
| LINC00589:3 | SEQ 0869 | 0.0449 | 0.781 | 0.743 |
| LINC00649:23 | SEQ 0077 | 0.00364 | 0.619 | 0.84 |
| LINC00698:2 | SEQ 0657 | 0.03324 | 0.85 | 0.757 |
| LINC00707:9 | SEQ 0572 | 0.02842 | 1.304 | 0.236 |
| LINC00839:18 | SEQ 0113 | 0.00556 | 0.874 | 0.826 |
| LINC00882:70 | SEQ 0028 | 0.00111 | 0.867 | 0.875 |

TABLE 1-continued

The Sequence number, p value, mean +/− SD, fold change and
AUC of the 1008 serum lncRNAs with differential expression in
AD group versus healthy control group (p value <0.05, Wilcoxon test)

| lncRNA | SEQ | p value | Fold change | AUC |
|---|---|---|---|---|
| LINC00882:71 | SEQ 0029 | 0.00111 | 0.867 | 0.875 |
| LINC00887:15 | SEQ 0870 | 0.0449 | 0.925 | 0.743 |
| LINC00895:3 | SEQ 0179 | 0.00829 | 1.491 | 0.188 |
| LINC00927:21 | SEQ 0658 | 0.03324 | 0.619 | 0.757 |
| LINC00927:22 | SEQ 0659 | 0.03324 | 0.619 | 0.757 |
| LINC00927:24 | SEQ 0343 | 0.01727 | 0.772 | 0.785 |
| LINC00938:6 | SEQ 0262 | 0.01209 | 0.811 | 0.799 |
| LINC00963:67 | SEQ 0573 | 0.02842 | 1.379 | 0.236 |
| LINC01050:6 | SEQ 0114 | 0.00556 | 0.82 | 0.826 |
| LINC01058:3 | SEQ 0871 | 0.0449 | 1.225 | 0.257 |
| LINC01087:1 | SEQ 0141 | 0.00681 | 0.764 | 0.819 |
| LINC01088:18 | SEQ 0660 | 0.03324 | 0.757 | 0.757 |
| LINC01107:1 | SEQ 0304 | 0.01449 | 0.768 | 0.792 |
| LINC01122:27 | SEQ 0574 | 0.02842 | 1.263 | 0.236 |
| LINC01146:14 | SEQ 0758 | 0.03872 | 0.774 | 0.75 |
| LINC01153:1 | SEQ 0661 | 0.03324 | 1.169 | 0.243 |
| LINC01185:7 | SEQ 0575 | 0.02842 | 0.793 | 0.764 |
| LINC01197:26 | SEQ 0759 | 0.03872 | 0.847 | 0.75 |
| LINC01206:11 | SEQ 0662 | 0.03324 | 0.612 | 0.757 |
| LINC01206:20 | SEQ 0400 | 0.02049 | 1.94 | 0.222 |
| LINC01226:8 | SEQ 0663 | 0.03324 | 0.902 | 0.757 |
| LINC01270:15 | SEQ 0477 | 0.02418 | 1.703 | 0.229 |
| LINC01320:22 | SEQ 0576 | 0.02842 | 0.785 | 0.764 |
| LINC01322:20 | SEQ 0223 | 0.01004 | 0.561 | 0.806 |
| LINC01355:9 | SEQ 0664 | 0.03324 | 0.854 | 0.757 |
| LINC01376:10 | SEQ 0760 | 0.03872 | 0.934 | 0.75 |
| LINC01394:15 | SEQ 0401 | 0.02049 | 1.238 | 0.222 |
| LINC01394:26 | SEQ 0402 | 0.02049 | 1.238 | 0.222 |
| LINC01394:50 | SEQ 0095 | 0.00451 | 0.797 | 0.833 |
| LINC01410:11 | SEQ 0023 | 0.00086 | 0.734 | 0.882 |
| LINC01419:6 | SEQ 0872 | 0.0449 | 0.663 | 0.743 |
| LINC01426:10 | SEQ 0577 | 0.02842 | 0.871 | 0.764 |
| LINC01481:8 | SEQ 0478 | 0.02418 | 0.9 | 0.771 |
| LINC01519:3 | SEQ 0305 | 0.01449 | 0.805 | 0.792 |
| LINC01527:1 | SEQ 0578 | 0.02842 | 0.781 | 0.764 |
| LINC01568:12 | SEQ 0479 | 0.02418 | 0.68 | 0.771 |
| LINC01629:11 | SEQ 0579 | 0.02842 | 0.59 | 0.764 |
| LINC01653:2 | SEQ 0580 | 0.02842 | 0.792 | 0.764 |
| LINC01684:16 | SEQ 0480 | 0.02418 | 0.907 | 0.771 |
| LINC01697:9 | SEQ 0873 | 0.0449 | 0.874 | 0.743 |
| LINC01719:19 | SEQ 0761 | 0.03872 | 0.855 | 0.75 |
| LINC01748:17 | SEQ 0481 | 0.02418 | 0.791 | 0.771 |
| LINC01762:4 | SEQ 0874 | 0.0449 | 0.941 | 0.743 |
| LINC01793:2 | SEQ 0344 | 0.01727 | 0.743 | 0.785 |
| LINC01798:4 | SEQ 0482 | 0.02418 | 0.791 | 0.771 |
| LINC01845:3 | SEQ 0115 | 0.00556 | 1.55 | 0.174 |
| LINC01856:2 | SEQ 0762 | 0.03872 | 1.176 | 0.25 |
| LINC01903:2 | SEQ 0345 | 0.01727 | 0.774 | 0.785 |
| LINC01918:13 | SEQ 0763 | 0.03872 | 1.138 | 0.25 |
| LINC02104:7 | SEQ 0306 | 0.01449 | 0.82 | 0.792 |
| LINC02177:6 | SEQ 0403 | 0.02049 | 0.768 | 0.778 |
| LINC02177:8 | SEQ 0764 | 0.03872 | 0.494 | 0.75 |
| LINC02197:6 | SEQ 0483 | 0.02418 | 0.76 | 0.771 |
| LINC02204:2 | SEQ 0142 | 0.00681 | 0.78 | 0.819 |
| LINC02204:3 | SEQ 0143 | 0.00681 | 0.78 | 0.819 |
| LINC02232:10 | SEQ 0665 | 0.03324 | 0.646 | 0.757 |
| LINC02246:11 | SEQ 0346 | 0.01727 | 0.74 | 0.785 |
| LINC02252:3 | SEQ 0765 | 0.03872 | 0.881 | 0.75 |
| LINC02323:8 | SEQ 0307 | 0.01449 | 0.622 | 0.792 |
| LINC02334:6 | SEQ 0581 | 0.02842 | 0.737 | 0.764 |
| LINC02345:11 | SEQ 0013 | 0.00066 | 1.181 | 0.111 |
| LINC02432:9 | SEQ 0180 | 0.00829 | 0.776 | 0.813 |
| LINC02473:3 | SEQ 0065 | 0.00291 | 0.786 | 0.847 |
| LINC02519:7 | SEQ 0875 | 0.0449 | 0.682 | 0.743 |
| LINC02554:5 | SEQ 0404 | 0.02049 | 0.744 | 0.778 |
| LINC02580:5 | SEQ 0484 | 0.02418 | 0.767 | 0.771 |
| lnc-AASDHPPT-3:1 | SEQ 0409 | 0.02049 | 0.715 | 0.778 |
| lnc-ABCA1-8:9 | SEQ 0589 | 0.02842 | 0.592 | 0.764 |
| lnc-ABCA5-14:2 | SEQ 0881 | 0.0449 | 1.164 | 0.257 |
| lnc-ABCA5-7:1 | SEQ 0014 | 0.00066 | 1.309 | 0.111 |
| lnc-ABCG2-3:5 | SEQ 0667 | 0.03324 | 0.758 | 0.757 |
| lnc-ACO1-1:1 | SEQ 0590 | 0.02842 | 0.759 | 0.764 |
| lnc-ACOT12-9:1 | SEQ 0053 | 0.00232 | 0.727 | 0.854 |
| lnc-ACTL7B-8:1 | SEQ 0493 | 0.02418 | 0.697 | 0.771 |

TABLE 1-continued

The Sequence number, p value, mean +/− SD, fold change and
AUC of the 1008 serum lncRNAs with differential expression in
AD group versus healthy control group (p value <0.05, Wilcoxon test)

| lncRNA | SEQ | p value | Fold change | AUC |
|---|---|---|---|---|
| lnc-ADAD1-3:1 | SEQ 0774 | 0.03872 | 0.828 | 0.75 |
| lnc-ADAMTS20-3:1 | SEQ 0494 | 0.02418 | 1.219 | 0.229 |
| lnc-ADAMTS5-1:1 | SEQ 0882 | 0.0449 | 0.851 | 0.743 |
| lnc-ADAT1-1:1 | SEQ 0495 | 0.02418 | 0.877 | 0.771 |
| lnc-ADRA2A-4:1 | SEQ 0883 | 0.0449 | 0.729 | 0.743 |
| lnc-ADRB1-4:1 | SEQ 0118 | 0.00556 | 0.858 | 0.826 |
| lnc-AFG1L-5:1 | SEQ 0263 | 0.01209 | 1.407 | 0.201 |
| lnc-AGO2-2:2 | SEQ 0119 | 0.00556 | 0.511 | 0.826 |
| lnc-AGO2-2:3 | SEQ 0668 | 0.03324 | 1.442 | 0.243 |
| lnc-AGR3-6:1 | SEQ 0884 | 0.0449 | 1.156 | 0.257 |
| lnc-AHR-5:1 | SEQ 0264 | 0.01209 | 0.792 | 0.799 |
| lnc-AIG1-5:1 | SEQ 0496 | 0.02418 | 0.862 | 0.771 |
| lnc-AKAP9-1:2 | SEQ 0775 | 0.03872 | 0.704 | 0.75 |
| lnc-AKIRIN1-1:11 | SEQ 0591 | 0.02842 | 0.553 | 0.764 |
| lnc-AKR1C2-3:17 | SEQ 0097 | 0.00451 | 0.768 | 0.833 |
| lnc-AKR1D1-5:2 | SEQ 0098 | 0.00451 | 0.891 | 0.833 |
| lnc-AKR1D1-8:3 | SEQ 0885 | 0.0449 | 0.797 | 0.743 |
| lnc-AKR1E2-15:1 | SEQ 0410 | 0.02049 | 1.303 | 0.222 |
| lnc-AKR7A2-2:1 | SEQ 0145 | 0.00681 | 1.339 | 0.181 |
| lnc-AKT1-1:15 | SEQ 0411 | 0.02049 | 0.825 | 0.778 |
| lnc-ALB-1:12 | SEQ 0146 | 0.00681 | 1.448 | 0.181 |
| lnc-ALB-1:6 | SEQ 0886 | 0.0449 | 0.881 | 0.743 |
| lnc-ALDH3B2-3:4 | SEQ 0412 | 0.02049 | 0.89 | 0.778 |
| lnc-ALG14-5:2 | SEQ 0350 | 0.01727 | 0.697 | 0.785 |
| lnc-ALS2CR12-1:2 | SEQ 0351 | 0.01727 | 0.729 | 0.785 |
| lnc-ANAPC11-2:6 | SEQ 0887 | 0.0449 | 1.836 | 0.257 |
| lnc-ANKRD1-1:6 | SEQ 0888 | 0.0449 | 0.77 | 0.743 |
| lnc-ANKRD26-1:3 | SEQ 0497 | 0.02418 | 0.852 | 0.771 |
| lnc-ANKRD30BL-2:2 | SEQ 0413 | 0.02049 | 0.747 | 0.778 |
| lnc-ANKRD46-1:3 | SEQ 0669 | 0.03324 | 0.687 | 0.757 |
| lnc-ANXA3-8:1 | SEQ 0670 | 0.03324 | 0.838 | 0.757 |
| lnc-APBA1-5:1 | SEQ 0592 | 0.02842 | 0.781 | 0.764 |
| lnc-APIP-1:13 | SEQ 0776 | 0.03872 | 0.807 | 0.75 |
| lnc-APLP2-4:1 | SEQ 0054 | 0.00232 | 0.786 | 0.854 |
| lnc-APOB-1:2 | SEQ 0777 | 0.03872 | 0.583 | 0.75 |
| lnc-APPL2-1:2 | SEQ 0498 | 0.02418 | 1.133 | 0.229 |
| lnc-AQP8-2:7 | SEQ 0352 | 0.01727 | 1.254 | 0.215 |
| lnc-ARAP2-9:1 | SEQ 0147 | 0.00681 | 0.795 | 0.819 |
| lnc-ARHGAP15-17:1 | SEQ 0353 | 0.01727 | 0.857 | 0.785 |
| lnc-ARHGAP15-22:1 | SEQ 0593 | 0.02842 | 0.846 | 0.764 |
| lnc-ARHGAP21-1:2 | SEQ 0309 | 0.01449 | 0.723 | 0.792 |
| lnc-ARHGAP26-4:11 | SEQ 0189 | 0.00829 | 0.923 | 0.813 |
| lnc-ARHGAP26-4:33 | SEQ 0778 | 0.03872 | 0.71 | 0.75 |
| lnc-ARHGAP26-4:39 | SEQ 0889 | 0.0449 | 1.383 | 0.257 |
| lnc-ARHGEF26-2:1 | SEQ 0067 | 0.00291 | 1.399 | 0.153 |
| lnc-ARHGEF5-5:1 | SEQ 0354 | 0.01727 | 0.712 | 0.785 |
| lnc-ARID2-7:1 | SEQ 0671 | 0.03324 | 0.924 | 0.757 |
| lnc-ARNTL-2:1 | SEQ 0265 | 0.01209 | 0.61 | 0.799 |
| lnc-ARRDC4-7:1 | SEQ 0779 | 0.03872 | 0.876 | 0.75 |
| lnc-ART5-2:1 | SEQ 0414 | 0.02049 | 0.787 | 0.778 |
| lnc-ATAD1-5:2 | SEQ 0148 | 0.00681 | 0.738 | 0.819 |
| lnc-ATIC-2:8 | SEQ 0780 | 0.03872 | 0.554 | 0.75 |
| lnc-ATP12A-3:1 | SEQ 0499 | 0.02418 | 0.763 | 0.771 |
| lnc-ATP13A4-2:4 | SEQ 0672 | 0.03324 | 1.64 | 0.243 |
| lnc-ATP5O-3:1 | SEQ 0224 | 0.01004 | 1.358 | 0.194 |
| lnc-ATP6V0E2-7:1 | SEQ 0500 | 0.02418 | 1.361 | 0.229 |
| lnc-ATP6V1B2-2:6 | SEQ 0594 | 0.02842 | 1.132 | 0.236 |
| lnc-ATP6V1B2-2:7 | SEQ 0595 | 0.02842 | 1.132 | 0.236 |
| lnc-ATP8A2-1:1 | SEQ 0355 | 0.01727 | 1.477 | 0.215 |
| lnc-ATXN2-1:1 | SEQ 0099 | 0.00451 | 0.792 | 0.833 |
| lnc-ATXN7-11:1 | SEQ 0501 | 0.02418 | 1.319 | 0.229 |
| lnc-ATXN7L1-1:1 | SEQ 0890 | 0.0449 | 1.32 | 0.257 |
| lnc-AUH-2:7 | SEQ 0190 | 0.00829 | 0.584 | 0.813 |
| lnc-AUH-2:9 | SEQ 0673 | 0.03324 | 1.35 | 0.243 |
| lnc-AUH-4:1 | SEQ 0596 | 0.02842 | 0.79 | 0.764 |
| lnc-BAG3-4:4 | SEQ 0891 | 0.0449 | 1.314 | 0.257 |
| lnc-BARHL2-4:4 | SEQ 0100 | 0.00451 | 0.736 | 0.833 |
| lnc-BCHE-1:1 | SEQ 0674 | 0.03324 | 0.741 | 0.757 |
| lnc-BCL6-9:1 | SEQ 0310 | 0.01449 | 0.885 | 0.792 |
| lnc-BIRC2-5:5 | SEQ 0225 | 0.01004 | 0.831 | 0.806 |
| lnc-BIRC6-1:4 | SEQ 0892 | 0.0449 | 0.829 | 0.743 |
| lnc-BMS1-2:1 | SEQ 0675 | 0.03324 | 1.124 | 0.243 |
| lnc-BNC2-5:1 | SEQ 0191 | 0.00829 | 1.299 | 0.188 |
| lnc-BORA-31:1 | SEQ 0192 | 0.00829 | 0.67 | 0.813 |

TABLE 1-continued

The Sequence number, p value, mean +/− SD, fold change and
AUC of the 1008 serum lncRNAs with differential expression in
AD group versus healthy control group (p value <0.05, Wilcoxon test)

| lncRNA | SEQ | p value | Fold change | AUC |
| --- | --- | --- | --- | --- |
| lnc-BRD1-17:1 | SEQ 0311 | 0.01449 | 0.669 | 0.792 |
| lnc-BRINP1-3:1 | SEQ 0893 | 0.0449 | 0.894 | 0.743 |
| lnc-BRINP2-3:1 | SEQ 0597 | 0.02842 | 0.878 | 0.764 |
| lnc-C10orf90-2:2 | SEQ 0415 | 0.02049 | 1.687 | 0.222 |
| lnc-C12orf40-3:3 | SEQ 0894 | 0.0449 | 1.434 | 0.257 |
| lnc-C12orf42-3:6 | SEQ 0598 | 0.02842 | 1.303 | 0.236 |
| lnc-C15orf41-18:5 | SEQ 0676 | 0.03324 | 1.649 | 0.243 |
| lnc-C15orf41-18:6 | SEQ 0895 | 0.0449 | 1.561 | 0.257 |
| lnc-C19orf57-1:1 | SEQ 0896 | 0.0449 | 1.361 | 0.257 |
| lnc-C1QTNF9-4:1 | SEQ 0781 | 0.03872 | 1.282 | 0.25 |
| lnc-C21orf58-1:2 | SEQ 0033 | 0.00143 | 2.231 | 0.132 |
| lnc-C2CD4B-6:4 | SEQ 0193 | 0.00829 | 1.39 | 0.188 |
| lnc-C2orf42-10:1 | SEQ 0502 | 0.02418 | 1.28 | 0.229 |
| lnc-C3orf58-7:1 | SEQ 0599 | 0.02842 | 0.725 | 0.764 |
| lnc-C5orf30-10:1 | SEQ 0266 | 0.01209 | 0.708 | 0.799 |
| lnc-C5orf30-10:2 | SEQ 0600 | 0.02842 | 0.891 | 0.764 |
| lnc-C5orf67-3:1 | SEQ 0149 | 0.00681 | 0.876 | 0.819 |
| lnc-C7orf57-4:1 | SEQ 0356 | 0.01727 | 1.461 | 0.215 |
| lnc-C9orf3-5:1 | SEQ 0120 | 0.00556 | 0.782 | 0.826 |
| lnc-CA7-2:2 | SEQ 0677 | 0.03324 | 0.817 | 0.757 |
| lnc-CAB39L-1:4 | SEQ 0267 | 0.01209 | 0.769 | 0.799 |
| lnc-CAB39L-4:2 | SEQ 0601 | 0.02842 | 1.181 | 0.236 |
| lnc-CACNA1I-1:1 | SEQ 0503 | 0.02418 | 0.813 | 0.771 |
| lnc-CACNA2D1-1:1 | SEQ 0897 | 0.0449 | 0.82 | 0.743 |
| lnc-CACNG1-1:1 | SEQ 0602 | 0.02842 | 0.652 | 0.764 |
| lnc-CALML6-1:10 | SEQ 0898 | 0.0449 | 0.577 | 0.743 |
| lnc-CAPS2-1:1 | SEQ 0357 | 0.01727 | 0.708 | 0.785 |
| lnc-CASC10-3:1 | SEQ 0899 | 0.0449 | 0.744 | 0.743 |
| lnc-CASP9-1:1 | SEQ 0782 | 0.03872 | 1.246 | 0.25 |
| lnc-CAVIN2-2:1 | SEQ 0416 | 0.02049 | 1.425 | 0.222 |
| lnc-CBLB-9:1 | SEQ 0900 | 0.0449 | 0.788 | 0.743 |
| lnc-CCDC102B-7:1 | SEQ 0901 | 0.0449 | 0.816 | 0.743 |
| lnc-CCDC167-5:1 | SEQ 0417 | 0.02049 | 1.25 | 0.222 |
| lnc-CCDC177-6:1 | SEQ 0783 | 0.03872 | 1.157 | 0.25 |
| lnc-CCDC192-3:1 | SEQ 0902 | 0.0449 | 0.8 | 0.743 |
| lnc-CCDC197-2:1 | SEQ 0068 | 0.00291 | 0.672 | 0.847 |
| lnc-CCDC61-4:1 | SEQ 0194 | 0.00829 | 0.561 | 0.813 |
| lnc-CCDC7-17:1 | SEQ 0226 | 0.01004 | 1.341 | 0.194 |
| lnc-CCDC93-10:2 | SEQ 0603 | 0.02842 | 0.87 | 0.764 |
| lnc-CCL1-10:1 | SEQ 0227 | 0.01004 | 1.307 | 0.194 |
| lnc-CCNB1IP1-1:2 | SEQ 0903 | 0.0449 | 0.512 | 0.743 |
| lnc-CCR8-2:1 | SEQ 0904 | 0.0449 | 1.409 | 0.257 |
| lnc-CCSER1-2:1 | SEQ 0678 | 0.03324 | 0.791 | 0.757 |
| lnc-CCT8L2-28:1 | SEQ 0418 | 0.02049 | 0.812 | 0.778 |
| lnc-CD47-11:2 | SEQ 0905 | 0.0449 | 1.317 | 0.257 |
| lnc-CD47-11:4 | SEQ 0906 | 0.0449 | 1.139 | 0.257 |
| lnc-CDADC1-1:1 | SEQ 0907 | 0.0449 | 1.18 | 0.257 |
| lnc-CDH23-2:1 | SEQ 0908 | 0.0449 | 0.757 | 0.743 |
| lnc-CDK20-14:1 | SEQ 0358 | 0.01727 | 1.274 | 0.215 |
| lnc-CDK2AP1-1:8 | SEQ 0909 | 0.0449 | 0.84 | 0.743 |
| lnc-CEACAM16-2:1 | SEQ 0195 | 0.00829 | 0.708 | 0.813 |
| lnc-CEBPD-11:2 | SEQ 0784 | 0.03872 | 0.763 | 0.75 |
| lnc-CELF4-15:1 | SEQ 0785 | 0.03872 | 0.89 | 0.75 |
| lnc-CELSR1-2:3 | SEQ 0268 | 0.01209 | 0.762 | 0.799 |
| lnc-CEP170-9:2 | SEQ 0042 | 0.00183 | 0.828 | 0.861 |
| lnc-CFAP36-3:2 | SEQ 0786 | 0.03872 | 0.69 | 0.75 |
| lnc-CHD1L-5:13 | SEQ 0312 | 0.01449 | 0.37 | 0.792 |
| lnc-CHMP2B-1:11 | SEQ 0679 | 0.03324 | 0.858 | 0.757 |
| lnc-CHN1-5:11 | SEQ 0419 | 0.02049 | 0.739 | 0.778 |
| lnc-CHRAC1-1:1 | SEQ 0680 | 0.03324 | 0.747 | 0.757 |
| lnc-CHRAC1-6:1 | SEQ 0420 | 0.02049 | 1.247 | 0.222 |
| lnc-CHRM2-1:1 | SEQ 0121 | 0.00556 | 0.833 | 0.826 |
| lnc-CHRM3-1:5 | SEQ 0681 | 0.03324 | 0.714 | 0.757 |
| lnc-CHST2-6:2 | SEQ 0196 | 0.00829 | 0.763 | 0.813 |
| lnc-CLDN10-5:1 | SEQ 0313 | 0.01449 | 0.717 | 0.792 |
| lnc-CLEC19A-3:1 | SEQ 0787 | 0.03872 | 1.284 | 0.25 |
| lnc-CLK1-1:7 | SEQ 0197 | 0.00829 | 0.602 | 0.813 |
| lnc-CLVS2-2:5 | SEQ 0359 | 0.01727 | 0.818 | 0.785 |
| lnc-CMPK2-34:4 | SEQ 0101 | 0.00451 | 0.651 | 0.833 |
| lnc-CMTM7-2:2 | SEQ 0269 | 0.01209 | 0.838 | 0.799 |
| lnc-CMTR1-10:1 | SEQ 0788 | 0.03872 | 0.868 | 0.75 |
| lnc-CNBD1-4:13 | SEQ 0682 | 0.03324 | 0.568 | 0.757 |
| lnc-CNDP1-7:1 | SEQ 0024 | 0.00086 | 0.534 | 0.882 |
| lnc-CNOT6-10:1 | SEQ 0270 | 0.01209 | 1.19 | 0.201 |

TABLE 1-continued

The Sequence number, p value, mean +/− SD, fold change and
AUC of the 1008 serum lncRNAs with differential expression in
AD group versus healthy control group (p value <0.05, Wilcoxon test)

| lncRNA | SEQ | p value | Fold change | AUC |
|---|---|---|---|---|
| lnc-COL6A6-2:1 | SEQ 0910 | 0.0449 | 0.717 | 0.743 |
| lnc-COMMD6-10:1 | SEQ 0079 | 0.00364 | 1.58 | 0.16 |
| lnc-COX10-9:2 | SEQ 0911 | 0.0449 | 0.849 | 0.743 |
| lnc-CPEB3-2:1 | SEQ 0789 | 0.03872 | 0.78 | 0.75 |
| lnc-CPM-2:11 | SEQ 0912 | 0.0449 | 0.424 | 0.743 |
| lnc-CPM-3:1 | SEQ 0228 | 0.01004 | 0.831 | 0.806 |
| lnc-CRIPT-1:3 | SEQ 0790 | 0.03872 | 0.802 | 0.75 |
| lnc-CRISP1-1:2 | SEQ 0271 | 0.01209 | 0.685 | 0.799 |
| lnc-CRYBA1-4:1 | SEQ 0421 | 0.02049 | 0.693 | 0.778 |
| lnc-CRYBB1-1:1 | SEQ 0055 | 0.00232 | 0.487 | 0.854 |
| lnc-CSGALNACT2-2:3 | SEQ 0791 | 0.03872 | 0.781 | 0.75 |
| lnc-CSNK1A1-6:1 | SEQ 0030 | 0.00111 | 0.696 | 0.875 |
| lnc-CTIF-9:2 | SEQ 0504 | 0.02418 | 1.28 | 0.229 |
| lnc-CTNNA2-3:11 | SEQ 0198 | 0.00829 | 0.812 | 0.813 |
| lnc-CTNNA3-1:2 | SEQ 0683 | 0.03324 | 0.82 | 0.757 |
| lnc-CTNND2-3:1 | SEQ 0913 | 0.0449 | 0.797 | 0.743 |
| lnc-CTR9-7:1 | SEQ 0914 | 0.0449 | 0.763 | 0.743 |
| lnc-CYB5R2-3:13 | SEQ 0199 | 0.00829 | 0.749 | 0.813 |
| lnc-CYBA-4:3 | SEQ 0150 | 0.00681 | 0.784 | 0.819 |
| lnc-CYP2E1-1:1 | SEQ 0684 | 0.03324 | 1.733 | 0.243 |
| lnc-CYTIP-2:1 | SEQ 0200 | 0.00829 | 0.727 | 0.813 |
| lnc-DAO-3:1 | SEQ 0685 | 0.03324 | 1.109 | 0.243 |
| lnc-DAPP1-2:11 | SEQ 0505 | 0.02418 | 0.822 | 0.771 |
| lnc-DAZAP2-3:1 | SEQ 0056 | 0.00232 | 0.797 | 0.854 |
| lnc-DDX1-3:1 | SEQ 0915 | 0.0449 | 1.251 | 0.257 |
| lnc-DDX18-1:1 | SEQ 0506 | 0.02418 | 0.721 | 0.771 |
| lnc-DDX18-1:7 | SEQ 0314 | 0.01449 | 0.755 | 0.792 |
| lnc-DEFB112-3:4 | SEQ 0422 | 0.02049 | 0.565 | 0.778 |
| lnc-DEK-4:1 | SEQ 0507 | 0.02418 | 0.715 | 0.771 |
| lnc-DEPTOR-5:3 | SEQ 0360 | 0.01727 | 0.846 | 0.785 |
| lnc-DGCR2-5:1 | SEQ 0423 | 0.02049 | 0.872 | 0.778 |
| lnc-DGCR6-7:26 | SEQ 0792 | 0.03872 | 0.736 | 0.75 |
| lnc-DHX37-18:1 | SEQ 0229 | 0.01004 | 0.751 | 0.806 |
| lnc-DHX38-25:1 | SEQ 0230 | 0.01004 | 0.894 | 0.806 |
| lnc-DKK1-5:3 | SEQ 0005 | 0.00027 | 0.739 | 0.91 |
| lnc-DKK1-5:4 | SEQ 0793 | 0.03872 | 0.893 | 0.75 |
| lnc-DLG5-1:1 | SEQ 0034 | 0.00143 | 0.773 | 0.868 |
| lnc-DLX2-12:1 | SEQ 0151 | 0.00681 | 0.747 | 0.819 |
| lnc-DMRTA1-17:1 | SEQ 0201 | 0.00829 | 0.79 | 0.813 |
| lnc-DNAH9-1:1 | SEQ 0508 | 0.02418 | 0.812 | 0.771 |
| lnc-DNALI1-5:4 | SEQ 0102 | 0.00451 | 0.776 | 0.833 |
| lnc-DOCK7-7:1 | SEQ 0015 | 0.00066 | 0.843 | 0.889 |
| lnc-DTWD2-14:1 | SEQ 0361 | 0.01727 | 0.811 | 0.785 |
| lnc-DUSP10-6:1 | SEQ 0057 | 0.00232 | 0.675 | 0.854 |
| lnc-DUSP26-3:2 | SEQ 0031 | 0.00111 | 0.796 | 0.875 |
| lnc-DYNAP-1:1 | SEQ 0604 | 0.02842 | 0.761 | 0.764 |
| lnc-EAF1-2:1 | SEQ 0509 | 0.02418 | 0.737 | 0.771 |
| lnc-EBF3-1:6 | SEQ 0686 | 0.03324 | 1.241 | 0.243 |
| lnc-EBLN1-1:4 | SEQ 0016 | 0.00066 | 0.725 | 0.889 |
| lnc-EDDM13-5:11 | SEQ 0231 | 0.01004 | 0.372 | 0.806 |
| lnc-EDDM13-5:3 | SEQ 0035 | 0.00143 | 1.505 | 0.132 |
| lnc-EDEM3-7:3 | SEQ 0272 | 0.01209 | 0.86 | 0.799 |
| lnc-EDRF1-1:5 | SEQ 0916 | 0.0449 | 0.728 | 0.743 |
| lnc-EEF1AKMT1-3:6 | SEQ 0202 | 0.00829 | 0.423 | 0.813 |
| lnc-EEF2-3:1 | SEQ 0687 | 0.03324 | 1.301 | 0.243 |
| lnc-EFR3B-7:2 | SEQ 0362 | 0.01727 | 0.821 | 0.785 |
| lnc-EGFR-7:1 | SEQ 0917 | 0.0449 | 1.181 | 0.257 |
| lnc-EIF2AK3-31:7 | SEQ 0918 | 0.0449 | 0.848 | 0.743 |
| lnc-EIF2AK3-4:81 | SEQ 0688 | 0.03324 | 1.466 | 0.243 |
| lnc-ELF1-5:1 | SEQ 0510 | 0.02418 | 0.799 | 0.771 |
| lnc-ELFN2-1:3 | SEQ 0080 | 0.00364 | 0.764 | 0.84 |
| lnc-EPB42-1:3 | SEQ 0689 | 0.03324 | 0.917 | 0.757 |
| lnc-EPHA7-3:1 | SEQ 0081 | 0.00364 | 0.763 | 0.84 |
| lnc-ERCC6L2-10:2 | SEQ 0605 | 0.02842 | 0.927 | 0.764 |
| lnc-ERCC6L2-6:1 | SEQ 0363 | 0.01727 | 1.784 | 0.215 |
| lnc-ERFE-1:1 | SEQ 0919 | 0.0449 | 0.489 | 0.743 |
| lnc-ERGIC2-2:2 | SEQ 0364 | 0.01727 | 0.799 | 0.785 |
| lnc-ERH-1:1 | SEQ 0424 | 0.02049 | 0.708 | 0.778 |
| lnc-ERICH1-9:1 | SEQ 0920 | 0.0449 | 0.85 | 0.743 |
| lnc-ERV3-1-9:1 | SEQ 0203 | 0.00829 | 1.32 | 0.188 |
| lnc-ESRP1-2:4 | SEQ 0315 | 0.01449 | 0.542 | 0.792 |
| lnc-ETS1-2:2 | SEQ 0082 | 0.00364 | 1.436 | 0.16 |
| lnc-EXOC2-21:6 | SEQ 0204 | 0.00829 | 1.528 | 0.188 |
| lnc-EZH2-3:1 | SEQ 0273 | 0.01209 | 0.79 | 0.799 |

TABLE 1-continued

The Sequence number, p value, mean +/− SD, fold change and
AUC of the 1008 serum lncRNAs with differential expression in
AD group versus healthy control group (p value <0.05, Wilcoxon test)

| lncRNA | SEQ | p value | Fold change | AUC |
|---|---|---|---|---|
| lnc-F11-8:1 | SEQ 0690 | 0.03324 | 0.876 | 0.757 |
| lnc-F13A1-2:7 | SEQ 0691 | 0.03324 | 1.485 | 0.243 |
| lnc-FAM133B-2:1 | SEQ 0036 | 0.00143 | 0.767 | 0.868 |
| lnc-FAM171B-1:6 | SEQ 0205 | 0.00829 | 0.851 | 0.813 |
| lnc-FAM19A3-6:3 | SEQ 0274 | 0.01209 | 0.75 | 0.799 |
| lnc-FAM217A-1:2 | SEQ 0032 | 0.00111 | 0.854 | 0.875 |
| lnc-FAM231B-2:1 | SEQ 0511 | 0.02418 | 1.252 | 0.229 |
| lnc-FAM231B-2:2 | SEQ 0512 | 0.02418 | 1.252 | 0.229 |
| lnc-FAM236D-2:1 | SEQ 0692 | 0.03324 | 0.601 | 0.757 |
| lnc-FAM46C-3:1 | SEQ 0794 | 0.03872 | 0.755 | 0.75 |
| lnc-FAM49B-8:1 | SEQ 0010 | 0.0005 | 1.758 | 0.104 |
| lnc-FAM71F2-5:1 | SEQ 0425 | 0.02049 | 0.642 | 0.778 |
| lnc-FAM72B-6:3 | SEQ 0606 | 0.02842 | 1.327 | 0.236 |
| lnc-FAM84A-5:1 | SEQ 0607 | 0.02842 | 0.697 | 0.764 |
| lnc-FAM84B-17:4 | SEQ 0608 | 0.02842 | 0.741 | 0.764 |
| lnc-FAM84B-4:3 | SEQ 0083 | 0.00364 | 0.803 | 0.84 |
| lnc-FAP-3:1 | SEQ 0206 | 0.00829 | 0.749 | 0.813 |
| lnc-FARSB-6:1 | SEQ 0232 | 0.01004 | 1.292 | 0.194 |
| lnc-FAT1-7:2 | SEQ 0017 | 0.00066 | 1.383 | 0.111 |
| lnc-FAT4-6:1 | SEQ 0609 | 0.02842 | 0.751 | 0.764 |
| lnc-FBRSL1-3:3 | SEQ 0610 | 0.02842 | 1.645 | 0.236 |
| lnc-FCGR3B-4:11 | SEQ 0513 | 0.02418 | 0.848 | 0.771 |
| lnc-FCGR3B-4:12 | SEQ 0514 | 0.02418 | 0.848 | 0.771 |
| lnc-FER1L6-2:1 | SEQ 0515 | 0.02418 | 0.779 | 0.771 |
| lnc-FGD4-8:1 | SEQ 0233 | 0.01004 | 0.688 | 0.806 |
| lnc-FGD4-9:1 | SEQ 0084 | 0.00364 | 0.711 | 0.84 |
| lnc-FILIP1L-3:1 | SEQ 0058 | 0.00232 | 0.867 | 0.854 |
| lnc-FNBP1L-1:11 | SEQ 0006 | 0.00027 | 0.743 | 0.91 |
| lnc-FOXC1-6:2 | SEQ 0516 | 0.02418 | 0.736 | 0.771 |
| lnc-FOXD4L5-35:1 | SEQ 0152 | 0.00681 | 1.878 | 0.181 |
| lnc-FOXO1-2:8 | SEQ 0611 | 0.02842 | 1.402 | 0.236 |
| lnc-FRG2-13:3 | SEQ 0275 | 0.01209 | 0.908 | 0.799 |
| lnc-FSIP1-6:4 | SEQ 0795 | 0.03872 | 1.401 | 0.25 |
| lnc-FSIP2-2:1 | SEQ 0921 | 0.0449 | 0.76 | 0.743 |
| lnc-FTCD-5:1 | SEQ 0796 | 0.03872 | 0.722 | 0.75 |
| lnc-FTMT-2:14 | SEQ 0517 | 0.02418 | 0.792 | 0.771 |
| lnc-GALC-9:8 | SEQ 0234 | 0.01004 | 0.557 | 0.806 |
| lnc-GALNT2-1:1 | SEQ 0426 | 0.02049 | 0.729 | 0.778 |
| lnc-GALNTL5-3:1 | SEQ 0693 | 0.03324 | 0.759 | 0.757 |
| lnc-GCLC-1:13 | SEQ 0922 | 0.0449 | 0.597 | 0.743 |
| lnc-GDPD5-6:1 | SEQ 0153 | 0.00681 | 0.799 | 0.819 |
| lnc-GFI1B-2:3 | SEQ 0797 | 0.03872 | 0.681 | 0.75 |
| lnc-GGH-3:1 | SEQ 0798 | 0.03872 | 0.782 | 0.75 |
| lnc-GHR-1:1 | SEQ 0003 | 0.0002 | 0.787 | 0.917 |
| lnc-GJC1-2:2 | SEQ 0799 | 0.03872 | 0.832 | 0.75 |
| lnc-GJC1-2:3 | SEQ 0800 | 0.03872 | 0.832 | 0.75 |
| lnc-GLIPR1-3:2 | SEQ 0923 | 0.0449 | 0.923 | 0.743 |
| lnc-GLIPR1L1-2:3 | SEQ 0427 | 0.02049 | 1.26 | 0.222 |
| lnc-GMDS-6:8 | SEQ 0694 | 0.03324 | 0.721 | 0.757 |
| lnc-GNG5-8:1 | SEQ 0695 | 0.03324 | 0.771 | 0.757 |
| lnc-GOLGA4-4:7 | SEQ 0365 | 0.01727 | 0.855 | 0.785 |
| lnc-GOLGA6L6-9:1 | SEQ 0069 | 0.00291 | 0.711 | 0.847 |
| lnc-GOLGA8F-2:1 | SEQ 0235 | 0.01004 | 0.756 | 0.806 |
| lnc-GOLGA80-5:6 | SEQ 0428 | 0.02049 | 0.715 | 0.778 |
| lnc-GPAT4-1:3 | SEQ 0316 | 0.01449 | 1.56 | 0.208 |
| lnc-GPATCH11-1:1 | SEQ 0612 | 0.02842 | 0.703 | 0.764 |
| lnc-GPATCH2L-2:1 | SEQ 0317 | 0.01449 | 0.85 | 0.792 |
| lnc-GPC2-2:5 | SEQ 0518 | 0.02418 | 1.355 | 0.229 |
| lnc-GPR157-6:1 | SEQ 0924 | 0.0449 | 0.827 | 0.743 |
| lnc-GPR161-4:1 | SEQ 0070 | 0.0029 | 0.726 | 0.847 |
| lnc-GPR27-18:1 | SEQ 0925 | 0.0449 | 0.774 | 0.743 |
| lnc-GPR33-14:1 | SEQ 0236 | 0.01004 | 0.828 | 0.806 |
| lnc-GPR37-1:1 | SEQ 0926 | 0.0449 | 0.793 | 0.743 |
| lnc-GPR39-10:2 | SEQ 0154 | 0.00681 | 1.393 | 0.181 |
| lnc-GPRC5A-4:1 | SEQ 0613 | 0.02842 | 0.717 | 0.764 |
| lnc-GPRC6A-2:1 | SEQ 0927 | 0.0449 | 0.865 | 0.743 |
| lnc-GPSM1-3:3 | SEQ 0928 | 0.0449 | 0.64 | 0.743 |
| lnc-GRAMD2B-4:1 | SEQ 0801 | 0.03872 | 0.879 | 0.75 |
| lnc-GRIP1-1:2 | SEQ 0429 | 0.02049 | 1.564 | 0.222 |
| lnc-GRIP1-5:2 | SEQ 0519 | 0.02418 | 0.914 | 0.771 |
| lnc-GRIP1-8:1 | SEQ 0802 | 0.03872 | 1.339 | 0.25 |
| lnc-GRM1-1:19 | SEQ 0929 | 0.0449 | 1.338 | 0.257 |
| lnc-GRM1-1:31 | SEQ 0155 | 0.00681 | 0.864 | 0.819 |
| lnc-GRM1-1:32 | SEQ 0156 | 0.00681 | 0.864 | 0.819 |

TABLE 1-continued

The Sequence number, p value, mean +/− SD, fold change and
AUC of the 1008 serum lncRNAs with differential expression in
AD group versus healthy control group (p value <0.05, Wilcoxon test)

| lncRNA | SEQ | p value | Fold change | AUC |
|---|---|---|---|---|
| lnc-GRM8-2:2 | SEQ 0430 | 0.02049 | 0.902 | 0.778 |
| lnc-GSN-2:4 | SEQ 0930 | 0.0449 | 0.94 | 0.743 |
| lnc-GSN-2:5 | SEQ 0803 | 0.03872 | 0.955 | 0.75 |
| lnc-GTDC1-28:5 | SEQ 0157 | 0.00681 | 0.725 | 0.819 |
| lnc-GUCY1A3-1:1 | SEQ 0520 | 0.02418 | 0.724 | 0.771 |
| lnc-GUSB-1:1 | SEQ 0931 | 0.0449 | 0.829 | 0.743 |
| lnc-HECA-3:13 | SEQ 0237 | 0.01004 | 0.8 | 0.806 |
| lnc-HECA-6:1 | SEQ 0007 | 0.00037 | 0.723 | 0.903 |
| lnc-HELT-6:1 | SEQ 0932 | 0.0449 | 0.784 | 0.743 |
| lnc-HHATL-2:1 | SEQ 0933 | 0.0449 | 1.127 | 0.257 |
| lnc-HHLA2-2:1 | SEQ 0696 | 0.03324 | 1.238 | 0.243 |
| lnc-HJURP-7:1 | SEQ 0431 | 0.02049 | 0.776 | 0.778 |
| lnc-HLCS-5:1 | SEQ 0238 | 0.01004 | 0.866 | 0.806 |
| lnc-HMG20A-1:2 | SEQ 0432 | 0.02049 | 0.513 | 0.778 |
| lnc-HMGA1-2:3 | SEQ 0804 | 0.03872 | 1.288 | 0.25 |
| lnc-HMGN1-2:1 | SEQ 0433 | 0.02049 | 1.424 | 0.222 |
| lnc-HOMEZ-4:1 | SEQ 0434 | 0.02049 | 0.848 | 0.778 |
| lnc-HOXC4-1:3 | SEQ 0805 | 0.03872 | 0.845 | 0.75 |
| lnc-HS3ST3A1-1:1 | SEQ 0239 | 0.01004 | 0.75 | 0.806 |
| lnc-HS6ST1-8:1 | SEQ 0697 | 0.03324 | 1.344 | 0.243 |
| lnc-HSCB-7:1 | SEQ 0614 | 0.02842 | 0.742 | 0.764 |
| lnc-HSD17B11-2:1 | SEQ 0276 | 0.01209 | 0.792 | 0.799 |
| lnc-IFRD2-6:1 | SEQ 0806 | 0.03872 | 1.31 | 0.25 |
| lnc-IFT80-8:1 | SEQ 0934 | 0.0449 | 0.916 | 0.743 |
| lnc-IL6-8:4 | SEQ 0318 | 0.01449 | 0.77 | 0.792 |
| lnc-IPO5-7:1 | SEQ 0521 | 0.02418 | 0.869 | 0.771 |
| lnc-IQCF6-2:3 | SEQ 0807 | 0.03872 | 2.026 | 0.25 |
| lnc-IRF2BP2-11:3 | SEQ 0103 | 0.00451 | 1.403 | 0.167 |
| lnc-IRF6-1:1 | SEQ 0808 | 0.03872 | 0.894 | 0.75 |
| lnc-IRS1-2:5 | SEQ 0615 | 0.02842 | 1.878 | 0.236 |
| lnc-IRS1-6:1 | SEQ 0037 | 0.00143 | 0.804 | 0.868 |
| lnc-IRS1-7:3 | SEQ 0522 | 0.02418 | 1.153 | 0.229 |
| lnc-IRX2-10:1 | SEQ 0698 | 0.03324 | 0.744 | 0.757 |
| lnc-ITGB8-2:8 | SEQ 0616 | 0.02842 | 0.805 | 0.764 |
| lnc-JMJD4-2:1 | SEQ 0435 | 0.02049 | 0.736 | 0.778 |
| lnc-JRK-2:1 | SEQ 0935 | 0.0449 | 1.162 | 0.257 |
| lnc-JRK-2:2 | SEQ 0699 | 0.03324 | 0.764 | 0.757 |
| lnc-KAT5-2:1 | SEQ 0936 | 0.0449 | 0.769 | 0.743 |
| lnc-KBTBD7-1:1 | SEQ 0523 | 0.02418 | 0.742 | 0.771 |
| lnc-KBTBD8-4:3 | SEQ 0366 | 0.01727 | 1.457 | 0.215 |
| lnc-KCNA1-1:23 | SEQ 0122 | 0.00556 | 0.633 | 0.826 |
| lnc-KCND3-1:1 | SEQ 0085 | 0.00364 | 0.808 | 0.84 |
| lnc-KCNE1B-15:1 | SEQ 0319 | 0.01449 | 0.823 | 0.792 |
| lnc-KCNS3-9:1 | SEQ 0320 | 0.01449 | 1.265 | 0.208 |
| lnc-KCTD13-3:1 | SEQ 0700 | 0.03324 | 0.709 | 0.757 |
| lnc-KCTD19-1:1 | SEQ 0701 | 0.03324 | 0.761 | 0.757 |
| lnc-KDM3A-1:4 | SEQ 0104 | 0.00451 | 0.731 | 0.833 |
| lnc-KDM8-3:1 | SEQ 0436 | 0.02049 | 0.758 | 0.778 |
| lnc-KIAA0141-3:1 | SEQ 0702 | 0.03324 | 1.15 | 0.243 |
| lnc-KIF21B-2:1 | SEQ 0937 | 0.0449 | 0.873 | 0.743 |
| lnc-KIN-5:1 | SEQ 0703 | 0.03324 | 0.835 | 0.757 |
| lnc-KLF11-1:8 | SEQ 0704 | 0.03324 | 0.286 | 0.757 |
| lnc-KLF12-4:1 | SEQ 0938 | 0.0449 | 0.806 | 0.743 |
| lnc-KLF12-7:1 | SEQ 0240 | 0.01004 | 0.88 | 0.806 |
| lnc-KLHL24-2:1 | SEQ 0321 | 0.01449 | 1.206 | 0.208 |
| lnc-KLK2-4:3 | SEQ 0524 | 0.02418 | 0.881 | 0.771 |
| lnc-KLRG1-8:1 | SEQ 0809 | 0.03872 | 1.222 | 0.25 |
| lnc-KREMEN2-1:1 | SEQ 0705 | 0.03324 | 1.279 | 0.243 |
| lnc-KRR1-4:7 | SEQ 0706 | 0.03324 | 0.801 | 0.757 |
| lnc-KY-4:1 | SEQ 0123 | 0.00556 | 0.708 | 0.826 |
| lnc-L3MBTL2-1:1 | SEQ 0367 | 0.01727 | 1.259 | 0.215 |
| lnc-LARP1B-1:15 | SEQ 0277 | 0.01209 | 0.786 | 0.799 |
| lnc-LARP1B-1:17 | SEQ 0278 | 0.01209 | 0.786 | 0.799 |
| lnc-LARP1B-1:18 | SEQ 0279 | 0.01209 | 1.214 | 0.201 |
| lnc-LARP4-6:1 | SEQ 0368 | 0.01727 | 0.803 | 0.785 |
| lnc-LBH-4:1 | SEQ 0707 | 0.03324 | 1.312 | 0.243 |
| lnc-LBX1-1:1 | SEQ 0241 | 0.01004 | 0.788 | 0.806 |
| lnc-LEPROTL1-12:1 | SEQ 0011 | 0.0005 | 0.749 | 0.896 |
| lnc-LIMS3-1:10 | SEQ 0086 | 0.00364 | 2.27 | 0.16 |
| lnc-LINC00675-1:3 | SEQ 0810 | 0.03872 | 0.669 | 0.75 |
| lnc-LINS1-2:1 | SEQ 0811 | 0.03872 | 0.81 | 0.75 |
| lnc-LMBRD1-5:17 | SEQ 0812 | 0.03872 | 0.574 | 0.75 |
| lnc-LMX1A-2:1 | SEQ 0708 | 0.03324 | 0.786 | 0.757 |
| lnc-LONP2-6:10 | SEQ 0280 | 0.01209 | 0.912 | 0.799 |

TABLE 1-continued

The Sequence number, p value, mean +/− SD, fold change and
AUC of the 1008 serum lncRNAs with differential expression in
AD group versus healthy control group (p value <0.05, Wilcoxon test)

| lncRNA | SEQ | p value | Fold change | AUC |
|---|---|---|---|---|
| lnc-LRCH1-1:1 | SEQ 0437 | 0.02049 | 0.793 | 0.778 |
| lnc-LRP12-4:3 | SEQ 0939 | 0.0449 | 1.165 | 0.257 |
| lnc-LRP5L-2:14 | SEQ 0940 | 0.0449 | 1.203 | 0.257 |
| lnc-LRR1-1:2 | SEQ 0813 | 0.03872 | 0.729 | 0.75 |
| lnc-LRR1-1:3 | SEQ 0814 | 0.03872 | 0.725 | 0.75 |
| lnc-LRRC1-5:2 | SEQ 0087 | 0.00364 | 0.649 | 0.84 |
| lnc-LRRC3B-1:3 | SEQ 0941 | 0.0449 | 0.463 | 0.743 |
| lnc-LRRC41-3:2 | SEQ 0942 | 0.0449 | 1.272 | 0.257 |
| lnc-LRRC4C-7:1 | SEQ 0815 | 0.03872 | 0.818 | 0.75 |
| lnc-LRRFIP2-3:4 | SEQ 0617 | 0.02842 | 0.74 | 0.764 |
| lnc-LRRK1-3:4 | SEQ 0242 | 0.01004 | 0.79 | 0.806 |
| lnc-LRRK2-1:10 | SEQ 0369 | 0.01727 | 0.86 | 0.785 |
| lnc-LRRK2-1:9 | SEQ 0370 | 0.01727 | 0.86 | 0.785 |
| lnc-LRRTM4-3:2 | SEQ 0618 | 0.02842 | 0.865 | 0.764 |
| lnc-LY9-3:1 | SEQ 0207 | 0.00829 | 1.317 | 0.188 |
| lnc-LYN-8:1 | SEQ 0619 | 0.02842 | 1.516 | 0.236 |
| lnc-MAFB-1:4 | SEQ 0525 | 0.02418 | 0.839 | 0.771 |
| lnc-MAMDC2-1:1 | SEQ 0526 | 0.02418 | 0.828 | 0.771 |
| lnc-MAML3-2:1 | SEQ 0438 | 0.02049 | 0.768 | 0.778 |
| lnc-MAN1A1-1:3 | SEQ 0158 | 0.00681 | 0.722 | 0.819 |
| lnc-MAP9-6:1 | SEQ 0281 | 0.01209 | 0.741 | 0.799 |
| lnc-MARCH4-2:7 | SEQ 0088 | 0.00364 | 2 | 0.16 |
| lnc-MARCKS-1:9 | SEQ 0527 | 0.02418 | 0.717 | 0.771 |
| lnc-MASTL-2:1 | SEQ 0943 | 0.0449 | 0.756 | 0.743 |
| lnc-MB-3:1 | SEQ 0944 | 0.0449 | 1.302 | 0.257 |
| lnc-MBP-16:2 | SEQ 0208 | 0.00829 | 1.204 | 0.188 |
| lnc-MC5R-5:1 | SEQ 0945 | 0.0449 | 0.742 | 0.743 |
| lnc-MC5R-6:2 | SEQ 0243 | 0.01004 | 0.626 | 0.806 |
| lnc-MDM4-8:1 | SEQ 0816 | 0.03872 | 0.791 | 0.75 |
| lnc-ME3-1:1 | SEQ 0946 | 0.0449 | 1.353 | 0.257 |
| lnc-MED10-23:1 | SEQ 0209 | 0.00829 | 1.295 | 0.188 |
| lnc-MED15-1:2 | SEQ 0620 | 0.02842 | 1.191 | 0.236 |
| lnc-MESD-6:1 | SEQ 0947 | 0.0449 | 0.762 | 0.743 |
| lnc-MEST-6:1 | SEQ 0124 | 0.00556 | 0.817 | 0.826 |
| lnc-METTL22-11:1 | SEQ 0709 | 0.03324 | 0.747 | 0.757 |
| lnc-MFSD8-6:3 | SEQ 0528 | 0.02418 | 0.845 | 0.771 |
| lnc-MFSD8-6:8 | SEQ 0371 | 0.01727 | 0.794 | 0.785 |
| lnc-MGST3-1:3 | SEQ 0043 | 0.00183 | 1.664 | 0.139 |
| lnc-MIB1-1:1 | SEQ 0159 | 0.00681 | 0.68 | 0.819 |
| lnc-MNX1-10:1 | SEQ 0322 | 0.01449 | 1.204 | 0.208 |
| lnc-MOGAT1-3:2 | SEQ 0948 | 0.0449 | 0.703 | 0.743 |
| lnc-MPLKIP-3:1 | SEQ 0710 | 0.03324 | 0.867 | 0.757 |
| lnc-MPP4-3:1 | SEQ 0817 | 0.03872 | 0.813 | 0.75 |
| lnc-MRC2-2:1 | SEQ 0818 | 0.03872 | 0.835 | 0.75 |
| lnc-MRGPRD-2:1 | SEQ 0244 | 0.01004 | 0.79 | 0.806 |
| lnc-MRGPRF-4:4 | SEQ 0105 | 0.00451 | 0.604 | 0.833 |
| lnc-MROH7-2:1 | SEQ 0529 | 0.02418 | 0.844 | 0.771 |
| lnc-MRPL57-5:8 | SEQ 0621 | 0.02842 | 0.855 | 0.764 |
| lnc-MRPS30-13:1 | SEQ 0819 | 0.03872 | 0.814 | 0.75 |
| lnc-MSH2-3:2 | SEQ 0711 | 0.03324 | 1.401 | 0.243 |
| lnc-MTRNR2L1-3:1 | SEQ 0530 | 0.02418 | 1.325 | 0.229 |
| lnc-MVB12B-6:1 | SEQ 0531 | 0.02418 | 0.811 | 0.771 |
| lnc-MYC-12:1 | SEQ 0622 | 0.02842 | 1.418 | 0.236 |
| lnc-MYO18B-2:3 | SEQ 0323 | 0.01449 | 0.833 | 0.792 |
| lnc-MYO18B-3:3 | SEQ 0160 | 0.00681 | 0.762 | 0.819 |
| lnc-MYOCOS-2:1 | SEQ 0439 | 0.02049 | 0.891 | 0.778 |
| lnc-NAA38-3:1 | SEQ 0532 | 0.02418 | 0.854 | 0.771 |
| lnc-NAALADL2-8:1 | SEQ 0324 | 0.01449 | 0.864 | 0.792 |
| lnc-NANOS1-3:1 | SEQ 0712 | 0.03324 | 1.277 | 0.243 |
| lnc-NAXD-6:5 | SEQ 0125 | 0.00556 | 0.479 | 0.826 |
| lnc-NBPF14-1:2 | SEQ 0089 | 0.00364 | 0.815 | 0.84 |
| lnc-NBPF14-3:1 | SEQ 0623 | 0.02842 | 0.889 | 0.764 |
| lnc-NCR3LG1-3:1 | SEQ 0018 | 0.00066 | 0.837 | 0.889 |
| lnc-NDFIP2-7:13 | SEQ 0820 | 0.03872 | 0.775 | 0.75 |
| lnc-NDFIP2-7:14 | SEQ 0440 | 0.02049 | 0.77 | 0.778 |
| lnc-NDRG2-5:1 | SEQ 0949 | 0.0449 | 0.773 | 0.743 |
| lnc-NDUFA10-6:1 | SEQ 0161 | 0.00681 | 0.712 | 0.819 |
| lnc-NDUFB9-2:2 | SEQ 0713 | 0.03324 | 1.345 | 0.243 |
| lnc-NDUFS6-15:1 | SEQ 0950 | 0.0449 | 0.805 | 0.743 |
| lnc-NEUROD2-4:1 | SEQ 0071 | 0.00291 | 0.772 | 0.847 |
| lnc-NKAIN2-5:1 | SEQ 0821 | 0.03872 | 0.794 | 0.75 |
| lnc-NKX6-1-2:1 | SEQ 0282 | 0.01209 | 0.773 | 0.799 |
| lnc-NOC2L-1:21 | SEQ 0245 | 0.01004 | 1.382 | 0.194 |
| lnc-NOC2L-12:1 | SEQ 0372 | 0.01727 | 1.479 | 0.215 |

TABLE 1-continued

The Sequence number, p value, mean +/− SD, fold change and
AUC of the 1008 serum lncRNAs with differential expression in
AD group versus healthy control group (p value <0.05, Wilcoxon test)

| lncRNA | SEQ | p value | Fold change | AUC |
|---|---|---|---|---|
| lnc-NOS2-7:1 | SEQ 0951 | 0.0449 | 1.203 | 0.257 |
| lnc-NPBWR1-2:2 | SEQ 0952 | 0.0449 | 1.517 | 0.257 |
| lnc-NPIPB12-1:1 | SEQ 0822 | 0.03872 | 1.13 | 0.25 |
| lnc-NPY5R-4:1 | SEQ 0823 | 0.03872 | 0.817 | 0.75 |
| lnc-NR2E1-4:4 | SEQ 0714 | 0.03324 | 0.688 | 0.757 |
| lnc-NR5A2-1:13 | SEQ 0441 | 0.02049 | 0.908 | 0.778 |
| lnc-NRP1-4:1 | SEQ 0953 | 0.0449 | 1.258 | 0.257 |
| lnc-NUB1-4:1 | SEQ 0126 | 0.00556 | 0.809 | 0.826 |
| lnc-NUP35-4:2 | SEQ 0715 | 0.03324 | 0.858 | 0.757 |
| lnc-NUTM1-14:4 | SEQ 0716 | 0.03324 | 0.638 | 0.757 |
| lnc-NUTM2B-3:1 | SEQ 0533 | 0.02418 | 0.801 | 0.771 |
| lnc-NUTM2E-1:5 | SEQ 0127 | 0.00556 | 0.849 | 0.826 |
| lnc-ODF1-5:2 | SEQ 0325 | 0.01449 | 0.847 | 0.792 |
| lnc-ODF1-9:1 | SEQ 0824 | 0.03872 | 0.806 | 0.75 |
| lnc-OPRK1-2:1 | SEQ 0717 | 0.03324 | 0.826 | 0.757 |
| lnc-OR10AD1-1:1 | SEQ 0624 | 0.02842 | 0.826 | 0.764 |
| lnc-OR13C4-8:1 | SEQ 0625 | 0.02842 | 0.806 | 0.764 |
| lnc-OR4F21-7:9 | SEQ 0283 | 0.01209 | 0.761 | 0.799 |
| lnc-OR4F29-3:11 | SEQ 0044 | 0.00183 | 0.85 | 0.861 |
| lnc-OR4F29-8:4 | SEQ 0210 | 0.00829 | 0.633 | 0.813 |
| lnc-OR5H2-1:2 | SEQ 0326 | 0.01449 | 0.768 | 0.792 |
| lnc-OR6S1-2:1 | SEQ 0373 | 0.01727 | 0.857 | 0.785 |
| lnc-OR8G5-7:2 | SEQ 0626 | 0.02842 | 0.763 | 0.764 |
| lnc-ORAOV1-3:3 | SEQ 0442 | 0.02049 | 0.895 | 0.778 |
| lnc-OSBPL6-1:1 | SEQ 0443 | 0.02049 | 1.366 | 0.222 |
| lnc-OSBPL7-3:3 | SEQ 0534 | 0.02418 | 0.855 | 0.771 |
| lnc-OSBPL7-3:4 | SEQ 0535 | 0.02418 | 0.855 | 0.771 |
| lnc-OSBPL7-3:6 | SEQ 0536 | 0.02418 | 0.855 | 0.771 |
| lnc-OSBPL7-5:1 | SEQ 0162 | 0.00681 | 1.685 | 0.181 |
| lnc-OST4-6:2 | SEQ 0954 | 0.0449 | 0.774 | 0.743 |
| lnc-OXGR1-6:2 | SEQ 0374 | 0.01727 | 1.987 | 0.215 |
| lnc-OXGR1-6:3 | SEQ 0163 | 0.00681 | 0.861 | 0.819 |
| lnc-OXR1-1:1 | SEQ 0627 | 0.02842 | 0.752 | 0.764 |
| lnc-P2RY2-11:1 | SEQ 0537 | 0.02418 | 0.86 | 0.771 |
| lnc-PABPC1-3:1 | SEQ 0444 | 0.02049 | 0.814 | 0.778 |
| lnc-PABPC4L-21:3 | SEQ 0375 | 0.01727 | 1.485 | 0.215 |
| lnc-PABPC4L-5:7 | SEQ 0284 | 0.01209 | 0.626 | 0.799 |
| lnc-PACRGL-5:1 | SEQ 0718 | 0.03324 | 0.64 | 0.757 |
| lnc-PAGR1-2:4 | SEQ 0719 | 0.03324 | 1.176 | 0.243 |
| lnc-PALLD-3:1 | SEQ 0164 | 0.00681 | 0.741 | 0.819 |
| lnc-PAN3-3:1 | SEQ 0955 | 0.0449 | 0.758 | 0.743 |
| lnc-PANK1-7:1 | SEQ 0211 | 0.00829 | 0.723 | 0.813 |
| lnc-PAPD7-2:3 | SEQ 0956 | 0.0449 | 0.786 | 0.743 |
| lnc-PAPPA-1:3 | SEQ 0720 | 0.03324 | 2.192 | 0.243 |
| lnc-PAPPA-1:4 | SEQ 0721 | 0.03324 | 0.814 | 0.757 |
| lnc-PAPPA2-1:10 | SEQ 0246 | 0.01004 | 0.753 | 0.806 |
| lnc-PAPPA2-7:1 | SEQ 0165 | 0.00681 | 0.839 | 0.819 |
| lnc-PATE2-1:1 | SEQ 0247 | 0.01004 | 0.728 | 0.806 |
| lnc-PAX8-6:2 | SEQ 0538 | 0.02418 | 1.413 | 0.229 |
| lnc-PAXIP1-8:1 | SEQ 0957 | 0.0449 | 0.731 | 0.743 |
| lnc-PCDH10-11:1 | SEQ 0958 | 0.0449 | 0.719 | 0.743 |
| lnc-PCDH8-12:1 | SEQ 0166 | 0.00681 | 0.742 | 0.819 |
| lnc-PCOLCE2-1:1 | SEQ 0959 | 0.0449 | 0.909 | 0.743 |
| lnc-PCSK9-4:6 | SEQ 0327 | 0.01449 | 1.154 | 0.208 |
| lnc-PCSK9-4:9 | SEQ 0328 | 0.01449 | 1.154 | 0.208 |
| lnc-PDLIM1-3:1 | SEQ 0960 | 0.0449 | 0.837 | 0.743 |
| lnc-PFKP-16:15 | SEQ 0628 | 0.02842 | 0.662 | 0.764 |
| lnc-PFKP-17:1 | SEQ 0445 | 0.02049 | 0.834 | 0.778 |
| lnc-PHF14-14:19 | SEQ 0825 | 0.03872 | 0.678 | 0.75 |
| lnc-PIGB-1:5 | SEQ 0539 | 0.02418 | 0.691 | 0.771 |
| lnc-PIGM-4:1 | SEQ 0248 | 0.01004 | 0.715 | 0.806 |
| lnc-PINX1-7:1 | SEQ 0329 | 0.01449 | 1.307 | 0.208 |
| lnc-PLA2G2F-1:2 | SEQ 0285 | 0.01209 | 1.224 | 0.201 |
| lnc-PLA2G4A-7:5 | SEQ 0446 | 0.02049 | 0.865 | 0.778 |
| lnc-PLA2G4A-7:8 | SEQ 0826 | 0.03872 | 0.74 | 0.75 |
| lnc-PLAT-1:3 | SEQ 0961 | 0.0449 | 0.738 | 0.743 |
| lnc-PLCB1-7:2 | SEQ 0827 | 0.03872 | 0.854 | 0.75 |
| lnc-PLEKHA8-3:5 | SEQ 0962 | 0.0449 | 0.793 | 0.743 |
| lnc-PLK1-1:6 | SEQ 0963 | 0.0449 | 0.663 | 0.743 |
| lnc-PLN-2:1 | SEQ 0722 | 0.03324 | 0.781 | 0.757 |
| lnc-PLSCR2-2:1 | SEQ 0964 | 0.0449 | 0.813 | 0.743 |
| lnc-POC5-3:1 | SEQ 0629 | 0.02842 | 0.747 | 0.764 |
| lnc-POLE4-3:1 | SEQ 0330 | 0.01449 | 0.798 | 0.792 |
| lnc-POU2AF1-1:2 | SEQ 0447 | 0.02049 | 0.874 | 0.778 |

TABLE 1-continued

The Sequence number, p value, mean +/− SD, fold change and
AUC of the 1008 serum lncRNAs with differential expression in
AD group versus healthy control group (p value <0.05, Wilcoxon test)

| lncRNA | SEQ | p value | Fold change | AUC |
| --- | --- | --- | --- | --- |
| lnc-PPIAL4F-3:2 | SEQ 0828 | 0.03872 | 1.302 | 0.25 |
| lnc-PPM1D-1:8 | SEQ 0540 | 0.02418 | 0.8 | 0.771 |
| lnc-PPP2R3C-4:1 | SEQ 0025 | 0.00086 | 0.879 | 0.882 |
| lnc-PPP5C-4:1 | SEQ 0723 | 0.03324 | 0.757 | 0.757 |
| lnc-PRDM9-19:2 | SEQ 0829 | 0.03872 | 0.709 | 0.75 |
| lnc-PRDM9-20:1 | SEQ 0376 | 0.01727 | 0.678 | 0.785 |
| lnc-PRELID2-1:2 | SEQ 0541 | 0.02418 | 1.232 | 0.229 |
| lnc-PRKACG-1:2 | SEQ 0724 | 0.03324 | 0.738 | 0.757 |
| lnc-PRKACG-2:1 | SEQ 0630 | 0.02842 | 1.186 | 0.236 |
| lnc-PRKCH-1:1 | SEQ 0286 | 0.01209 | 0.904 | 0.799 |
| lnc-PRKN-8:1 | SEQ 0212 | 0.00829 | 1.368 | 0.188 |
| lnc-PRND-2:1 | SEQ 0287 | 0.01209 | 0.798 | 0.799 |
| lnc-PRR11-1:4 | SEQ 0288 | 0.01209 | 0.862 | 0.799 |
| lnc-PRR5-5:1 | SEQ 0167 | 0.00681 | 0.703 | 0.819 |
| lnc-PRSS54-2:2 | SEQ 0168 | 0.00681 | 0.769 | 0.819 |
| lnc-PSMB1-6:4 | SEQ 0331 | 0.01449 | 2.134 | 0.208 |
| lnc-PTDSS1-1:2 | SEQ 0448 | 0.02049 | 1.246 | 0.222 |
| lnc-PTP4A2-1:2 | SEQ 0725 | 0.03324 | 1.223 | 0.243 |
| lnc-PTPN14-11:1 | SEQ 0449 | 0.02049 | 1.341 | 0.222 |
| lnc-PTPN4-1:1 | SEQ 0631 | 0.02842 | 0.755 | 0.764 |
| lnc-QRFP-5:1 | SEQ 0019 | 0.00066 | 2.17 | 0.111 |
| lnc-RAB3B-1:1 | SEQ 0965 | 0.0449 | 0.843 | 0.743 |
| lnc-RAB6C-3:1 | SEQ 0966 | 0.0449 | 0.836 | 0.743 |
| lnc-RAI14-3:1 | SEQ 0542 | 0.02418 | 0.835 | 0.771 |
| lnc-RALGAPA1-1:2 | SEQ 0726 | 0.03324 | 0.86 | 0.757 |
| lnc-RALGAPA2-2:4 | SEQ 0967 | 0.0449 | 0.805 | 0.743 |
| lnc-RARRES1-3:2 | SEQ 0632 | 0.02842 | 0.84 | 0.764 |
| lnc-RASGRP1-3:3 | SEQ 0968 | 0.0449 | 0.796 | 0.743 |
| lnc-RBFOX1-2:1 | SEQ 0377 | 0.01727 | 1.269 | 0.215 |
| lnc-RBKS-6:1 | SEQ 0128 | 0.00556 | 0.802 | 0.826 |
| lnc-RBM11-11:1 | SEQ 0450 | 0.02049 | 0.714 | 0.778 |
| lnc-RBM25-1:1 | SEQ 0969 | 0.0449 | 0.89 | 0.743 |
| lnc-RBM33-3:1 | SEQ 0727 | 0.03324 | 0.762 | 0.757 |
| lnc-RBM45-7:1 | SEQ 0830 | 0.03872 | 0.792 | 0.75 |
| lnc-RBMS1-7:1 | SEQ 0249 | 0.01004 | 0.778 | 0.806 |
| lnc-RCSD1-4:1 | SEQ 0831 | 0.03872 | 0.831 | 0.75 |
| lnc-RDH13-1:2 | SEQ 0250 | 0.01004 | 0.635 | 0.806 |
| lnc-RGMA-28:2 | SEQ 0378 | 0.01727 | 0.875 | 0.785 |
| lnc-RGS9-15:6 | SEQ 0970 | 0.0449 | 0.705 | 0.743 |
| lnc-RHNO1-1:1 | SEQ 0026 | 0.00086 | 1.248 | 0.118 |
| lnc-RHOB-1:3 | SEQ 0451 | 0.02049 | 0.612 | 0.778 |
| lnc-RHOB-21:1 | SEQ 0971 | 0.0449 | 0.817 | 0.743 |
| lnc-RHOBTB2-4:1 | SEQ 0213 | 0.00829 | 0.839 | 0.813 |
| lnc-RIPPLY3-1:3 | SEQ 0832 | 0.03872 | 0.889 | 0.75 |
| lnc-RIT2-5:1 | SEQ 0289 | 0.01209 | 1.302 | 0.201 |
| lnc-RNF6-2:1 | SEQ 0059 | 0.00232 | 0.692 | 0.854 |
| lnc-RNFT2-1:5 | SEQ 0379 | 0.01727 | 0.8 | 0.785 |
| lnc-RNLS-1:1 | SEQ 0972 | 0.0449 | 0.829 | 0.743 |
| lnc-ROBO2-16:1 | SEQ 0251 | 0.01004 | 0.799 | 0.806 |
| lnc-RPE65-4:2 | SEQ 0129 | 0.00556 | 0.857 | 0.826 |
| lnc-RPIA-25:1 | SEQ 0130 | 0.00556 | 0.866 | 0.826 |
| lnc-RPL10L-5:1 | SEQ 0452 | 0.02049 | 0.77 | 0.778 |
| lnc-RPL24-6:1 | SEQ 0728 | 0.03324 | 1.245 | 0.243 |
| lnc-RPL35-2:1 | SEQ 0543 | 0.02418 | 0.812 | 0.771 |
| lnc-RPL37-2:1 | SEQ 0214 | 0.00829 | 1.309 | 0.188 |
| lnc-RPRM-7:1 | SEQ 0380 | 0.01727 | 0.679 | 0.785 |
| lnc-RPS12-4:1 | SEQ 0633 | 0.02842 | 0.806 | 0.764 |
| lnc-RPS21-4:2 | SEQ 0027 | 0.00086 | 0.664 | 0.882 |
| lnc-RRM1-2:5 | SEQ 0973 | 0.0449 | 0.934 | 0.743 |
| lnc-RSL1D1-2:1 | SEQ 0215 | 0.00829 | 0.762 | 0.813 |
| lnc-RTL1-3:9 | SEQ 0544 | 0.02418 | 0.848 | 0.771 |
| lnc-RUBCN-1:1 | SEQ 0833 | 0.03872 | 0.788 | 0.75 |
| lnc-S1PR1-13:1 | SEQ 0381 | 0.01727 | 0.686 | 0.785 |
| lnc-SAMD11-1:1 | SEQ 0729 | 0.03324 | 1.247 | 0.243 |
| lnc-SAMD5-1:10 | SEQ 0090 | 0.00364 | 0.708 | 0.84 |
| lnc-SC5D-4:1 | SEQ 0730 | 0.03324 | 1.249 | 0.243 |
| lnc-SCD-7:1 | SEQ 0974 | 0.0449 | 0.731 | 0.743 |
| lnc-SCGB1C2-8:1 | SEQ 0975 | 0.0449 | 0.776 | 0.743 |
| lnc-SCNN1B-3:1 | SEQ 0976 | 0.0449 | 1.155 | 0.257 |
| lnc-SCTR-2:4 | SEQ 0634 | 0.02842 | 0.852 | 0.764 |
| lnc-SEPT14-6:1 | SEQ 0545 | 0.02418 | 0.878 | 0.771 |
| lnc-SERHL2-1:8 | SEQ 0546 | 0.02418 | 1.483 | 0.229 |
| lnc-SERINC1-8:3 | SEQ 0731 | 0.03324 | 0.827 | 0.757 |
| lnc-SERP1-4:6 | SEQ 0072 | 0.00291 | 0.719 | 0.847 |

TABLE 1-continued

The Sequence number, p value, mean +/− SD, fold change and AUC of the 1008 serum lncRNAs with differential expression in AD group versus healthy control group (p value <0.05, Wilcoxon test)

| lncRNA | SEQ | p value | Fold change | AUC |
|---|---|---|---|---|
| lnc-SERP1-4:8 | SEQ 0977 | 0.0449 | 0.831 | 0.743 |
| lnc-SERPINI1-14:1 | SEQ 0978 | 0.0449 | 0.85 | 0.743 |
| lnc-SERTM1-1:1 | SEQ 0290 | 0.01209 | 0.817 | 0.799 |
| lnc-SFPQ-2:1 | SEQ 0169 | 0.00681 | 0.72 | 0.819 |
| lnc-SGCG-7:2 | SEQ 0453 | 0.02049 | 0.733 | 0.778 |
| lnc-SGK1-3:14 | SEQ 0979 | 0.0449 | 1.836 | 0.257 |
| lnc-SGMS1-4:1 | SEQ 0834 | 0.03872 | 0.793 | 0.75 |
| lnc-SH3BGRL2-4:1 | SEQ 0980 | 0.0449 | 1.174 | 0.257 |
| lnc-SKIL-2:3 | SEQ 0981 | 0.0449 | 1.222 | 0.257 |
| lnc-SLC1A3-1:1 | SEQ 0547 | 0.02418 | 0.791 | 0.771 |
| lnc-SLC22A23-11:2 | SEQ 0732 | 0.03324 | 1.239 | 0.243 |
| lnc-SLC25A21-1:1 | SEQ 0733 | 0.03324 | 0.77 | 0.757 |
| lnc-SLC25A24-2:1 | SEQ 0548 | 0.02418 | 0.883 | 0.771 |
| lnc-SLC25A30-2:4 | SEQ 0291 | 0.01209 | 1.539 | 0.201 |
| lnc-SLC2A10-1:1 | SEQ 0549 | 0.02418 | 0.788 | 0.771 |
| lnc-SLC38A2-1:11 | SEQ 0252 | 0.01004 | 0.892 | 0.806 |
| lnc-SLC38A2-1:15 | SEQ 0332 | 0.01449 | 1.425 | 0.208 |
| lnc-SLC39A11-10:11 | SEQ 0292 | 0.01209 | 4.38 | 0.201 |
| lnc-SLC46A3-7:1 | SEQ 0550 | 0.02418 | 0.858 | 0.771 |
| lnc-SLCO6A1-2:1 | SEQ 0635 | 0.02842 | 0.775 | 0.764 |
| lnc-SLITRK5-17:1 | SEQ 0293 | 0.01209 | 0.636 | 0.799 |
| lnc-SLTM-1:2 | SEQ 0982 | 0.0449 | 0.9 | 0.743 |
| lnc-SMARCA5-4:18 | SEQ 0253 | 0.01004 | 0.825 | 0.806 |
| lnc-SMIM14-4:1 | SEQ 0454 | 0.02049 | 0.788 | 0.778 |
| lnc-SMIM17-5:4 | SEQ 0734 | 0.03324 | 0.715 | 0.757 |
| lnc-SNAPC3-12:5 | SEQ 0455 | 0.02049 | 1.387 | 0.222 |
| lnc-SNCA-3:1 | SEQ 0551 | 0.02418 | 0.498 | 0.771 |
| lnc-SNRPB2-2:4 | SEQ 0254 | 0.01004 | 1.727 | 0.194 |
| lnc-SNX10-6:1 | SEQ 0636 | 0.02842 | 0.764 | 0.764 |
| lnc-SNX13-2:6 | SEQ 0456 | 0.02049 | 1.576 | 0.222 |
| lnc-SNX16-6:1 | SEQ 0983 | 0.0449 | 0.83 | 0.743 |
| lnc-SNX17-1:13 | SEQ 0333 | 0.01449 | 1.985 | 0.208 |
| lnc-SNX17-1:8 | SEQ 0984 | 0.0449 | 0.754 | 0.743 |
| lnc-SNX19-6:1 | SEQ 0835 | 0.03872 | 1.249 | 0.25 |
| lnc-SNX19-9:1 | SEQ 0836 | 0.03872 | 0.837 | 0.75 |
| lnc-SNX20-8:5 | SEQ 0985 | 0.0449 | 0.933 | 0.743 |
| lnc-SOX11-5:1 | SEQ 0382 | 0.01727 | 1.216 | 0.215 |
| lnc-SOX14-2:1 | SEQ 0045 | 0.00183 | 0.837 | 0.861 |
| lnc-SPAG9-2:1 | SEQ 0383 | 0.01727 | 0.851 | 0.785 |
| lnc-SPAG9-2:2 | SEQ 0384 | 0.01727 | 0.851 | 0.785 |
| lnc-SPATA31A6-10:1 | SEQ 0837 | 0.03872 | 0.804 | 0.75 |
| lnc-SPATA31D4-1:6 | SEQ 0838 | 0.03872 | 0.718 | 0.75 |
| lnc-SPP1-1:1 | SEQ 0046 | 0.00183 | 0.846 | 0.861 |
| lnc-SPRY1-9:1 | SEQ 0839 | 0.03872 | 0.767 | 0.75 |
| lnc-SPTSSA-5:2 | SEQ 0552 | 0.02418 | 1.31 | 0.229 |
| lnc-SRCIN1-1:18 | SEQ 0553 | 0.02418 | 0.798 | 0.771 |
| lnc-SRSF2-2:5 | SEQ 0735 | 0.03324 | 0.633 | 0.757 |
| lnc-ST8SIA4-3:5 | SEQ 0457 | 0.02049 | 1.584 | 0.222 |
| lnc-STARD10-1:6 | SEQ 0840 | 0.03872 | 1.156 | 0.25 |
| lnc-STAT1-2:3 | SEQ 0986 | 0.0449 | 0.832 | 0.743 |
| lnc-STK32B-2:1 | SEQ 0170 | 0.00681 | 0.807 | 0.819 |
| lnc-STOML3-6:1 | SEQ 0038 | 0.00143 | 0.731 | 0.868 |
| lnc-STPG1-1:1 | SEQ 0637 | 0.02842 | 0.82 | 0.764 |
| lnc-STRADB-6:2 | SEQ 0987 | 0.0449 | 0.723 | 0.743 |
| lnc-SUCLA2-13:2 | SEQ 0736 | 0.03324 | 1.22 | 0.243 |
| lnc-SUCLA2-13:3 | SEQ 0737 | 0.03324 | 1.22 | 0.243 |
| lnc-SUGT1-3:1 | SEQ 0131 | 0.00556 | 2.047 | 0.174 |
| lnc-SULT1A4-1:27 | SEQ 0841 | 0.03872 | 1.274 | 0.25 |
| lnc-SULT1C2-3:1 | SEQ 0842 | 0.03872 | 1.396 | 0.25 |
| lnc-SUSD1-1:5 | SEQ 0638 | 0.02842 | 0.798 | 0.764 |
| lnc-SYCP1-4:1 | SEQ 0843 | 0.03872 | 1.204 | 0.25 |
| lnc-TAAR9-3:2 | SEQ 0738 | 0.03324 | 0.806 | 0.757 |
| lnc-TAB2-1:4 | SEQ 0988 | 0.0449 | 0.846 | 0.743 |
| lnc-TACC2-8:6 | SEQ 0171 | 0.00681 | 0.869 | 0.819 |
| lnc-TACSTD2-2:4 | SEQ 0020 | 0.00066 | 0.757 | 0.889 |
| lnc-TADA2B-6:1 | SEQ 0554 | 0.02418 | 1.467 | 0.229 |
| lnc-TAF9-10:1 | SEQ 0639 | 0.02842 | 0.825 | 0.764 |
| lnc-TASP1-11:1 | SEQ 0989 | 0.0449 | 1.217 | 0.257 |
| lnc-TBC1D22A-4:12 | SEQ 0739 | 0.03324 | 0.969 | 0.757 |
| lnc-TBC1D3H-1:1 | SEQ 0334 | 0.01449 | 0.729 | 0.792 |
| lnc-TBC1D3H-3:1 | SEQ 0294 | 0.01209 | 0.72 | 0.799 |
| lnc-TBL1XR1-7:1 | SEQ 0458 | 0.02049 | 0.754 | 0.778 |
| lnc-TCEANC2-3:1 | SEQ 0106 | 0.00451 | 0.549 | 0.833 |
| lnc-TCEANC2-3:2 | SEQ 0385 | 0.01727 | 1.882 | 0.215 |

TABLE 1-continued

The Sequence number, p value, mean +/− SD, fold change and
AUC of the 1008 serum lncRNAs with differential expression in
AD group versus healthy control group (p value <0.05, Wilcoxon test)

| lncRNA | SEQ | p value | Fold change | AUC |
| --- | --- | --- | --- | --- |
| lnc-TCF19-1:80 | SEQ 0740 | 0.03324 | 1.351 | 0.243 |
| lnc-TCF7-1:3 | SEQ 0990 | 0.0449 | 0.866 | 0.743 |
| lnc-TCP10-2:1 | SEQ 0991 | 0.0449 | 0.876 | 0.743 |
| lnc-TCP11-2:3 | SEQ 0640 | 0.02842 | 0.67 | 0.764 |
| lnc-TCP11L2-1:4 | SEQ 0741 | 0.03324 | 0.74 | 0.757 |
| lnc-TDO2-6:1 | SEQ 0641 | 0.02842 | 0.758 | 0.764 |
| lnc-TDP2-1:1 | SEQ 0335 | 0.01449 | 1.29 | 0.208 |
| lnc-TEAD4-1:1 | SEQ 0992 | 0.0449 | 1.868 | 0.257 |
| lnc-TEFM-10:2 | SEQ 0993 | 0.0449 | 0.736 | 0.743 |
| lnc-TEKT3-3:1 | SEQ 0844 | 0.03872 | 0.744 | 0.75 |
| lnc-TEKT4-4:1 | SEQ 0132 | 0.00556 | 1.332 | 0.174 |
| lnc-TENM3-3:3 | SEQ 0001 | 0.00007 | 0.717 | 0.938 |
| lnc-TENM3-3:4 | SEQ 0008 | 0.00037 | 1.947 | 0.097 |
| lnc-TENM3-3:5 | SEQ 0009 | 0.00037 | 1.993 | 0.097 |
| lnc-TENM4-4:1 | SEQ 0742 | 0.03324 | 2.209 | 0.243 |
| lnc-TEX10-1:1 | SEQ 0459 | 0.02049 | 0.814 | 0.778 |
| lnc-TEX29-3:1 | SEQ 0172 | 0.00681 | 0.767 | 0.819 |
| lnc-TEX49-4:1 | SEQ 0994 | 0.0449 | 0.789 | 0.743 |
| lnc-TF-4:1 | SEQ 0743 | 0.03324 | 0.898 | 0.757 |
| lnc-TFCP2L1-6:1 | SEQ 0460 | 0.02049 | 0.743 | 0.778 |
| lnc-TGM6-2:1 | SEQ 0216 | 0.00829 | 0.741 | 0.813 |
| lnc-THAP12-1:5 | SEQ 0642 | 0.02842 | 1.427 | 0.236 |
| lnc-THOC5-3:1 | SEQ 0133 | 0.00556 | 0.717 | 0.826 |
| lnc-THY1-3:1 | SEQ 0995 | 0.0449 | 0.788 | 0.743 |
| lnc-THYN1-1:1 | SEQ 0461 | 0.02049 | 1.173 | 0.222 |
| lnc-TLDC2-4:1 | SEQ 0555 | 0.02418 | 1.214 | 0.229 |
| lnc-TLE4-7:1 | SEQ 0255 | 0.01004 | 1.184 | 0.194 |
| lnc-TLK1-1:2 | SEQ 0556 | 0.02418 | 0.76 | 0.771 |
| lnc-TLNRD1-3:1 | SEQ 0462 | 0.02049 | 0.829 | 0.778 |
| lnc-TMEM126B-2:3 | SEQ 0336 | 0.01449 | 0.508 | 0.792 |
| lnc-TMEM126B-2:4 | SEQ 0643 | 0.02842 | 1.964 | 0.236 |
| lnc-TMEM132C-6:5 | SEQ 0996 | 0.0449 | 1.222 | 0.257 |
| lnc-TMEM168-1:1 | SEQ 0073 | 0.00291 | 0.761 | 0.847 |
| lnc-TMEM185B-12:1 | SEQ 0173 | 0.00681 | 0.549 | 0.819 |
| lnc-TMEM185B-12:7 | SEQ 0060 | 0.00232 | 1.694 | 0.146 |
| lnc-TMEM185B-2:3 | SEQ 0386 | 0.01727 | 1.212 | 0.215 |
| lnc-TMEM211-2:8 | SEQ 0644 | 0.02842 | 1.278 | 0.236 |
| lnc-TMEM242-6:1 | SEQ 0463 | 0.02049 | 0.879 | 0.778 |
| lnc-TMEM248-4:11 | SEQ 0845 | 0.03872 | 0.842 | 0.75 |
| lnc-TMEM70-7:1 | SEQ 0217 | 0.00829 | 1.404 | 0.188 |
| lnc-TMX4-3:1 | SEQ 0464 | 0.02049 | 0.776 | 0.778 |
| lnc-TNFRSF19-2:1 | SEQ 0744 | 0.03324 | 1.177 | 0.243 |
| lnc-TNFSF4-3:3 | SEQ 0337 | 0.01449 | 1.714 | 0.208 |
| lnc-TOGARAM2-1:5 | SEQ 0645 | 0.02842 | 0.81 | 0.764 |
| lnc-TOGARAM2-1:6 | SEQ 0646 | 0.02842 | 0.81 | 0.764 |
| lnc-TP53TG3-65:1 | SEQ 0465 | 0.02049 | 1.227 | 0.222 |
| lnc-TP53TG3D-2:1 | SEQ 0846 | 0.03872 | 0.9 | 0.75 |
| lnc-TP53TG3F-8:1 | SEQ 0647 | 0.02842 | 1.33 | 0.236 |
| lnc-TPPP-1:2 | SEQ 0002 | 0.00014 | 0.158 | 0.924 |
| lnc-TPPP-1:3 | SEQ 0134 | 0.00556 | 1.834 | 0.174 |
| lnc-TRAM1-1:1 | SEQ 0074 | 0.00291 | 0.59 | 0.847 |
| lnc-TRIB2-14:1 | SEQ 0021 | 0.00066 | 0.788 | 0.889 |
| lnc-TRIM13-2:1 | SEQ 0174 | 0.00681 | 0.739 | 0.819 |
| lnc-TRIM26-2:33 | SEQ 0745 | 0.03324 | 0.782 | 0.757 |
| lnc-TRIM26-2:74 | SEQ 0338 | 0.01449 | 1.231 | 0.208 |
| lnc-TRIM27-10:2 | SEQ 0107 | 0.00451 | 1.227 | 0.167 |
| lnc-TRIM37-2:1 | SEQ 0997 | 0.0449 | 1.221 | 0.257 |
| lnc-TRIM43B-1:2 | SEQ 0387 | 0.01727 | 0.8 | 0.785 |
| lnc-TRIM49D1-4:1 | SEQ 0175 | 0.00681 | 1.36 | 0.181 |
| lnc-TRIM77-7:1 | SEQ 0847 | 0.03872 | 0.741 | 0.75 |
| lnc-TRIML2-11:1 | SEQ 0557 | 0.02418 | 1.296 | 0.229 |
| lnc-TRMT11-4:1 | SEQ 0218 | 0.00829 | 0.773 | 0.813 |
| lnc-TRPM1-3:1 | SEQ 0388 | 0.01727 | 0.83 | 0.785 |
| lnc-TSC22D2-1:4 | SEQ 0466 | 0.02049 | 0.633 | 0.778 |
| lnc-TSHB-2:3 | SEQ 0295 | 0.01209 | 0.564 | 0.799 |
| lnc-TSHB-2:4 | SEQ 0467 | 0.02049 | 1.766 | 0.222 |
| lnc-TSHB-2:5 | SEQ 0468 | 0.02049 | 1.766 | 0.222 |
| lnc-TSHB-2:6 | SEQ 0296 | 0.01209 | 0.564 | 0.799 |
| lnc-TSR3-1:2 | SEQ 0339 | 0.01449 | 0.784 | 0.792 |
| lnc-TSTD2-4:3 | SEQ 0848 | 0.03872 | 1.229 | 0.25 |
| lnc-TTC26-9:1 | SEQ 0558 | 0.02418 | 0.686 | 0.771 |
| lnc-TTC38-7:1 | SEQ 0849 | 0.03872 | 1.169 | 0.25 |
| lnc-TTF2-4:1 | SEQ 0998 | 0.0449 | 0.848 | 0.743 |
| lnc-TUBA1C-1:12 | SEQ 0999 | 0.0449 | 0.731 | 0.743 |

TABLE 1-continued

The Sequence number, p value, mean +/− SD, fold change and AUC of the 1008 serum lncRNAs with differential expression in AD group versus healthy control group (p value <0.05, Wilcoxon test)

| lncRNA | SEQ | p value | Fold change | AUC |
|---|---|---|---|---|
| lnc-TUBE1-6:1 | SEQ 0850 | 0.03872 | 1.141 | 0.25 |
| lnc-TUBGCP3-11:1 | SEQ 0469 | 0.02049 | 0.885 | 0.778 |
| lnc-TUSC5-3:1 | SEQ 1000 | 0.0449 | 1.345 | 0.257 |
| lnc-TWSG1-2:1 | SEQ 0047 | 0.00183 | 0.673 | 0.861 |
| lnc-UBE2QL1-4:1 | SEQ 0648 | 0.02842 | 0.864 | 0.764 |
| lnc-UBE3C-10:1 | SEQ 0075 | 0.00291 | 1.627 | 0.153 |
| lnc-UBLCP1-2:6 | SEQ 0048 | 0.00183 | 0.755 | 0.861 |
| lnc-UCK1-2:1 | SEQ 0851 | 0.03872 | 0.774 | 0.75 |
| lnc-UGCG-1:1 | SEQ 0219 | 0.00829 | 0.802 | 0.813 |
| lnc-UGT1A8-3:1 | SEQ 0649 | 0.02842 | 1.428 | 0.236 |
| lnc-UGT2B28-1:2 | SEQ 1001 | 0.0449 | 0.818 | 0.743 |
| lnc-UGT2B28-2:1 | SEQ 0559 | 0.02418 | 0.764 | 0.771 |
| lnc-UGT3A2-3:1 | SEQ 0389 | 0.01727 | 0.855 | 0.785 |
| lnc-UNC93B1-1:5 | SEQ 1002 | 0.0449 | 0.806 | 0.743 |
| lnc-UNCX-3:26 | SEQ 0470 | 0.02049 | 0.493 | 0.778 |
| lnc-UPK3B-7:1 | SEQ 0297 | 0.01209 | 0.607 | 0.799 |
| lnc-USP16-15:1 | SEQ 0650 | 0.02842 | 0.811 | 0.764 |
| lnc-USP16-9:3 | SEQ 0091 | 0.00364 | 0.834 | 0.84 |
| lnc-USP17L7-1:1 | SEQ 0746 | 0.03324 | 1.48 | 0.243 |
| lnc-USP24-2:3 | SEQ 0747 | 0.03324 | 0.694 | 0.757 |
| lnc-USP31-2:3 | SEQ 0022 | 0.00066 | 0.685 | 0.889 |
| lnc-USP53-1:1 | SEQ 0390 | 0.01727 | 0.824 | 0.785 |
| lnc-USP6NL-13:1 | SEQ 0748 | 0.03324 | 1.209 | 0.243 |
| lnc-VGLL3-11:1 | SEQ 0220 | 0.00829 | 0.81 | 0.813 |
| lnc-VPS8-2:4 | SEQ 0852 | 0.03872 | 0.742 | 0.75 |
| lnc-VSTM2B-5:12 | SEQ 0560 | 0.02418 | 0.771 | 0.771 |
| lnc-VWA5B1-2:1 | SEQ 0391 | 0.01727 | 1.479 | 0.215 |
| lnc-WDR4-2:6 | SEQ 1003 | 0.0449 | 0.929 | 0.743 |
| lnc-WDR63-6:2 | SEQ 0471 | 0.02049 | 0.655 | 0.778 |
| lnc-WDR70-7:6 | SEQ 1004 | 0.0449 | 0.929 | 0.743 |
| lnc-WDR7-11:1 | SEQ 0749 | 0.03324 | 1.151 | 0.243 |
| lnc-WDYHV1-1:2 | SEQ 0561 | 0.02418 | 0.912 | 0.771 |
| lnc-WISP1-17:2 | SEQ 0135 | 0.00556 | 0.715 | 0.826 |
| lnc-WSB1-2:1 | SEQ 0256 | 0.01004 | 1.293 | 0.194 |
| lnc-XCL2-4:1 | SEQ 1005 | 0.0449 | 0.714 | 0.743 |
| lnc-XXYLT1-5:1 | SEQ 0221 | 0.00829 | 0.681 | 0.813 |
| lnc-YPEL5-5:1 | SEQ 0750 | 0.03324 | 1.357 | 0.243 |
| lnc-ZC3H12D-2:3 | SEQ 0392 | 0.01727 | 0.831 | 0.785 |
| lnc-ZC3H15-2:1 | SEQ 0012 | 0.0005 | 0.765 | 0.896 |
| lnc-ZFAT-1:3 | SEQ 0562 | 0.02418 | 0.907 | 0.771 |
| lnc-ZFAT-1:8 | SEQ 0393 | 0.01727 | 0.841 | 0.785 |
| lnc-ZFC3H1-16:2 | SEQ 0651 | 0.02842 | 0.789 | 0.764 |
| lnc-ZFP57-15:1 | SEQ 0177 | 0.00701 | 0.402 | 0.826 |
| lnc-ZFP90-3:6 | SEQ 0563 | 0.02418 | 0.739 | 0.771 |
| lnc-ZMYM2-7:1 | SEQ 0853 | 0.03872 | 1.335 | 0.25 |
| lnc-ZNF107-7:1 | SEQ 0652 | 0.02842 | 0.735 | 0.764 |
| lnc-ZNF124-1:2 | SEQ 0564 | 0.02418 | 0.827 | 0.771 |
| lnc-ZNF189-2:1 | SEQ 0751 | 0.03324 | 0.903 | 0.757 |
| lnc-ZNF25-7:1 | SEQ 0257 | 0.01004 | 1.37 | 0.194 |
| lnc-ZNF25-9:4 | SEQ 0298 | 0.01209 | 0.663 | 0.799 |
| lnc-ZNF273-4:4 | SEQ 0092 | 0.00364 | 0.742 | 0.84 |
| lnc-ZNF330-2:1 | SEQ 0854 | 0.03872 | 0.833 | 0.75 |
| lnc-ZNF33A-14:1 | SEQ 0049 | 0.00183 | 1.499 | 0.139 |
| lnc-ZNF33A-8:1 | SEQ 1006 | 0.0449 | 1.115 | 0.257 |
| lnc-ZNF33B-3:11 | SEQ 1007 | 0.0449 | 0.846 | 0.743 |
| lnc-ZNF33B-6:1 | SEQ 0394 | 0.01727 | 2.524 | 0.215 |
| lnc-ZNF33B-6:3 | SEQ 0299 | 0.01209 | 0.825 | 0.799 |
| lnc-ZNF385C-4:1 | SEQ 0472 | 0.02049 | 1.311 | 0.222 |
| lnc-ZNF423-3:3 | SEQ 1008 | 0.0449 | 1.258 | 0.257 |

TABLE 1-continued

The Sequence number, p value, mean +/− SD, fold change and
AUC of the 1008 serum lncRNAs with differential expression in
AD group versus healthy control group (p value <0.05, Wilcoxon test)

| lncRNA | SEQ | p value | Fold change | AUC |
|---|---|---|---|---|
| lnc-ZNF430-3:1 | SEQ 0855 | 0.03872 | 0.797 | 0.75 |
| lnc-ZNF430-3:4 | SEQ 0258 | 0.01004 | 0.788 | 0.806 |
| lnc-ZNF442-1:2 | SEQ 0061 | 0.00232 | 0.683 | 0.854 |
| lnc-ZNF460-2:1 | SEQ 0473 | 0.02049 | 0.842 | 0.778 |
| lnc-ZNF506-5:2 | SEQ 0108 | 0.00451 | 0.684 | 0.833 |
| lnc-ZNF544-2:1 | SEQ 0474 | 0.02049 | 0.805 | 0.778 |
| lnc-ZNF573-2:2 | SEQ 0856 | 0.03872 | 0.823 | 0.75 |
| lnc-ZNF624-4:3 | SEQ 0395 | 0.01727 | 1.241 | 0.215 |
| lnc-ZNF654-3:1 | SEQ 0857 | 0.03872 | 0.869 | 0.75 |
| lnc-ZNF720-5:3 | SEQ 0222 | 0.00829 | 1.313 | 0.188 |
| lnc-ZNF724-6:1 | SEQ 0176 | 0.00681 | 0.729 | 0.819 |
| lnc-ZNF726-1:3 | SEQ 0259 | 0.01004 | 2.115 | 0.194 |
| lnc-ZNF827-2:1 | SEQ 0653 | 0.02842 | 0.924 | 0.764 |
| lnc-ZNF99-3:2 | SEQ 0396 | 0.01727 | 0.751 | 0.785 |
| lnc-ZRANB2-2:1 | SEQ 0654 | 0.02842 | 0.801 | 0.764 |
| lnc-ZSWIM2-15:1 | SEQ 0655 | 0.02842 | 0.696 | 0.764 |
| lnc-ZWINT-2:4 | SEQ 0565 | 0.02418 | 0.637 | 0.771 |
| LRP4-AS1:5 | SEQ 0766 | 0.03872 | 1.288 | 0.25 |
| LYRM4-AS1:17 | SEQ 0485 | 0.02418 | 0.893 | 0.771 |
| MAPT-AS1:1 | SEQ 0767 | 0.03872 | 0.785 | 0.75 |
| MCPH1-AS1:2 | SEQ 0308 | 0.01449 | 1.321 | 0.208 |
| MDC1-AS1:5 | SEQ 0486 | 0.02418 | 1.248 | 0.229 |
| MEF2C-AS1:25 | SEQ 0582 | 0.02842 | 0.907 | 0.764 |
| MIR155HG:7 | SEQ 0876 | 0.0449 | 0.606 | 0.743 |
| MIR29B2CHG:33 | SEQ 0583 | 0.02842 | 0.624 | 0.764 |
| MIR29B2CHG:46 | SEQ 0181 | 0.00829 | 1.522 | 0.188 |
| MIR31HG:9 | SEQ 0768 | 0.03872 | 0.835 | 0.75 |
| MIR4290HG:1 | SEQ 0405 | 0.02049 | 0.773 | 0.778 |
| MIR9-3HG:29 | SEQ 0769 | 0.03872 | 0.557 | 0.75 |
| MIR99AHG:104 | SEQ 0096 | 0.00451 | 0.871 | 0.833 |
| MIR99AHG:37 | SEQ 0584 | 0.02842 | 0.879 | 0.764 |
| MIR99AHG:46 | SEQ 0877 | 0.0449 | 2.516 | 0.257 |
| NAV2-AS5:1 | SEQ 0051 | 0.00232 | 1.302 | 0.146 |
| NAV2-AS5:2 | SEQ 0052 | 0.00232 | 1.302 | 0.146 |
| NBAT1:11 | SEQ 0347 | 0.01727 | 1.738 | 0.215 |
| NIFK-AS1:25 | SEQ 0487 | 0.02418 | 0.846 | 0.771 |
| NUTM2A-AS1:49 | SEQ 0182 | 0.00829 | 0.633 | 0.813 |
| NUTM2B-AS1:40 | SEQ 0348 | 0.01727 | 0.74 | 0.785 |
| NUTM2B-AS1:53 | SEQ 0004 | 0.00027 | 0.655 | 0.91 |
| PACRG-AS3:1 | SEQ 0666 | 0.03324 | 1.162 | 0.243 |
| PCBP1-AS1:250 | SEQ 0770 | 0.03872 | 1.266 | 0.25 |
| PITRM1-AS1:10 | SEQ 0488 | 0.02418 | 1.274 | 0.229 |
| PTPRG-AS1:14 | SEQ 0183 | 0.00829 | 0.625 | 0.813 |
| PURPL:13 | SEQ 0585 | 0.02842 | 1.386 | 0.236 |
| RAPGEF4-AS1:1 | SEQ 0878 | 0.0449 | 0.824 | 0.743 |
| RFX3-AS1:22 | SEQ 0586 | 0.02842 | 0.819 | 0.764 |
| RORB-AS1:6 | SEQ 0116 | 0.00556 | 0.845 | 0.826 |
| SCHLAP1:9 | SEQ 0144 | 0.00681 | 0.8 | 0.819 |
| SEC24B-AS1:19 | SEQ 0406 | 0.02049 | 1.852 | 0.222 |
| SLC16A12-AS1:1 | SEQ 0771 | 0.03872 | 0.773 | 0.75 |
| SMILR:3 | SEQ 0040 | 0.00183 | 1.306 | 0.139 |
| SNCA-AS1:3 | SEQ 0041 | 0.00183 | 0.777 | 0.861 |
| SPATA41:13 | SEQ 0879 | 0.0449 | 1.607 | 0.257 |
| SRGAP3-AS2:10 | SEQ 0349 | 0.01727 | 0.674 | 0.785 |
| SUCLG2-AS1:14 | SEQ 0489 | 0.02418 | 0.92 | 0.771 |
| SUCLG2-AS1:9 | SEQ 0490 | 0.02418 | 0.92 | 0.771 |
| TCL6:24 | SEQ 0066 | 0.00291 | 1.448 | 0.153 |
| TM4SF19-AS1:10 | SEQ 0184 | 0.00829 | 1.84 | 0.188 |
| TM4SF19-AS1:15 | SEQ 0491 | 0.02418 | 0.853 | 0.771 |
| TMEM9B-AS1:11 | SEQ 0185 | 0.00829 | 3.049 | 0.188 |
| TPT1-AS1:26 | SEQ 0186 | 0.00829 | 0.763 | 0.813 |
| TRIM52-AS1:24 | SEQ 0492 | 0.02418 | 1.183 | 0.229 |
| TRIM52-AS1:8 | SEQ 0587 | 0.02842 | 1.272 | 0.236 |
| TTN-AS1:79 | SEQ 0187 | 0.00829 | 0.829 | 0.813 |
| TTN-AS1:80 | SEQ 0188 | 0.00829 | 0.829 | 0.813 |
| UCA1:7 | SEQ 0078 | 0.00364 | 0.697 | 0.84 |
| UGDH-AS1:10 | SEQ 0407 | 0.02049 | 0.541 | 0.778 |
| WDR86-AS1:15 | SEQ 0588 | 0.02842 | 1.212 | 0.236 |
| WEE2-AS1:23 | SEQ 0408 | 0.02049 | 0.704 | 0.778 |
| WT1-AS:9 | SEQ 0117 | 0.00556 | 0.542 | 0.826 |
| YEATS2-AS1:3 | SEQ 0772 | 0.03872 | 0.806 | 0.75 |
| ZNF528-AS1:1 | SEQ 0773 | 0.03872 | 0.636 | 0.75 |
| ZNF529-AS1:21 | SEQ 0880 | 0.0449 | 0.819 | 0.743 |

Out of the 1008 serum lncRNAs differentially expressed with a statistical significance (p value <0.05), 33 lncRNAs showed a fold change of >2 or <0.5 and are shown in the Table 2.

TABLE 2

Mean +/− SD of the 33 serum lncRNAs that shows a differential expression with both a statistically significance (p < 0.05, Wilcoxon test) and a fold change > 2 or < 0.5

| lncRNA | p value | Fold change |
|---|---|---|
| lnc-QRFP-5:1 | 0.00066 | 2.170 |
| lnc-C21orf58-1:2 | 0.00143 | 2.231 |
| ARRDC3-AS1:7 | 0.00232 | 0.441 |
| lnc-CRYBB1-1:1 | 0.00232 | 0.487 |
| lnc-LIMS3-1:10 | 0.00364 | 2.270 |
| lnc-MARCH4-2:7 | 0.00364 | 2.000 |
| lnc-SUGT1-3:1 | 0.00556 | 2.047 |
| DARS-AS1:47 | 0.00829 | 2.015 |
| TMEM9B-AS1:11 | 0.00829 | 3.049 |
| lnc-ZNF726-1:3 | 0.01004 | 2.115 |
| lnc-SLC39A11-10:11 | 0.01209 | 4.380 |
| lnc-PSMB1-6:4 | 0.01449 | 2.134 |
| DPH6-AS1:3 | 0.01727 | 2.004 |
| lnc-ZNF33B-6:1 | 0.01727 | 2.524 |
| lnc-PAPPA-1:3 | 0.03324 | 2.192 |
| lnc-TENM4-4:1 | 0.03324 | 2.209 |
| lnc-IQCF6-2:3 | 0.03872 | 2.026 |
| MIR99AHG:46 | 0.04490 | 2.516 |
| lnc-CPM-2:11 | 0.04490 | 0.424 |
| lnc-ERFE-1:1 | 0.04490 | 0.489 |
| lnc-LRRC3B-1:3 | 0.04490 | 0.463 |
| LINC02177:8 | 0.03872 | 0.494 |
| lnc-KLF11-1:8 | 0.03324 | 0.286 |
| lnc-SNCA-3:1 | 0.02418 | 0.498 |
| lnc-UNCX-3:26 | 0.02049 | 0.493 |
| BLACAT1:5 | 0.01727 | 0.424 |
| lnc-CHD1L-5:13 | 0.01449 | 0.370 |
| lnc-EDDM13-5:11 | 0.01004 | 0.372 |
| lnc-EEF1AKMT1-3:6 | 0.00829 | 0.423 |
| FLVCR1-AS1:13 | 0.00681 | 0.413 |
| lnc-NAXD-6:5 | 0.00556 | 0.479 |
| lnc-ZFP57-15:1 | 0.00701 | 0.402 |
| lnc-TPPP-1:2 | 0.00014 | 0.158 |

Out of the 1008 serum lncRNAs differentially expressed with a statistical significance (p value <0.05), 60 lncRNAs showed an AUC of ≥0.85 and are shown in Table 3.

TABLE 3

60 serum lncRNAs with a p value < 0.05 and an individual AUC value AUC ≥ 0.85

| lncRNA | AUC |
|---|---|
| ARRDC3-AS1:7 | 0.854 |
| HAND2-AS1:70 | 0.861 |
| LINC00882:70 | 0.875 |
| LINC00882:71 | 0.875 |
| LINC01410:11 | 0.882 |
| LINC02345:11 | 0.111 |
| NAV2-AS5:1 | 0.146 |
| NAV2-AS5:2 | 0.146 |
| NUTM2B-AS1:53 | 0.910 |
| SMILR:3 | 0.139 |
| SNCA-AS1:3 | 0.861 |
| lnc-ABCA5-7:1 | 0.111 |
| lnc-ACOT12-9:1 | 0.854 |
| lnc-APLP2-4:1 | 0.854 |
| lnc-C21orf58-1:2 | 0.132 |
| lnc-CEP170-9:2 | 0.861 |
| lnc-CNDP1-7:1 | 0.882 |
| lnc-CRYBB1-1:1 | 0.854 |
| lnc-CSNK1A1-6:1 | 0.875 |
| lnc-DAZAP2-3:1 | 0.854 |
| lnc-DKK1-5:3 | 0.910 |
| lnc-DLG5-1:1 | 0.868 |
| lnc-DOCK7-7:1 | 0.889 |
| lnc-DUSP10-6:1 | 0.854 |
| lnc-DUSP26-3:2 | 0.875 |
| lnc-EBLN1-1:4 | 0.889 |
| lnc-EDDM13-5:3 | 0.132 |
| lnc-FAM133B-2:1 | 0.868 |
| lnc-FAM217A-1:2 | 0.875 |
| lnc-FAM49B-8:1 | 0.104 |
| lnc-FAT1-7:2 | 0.111 |
| lnc-FILIP1L-3:1 | 0.854 |
| lnc-FNBP1L-1:11 | 0.910 |
| lnc-GHR-1:1 | 0.917 |
| lnc-HECA-6:1 | 0.903 |
| lnc-IRS1-6:1 | 0.868 |
| lnc-LEPROTL1-12:1 | 0.896 |
| lnc-MGST3-1:3 | 0.139 |
| lnc-NCR3LG1-3:1 | 0.889 |
| lnc-OR4F29-3:11 | 0.861 |
| lnc-PPP2R3C-4:1 | 0.882 |
| lnc-QRFP-5:1 | 0.111 |
| lnc-RHNO1-1:1 | 0.118 |
| lnc-RNF6-2:1 | 0.854 |
| lnc-RPS21-4:2 | 0.882 |
| lnc-SOX14-2:1 | 0.861 |
| lnc-SPP1-1:1 | 0.861 |
| lnc-STOML3-6:1 | 0.868 |
| lnc-TACSTD2-2:4 | 0.889 |
| lnc-TENM3-3:3 | 0.938 |
| lnc-TENM3-3:4 | 0.097 |
| lnc-TENM3-3:5 | 0.097 |
| lnc-TMEM185B-12:7 | 0.146 |
| lnc-TPPP-1:2 | 0.924 |
| lnc-TRIB2-14:1 | 0.889 |
| lnc-TWSG1-2:1 | 0.861 |
| lnc-UBLCP1-2:6 | 0.861 |
| lnc-USP31-2:3 | 0.889 |
| lnc-ZC3H15-2:1 | 0.896 |
| lnc-ZNF33A-14:1 | 0.139 |
| lnc-ZNF442-1:2 | 0.854 |

The predictive modelling based on the random forest algorithm to discriminate between AD patient and healthy control populations when using the total of the 19867 serum lncRNAs analyzed, enabled to show that the AUC in function of the number of lncRNA reached a plateau with the following 13 lncRNAs. These 13 lncRNAs were used to construct the model. The results show that this lncRNA signature enabled a discrimination between the 2 populations (mild AD patient and healthy control populations) with an AUC value=0.993, an accuracy=95.8%, sensitivity=100% and specificity=91.7%.

| lncRNA | Rank |
|---|---|
| lnc-DLG5-1:1 | 1 |
| lnc-EBLN1-1:4 | 2 |
| lnc-FAT1-7:2 | 3 |
| lnc-PRR5-5:1 | 4 |
| lnc-RBKS-6:1 | 5 |
| lnc-FOXD4L5-35:1 | 6 |
| lnc-TENM3-3:3 | 7 |
| lnc-FAM133B-2:1 | 8 |
| lnc-ZNF726-1:3 | 9 |
| lnc-AP3M1-1:1 | 10 |
| lnc-DUSP10-6:1 | 11 |
| lnc-TPPP-1:2 | 12 |
| LINC01206:20 | 13 |

Out of the 1008 serum lncRNAs differentially expressed with a statistical significance (p value <0.05), the 90 lncRNAs with a fold change of >2 (or <0.5) or an AUC of ≥0.85 (or ≤0.15) were used for the predictive modelling based on the random forest algorithm. The results show that with the following 7 top ranked candidates enabled a full discrimination between AD and HV groups, with an AUC value of 100% as well as 100% accuracy, 100% sensitivity and 100% specificity.

| lncRNA | Rank |
|---|---|
| LINC02345:11 | 1 |
| lnc-EBLN1-1:4 | 2 |
| lnc-TPPP-1:2 | 3 |
| lnc-TENM3-3:3 | 4 |
| lnc-FAT1-7:2 | 5 |
| lnc-DKK1-5:3 | 6 |
| lnc-TACSTD2-2:4 | 7 |

When applying another filter considering a list of the lncRNAs which have a fold change of ≥1.6 and an AUC of ≥0.85, the use of random forest algorithm enabled to select the following 12-top ranked serum lncRNAs to construct the model and this enabled to discriminate between the AD and HV populations with still an excellent AUC=0.979, excellent accuracy of 95.8% sensitivity of 91.7% and specificity of 100%.

| lncRNA | Rank |
|---|---|
| lnc-TPPP-1:2 | 1 |
| ARRDC3-AS1:7 | 2 |
| lnc-TENM3-3:5 | 3 |
| lnc-TENM3-3:4 | 4 |
| lnc-QRFP-5:1 | 5 |
| lnc-CRYBB1-1:1 | 6 |
| lnc-MGST3-1:3 | 7 |
| lnc-FAM49B-8:1 | 8 |
| HAND2-AS1:70 | 9 |
| lnc-TMEM185B-12:7 | 10 |
| lnc-CNDP1-7:1 | 11 |
| lnc-C21orf58-1:2 | 12 |

Further to select the best serum lncRNA candidates, modeling using Random Forest algorithm was applied to a specific set of lncRNA candidates having both a statistically significant differential expression in AD patients versus healthy control populations and a good correlation (Pearson R coefficient) with scores of neurocognitive tests including MMSE and/or MOCA out of 7 neuropsychological tests performed (Table 4): The results show that the signature of the following 3 top ranked lncRNAs enabled an excellent discrimination between AD patients and healthy control populations with AUC=0.953, accuracy, sensitivity and specificity of 91.7%. 91.7% and 91.7%.

| lncRNA | Rank |
|---|---|
| lnc-TENM3-3:3 | 1 |
| lnc-MARCH4-2:7 | 2 |
| lnc-LRRC1-5:2 | 3 |

TABLE 4

Serum lncRNAs of the present invention that correlate with neurocognitive tests, MoCA, MMSE.

| Cognitive test | lncRNA | R_HV + AD | R_HV | R_AD | p value | AUC |
|---|---|---|---|---|---|---|
| MoCA | LINC00839:18 | −0.80 | 0.29 | −0.78 | 0.00556 | 0.83 |
| MoCA | LINC01087:1 | −0.74 | −0.13 | −0.89 | 0.00681 | 0.82 |
| MMSE | LINC01087:1 | −0.68 | 0.05 | −0.75 | 0.00681 | 0.82 |
| MMSE | lnc-ANAPC11-2:6 | 0.65 | 0.26 | 0.77 | 0.04490 | 0.26 |
| MoCA | lnc-ANAPC11-2:6 | 0.59 | −0.46 | 0.77 | 0.04490 | 0.26 |
| MoCA | lnc-ARHGAP26-4:33 | −0.64 | −0.66 | −0.72 | 0.03872 | 0.75 |
| MoCA | lnc-CCDC197-2:1 | −0.14 | −0.42 | 0.74 | 0.00291 | 0.85 |
| MMSE | lnc-CFAP36-3:2 | −0.62 | 0.05 | −0.75 | 0.03872 | 0.75 |
| MoCA | lnc-DHX38-25:1 | −0.69 | −0.60 | −0.77 | 0.01004 | 0.81 |
| MMSE | lnc-DHX38-25:1 | −0.65 | −0.57 | −0.71 | 0.01004 | 0.81 |
| MoCA | lnc-EZH2-3:1 | −0.69 | 0.18 | −0.78 | 0.01209 | 0.80 |
| MMSE | lnc-GNG5-8:1 | −0.72 | 0.32 | −0.71 | 0.03324 | 0.76 |
| MoCA | lnc-GPRC5A-4:1 | −0.65 | −0.02 | −0.74 | 0.02842 | 0.76 |
| MMSE | lnc-GRAMD2B-4:1 | −0.59 | 0.42 | −0.72 | 0.03872 | 0.75 |
| MMSE | lnc-GRIP1-8:1 | −0.03 | 0.30 | −0.73 | 0.03872 | 0.25 |
| MoCA | lnc-LYN-8:1 | 0.13 | 0.54 | −0.71 | 0.02842 | 0.24 |
| MMSE | lnc-MAP9-6:1 | −0.73 | −0.08 | −0.74 | 0.01209 | 0.80 |
| MMSE | lnc-NRP1-4:1 | −0.11 | 0.27 | −0.72 | 0.04490 | 0.26 |
| MoCA | lnc-RBFOX1-2:1 | 0.02 | 0.13 | −0.75 | 0.01727 | 0.22 |
| MoCA | lnc-RPL37-2:1 | 0.62 | −0.16 | 0.75 | 0.00829 | 0.19 |
| MMSE | lnc-RUBCN-1:1 | 0.11 | 0.33 | 0.72 | 0.03872 | 0.75 |
| MMSE | lnc-SNCA-3:1 | 0.08 | 0.12 | 0.76 | 0.02418 | 0.77 |
| MMSE | lnc-SRSF2-2:5 | 0.10 | 0.04 | 0.75 | 0.03324 | 0.76 |
| MoCA | lnc-SRSF2-2:5 | −0.05 | −0.32 | 0.73 | 0.03324 | 0.76 |
| MMSE | lnc-TMEM185B-12:7 | 0.06 | −0.14 | −0.73 | 0.00232 | 0.15 |
| MoCA | lnc-TRIB2-14:1 | −0.76 | −0.45 | −0.71 | 0.00066 | 0.89 |
| MMSE | lnc-TRIM43B-1:2 | −0.74 | −0.11 | −0.76 | 0.01727 | 0.78 |
| MoCA | lnc-TRIM43B-1:2 | −0.72 | −0.12 | −0.74 | 0.01727 | 0.78 |
| MMSE | lnc-ZNF189-2:1 | −0.70 | −0.35 | −0.74 | 0.03324 | 0.76 |
| MoCA | lnc-ZNF189-2:1 | −0.67 | 0.03 | −0.76 | 0.03324 | 0.76 |
| MMSE | lnc-ZRANB2-2:1 | −0.65 | −0.36 | −0.82 | 0.02842 | 0.76 |
| MoCA | lnc-ZRANB2-2:1 | −0.59 | 0.16 | −0.80 | 0.02842 | 0.76 |

R: correlation coefficient (Pearson). HV: healthy control group, AD: mild to moderate AD group Modeling using Random Forest algorithm was also applied to a specific set of serum lncRNA candidates from Table 5 having both a statistically significant differential expression in AD patients versus healthy control populations and a good correlation (Pearson) with neuroimaging scores (volume of brain structures of relevance for cognition and memory such as the mediotemporal area, left and right hippocampus, left and right amygdala, entorhinal cortex out of more than 120 structures measured): The results show that the signature of the following 7 top ranked lncRNAs enabled an excellent discrimination between AD patients and healthy control population with AUC=0.993, accuracy=95.8%, sensitivity=91.7% and specificity=100%.

| lncRNA | Rank |
| --- | --- |
| lnc-TPPP-1:2 | 1 |
| lnc-TENM3-3:3 | 2 |
| lnc-TMEM185B-12:7 | 3 |
| lnc-NAXD-6:5 | 4 |
| lnc-HECA-6:1 | 5 |
| lnc-COMMD6-10:1 | 6 |
| MIR29B2CHG:46 | 7 |

TABLE 5

Serum lncRNAs of the present invention that correlate with MRI (volumes of the brain structures).

| MRI | lncRNA | R_HV + AD | R_HV | R_AD | p value | AUC |
| --- | --- | --- | --- | --- | --- | --- |
| Left.Amygdala | CYTOR:18 | 0.71 | 0.30 | 0.69 | 0.00291 | 0.15 |
| Left.Hippocampus | DLGAP2-AS1:18 | −0.71 | −0.51 | −0.76 | 0.03324 | 0.76 |
| Left.Hippocampus | LINC00458:19 | −0.79 | −0.48 | −0.78 | 0.02842 | 0.76 |
| Mediotemporal | LINC00458:19 | −0.72 | −0.48 | −0.53 | 0.02842 | 0.76 |
| Left.Hippocampus | LINC00938:6 | −0.82 | −0.48 | −0.76 | 0.01209 | 0.80 |
| Mediotemporal | LINC00938:6 | −0.76 | −0.63 | −0.46 | 0.01209 | 0.80 |
| Right.Hippocampus | LINC00938:6 | −0.75 | −0.56 | −0.48 | 0.01209 | 0.80 |
| Left.Amygdala | LINC01629:11 | −0.78 | −0.53 | −0.83 | 0.02842 | 0.76 |
| Left.Hippocampus | lnc-AIG1-5:1 | −0.78 | −0.64 | −0.73 | 0.02418 | 0.77 |
| Left.Hippocampus | lnc-AKR1D1-5:2 | −0.74 | −0.47 | −0.69 | 0.00451 | 0.83 |
| Right.Hippocampus | lnc-AKR1D1-5:2 | −0.71 | −0.27 | −0.73 | 0.00451 | 0.83 |
| Mediotemporal | lnc-AKR1D1-5:2 | −0.71 | −0.26 | −0.72 | 0.00451 | 0.83 |
| Right.Amygdala | lnc-C3orf58-7:1 | −0.73 | −0.22 | −0.69 | 0.02842 | 0.76 |
| Left.Hippocampus | lnc-C5orf30-10:2 | −0.73 | −0.58 | −0.58 | 0.02842 | 0.76 |
| Right.Amygdala | lnc-CASP9-1:1 | 0.73 | 0.26 | 0.81 | 0.03872 | 0.25 |
| Right.Hippocampus | lnc-CHN1-5:11 | −0.72 | −0.44 | −0.67 | 0.02049 | 0.78 |
| Right.Amygdala | lnc-CLVS2-2:5 | −0.74 | −0.39 | −0.75 | 0.01727 | 0.78 |
| Left.Hippocampus | lnc-DAZAP2-3:1 | −0.72 | −0.53 | −0.58 | 0.00232 | 0.85 |
| Mediotemporal | lnc-DTWD2-14:1 | −0.75 | −0.49 | −0.79 | 0.01727 | 0.78 |
| Left.Amygdala | lnc-DTWD2-14:1 | −0.74 | −0.46 | −0.82 | 0.01727 | 0.78 |
| Ih_entorhinal | lnc-DTWD2-14:1 | −0.74 | −0.59 | −0.61 | 0.01727 | 0.78 |
| Right.Hippocampus | lnc-ELFN2-1:3 | −0.77 | −0.26 | −0.76 | 0.00364 | 0.84 |
| Left.Amygdala | lnc-ELFN2-1:3 | −0.74 | −0.27 | −0.81 | 0.00364 | 0.84 |
| Mediotemporal | lnc-ELFN2-1:3 | −0.74 | −0.22 | −0.73 | 0.00364 | 0.84 |
| Right.Amygdala | lnc-ELFN2-1:3 | −0.74 | −0.37 | −0.61 | 0.00364 | 0.84 |
| Left.Hippocampus | lnc-FAM171B-1:6 | −0.72 | −0.28 | −0.62 | 0.00829 | 0.81 |
| Left.Hippocampus | lnc-FGD4-8:1 | −0.74 | −0.49 | −0.61 | 0.01004 | 0.81 |
| Left.Amygdala | lnc-FGD4-9:1 | −0.76 | −0.49 | −0.56 | 0.00364 | 0.84 |
| Right.Hippocampus | lnc-FGD4-9:1 | −0.74 | −0.19 | −0.64 | 0.00364 | 0.84 |
| Mediotemporal | lnc-FGD4-9:1 | −0.72 | −0.28 | −0.54 | 0.00364 | 0.84 |
| Left.Hippocampus | lnc-FGD4-9:1 | −0.71 | −0.33 | −0.52 | 0.00364 | 0.84 |
| Ih_entorhinal | lnc-GPR39-10:2 | 0.77 | 0.68 | 0.49 | 0.00681 | 0.18 |
| Left.Amygdala | lnc-GPR39-10:2 | 0.72 | 0.54 | 0.37 | 0.00681 | 0.18 |
| Left.Hippocampus | lnc-GRM1-1:31 | −0.76 | −0.39 | −0.72 | 0.00681 | 0.82 |
| Right.Hippocampus | lnc-GRM1-1:31 | −0.71 | −0.38 | −0.56 | 0.00681 | 0.82 |
| Left.Hippocampus | lnc-GRM1-1:32 | −0.76 | −0.39 | −0.72 | 0.00681 | 0.82 |
| Right.Hippocampus | lnc-GRM1-1:32 | −0.71 | −0.38 | −0.56 | 0.00681 | 0.82 |
| Right.Hippocampus | lnc-HECA-3:13 | −0.72 | −0.31 | −0.67 | 0.01004 | 0.81 |
| Right.Amygdala | lnc-HJURP-7:1 | −0.77 | −0.46 | −0.77 | 0.02049 | 0.78 |
| Left.Hippocampus | lnc-HJURP-7:1 | −0.73 | −0.33 | −0.73 | 0.02049 | 0.78 |
| Right.Hippocampus | lnc-HJURP-7:1 | −0.73 | −0.02 | −0.93 | 0.02049 | 0.78 |
| Mediotemporal | lnc-HJURP-7:1 | −0.72 | −0.20 | −0.82 | 0.02049 | 0.78 |
| Left.Amygdala | lnc-IRS1-6:1 | −0.75 | −0.35 | −0.72 | 0.00143 | 0.87 |
| Right.Hippocampus | lnc-IRS1-6:1 | −0.73 | −0.36 | −0.56 | 0.00143 | 0.87 |
| Mediotemporal | lnc-IRS1-6:1 | −0.71 | −0.34 | −0.51 | 0.00143 | 0.87 |
| Right.Hippocampus | lnc-KDM3A-1:4 | −0.81 | −0.35 | −0.80 | 0.00451 | 0.83 |
| Mediotemporal | lnc-KDM3A-1:4 | −0.77 | −0.36 | −0.70 | 0.00451 | 0.83 |
| Left.Hippocampus | lnc-KDM3A-1:4 | −0.72 | −0.26 | −0.61 | 0.00451 | 0.83 |
| Left.Hippocampus | lnc-LARP1B-1:15 | −0.75 | −0.56 | −0.75 | 0.01209 | 0.80 |
| Right.Amygdala | lnc-LARP1B-1:15 | −0.75 | −0.63 | −0.71 | 0.01209 | 0.80 |
| Left.Hippocampus | lnc-LARP1B-1:17 | −0.75 | −0.56 | −0.75 | 0.01209 | 0.80 |
| Right.Amygdala | lnc-LARP1B-1:17 | −0.75 | −0.63 | −0.71 | 0.01209 | 0.80 |
| Right.Amygdala | lnc-MAMDC2-1:1 | −0.75 | −0.72 | −0.70 | 0.02418 | 0.77 |
| Left.Hippocampus | lnc-MAP9-6:1 | −0.79 | −0.43 | −0.87 | 0.01209 | 0.80 |
| Right.Hippocampus | lnc-NAALADL2-8:1 | −0.71 | −0.28 | −0.72 | 0.01449 | 0.79 |
| Right.Hippocampus | lnc-NBPF14-1:2 | −0.80 | −0.38 | −0.82 | 0.00364 | 0.84 |
| Mediotemporal | lnc-NBPF14-1:2 | −0.75 | −0.37 | −0.67 | 0.00364 | 0.84 |
| Right.Amygdala | lnc-NBPF14-1:2 | −0.73 | −0.40 | −0.60 | 0.00364 | 0.84 |

TABLE 5-continued

Serum lncRNAs of the present invention that correlate with MRI (volumes of the brain structures).

| MRI | lncRNA | R_HV + AD | R_HV | R_AD | p value | AUC |
|---|---|---|---|---|---|---|
| Left.Hippocampus | lnc-NBPF14-1:2 | −0.72 | −0.48 | −0.52 | 0.00364 | 0.84 |
| Right.Hippocampus | lnc-PIGB-1:5 | −0.73 | −0.26 | −0.79 | 0.02418 | 0.77 |
| Right.Amygdala | lnc-PLN-2:1 | −0.77 | −0.66 | −0.72 | 0.03324 | 0.76 |
| Mediotemporal | lnc-PLN-2:1 | −0.76 | −0.66 | −0.67 | 0.03324 | 0.76 |
| Left.Hippocampus | lnc-PLN-2:1 | −0.75 | −0.67 | −0.64 | 0.03324 | 0.76 |
| Right.Hippocampus | lnc-PLN-2:1 | −0.73 | −0.54 | −0.68 | 0.03324 | 0.76 |
| Left.Hippocampus | lnc-PTPN4-1:1 | −0.74 | −0.59 | −0.69 | 0.02842 | 0.76 |
| Right.Amygdala | lnc-SLC38A2-1:11 | −0.76 | −0.73 | −0.57 | 0.01004 | 0.81 |
| Left.Amygdala | lnc-SLC38A2-1:11 | −0.73 | −0.57 | −0.38 | 0.01004 | 0.81 |
| Right.Amygdala | lnc-SMARCA5-4:18 | −0.72 | −0.35 | −0.78 | 0.01004 | 0.81 |
| Mediotemporal | lnc-SMARCA5-4:18 | −0.72 | −0.29 | −0.84 | 0.01004 | 0.81 |
| Left.Amygdala | lnc-SMARCA5-4:18 | −0.71 | −0.30 | −0.92 | 0.01004 | 0.81 |
| lh_entorhinal | lnc-TMEM242-6:1 | −0.77 | −0.64 | −0.78 | 0.02049 | 0.78 |
| Mediotemporal | lnc-TMEM242-6:1 | −0.72 | −0.62 | −0.63 | 0.02049 | 0.78 |
| Right.Hippocampus | lnc-TPPP-1:2 | −0.73 | −0.03 | −0.42 | 0.00014 | 0.92 |
| Left.Hippocampus | lnc-TRIM43B-1:2 | −0.75 | −0.47 | −0.72 | 0.01727 | 0.78 |
| lh_entorhinal | lnc-TRMT11-4:1 | −0.80 | −0.86 | −0.30 | 0.00829 | 0.81 |
| Mediotemporal | lnc-TRMT11-4:1 | −0.74 | −0.73 | −0.30 | 0.00829 | 0.81 |
| Left.Amygdala | lnc-TRMT11-4:1 | −0.73 | −0.58 | −0.35 | 0.00829 | 0.81 |
| Left.Hippocampus | lnc-USP53-1:1 | −0.75 | −0.24 | −0.84 | 0.01727 | 0.78 |
| Left.Hippocampus | lnc-ZNF33B-6:3 | −0.78 | −0.40 | −0.81 | 0.01209 | 0.80 |
| Right.Amygdala | lnc-ZNF33B-6:3 | −0.74 | −0.47 | −0.65 | 0.01209 | 0.80 |
| Right.Amygdala | MIR29B2CHG:46 | 0.74 | 0.35 | 0.82 | 0.00829 | 0.19 |
| rh_entorhinal | MIR29B2CHG:46 | 0.71 | 0.45 | 0.80 | 0.00829 | 0.19 |
| Right.Amygdala | PCBP1-AS1:250 | 0.73 | 0.20 | 0.71 | 0.03872 | 0.25 |
| Mediotemporal | PCBP1-AS1:250 | 0.71 | 0.19 | 0.70 | 0.03872 | 0.25 |

R: correlation coefficient (Pearson).
HV: healthy control group,
AD: mild to moderate AD group.

Modeling using Random Forest algorithm was also applied to a specific set of serum lncRNA candidates from Table 6 having both a statistically significant differential expression in AD patients versus healthy control populations and a good correlation (Pearson) with level of the CSF biomarkers of high relevance to AD pathology: Aβ42, tau or phosphorylated-tau: The results show that the signature of the following 18 top ranked lncRNAs enabled an excellent discrimination between AD patients and healthy control population with AUC=0.972 accuracy=0,917 sensitivity=0.83 and specificity=1.

| lncRNA | Rank |
|---|---|
| lnc-TPPP-1:2 | 1 |
| LINC02345:11 | 2 |
| lnc-ZNF273-4:4 | 3 |
| lnc-TACC2-8:6 | 4 |
| LINC01206:20 | 5 |
| lnc-C5orf67-3:1 | 6 |
| HAND2-AS1:58 | 7 |
| lnc-PRDM9-20:1 | 8 |
| lnc-CLK1-1:7 | 9 |
| lnc-DNALI1-5:4 | 10 |
| RORB-AS1:6 | 11 |
| lnc-TPPP-1:3 | 12 |
| lnc-BMS1-2:1 | 13 |
| lnc-ADRB1-4:1 | 14 |
| lnc-XXYLT1-5:1 | 15 |
| MIR99AHG: 104 | 16 |
| LINC01748:17 | 17 |
| lnc-AKR1E2-15:1 | 18 |

TABLE 6

Serum lncRNAs of the present invention that correlate with CSF biomarkers

| CSF BM | lncRNA | R_AD | PValue | AUC |
|---|---|---|---|---|
| AB42 | LINC01748:17 | −0.73 | 0.0242 | 0.77 |
| AB42 | lnc-C5orf67-3:1 | 0.72 | 0.0068 | 0.82 |
| Aβ42 | lnc-CYP2E1-1:1 | −0.74 | 0.0332 | 0.24 |
| AB42 | lnc-FAP-3:1 | −0.72 | 0.0083 | 0.81 |
| Aβ42 | lnc-FGD4-9:1 | −0.73 | 0.0036 | 0.84 |
| AB42 | lnc-GLIPR1L1-2:3 | 0.72 | 0.0205 | 0.22 |
| AB42 | lnc-KDM3A-1:4 | −0.77 | 0.0045 | 0.83 |
| AB42 | lnc-LRCH1-1:1 | −0.75 | 0.0205 | 0.78 |
| AB42 | lnc-NPBWR1-2:2 | 0.81 | 0.0449 | 0.26 |
| AB42 | lnc-PLA2G2F-1:2 | −0.74 | 0.0121 | 0.20 |
| AB42 | lnc-POU2AF1-1:2 | −0.84 | 0.0205 | 0.78 |
| Aβ42 | lnc-RCSD1-4:1 | −0.72 | 0.0387 | 0.75 |
| AB42 | lnc-SERPINI1-14:1 | −0.74 | 0.0449 | 0.74 |
| AB42 | lnc-TAF9-10:1 | −0.75 | 0.0284 | 0.76 |
| AB42 | lnc-TNFRSF19-2:1 | 0.71 | 0.0332 | 0.24 |
| AB42 | lnc-TPPP-1:2 | −0.86 | 0.0001 | 0.92 |
| AB42 | lnc-TPPP-1:3 | 0.8 | 0.0056 | 0.17 |
| AB42 | lnc-ZNF273-4:4 | −0.87 | 0.0036 | 0.84 |
| T-tau | HAND2-AS1:58 | 0.92 | 0.0045 | 0.83 |
| T-tau | HAND2-AS1:59 | 0.9 | 0.0056 | 0.83 |
| T-tau | HAND2-AS1:70 | 0.8 | 0.0018 | 0.86 |
| T-tau | HAND2-AS1:71 | 0.8 | 0.0036 | 0.84 |
| T-tau | LINC00200:6 | 0.71 | 0.0029 | 0.15 |
| T-tau | LINC00649:23 | −0.74 | 0.0036 | 0.84 |
| T-tau | LINC01206:11 | −0.74 | 0.0332 | 0.76 |
| T-tau | LINC01355:9 | 0.83 | 0.0332 | 0.76 |
| T-tau | lnc-ADRB1-4:1 | 0.8 | 0.0056 | 0.83 |
| T-tau | lnc-AKR1E2-15:1 | 0.75 | 0.0205 | 0.22 |
| T-tau | lnc-APBA1-5:1 | 0.8 | 0.0284 | 0.76 |
| T-tau | lnc-BMS1-2:1 | 0.76 | 0.0332 | 0.24 |
| T-tau | lnc-CA7-2:2 | −0.73 | 0.0332 | 0.76 |
| T-tau | lnc-CLK1-1:7 | −0.83 | 0.0083 | 0.81 |
| T-tau | lnc-DAPP1-2:11 | 0.8 | 0.0242 | 0.77 |
| T-tau | lnc-DNALI1-5:4 | −0.76 | 0.0045 | 0.83 |
| T-tau | lnc-ELF1-5:1 | 0.86 | 0.0242 | 0.77 |

TABLE 6-continued

Serum lncRNAs of the present invention that correlate with CSF biomarkers

| CSF BM | lncRNA | R_AD | PValue | AUC |
|---|---|---|---|---|
| T-tau | lnc-LBH-4:1 | −0.79 | 0.0332 | 0.24 |
| T-tau | lnc-MVB12B-6:1 | 0.89 | 0.0242 | 0.77 |
| T-tau | lnc-MYO18B-2:3 | −0.72 | 0.0145 | 0.79 |
| T-tau | lnc-OR8G5-7:2 | −0.81 | 0.0284 | 0.76 |
| T-tau | lnc-PAX8-6:2 | 0.71 | 0.0242 | 0.23 |
| T-tau | lnc-POLE4-3:1 | 0.71 | 0.0145 | 0.79 |
| T-tau | lnc-SERTM1-1:1 | −0.72 | 0.0121 | 0.80 |
| T-tau | lnc-SOX14-2:1 | 0.71 | 0.0018 | 0.86 |
| T-tau | lnc-SYCP1-4:1 | −0.83 | 0.0387 | 0.25 |
| T-tau | lnc-TACC2-8:6 | −0.78 | 0.0068 | 0.82 |
| T-tau | lnc-TEAD4-1:1 | −0.71 | 0.0449 | 0.26 |
| T-tau | lnc-TF-4:1 | 0.82 | 0.0332 | 0.76 |
| T-tau | lnc-TTF2-4:1 | −0.8 | 0.0449 | 0.74 |
| T-tau | lnc-XXYLT1-5:1 | −0.71 | 0.0083 | 0.81 |
| T-tau | lnc-ZC3H12D-2:3 | −0.72 | 0.0173 | 0.78 |
| T-tau | lnc-ZNF430-3:4 | −0.79 | 0.01 | 0.81 |
| T-tau | MIR99AHG:104 | 0.9 | 0.0045 | 0.83 |
| T-tau | PITRM1-AS1:10 | 0.91 | 0.0242 | 0.23 |
| T-tau | RORB-AS1:6 | 0.73 | 0.0056 | 0.83 |
| T-tau | SEC24B-AS1:19 | −0.93 | 0.0205 | 0.22 |
| T-tau | ZNF528-AS1:1 | −0.74 | 0.0387 | 0.75 |
| p-tau | BLACAT1:3 | −0.71 | 0.0145 | 0.21 |
| p-tau | HAND2-AS1:58 | 0.71 | 0.0045 | 0.83 |
| p-tau | KAZN-AS1:4 | −0.73 | 0.0205 | 0.78 |
| p-tau | LINC00649:23 | −0.71 | 0.0036 | 0.84 |
| p-tau | LINC01206:11 | −0.77 | 0.0332 | 0.76 |
| p-tau | LINC01206:20 | 0.84 | 0.0205 | 0.22 |
| p-tau | LINC01684:16 | 0.71 | 0.0242 | 0.77 |
| p-tau | LINCO2246:11 | 0.74 | 0.0173 | 0.78 |
| p-tau | LINC02345:11 | −0.75 | 0.0007 | 0.11 |
| p-tau | lnc-AQP8-2:7 | −0.82 | 0.0173 | 0.22 |
| p-tau | lnc-AUH-2:9 | −0.78 | 0.0332 | 0.24 |
| p-tau | lnc-CA7-2:2 | −0.79 | 0.0332 | 0.76 |
| p-tau | lnc-CLK1-1:7 | −0.73 | 0.0083 | 0.81 |
| p-tau | lnc-ELF1-5:1 | 0.74 | 0.0242 | 0.77 |
| p-tau | lnc-FER1L6-2:1 | 0.83 | 0.0242 | 0.77 |
| p-tau | lnc-HS3ST3A1-1:1 | 0.77 | 0.01 | 0.81 |
| p-tau | lnc-KCTD19-1:1 | 0.78 | 0.0332 | 0.76 |
| p-tau | lnc-LMBRD1-5:17 | −0.73 | 0.0387 | 0.75 |
| p-tau | lnc-MVB12B-6:1 | 0.72 | 0.0242 | 0.77 |
| p-tau | lnc-NKX6-1-2:1 | 0.79 | 0.0121 | 0.80 |
| p-tau | lnc-OR8G5-7:2 | −0.85 | 0.0284 | 0.76 |
| p-tau | lnc-PACRGL-5:1 | 0.71 | 0.0332 | 0.76 |
| p-tau | lnc-PRDM9-20:1 | 0.73 | 0.0173 | 0.78 |
| p-tau | lnc-RHOB-1:3 | −0.76 | 0.0205 | 0.78 |
| p-tau | lnc-RPE65-4:2 | −0.79 | 0.0056 | 0.83 |
| p-tau | lnc-SERTM1-1:1 | −0.82 | 0.0121 | 0.80 |
| p-tau | lnc-SOX14-2:1 | 0.76 | 0.0018 | 0.86 |
| p-tau | lnc-SPAG9-2:1 | 0.71 | 0.0173 | 0.78 |
| p-tau | lnc-SPAG9-2:2 | 0.71 | 0.0173 | 0.78 |
| p-tau | lnc-SYCP1-4:1 | −0.76 | 0.0387 | 0.25 |
| p-tau | lnc-TACC2-8:6 | −0.75 | 0.0068 | 0.82 |
| p-tau | lnc-TEKT3-3:1 | −0.84 | 0.0387 | 0.75 |
| p-tau | lnc-TF-4:1 | 0.73 | 0.0332 | 0.76 |
| p-tau | lnc-TP53TG3D-2:1 | 0.71 | 0.0387 | 0.75 |
| p-tau | MIR99AHG:104 | 0.92 | 0.0045 | 0.83 |
| p-tau | RORB-AS1:6 | 0.81 | 0.0056 | 0.83 |
| p-tau | SEC24B-AS1:19 | −0.75 | 0.0205 | 0.22 |
| p-tau | TM4SF19-AS1:10 | 0.76 | 0.0083 | 0.19 |

To identify additional brain lncRNAs implicated specifically in brain disorders, in particular in MCI, AD, for therapeutic applications, frozen tissue samples consisting of postmortem brain mediotemporal cortex from AD patients (tissue histo-pathologically showing typical AD lesions: amyloid plaques and tangles) and from non-demented healthy control (HC) subjects (tissue devoid from AD and other lesions) were used in the experiments of deep sequencing and quantification of novel lncRNAs and the 127802 lncRNAs based on LNCipedia, a database for annotated human lncRNA transcript sequences and structures.

A total of 1091 novel lncRNAs were identified in the AD and/or HC brains. These novel 1091 lncRNAs were subsequently added in the list of the sequenced 127802 lncRNAs totalizing 128,894 lncRNAs profiled in all experiments in the brain. The 1091 novel lncRNAs are shown in Table 7.

TABLE 7

The 1091 novel lncRNAs identified by the invention and fold change and p-value (differential expression in AD group versus healthy control group).

| lncRNA | SEQ | p-value | FC |
|---|---|---|---|
| TCONS_00062603 | SEQ 2031 | 0.00794 | <0.01 |
| TCONS_00045361 | SEQ 1784 | 0.00794 | 0.36 |
| TCONS_00059198 | SEQ 1931 | 0.00794 | 0.32 |
| TCONS_00055496 | SEQ 1898 | 0.00794 | 0.30 |
| TCONS_00033736 | SEQ 1544 | 0.00794 | 5.08 |
| TCONS_00027765 | SEQ 1436 | 0.00794 | 4.55 |
| TCONS_00017427 | SEQ 1285 | 0.01193 | 0.36 |
| TCONS_00012083 | SEQ 1209 | 0.01193 | 0.09 |
| TCONS_00005009 | SEQ 1130 | 0.01193 | 0.08 |
| TCONS_00036823 | SEQ 1627 | 0.01193 | 2.26 |
| TCONS_00050539 | SEQ 1828 | 0.01471 | 22.25 |
| TCONS_00005139 | SEQ 1106 | 0.01587 | 0.34 |
| TCONS_00050178 | SEQ 1833 | 0.01587 | 0.11 |
| TCONS_00050218 | SEQ 1850 | 0.01587 | 0.03 |
| TCONS_00062555 | SEQ 1991 | 0.01587 | 19.87 |
| TCONS_00000634 | SEQ 1045 | 0.01587 | 5.10 |
| TCONS_00066462 | SEQ 2061 | 0.02118 | 9.50 |
| TCONS_00055487 | SEQ 1896 | 0.03175 | 0.50 |
| TCONS_00036834 | SEQ 1628 | 0.03175 | 0.45 |
| TCONS_00017409 | SEQ 1280 | 0.03175 | 0.43 |
| TCONS_00011974 | SEQ 1218 | 0.03175 | 0.42 |
| TCONS_00026584 | SEQ 1418 | 0.03175 | 0.40 |
| TCONS_00059199 | SEQ 1932 | 0.03175 | 0.37 |
| TCONS_00040994 | SEQ 1713 | 0.03175 | 0.36 |
| TCONS_00005325 | SEQ 1141 | 0.03175 | 0.34 |

TABLE 7-continued

The 1091 novel lncRNAs identified by the invention and fold change and p-value (differential expression in AD group versus healthy control group).

| lncRNA | SEQ | p-value | FC |
| --- | --- | --- | --- |
| TCONS_00050200 | SEQ 1841 | 0.03175 | 0.31 |
| TCONS_00027438 | SEQ 1450 | 0.03175 | 0.22 |
| TCONS_00024916 | SEQ 1404 | 0.03175 | 11.52 |
| TCONS_00023309 | SEQ 1355 | 0.03175 | 4.71 |
| TCONS_00062602 | SEQ 2030 | 0.03175 | 3.75 |
| TCONS_00023240 | SEQ 1383 | 0.03175 | 3.68 |
| TCONS_00023401 | SEQ 1386 | 0.03175 | 2.81 |
| TCONS_00062306 | SEQ 1989 | 0.03175 | 2.27 |
| TCONS_00027556 | SEQ 1495 | 0.03445 | 0.32 |
| TCONS_00000570 | SEQ 1032 | 0.03615 | 0.31 |
| TCONS_00000571 | SEQ 1033 | 0.03615 | 0.25 |
| TCONS_00033653 | SEQ 1548 | 0.03615 | 7.72 |
| TCONS_00040878 | SEQ 1680 | 0.03615 | 7.58 |
| TCONS_00066358 | SEQ 2068 | 0.03615 | 2.31 |
| TCONS_00004915 | SEQ 1109 | 0.04322 | 0.15 |
| TCONS_00050234 | SEQ 1855 | 0.04587 | 0.19 |
| TCONS_00000601 | SEQ 1037 | 0.04653 | 0.44 |
| TCONS_00008841 | SEQ 1158 | 0.05556 | 0.44 |
| TCONS_00050014 | SEQ 1803 | 0.05556 | 0.44 |
| TCONS_00012062 | SEQ 1202 | 0.05556 | 0.43 |
| TCONS_00008942 | SEQ 1177 | 0.05556 | 0.43 |
| TCONS_00012009 | SEQ 1185 | 0.05556 | 0.42 |
| TCONS_00050606 | SEQ 1861 | 0.05556 | 0.32 |
| TCONS_00035031 | SEQ 1583 | 0.05556 | 0.32 |
| TCONS_00055481 | SEQ 1894 | 0.05556 | 0.31 |
| TCONS_00028007 | SEQ 1498 | 0.05556 | 0.15 |
| TCONS_00035091 | SEQ 1565 | 0.05556 | 2.67 |
| TCONS_00066501 | SEQ 2066 | 0.05556 | 2.54 |
| TCONS_00023133 | SEQ 1357 | 0.05556 | 2.54 |
| TCONS_00005141 | SEQ 1108 | 0.05556 | 2.21 |
| TCONS_00055535 | SEQ 1909 | 0.05556 | 1.88 |
| TCONS_00040949 | SEQ 1706 | 0.05556 | 1.88 |
| TCONS_00036895 | SEQ 1643 | 0.05556 | 1.57 |
| TCONS_00028131 | SEQ 1522 | 0.05556 | 0.60 |
| TCONS_00000237 | SEQ 1052 | 0.05556 | 0.57 |
| TCONS_00027683 | SEQ 1521 | 0.05556 | 0.56 |
| TCONS_00012063 | SEQ 1203 | 0.05556 | 0.56 |
| TCONS_00062422 | SEQ 2040 | 0.05556 | 0.54 |
| TCONS_00024801 | SEQ 1392 | 0.05701 | 0.15 |
| TCONS_00068994 | SEQ 2110 | 0.05701 | 6.03 |
| TCONS_00008747 | SEQ 1175 | 0.05933 | 4.40 |
| TCONS_00066312 | SEQ 2053 | 0.07201 | 1.09 |
| TCONS_00050655 | SEQ 1875 | 0.07464 | 0.19 |
| TCONS_00040935 | SEQ 1702 | 0.07491 | 6.49 |
| TCONS_00045332 | SEQ 1775 | 0.09269 | 0.31 |
| TCONS_00062739 | SEQ 2052 | 0.09269 | 2.40 |
| TCONS_00035032 | SEQ 1585 | 0.09369 | 0.46 |
| TCONS_00014419 | SEQ 1250 | 0.09369 | 0.40 |
| TCONS_00045210 | SEQ 1742 | 0.09369 | 0.19 |
| TCONS_00040809 | SEQ 1720 | 0.09369 | 6.83 |
| TCONS_00021525 | SEQ 1313 | 0.09369 | 1.77 |
| TCONS_00066459 | SEQ 2058 | 0.09369 | 1.71 |
| TCONS_00000337 | SEQ 1073 | 0.09369 | 0.59 |
| TCONS_00028030 | SEQ 1505 | 0.09369 | 0.57 |
| TCONS_00027502 | SEQ 1479 | 0.09369 | 0.56 |
| TCONS_00000744 | SEQ 1071 | 0.09524 | 0.50 |
| TCONS_00059197 | SEQ 1930 | 0.09524 | 0.49 |
| TCONS_00037029 | SEQ 1675 | 0.09524 | 0.48 |
| TCONS_00045125 | SEQ 1790 | 0.09524 | 0.47 |
| TCONS_00066422 | SEQ 2093 | 0.09524 | 0.46 |
| TCONS_00017476 | SEQ 1261 | 0.09524 | 0.46 |
| TCONS_00000765 | SEQ 1085 | 0.09524 | 0.46 |
| TCONS_00012067 | SEQ 1204 | 0.09524 | 0.41 |
| TCONS_00050090 | SEQ 1814 | 0.09524 | 0.37 |
| TCONS_00027933 | SEQ 1464 | 0.09524 | 0.37 |

TABLE 7-continued

The 1091 novel lncRNAs identified by the invention and fold change and p-value (differential expression in AD group versus healthy control group).

| lncRNA | SEQ | p-value | FC |
| --- | --- | --- | --- |
| TCONS_00019766 | SEQ 1300 | 0.09524 | 0.26 |
| TCONS_00005240 | SEQ 1115 | 0.09524 | 0.26 |
| TCONS_00005376 | SEQ 1147 | 0.09524 | 4.67 |
| TCONS_00028169 | SEQ 1538 | 0.09524 | 2.52 |
| TCONS_00055703 | SEQ 1892 | 0.09524 | 2.38 |
| TCONS_00021393 | SEQ 1318 | 0.09524 | 2.12 |
| TCONS_00028111 | SEQ 1513 | 0.09524 | 1.89 |
| TCONS_00000468 | SEQ 1014 | 0.09524 | 1.86 |
| TCONS_00027920 | SEQ 1455 | 0.09524 | 1.82 |
| TCONS_00036021 | SEQ 1604 | 0.09524 | 1.79 |
| TCONS_00036894 | SEQ 1642 | 0.09524 | 1.75 |
| TCONS_00062311 | SEQ 1996 | 0.09524 | 1.71 |
| TCONS_00027931 | SEQ 1462 | 0.09524 | 1.70 |
| TCONS_00021544 | SEQ 1320 | 0.09524 | 1.59 |
| TCONS_00021556 | SEQ 1332 | 0.09524 | 1.56 |
| TCONS_00045262 | SEQ 1758 | 0.09524 | 1.51 |
| TCONS_00019840 | SEQ 1292 | 0.09524 | 0.66 |
| TCONS_00033666 | SEQ 1553 | 0.09524 | 0.61 |
| TCONS_00026547 | SEQ 1410 | 0.09524 | 0.58 |
| TCONS_00023102 | SEQ 1346 | 0.09524 | 0.56 |
| TCONS_00014407 | SEQ 1245 | 0.09524 | 0.52 |
| TCONS_00062324 | SEQ 2004 | 0.09524 | 0.52 |
| TCONS_00044977 | SEQ 1753 | 0.11496 | 2.62 |
| TCONS_00028123 | SEQ 1519 | 0.11496 | 2.31 |
| TCONS_00055574 | SEQ 1917 | 0.11496 | 0.52 |
| TCONS_00011923 | SEQ 1208 | 0.11607 | 0.32 |
| TCONS_00026753 | SEQ 1424 | 0.11607 | 6.14 |
| TCONS_00040926 | SEQ 1698 | 0.11752 | 0.15 |
| TCONS_00008975 | SEQ 1183 | 0.13386 | 0.41 |
| TCONS_00040879 | SEQ 1681 | 0.13756 | 3.00 |
| TCONS_00026537 | SEQ 1408 | 0.13756 | 2.67 |
| TCONS_00062522 | SEQ 1976 | 0.13879 | 0.14 |
| TCONS_00005286 | SEQ 1134 | 0.13879 | 0.13 |
| TCONS_00033735 | SEQ 1543 | 0.13879 | 3.16 |
| TCONS_00000311 | SEQ 1063 | 0.13879 | 0.55 |
| TCONS_00000139 | SEQ 1035 | 0.14124 | 0.47 |
| TCONS_00037036 | SEQ 1616 | 0.14124 | 0.32 |
| TCONS_00040743 | SEQ 1715 | 0.14246 | 0.43 |
| TCONS_00037019 | SEQ 1672 | 0.14246 | 2.20 |
| TCONS_00037027 | SEQ 1674 | 0.14246 | 1.96 |
| TCONS_00040820 | SEQ 1721 | 0.14246 | 0.84 |
| TCONS_00050289 | SEQ 1866 | 0.14246 | 0.61 |
| TCONS_00045439 | SEQ 1795 | 0.14246 | 0.55 |
| TCONS_00066425 | SEQ 2096 | 0.15079 | 0.47 |
| TCONS_00024810 | SEQ 1396 | 0.15079 | 0.46 |
| TCONS_00027448 | SEQ 1451 | 0.15079 | 0.44 |
| TCONS_00035100 | SEQ 1577 | 0.15079 | 0.42 |
| TCONS_00035102 | SEQ 1579 | 0.15079 | 0.40 |
| TCONS_00059196 | SEQ 1929 | 0.15079 | 0.37 |
| TCONS_00027930 | SEQ 1461 | 0.15079 | 0.34 |
| TCONS_00000734 | SEQ 1066 | 0.15079 | 0.22 |
| TCONS_00024864 | SEQ 1388 | 0.15079 | 7.03 |
| TCONS_00023390 | SEQ 1384 | 0.15079 | 4.26 |
| TCONS_00035092 | SEQ 1569 | 0.15079 | 3.18 |
| TCONS_00059499 | SEQ 1963 | 0.15079 | 2.96 |
| TCONS_00024865 | SEQ 1389 | 0.15079 | 2.81 |
| TCONS_00066369 | SEQ 2072 | 0.15079 | 2.64 |
| TCONS_00035090 | SEQ 1564 | 0.15079 | 2.60 |
| TCONS_00050071 | SEQ 1807 | 0.15079 | 2.43 |
| TCONS_00033669 | SEQ 1555 | 0.15079 | 2.31 |
| TCONS_00004965 | SEQ 1114 | 0.15079 | 2.04 |
| TCONS_00062729 | SEQ 2050 | 0.15079 | 2.04 |
| TCONS_00035094 | SEQ 1573 | 0.15079 | 1.97 |
| TCONS_00045265 | SEQ 1761 | 0.15079 | 1.97 |
| TCONS_00005138 | SEQ 1105 | 0.15079 | 1.93 |
| TCONS_00066313 | SEQ 2054 | 0.15079 | 1.90 |
| TCONS_00027929 | SEQ 1460 | 0.15079 | 1.73 |
| TCONS_00055752 | SEQ 1906 | 0.15079 | 1.72 |
| TCONS_00062338 | SEQ 2009 | 0.15079 | 1.68 |
| TCONS_00005242 | SEQ 1118 | 0.15079 | 1.55 |
| TCONS_00027945 | SEQ 1483 | 0.15079 | 1.45 |
| TCONS_00027766 | SEQ 1437 | 0.15079 | 1.43 |
| TCONS_00026617 | SEQ 1422 | 0.15079 | 1.32 |
| TCONS_00066314 | SEQ 2055 | 0.15079 | 1.29 |
| TCONS_00062497 | SEQ 1967 | 0.15079 | 1.22 |

TABLE 7-continued

The 1091 novel lncRNAs identified by the invention and fold change and p-value
(differential expression in AD group versus healthy control group).

| lncRNA | SEQ | p-value | FC |
|---|---|---|---|
| TCONS_00019689 | SEQ 1290 | 0.15079 | 1.13 |
| TCONS_00062351 | SEQ 2026 | 0.15079 | 0.69 |
| TCONS_00066357 | SEQ 2067 | 0.15079 | 0.65 |
| TCONS_00062341 | SEQ 2012 | 0.15079 | 0.61 |
| TCONS_00037250 | SEQ 1673 | 0.15079 | 0.60 |
| TCONS_00017351 | SEQ 1265 | 0.15079 | 0.60 |
| TCONS_00019772 | SEQ 1301 | 0.15079 | 0.58 |
| TCONS_00027507 | SEQ 1484 | 0.15079 | 0.57 |
| TCONS_00000828 | SEQ 1096 | 0.15079 | 0.55 |
| TCONS_00036133 | SEQ 1607 | 0.15079 | 0.55 |
| TCONS_00050012 | SEQ 1801 | 0.15079 | 0.54 |
| TCONS_00035046 | SEQ 1588 | 0.15079 | 0.54 |
| TCONS_00044939 | SEQ 1736 | 0.15079 | 0.53 |
| TCONS_00014261 | SEQ 1249 | 0.15079 | 0.53 |
| TCONS_00055513 | SEQ 1901 | 0.15794 | 0.03 |
| TCONS_00019796 | SEQ 1303 | 0.16926 | 0.33 |
| TCONS_00008691 | SEQ 1159 | 0.17190 | 0.39 |
| TCONS_00000350 | SEQ 1084 | 0.17190 | 4.60 |
| TCONS_00000760 | SEQ 1083 | 0.17322 | 0.50 |
| TCONS_00019866 | SEQ 1295 | 0.17322 | 0.44 |
| TCONS_00055525 | SEQ 1907 | 0.17322 | 0.40 |
| TCONS_00033608 | SEQ 1541 | 0.17322 | 2.45 |
| TCONS_00036061 | SEQ 1614 | 0.17322 | 2.39 |
| TCONS_00033668 | SEQ 1554 | 0.17322 | 0.51 |
| TCONS_00021549 | SEQ 1327 | 0.17971 | >100 |
| TCONS_00050263 | SEQ 1860 | 0.17971 | >100 |
| TCONS_00068989 | SEQ 2111 | 0.17971 | >100 |
| TCONS_00037221 | SEQ 1667 | 0.20309 | 0.16 |
| TCONS_00011831 | SEQ 1191 | 0.20309 | 4.10 |
| TCONS_00044961 | SEQ 1746 | 0.20309 | 2.12 |
| TCONS_00066547 | SEQ 2099 | 0.20309 | 2.08 |
| TCONS_00045056 | SEQ 1773 | 0.20450 | 0.50 |
| TCONS_00037177 | SEQ 1657 | 0.20450 | 0.46 |
| TCONS_00066513 | SEQ 2077 | 0.20450 | 1.13 |
| TCONS_00012089 | SEQ 1210 | 0.20450 | 0.55 |
| TCONS_00027715 | SEQ 1535 | 0.20590 | 0.24 |
| TCONS_00000536 | SEQ 1021 | 0.20730 | 0.45 |
| TCONS_00027498 | SEQ 1474 | 0.20730 | 1.34 |
| TCONS_00036797 | SEQ 1621 | 0.20730 | 0.75 |
| TCONS_00062437 | SEQ 2044 | 0.20869 | 0.47 |
| TCONS_00023224 | SEQ 1381 | 0.20869 | 2.27 |
| TCONS_00036792 | SEQ 1620 | 0.20869 | 2.03 |
| TCONS_00045156 | SEQ 1796 | 0.20869 | 1.59 |
| TCONS_00036933 | SEQ 1655 | 0.20869 | 0.75 |
| TCONS_00027513 | SEQ 1487 | 0.20869 | 0.51 |
| TCONS_00050460 | SEQ 1809 | 0.22222 | 0.50 |
| TCONS_00011972 | SEQ 1217 | 0.22222 | 0.50 |
| TCONS_00059439 | SEQ 1956 | 0.22222 | 0.49 |
| TCONS_00037143 | SEQ 1649 | 0.22222 | 0.44 |
| TCONS_00045093 | SEQ 1782 | 0.22222 | 0.40 |
| TCONS_00045133 | SEQ 1792 | 0.22222 | 0.33 |
| TCONS_00035101 | SEQ 1578 | 0.22222 | 0.28 |
| TCONS_00050087 | SEQ 1811 | 0.22222 | 0.20 |
| TCONS_00036899 | SEQ 1644 | 0.22222 | 16.33 |
| TCONS_00036100 | SEQ 1600 | 0.22222 | 4.21 |
| TCONS_00044916 | SEQ 1729 | 0.22222 | 4.18 |
| TCONS_00044921 | SEQ 1734 | 0.22222 | 4.01 |
| TCONS_00035021 | SEQ 1566 | 0.22222 | 3.65 |
| TCONS_00045203 | SEQ 1731 | 0.22222 | 3.29 |
| TCONS_00017370 | SEQ 1271 | 0.22222 | 2.90 |
| TCONS_00037224 | SEQ 1668 | 0.22222 | 2.08 |
| TCONS_00000357 | SEQ 1087 | 0.22222 | 1.98 |
| TCONS_00035024 | SEQ 1571 | 0.22222 | 1.90 |
| TCONS_00000204 | SEQ 1044 | 0.22222 | 1.65 |
| TCONS_00021407 | SEQ 1326 | 0.22222 | 1.65 |
| TCONS_00050176 | SEQ 1831 | 0.22222 | 1.62 |
| TCONS_00062700 | SEQ 2045 | 0.22222 | 1.61 |
| TCONS_00045048 | SEQ 1772 | 0.22222 | 1.61 |
| TCONS_00021555 | SEQ 1331 | 0.22222 | 1.60 |
| TCONS_00000202 | SEQ 1042 | 0.22222 | 1.59 |
| TCONS_00044996 | SEQ 1755 | 0.22222 | 1.58 |
| TCONS_00021554 | SEQ 1330 | 0.22222 | 1.54 |
| TCONS_00000809 | SEQ 1090 | 0.22222 | 1.48 |
| TCONS_00045266 | SEQ 1762 | 0.22222 | 1.47 |
| TCONS_00027936 | SEQ 1469 | 0.22222 | 1.44 |

TABLE 7-continued

The 1091 novel lncRNAs identified by the invention and fold change and p-value
(differential expression in AD group versus healthy control group).

| lncRNA | SEQ | p-value | FC |
| --- | --- | --- | --- |
| TCONS_00059492 | SEQ 1962 | 0.22222 | 1.42 |
| TCONS_00037052 | SEQ 1619 | 0.22222 | 1.42 |
| TCONS_00059234 | SEQ 1942 | 0.22222 | 0.76 |
| TCONS_00023148 | SEQ 1363 | 0.22222 | 0.73 |
| TCONS_00059245 | SEQ 1946 | 0.22222 | 0.69 |
| TCONS_00017373 | SEQ 1274 | 0.22222 | 0.68 |
| TCONS_00050224 | SEQ 1854 | 0.22222 | 0.67 |
| TCONS_00014393 | SEQ 1240 | 0.22222 | 0.65 |
| TCONS_00062299 | SEQ 1977 | 0.22222 | 0.64 |
| TCONS_00005308 | SEQ 1139 | 0.22222 | 0.62 |
| TCONS_00062317 | SEQ 2002 | 0.22222 | 0.61 |
| TCONS_00040718 | SEQ 1711 | 0.22222 | 0.61 |
| TCONS_00045364 | SEQ 1785 | 0.22222 | 0.55 |
| TCONS_00044917 | SEQ 1732 | 0.22222 | 0.54 |
| TCONS_00017354 | SEQ 1268 | 0.22222 | 0.53 |
| TCONS_00066426 | SEQ 2097 | 0.22222 | 0.53 |
| TCONS_00045333 | SEQ 1776 | 0.22222 | 0.52 |
| TCONS_00000341 | SEQ 1075 | 0.22222 | 0.52 |
| TCONS_00050220 | SEQ 1852 | 0.22222 | 0.51 |
| TCONS_00045227 | SEQ 1745 | 0.22222 | 0.51 |
| TCONS_00050127 | SEQ 1820 | 0.23932 | 0.07 |
| TCONS_00000692 | SEQ 1055 | 0.24184 | 0.21 |
| TCONS_00014277 | SEQ 1254 | 0.24332 | 0.90 |
| TCONS_00066518 | SEQ 2084 | 0.24771 | 0.49 |
| TCONS_00027340 | SEQ 1435 | 0.24771 | 4.23 |
| TCONS_00050549 | SEQ 1835 | 0.24771 | 1.25 |
| TCONS_00045466 | SEQ 1798 | 0.24771 | 0.91 |
| TCONS_00027787 | SEQ 1439 | 0.24771 | 0.57 |
| TCONS_00037103 | SEQ 1635 | 0.24915 | 0.47 |
| TCONS_00023136 | SEQ 1358 | 0.24915 | 5.81 |
| TCONS_00036799 | SEQ 1622 | 0.24915 | 0.68 |
| TCONS_00045086 | SEQ 1780 | 0.24915 | 0.66 |
| TCONS_00000556 | SEQ 1026 | 0.24915 | 0.59 |
| TCONS_00024823 | SEQ 1400 | 0.24915 | 0.58 |
| TCONS_00023237 | SEQ 1382 | 0.28733 | 3.80 |
| TCONS_00050217 | SEQ 1849 | 0.29035 | 0.39 |
| TCONS_00062303 | SEQ 1986 | 0.29035 | 0.01 |
| TCONS_00050615 | SEQ 1865 | 0.29035 | 1.60 |
| TCONS_00036878 | SEQ 1636 | 0.29035 | 1.46 |
| TCONS_00062432 | SEQ 2043 | 0.29184 | 0.36 |
| TCONS_00023255 | SEQ 1385 | 0.29184 | 1.40 |
| TCONS_00040948 | SEQ 1705 | 0.29184 | 0.62 |
| TCONS_00050540 | SEQ 1829 | 0.29333 | 2.93 |
| TCONS_00019817 | SEQ 1310 | 0.29333 | 1.52 |
| TCONS_00062492 | SEQ 1965 | 0.29333 | 0.71 |
| TCONS_00027901 | SEQ 1453 | 0.29480 | 0.26 |
| TCONS_00026536 | SEQ 1407 | 0.29480 | 2.63 |
| TCONS_00000424 | SEQ 1094 | 0.29480 | 1.61 |
| TCONS_00008797 | SEQ 1182 | 0.29480 | 0.71 |
| TCONS_00066544 | SEQ 2098 | 0.29480 | 0.63 |
| TCONS_00040973 | SEQ 1709 | 0.30952 | 0.50 |
| TCONS_00035104 | SEQ 1582 | 0.30952 | 0.47 |
| TCONS_00062518 | SEQ 1972 | 0.30952 | 0.46 |
| TCONS_00033687 | SEQ 1558 | 0.30952 | 0.41 |
| TCONS_00040951 | SEQ 1708 | 0.30952 | 0.40 |
| TCONS_00036892 | SEQ 1640 | 0.30952 | 0.38 |
| TCONS_00035976 | SEQ 1596 | 0.30952 | 0.35 |
| TCONS_00066533 | SEQ 2088 | 0.30952 | 0.35 |
| TCONS_00014406 | SEQ 1244 | 0.30952 | 0.34 |
| TCONS_00040803 | SEQ 1719 | 0.30952 | 0.29 |
| TCONS_00068990 | SEQ 2112 | 0.30952 | 7.13 |
| TCONS_00044915 | SEQ 1728 | 0.30952 | 3.75 |
| TCONS_00045202 | SEQ 1730 | 0.30952 | 2.94 |
| TCONS_00035025 | SEQ 1572 | 0.30952 | 2.73 |
| TCONS_00028005 | SEQ 1496 | 0.30952 | 2.50 |
| TCONS_00068991 | SEQ 2113 | 0.30952 | 2.49 |
| TCONS_00059210 | SEQ 1935 | 0.30952 | 2.45 |
| TCONS_00027492 | SEQ 1459 | 0.30952 | 1.96 |
| TCONS_00055571 | SEQ 1915 | 0.30952 | 1.87 |
| TCONS_00045041 | SEQ 1769 | 0.30952 | 1.85 |
| TCONS_00062340 | SEQ 2011 | 0.30952 | 1.84 |
| TCONS_00062276 | SEQ 1969 | 0.30952 | 1.80 |
| TCONS_00062557 | SEQ 1993 | 0.30952 | 1.69 |
| TCONS_00045252 | SEQ 1752 | 0.30952 | 1.62 |
| TCONS_00012112 | SEQ 1214 | 0.30952 | 1.61 |

TABLE 7-continued

The 1091 novel lncRNAs identified by the invention and fold change and p-value
(differential expression in AD group versus healthy control group).

| lncRNA | SEQ | p-value | FC |
|---|---|---|---|
| TCONS_00035027 | SEQ 1575 | 0.30952 | 1.60 |
| TCONS_00026721 | SEQ 1417 | 0.30952 | 1.60 |
| TCONS_00014391 | SEQ 1237 | 0.30952 | 1.58 |
| TCONS_00023372 | SEQ 1374 | 0.30952 | 1.58 |
| TCONS_00045309 | SEQ 1771 | 0.30952 | 1.57 |
| TCONS_00062327 | SEQ 2005 | 0.30952 | 1.56 |
| TCONS_00027493 | SEQ 1467 | 0.30952 | 1.52 |
| TCONS_00059139 | SEQ 1923 | 0.30952 | 1.52 |
| TCONS_00021559 | SEQ 1333 | 0.30952 | 1.49 |
| TCONS_00027495 | SEQ 1471 | 0.30952 | 1.49 |
| TCONS_00050207 | SEQ 1846 | 0.30952 | 1.48 |
| TCONS_00012060 | SEQ 1201 | 0.30952 | 1.45 |
| TCONS_00014141 | SEQ 1224 | 0.30952 | 1.44 |
| TCONS_00033703 | SEQ 1561 | 0.30952 | 1.41 |
| TCONS_00035095 | SEQ 1574 | 0.30952 | 1.41 |
| TCONS_00021427 | SEQ 1335 | 0.30952 | 1.40 |
| TCONS_00033615 | SEQ 1542 | 0.30952 | 1.33 |
| TCONS_00045264 | SEQ 1760 | 0.30952 | 1.33 |
| TCONS_00050203 | SEQ 1842 | 0.30952 | 1.33 |
| TCONS_00055690 | SEQ 1890 | 0.30952 | 1.31 |
| TCONS_00000437 | SEQ 1097 | 0.30952 | 1.27 |
| TCONS_00005137 | SEQ 1104 | 0.30952 | 1.15 |
| TCONS_00027501 | SEQ 1478 | 0.30952 | 1.15 |
| TCONS_00021372 | SEQ 1311 | 0.30952 | 1.10 |
| TCONS_00045398 | SEQ 1789 | 0.30952 | 0.84 |
| TCONS_00066424 | SEQ 2095 | 0.30952 | 0.83 |
| TCONS_00066441 | SEQ 2102 | 0.30952 | 0.79 |
| TCONS_00027951 | SEQ 1488 | 0.30952 | 0.74 |
| TCONS_00044932 | SEQ 1735 | 0.30952 | 0.73 |
| TCONS_00019873 | SEQ 1297 | 0.30952 | 0.73 |
| TCONS_00000438 | SEQ 1098 | 0.30952 | 0.72 |
| TCONS_00000416 | SEQ 1091 | 0.30952 | 0.71 |
| TCONS_00040733 | SEQ 1712 | 0.30952 | 0.71 |
| TCONS_00008952 | SEQ 1178 | 0.30952 | 0.70 |
| TCONS_00012038 | SEQ 1198 | 0.30952 | 0.70 |
| TCONS_00059378 | SEQ 1928 | 0.30952 | 0.69 |
| TCONS_00028120 | SEQ 1518 | 0.30952 | 0.68 |
| TCONS_00059394 | SEQ 1941 | 0.30952 | 0.67 |
| TCONS_00059321 | SEQ 1959 | 0.30952 | 0.67 |
| TCONS_00019850 | SEQ 1294 | 0.30952 | 0.66 |
| TCONS_00062349 | SEQ 2024 | 0.30952 | 0.65 |
| TCONS_00017349 | SEQ 1263 | 0.30952 | 0.64 |
| TCONS_00027658 | SEQ 1511 | 0.30952 | 0.63 |
| TCONS_00027934 | SEQ 1465 | 0.30952 | 0.60 |
| TCONS_00035030 | SEQ 1580 | 0.30952 | 0.56 |
| TCONS_00027702 | SEQ 1525 | 0.30952 | 0.54 |
| TCONS_00050192 | SEQ 1837 | 0.30952 | 0.54 |
| TCONS_00062313 | SEQ 1998 | 0.30952 | 0.52 |
| TCONS_00000002 | SEQ 1009 | 0.31430 | 5.14 |
| TCONS_00055627 | SEQ 1920 | 0.32579 | 0.31 |
| TCONS_00027725 | SEQ 1536 | 0.33827 | 2.21 |
| TCONS_00055542 | SEQ 1911 | 0.34427 | 3.03 |
| TCONS_00055450 | SEQ 1888 | 0.34427 | 2.82 |
| TCONS_00017439 | SEQ 1286 | 0.34427 | 2.36 |
| TCONS_00005307 | SEQ 1138 | 0.34427 | 1.77 |
| TCONS_00023357 | SEQ 1370 | 0.34574 | 0.49 |
| TCONS_00000147 | SEQ 1036 | 0.34574 | 0.41 |
| TCONS_00023193 | SEQ 1372 | 0.34574 | 0.41 |
| TCONS_00012126 | SEQ 1220 | 0.34574 | 2.38 |
| TCONS_00028014 | SEQ 1499 | 0.34574 | 2.35 |
| TCONS_00000427 | SEQ 1095 | 0.34574 | 1.88 |
| TCONS_00008852 | SEQ 1165 | 0.34574 | 1.80 |
| TCONS_00021588 | SEQ 1339 | 0.34574 | 1.63 |
| TCONS_00050505 | SEQ 1823 | 0.34574 | 1.33 |
| TCONS_00021547 | SEQ 1324 | 0.34574 | 1.24 |
| TCONS_00066397 | SEQ 2083 | 0.34574 | 0.75 |
| TCONS_00059405 | SEQ 1944 | 0.34574 | 0.66 |
| TCONS_00005302 | SEQ 1137 | 0.34574 | 0.64 |
| TCONS_00055591 | SEQ 1918 | 0.34652 | 0.30 |
| TCONS_00014196 | SEQ 1232 | 0.36605 | 0.14 |
| TCONS_00024813 | SEQ 1398 | 0.39614 | 1.29 |
| TCONS_00026636 | SEQ 1425 | 0.39614 | 1.16 |
| TCONS_00023192 | SEQ 1371 | 0.39761 | 5.31 |
| TCONS_00037244 | SEQ 1670 | 0.39761 | 4.55 |
| TCONS_00000122 | SEQ 1031 | 0.39761 | 1.42 |

TABLE 7-continued

The 1091 novel lncRNAs identified by the invention and fold change and p-value
(differential expression in AD group versus healthy control group).

| lncRNA | SEQ | p-value | FC |
|---|---|---|---|
| TCONS_00036983 | SEQ 1663 | 0.39761 | 1.01 |
| TCONS_00027697 | SEQ 1524 | 0.39761 | 0.87 |
| TCONS_00000305 | SEQ 1062 | 0.39761 | 0.58 |
| TCONS_00011954 | SEQ 1211 | 0.39908 | 1.81 |
| TCONS_00008860 | SEQ 1167 | 0.39908 | 1.45 |
| TCONS_00017451 | SEQ 1287 | 0.40053 | 3.43 |
| TCONS_00023333 | SEQ 1364 | 0.40053 | 2.91 |
| TCONS_00014210 | SEQ 1238 | 0.40053 | 1.59 |
| TCONS_00066400 | SEQ 2085 | 0.40053 | 1.43 |
| TCONS_00023086 | SEQ 1345 | 0.40053 | 1.20 |
| TCONS_00050221 | SEQ 1853 | 0.40053 | 0.78 |
| TCONS_00036782 | SEQ 1618 | 0.40053 | 0.61 |
| TCONS_00017363 | SEQ 1269 | 0.40053 | 0.57 |
| TCONS_00066494 | SEQ 2065 | 0.40197 | 1.89 |
| TCONS_00023122 | SEQ 1354 | 0.40197 | 1.71 |
| TCONS_00008663 | SEQ 1149 | 0.40197 | 1.40 |
| TCONS_00027714 | SEQ 1534 | 0.40197 | 0.90 |
| TCONS_00037110 | SEQ 1641 | 0.40197 | 0.74 |
| TCONS_00062521 | SEQ 1975 | 0.42063 | 0.46 |
| TCONS_00014425 | SEQ 1252 | 0.42063 | 0.43 |
| TCONS_00050494 | SEQ 1818 | 0.42063 | 0.14 |
| TCONS_00055453 | SEQ 1891 | 0.42063 | 2.33 |
| TCONS_00017372 | SEQ 1273 | 0.42063 | 2.03 |
| TCONS_00066562 | SEQ 2106 | 0.42063 | 2.00 |
| TCONS_00000343 | SEQ 1076 | 0.42063 | 1.98 |
| TCONS_00027923 | SEQ 1458 | 0.42063 | 1.77 |
| TCONS_00023114 | SEQ 1351 | 0.42063 | 1.75 |
| TCONS_00055786 | SEQ 1913 | 0.42063 | 1.68 |
| TCONS_00012029 | SEQ 1195 | 0.42063 | 1.61 |
| TCONS_00050177 | SEQ 1832 | 0.42063 | 1.57 |
| TCONS_00062728 | SEQ 2049 | 0.42063 | 1.53 |
| TCONS_00062427 | SEQ 2042 | 0.42063 | 1.50 |
| TCONS_00066420 | SEQ 2092 | 0.42063 | 1.49 |
| TCONS_00059385 | SEQ 1939 | 0.42063 | 1.47 |
| TCONS_00008693 | SEQ 1160 | 0.42063 | 1.42 |
| TCONS_00027937 | SEQ 1470 | 0.42063 | 1.42 |
| TCONS_00040601 | SEQ 1679 | 0.42063 | 1.37 |
| TCONS_00050574 | SEQ 1845 | 0.42063 | 1.36 |
| TCONS_00027496 | SEQ 1472 | 0.42063 | 1.31 |
| TCONS_00055468 | SEQ 1893 | 0.42063 | 1.25 |
| TCONS_00008918 | SEQ 1176 | 0.42063 | 1.24 |
| TCONS_00027531 | SEQ 1492 | 0.42063 | 1.24 |
| TCONS_00040919 | SEQ 1693 | 0.42063 | 1.24 |
| TCONS_00000201 | SEQ 1041 | 0.42063 | 1.22 |
| TCONS_00021541 | SEQ 1319 | 0.42063 | 1.21 |
| TCONS_00012109 | SEQ 1213 | 0.42063 | 1.16 |
| TCONS_00027754 | SEQ 1432 | 0.42063 | 1.16 |
| TCONS_00027500 | SEQ 1476 | 0.42063 | 1.07 |
| TCONS_00014326 | SEQ 1225 | 0.42063 | 0.95 |
| TCONS_00045322 | SEQ 1774 | 0.42063 | 0.93 |
| TCONS_00026552 | SEQ 1411 | 0.42063 | 0.89 |
| TCONS_00062559 | SEQ 1995 | 0.42063 | 0.87 |
| TCONS_00033704 | SEQ 1562 | 0.42063 | 0.85 |
| TCONS_00037031 | SEQ 1676 | 0.42063 | 0.84 |
| TCONS_00037216 | SEQ 1662 | 0.42063 | 0.83 |
| TCONS_00019918 | SEQ 1308 | 0.42063 | 0.82 |
| TCONS_00050212 | SEQ 1847 | 0.42063 | 0.82 |
| TCONS_00062420 | SEQ 2038 | 0.42063 | 0.81 |
| TCONS_00062314 | SEQ 1999 | 0.42063 | 0.81 |
| TCONS_00019917 | SEQ 1307 | 0.42063 | 0.80 |
| TCONS_00062315 | SEQ 2000 | 0.42063 | 0.79 |
| TCONS_00062503 | SEQ 1971 | 0.42063 | 0.78 |
| TCONS_00050088 | SEQ 1812 | 0.42063 | 0.78 |
| TCONS_00045244 | SEQ 1750 | 0.42063 | 0.77 |
| TCONS_00023220 | SEQ 1379 | 0.42063 | 0.77 |
| TCONS_00059438 | SEQ 1955 | 0.42063 | 0.76 |
| TCONS_00050204 | SEQ 1843 | 0.42063 | 0.74 |
| TCONS_00041037 | SEQ 1717 | 0.42063 | 0.74 |
| TCONS_00062348 | SEQ 2023 | 0.42063 | 0.74 |
| TCONS_00044971 | SEQ 1749 | 0.42063 | 0.73 |
| TCONS_00021570 | SEQ 1336 | 0.42063 | 0.73 |
| TCONS_00027397 | SEQ 1443 | 0.42063 | 0.70 |
| TCONS_00017374 | SEQ 1275 | 0.42063 | 0.70 |
| TCONS_00024800 | SEQ 1391 | 0.42063 | 0.69 |
| TCONS_00045249 | SEQ 1751 | 0.42063 | 0.69 |

TABLE 7-continued

The 1091 novel lncRNAs identified by the invention and fold change and p-value (differential expression in AD group versus healthy control group).

| lncRNA | SEQ | p-value | FC |
| --- | --- | --- | --- |
| TCONS_00035103 | SEQ 1581 | 0.42063 | 0.68 |
| TCONS_00027339 | SEQ 1434 | 0.42063 | 0.67 |
| TCONS_00014199 | SEQ 1233 | 0.42063 | 0.67 |
| TCONS_00066535 | SEQ 2089 | 0.42063 | 0.66 |
| TCONS_00026643 | SEQ 1427 | 0.42063 | 0.65 |
| TCONS_00066423 | SEQ 2094 | 0.42063 | 0.63 |
| TCONS_00037245 | SEQ 1671 | 0.42063 | 0.63 |
| TCONS_00027389 | SEQ 1440 | 0.42063 | 0.61 |
| TCONS_00000010 | SEQ 1012 | 0.42063 | 0.58 |
| TCONS_00035977 | SEQ 1597 | 0.42063 | 0.55 |
| TCONS_00062426 | SEQ 2041 | 0.42063 | 0.51 |
| TCONS_00033768 | SEQ 1549 | 0.42371 | <0.01 |
| TCONS_00045267 | SEQ 1764 | 0.42371 | <0.01 |
| TCONS_00055749 | SEQ 1903 | 0.42371 | <0.01 |
| TCONS_00062367 | SEQ 2029 | 0.42371 | <0.01 |
| TCONS_00000657 | SEQ 1051 | 0.42371 | >100 |
| TCONS_00021545 | SEQ 1322 | 0.42371 | >100 |
| TCONS_00027410 | SEQ 1448 | 0.42371 | >100 |
| TCONS_00040694 | SEQ 1699 | 0.42371 | >100 |
| TCONS_00050293 | SEQ 1867 | 0.43385 | 0.32 |
| TCONS_00024843 | SEQ 1402 | 0.43858 | 10.00 |
| TCONS_00000344 | SEQ 1077 | 0.44069 | >100 |
| TCONS_00045261 | SEQ 1757 | 0.44069 | >100 |
| TCONS_00000836 | SEQ 1101 | 0.45781 | 1.19 |
| TCONS_00050345 | SEQ 1876 | 0.45781 | 1.17 |
| TCONS_00027963 | SEQ 1490 | 0.46060 | 1.51 |
| TCONS_00027394 | SEQ 1442 | 0.46198 | 1.94 |
| TCONS_00027745 | SEQ 1539 | 0.46198 | 1.10 |
| TCONS_00035112 | SEQ 1587 | 0.46334 | 2.00 |
| TCONS_00021382 | SEQ 1312 | 0.46334 | 1.70 |
| TCONS_00019813 | SEQ 1309 | 0.46334 | 1.62 |
| TCONS_00023106 | SEQ 1349 | 0.46334 | 1.61 |
| TCONS_00014185 | SEQ 1230 | 0.46334 | 1.53 |
| TCONS_00045175 | SEQ 1797 | 0.46334 | 0.79 |
| TCONS_00021388 | SEQ 1314 | 0.46334 | 0.65 |
| TCONS_00050126 | SEQ 1819 | 0.50233 | 0.15 |
| TCONS_00066442 | SEQ 2103 | 0.51790 | 1.19 |
| TCONS_00040618 | SEQ 1682 | 0.51925 | 1.51 |
| TCONS_00027637 | SEQ 1507 | 0.52058 | 0.45 |
| TCONS_00050646 | SEQ 1873 | 0.52322 | 0.15 |
| TCONS_00023144 | SEQ 1362 | 0.52452 | 0.52 |
| TCONS_00021528 | SEQ 1315 | 0.52709 | 0.40 |
| TCONS_00027689 | SEQ 1523 | 0.52836 | 0.50 |
| TCONS_00059396 | SEQ 1943 | 0.52836 | 0.43 |
| TCONS_00000296 | SEQ 1059 | 0.52836 | 0.40 |
| TCONS_00023262 | SEQ 1387 | 0.52836 | 2.32 |
| TCONS_00012120 | SEQ 1219 | 0.52836 | 2.13 |
| TCONS_00000773 | SEQ 1086 | 0.52836 | 1.58 |
| TCONS_00017460 | SEQ 1259 | 0.52836 | 1.11 |
| TCONS_00066515 | SEQ 2078 | 0.52836 | 1.06 |
| TCONS_00050346 | SEQ 1877 | 0.52836 | 0.55 |
| TCONS_00066404 | SEQ 2086 | 0.52962 | 1.57 |
| TCONS_00059427 | SEQ 1949 | 0.52962 | 1.39 |
| TCONS_00014431 | SEQ 1255 | 0.52962 | 1.06 |
| TCONS_00019761 | SEQ 1298 | 0.52962 | 0.98 |
| TCONS_00044946 | SEQ 1740 | 0.52962 | 0.90 |
| TCONS_00000256 | SEQ 1053 | 0.52962 | 0.75 |
| TCONS_00062576 | SEQ 2015 | 0.54762 | 3.63 |
| TCONS_00011991 | SEQ 1221 | 0.54762 | 2.36 |
| TCONS_00037101 | SEQ 1634 | 0.54762 | 2.17 |
| TCONS_00055570 | SEQ 1914 | 0.54762 | 2.00 |
| TCONS_00055541 | SEQ 1910 | 0.54762 | 1.90 |
| TCONS_00044997 | SEQ 1756 | 0.54762 | 1.58 |
| TCONS_00026700 | SEQ 1416 | 0.54762 | 1.56 |
| TCONS_00036986 | SEQ 1666 | 0.54762 | 1.55 |
| TCONS_00033771 | SEQ 1551 | 0.54762 | 1.54 |
| TCONS_00062339 | SEQ 2010 | 0.54762 | 1.54 |
| TCONS_00008820 | SEQ 1148 | 0.54762 | 1.54 |
| TCONS_00000059 | SEQ 1018 | 0.54762 | 1.46 |
| TCONS_00055612 | SEQ 1919 | 0.54762 | 1.46 |
| TCONS_00000708 | SEQ 1057 | 0.54762 | 1.45 |
| TCONS_00023281 | SEQ 1350 | 0.54762 | 1.44 |
| TCONS_00011829 | SEQ 1189 | 0.54762 | 1.43 |
| TCONS_00023217 | SEQ 1376 | 0.54762 | 1.41 |
| TCONS_00027589 | SEQ 1503 | 0.54762 | 1.39 |

TABLE 7-continued

The 1091 novel lncRNAs identified by the invention and fold change and p-value
(differential expression in AD group versus healthy control group).

| lncRNA | SEQ | p-value | FC |
| --- | --- | --- | --- |
| TCONS_00027943 | SEQ 1481 | 0.54762 | 1.36 |
| TCONS_00027704 | SEQ 1527 | 0.54762 | 1.35 |
| TCONS_00011821 | SEQ 1187 | 0.54762 | 1.34 |
| TCONS_00027587 | SEQ 1502 | 0.54762 | 1.33 |
| TCONS_00008676 | SEQ 1153 | 0.54762 | 1.33 |
| TCONS_00005287 | SEQ 1135 | 0.54762 | 1.32 |
| TCONS_00000640 | SEQ 1046 | 0.54762 | 1.31 |
| TCONS_00045213 | SEQ 1743 | 0.54762 | 1.31 |
| TCONS_00008828 | SEQ 1150 | 0.54762 | 1.30 |
| TCONS_00066367 | SEQ 2071 | 0.54762 | 1.29 |
| TCONS_00040892 | SEQ 1684 | 0.54762 | 1.26 |
| TCONS_00021484 | SEQ 1343 | 0.54762 | 1.24 |
| TCONS_00062554 | SEQ 1984 | 0.54762 | 1.23 |
| TCONS_00027499 | SEQ 1475 | 0.54762 | 1.23 |
| TCONS_00050541 | SEQ 1830 | 0.54762 | 1.23 |
| TCONS_00062304 | SEQ 1987 | 0.54762 | 1.22 |
| TCONS_00026662 | SEQ 1405 | 0.54762 | 1.21 |
| TCONS_00037058 | SEQ 1623 | 0.54762 | 1.21 |
| TCONS_00062377 | SEQ 2034 | 0.54762 | 1.19 |
| TCONS_00027949 | SEQ 1486 | 0.54762 | 1.18 |
| TCONS_00059376 | SEQ 1926 | 0.54762 | 1.15 |
| TCONS_00000033 | SEQ 1016 | 0.54762 | 1.15 |
| TCONS_00023104 | SEQ 1348 | 0.54762 | 1.13 |
| TCONS_00055452 | SEQ 1889 | 0.54762 | 1.12 |
| TCONS_00014356 | SEQ 1229 | 0.54762 | 1.12 |
| TCONS_00004942 | SEQ 1112 | 0.54762 | 1.10 |
| TCONS_00036055 | SEQ 1613 | 0.54762 | 1.08 |
| TCONS_00021531 | SEQ 1316 | 0.54762 | 1.06 |
| TCONS_00005265 | SEQ 1124 | 0.54762 | 1.05 |
| TCONS_00000557 | SEQ 1027 | 0.54762 | 1.02 |
| TCONS_00027935 | SEQ 1466 | 0.54762 | 1.00 |
| TCONS_00023190 | SEQ 1369 | 0.54762 | 0.97 |
| TCONS_00026752 | SEQ 1423 | 0.54762 | 0.95 |
| TCONS_00050086 | SEQ 1810 | 0.54762 | 0.92 |
| TCONS_00019798 | SEQ 1305 | 0.54762 | 0.92 |
| TCONS_00062550 | SEQ 1980 | 0.54762 | 0.91 |
| TCONS_00000346 | SEQ 1079 | 0.54762 | 0.91 |
| TCONS_00000742 | SEQ 1070 | 0.54762 | 0.90 |
| TCONS_00062316 | SEQ 2001 | 0.54762 | 0.89 |
| TCONS_00021546 | SEQ 1323 | 0.54762 | 0.87 |
| TCONS_00050197 | SEQ 1839 | 0.54762 | 0.83 |
| TCONS_00027601 | SEQ 1506 | 0.54762 | 0.80 |
| TCONS_00008980 | SEQ 1184 | 0.54762 | 0.78 |
| TCONS_00008697 | SEQ 1161 | 0.54762 | 0.76 |
| TCONS_00055628 | SEQ 1921 | 0.54762 | 0.76 |
| TCONS_00045230 | SEQ 1747 | 0.54762 | 0.76 |
| TCONS_00027402 | SEQ 1445 | 0.54762 | 0.75 |
| TCONS_00035975 | SEQ 1594 | 0.54762 | 0.75 |
| TCONS_00014260 | SEQ 1248 | 0.54762 | 0.74 |
| TCONS_00027932 | SEQ 1463 | 0.54762 | 0.74 |
| TCONS_00036814 | SEQ 1625 | 0.54762 | 0.73 |
| TCONS_00011832 | SEQ 1192 | 0.54762 | 0.68 |
| TCONS_00050729 | SEQ 1881 | 0.54762 | 0.68 |
| TCONS_00033750 | SEQ 1545 | 0.54762 | 0.67 |
| TCONS_00066563 | SEQ 2107 | 0.54762 | 0.65 |
| TCONS_00027585 | SEQ 1500 | 0.54762 | 0.60 |
| TCONS_00050731 | SEQ 1882 | 0.54762 | 0.60 |
| TCONS_00000120 | SEQ 1029 | 0.54762 | 0.59 |
| TCONS_00045017 | SEQ 1766 | 0.54762 | 0.57 |
| TCONS_00059243 | SEQ 1945 | 0.54762 | 0.57 |
| TCONS_00023215 | SEQ 1375 | 0.54762 | 0.53 |
| TCONS_00005363 | SEQ 1145 | 0.59703 | 0.56 |
| TCONS_00014200 | SEQ 1234 | 0.59816 | 1.89 |
| TCONS_00037098 | SEQ 1633 | 0.59816 | 0.74 |
| TCONS_00027536 | SEQ 1494 | 0.59929 | 1.58 |
| TCONS_00035088 | SEQ 1563 | 0.59929 | 1.48 |
| TCONS_00008776 | SEQ 1180 | 0.59929 | 0.71 |
| TCONS_00019694 | SEQ 1291 | 0.59929 | 0.70 |
| TCONS_00000321 | SEQ 1069 | 0.60040 | 1.81 |
| TCONS_00017396 | SEQ 1278 | 0.60040 | 1.63 |
| TCONS_00040930 | SEQ 1700 | 0.60040 | 1.50 |
| TCONS_00066384 | SEQ 2081 | 0.60040 | 1.49 |
| TCONS_00036109 | SEQ 1601 | 0.60040 | 1.47 |
| TCONS_00050306 | SEQ 1870 | 0.60040 | 1.18 |
| TCONS_00005183 | SEQ 1111 | 0.60040 | 1.16 |

TABLE 7-continued

The 1091 novel lncRNAs identified by the invention and fold change and p-value
(differential expression in AD group versus healthy control group).

| lncRNA | SEQ | p-value | FC |
| --- | --- | --- | --- |
| TCONS_00000523 | SEQ 1019 | 0.60040 | 1.01 |
| TCONS_00062549 | SEQ 1979 | 0.60040 | 0.80 |
| TCONS_00066479 | SEQ 2064 | 0.60040 | 0.77 |
| TCONS_00062496 | SEQ 1966 | 0.60724 | >100 |
| TCONS_00027590 | SEQ 1504 | 0.60724 | 10.54 |
| TCONS_00000531 | SEQ 1020 | 0.60724 | 2.40 |
| TCONS_00028006 | SEQ 1497 | 0.60724 | 1.02 |
| TCONS_00040662 | SEQ 1694 | 0.66231 | 1.25 |
| TCONS_00040905 | SEQ 1688 | 0.66843 | 1.54 |
| TCONS_00008965 | SEQ 1181 | 0.67040 | 2.00 |
| TCONS_00014150 | SEQ 1226 | 0.67040 | 1.90 |
| TCONS_00062278 | SEQ 1970 | 0.67137 | 0.36 |
| TCONS_00008851 | SEQ 1164 | 0.67137 | 0.19 |
| TCONS_00062704 | SEQ 2046 | 0.67137 | 1.16 |
| TCONS_00055724 | SEQ 1897 | 0.67137 | 0.69 |
| TCONS_00050563 | SEQ 1836 | 0.67234 | 2.39 |
| TCONS_00044945 | SEQ 1739 | 0.67234 | 1.36 |
| TCONS_00005005 | SEQ 1127 | 0.67234 | 0.71 |
| TCONS_00019799 | SEQ 1306 | 0.67424 | 1.48 |
| TCONS_00050235 | SEQ 1856 | 0.67424 | 1.06 |
| TCONS_00008677 | SEQ 1154 | 0.67424 | 0.57 |
| TCONS_00059214 | SEQ 1938 | 0.67517 | 2.88 |
| TCONS_00059212 | SEQ 1936 | 0.67517 | 2.41 |
| TCONS_00017530 | SEQ 1282 | 0.67517 | 1.93 |
| TCONS_00000551 | SEQ 1023 | 0.67517 | 1.49 |
| TCONS_00027471 | SEQ 1454 | 0.67517 | 0.86 |
| TCONS_00027750 | SEQ 1429 | 0.67517 | 0.70 |
| TCONS_00027703 | SEQ 1526 | 0.67517 | 0.54 |
| TCONS_00036836 | SEQ 1630 | 0.69048 | 0.47 |
| TCONS_00062275 | SEQ 1968 | 0.69048 | 0.34 |
| TCONS_00050089 | SEQ 1813 | 0.69048 | 0.29 |
| TCONS_00017348 | SEQ 1262 | 0.69048 | 2.42 |
| TCONS_00044919 | SEQ 1733 | 0.69048 | 2.23 |
| TCONS_00023221 | SEQ 1380 | 0.69048 | 1.93 |
| TCONS_00023323 | SEQ 1359 | 0.69048 | 1.91 |
| TCONS_00027767 | SEQ 1438 | 0.69048 | 1.88 |
| TCONS_00036034 | SEQ 1610 | 0.69048 | 1.81 |
| TCONS_00028167 | SEQ 1537 | 0.69048 | 1.76 |
| TCONS_00012068 | SEQ 1205 | 0.69048 | 1.73 |
| TCONS_00023174 | SEQ 1368 | 0.69048 | 1.72 |
| TCONS_00028054 | SEQ 1508 | 0.69048 | 1.60 |
| TCONS_00062558 | SEQ 1994 | 0.69048 | 1.55 |
| TCONS_00045182 | SEQ 1799 | 0.69048 | 1.52 |
| TCONS_00027944 | SEQ 1482 | 0.69048 | 1.44 |
| TCONS_00040703 | SEQ 1707 | 0.69048 | 1.44 |
| TCONS_00028113 | SEQ 1515 | 0.69048 | 1.43 |
| TCONS_00045346 | SEQ 1781 | 0.69048 | 1.41 |
| TCONS_00000260 | SEQ 1054 | 0.69048 | 1.39 |
| TCONS_00055508 | SEQ 1899 | 0.69048 | 1.38 |
| TCONS_00050070 | SEQ 1806 | 0.69048 | 1.33 |
| TCONS_00035093 | SEQ 1570 | 0.69048 | 1.29 |
| TCONS_00005037 | SEQ 1136 | 0.69048 | 1.29 |
| TCONS_00000650 | SEQ 1049 | 0.69048 | 1.29 |
| TCONS_00027494 | SEQ 1468 | 0.69048 | 1.28 |
| TCONS_00066504 | SEQ 2069 | 0.69048 | 1.27 |
| TCONS_00008871 | SEQ 1169 | 0.69048 | 1.26 |
| TCONS_00027416 | SEQ 1449 | 0.69048 | 1.25 |
| TCONS_00062579 | SEQ 2018 | 0.69048 | 1.24 |
| TCONS_00014136 | SEQ 1223 | 0.69048 | 1.23 |
| TCONS_00021619 | SEQ 1341 | 0.69048 | 1.23 |
| TCONS_00000009 | SEQ 1011 | 0.69048 | 1.23 |
| TCONS_00040658 | SEQ 1689 | 0.69048 | 1.22 |
| TCONS_00059271 | SEQ 1948 | 0.69048 | 1.22 |
| TCONS_00036123 | SEQ 1605 | 0.69048 | 1.20 |
| TCONS_00000751 | SEQ 1072 | 0.69048 | 1.20 |
| TCONS_00027400 | SEQ 1444 | 0.69048 | 1.17 |
| TCONS_00045438 | SEQ 1794 | 0.69048 | 1.15 |
| TCONS_00062551 | SEQ 1981 | 0.69048 | 1.14 |
| TCONS_00012059 | SEQ 1200 | 0.69048 | 1.14 |
| TCONS_00033689 | SEQ 1560 | 0.69048 | 1.13 |
| TCONS_00050017 | SEQ 1804 | 0.69048 | 1.12 |
| TCONS_00036113 | SEQ 1603 | 0.69048 | 1.11 |
| TCONS_00004983 | SEQ 1121 | 0.69048 | 1.11 |
| TCONS_00033710 | SEQ 1540 | 0.69048 | 1.10 |
| TCONS_00040895 | SEQ 1686 | 0.69048 | 1.10 |

TABLE 7-continued

The 1091 novel lncRNAs identified by the invention and fold change and p-value
(differential expression in AD group versus healthy control group).

| lncRNA | SEQ | p-value | FC |
| --- | --- | --- | --- |
| TCONS_00014428 | SEQ 1253 | 0.69048 | 1.07 |
| TCONS_00005077 | SEQ 1142 | 0.69048 | 1.06 |
| TCONS_00059297 | SEQ 1957 | 0.69048 | 1.04 |
| TCONS_00036901 | SEQ 1646 | 0.69048 | 1.03 |
| TCONS_00055681 | SEQ 1887 | 0.69048 | 1.00 |
| TCONS_00050638 | SEQ 1871 | 0.69048 | 0.99 |
| TCONS_00062730 | SEQ 2051 | 0.69048 | 0.98 |
| TCONS_00005008 | SEQ 1129 | 0.69048 | 0.97 |
| TCONS_00023131 | SEQ 1356 | 0.69048 | 0.95 |
| TCONS_00040590 | SEQ 1677 | 0.69048 | 0.94 |
| TCONS_00023085 | SEQ 1344 | 0.69048 | 0.93 |
| TCONS_00062305 | SEQ 1988 | 0.69048 | 0.92 |
| TCONS_00000127 | SEQ 1034 | 0.69048 | 0.92 |
| TCONS_00062347 | SEQ 2021 | 0.69048 | 0.89 |
| TCONS_00036813 | SEQ 1624 | 0.69048 | 0.89 |
| TCONS_00017328 | SEQ 1260 | 0.69048 | 0.89 |
| TCONS_00036984 | SEQ 1664 | 0.69048 | 0.89 |
| TCONS_00008856 | SEQ 1166 | 0.69048 | 0.87 |
| TCONS_00004943 | SEQ 1113 | 0.69048 | 0.86 |
| TCONS_00062572 | SEQ 2007 | 0.69048 | 0.86 |
| TCONS_00037090 | SEQ 1632 | 0.69048 | 0.85 |
| TCONS_00036093 | SEQ 1595 | 0.69048 | 0.83 |
| TCONS_00066409 | SEQ 2090 | 0.69048 | 0.83 |
| TCONS_00019776 | SEQ 1302 | 0.69048 | 0.82 |
| TCONS_00026614 | SEQ 1421 | 0.69048 | 0.82 |
| TCONS_00059284 | SEQ 1952 | 0.69048 | 0.82 |
| TCONS_00035978 | SEQ 1598 | 0.69048 | 0.82 |
| TCONS_00044941 | SEQ 1737 | 0.69048 | 0.81 |
| TCONS_00000345 | SEQ 1078 | 0.69048 | 0.81 |
| TCONS_00033664 | SEQ 1552 | 0.69048 | 0.80 |
| TCONS_00062302 | SEQ 1985 | 0.69048 | 0.79 |
| TCONS_00035096 | SEQ 1576 | 0.69048 | 0.79 |
| TCONS_00000006 | SEQ 1010 | 0.69048 | 0.79 |
| TCONS_00024807 | SEQ 1393 | 0.69048 | 0.77 |
| TCONS_00000735 | SEQ 1067 | 0.69048 | 0.73 |
| TCONS_00050598 | SEQ 1857 | 0.69048 | 0.71 |
| TCONS_00014211 | SEQ 1239 | 0.69048 | 0.71 |
| TCONS_00027711 | SEQ 1533 | 0.69048 | 0.69 |
| TCONS_00059424 | SEQ 1947 | 0.69048 | 0.69 |
| TCONS_00017350 | SEQ 1264 | 0.69048 | 0.65 |
| TCONS_00044948 | SEQ 1741 | 0.69048 | 0.64 |
| TCONS_00050219 | SEQ 1851 | 0.69048 | 0.64 |
| TCONS_00033649 | SEQ 1546 | 0.69048 | 0.64 |
| TCONS_00066412 | SEQ 2091 | 0.69048 | 0.63 |
| TCONS_00019765 | SEQ 1299 | 0.69048 | 0.59 |
| TCONS_00014453 | SEQ 1256 | 0.69048 | 0.59 |
| TCONS_00000723 | SEQ 1058 | 0.69048 | 0.54 |
| TCONS_00027530 | SEQ 1491 | 0.72408 | 2.29 |
| TCONS_00050316 | SEQ 1872 | 0.74568 | 0.27 |
| TCONS_00055421 | SEQ 1885 | 0.75033 | 2.82 |
| TCONS_00005243 | SEQ 1120 | 0.75033 | 1.39 |
| TCONS_00000338 | SEQ 1074 | 0.75033 | 0.78 |
| TCONS_00066451 | SEQ 2105 | 0.75257 | 0.48 |
| TCONS_00027505 | SEQ 1480 | 0.75257 | 1.29 |
| TCONS_00040947 | SEQ 1704 | 0.75257 | 1.14 |
| TCONS_00021392 | SEQ 1317 | 0.75257 | 0.69 |
| TCONS_00005182 | SEQ 1110 | 0.75257 | 0.69 |
| TCONS_00026597 | SEQ 1420 | 0.75330 | 1.73 |
| TCONS_00062376 | SEQ 2033 | 0.75330 | 1.43 |
| TCONS_00024847 | SEQ 1403 | 0.75330 | 1.25 |
| TCONS_00035994 | SEQ 1602 | 0.75330 | 1.23 |
| TCONS_00045240 | SEQ 1748 | 0.75330 | 1.15 |
| TCONS_00050459 | SEQ 1808 | 0.75330 | 1.13 |
| TCONS_00059174 | SEQ 1924 | 0.75330 | 1.09 |
| TCONS_00050703 | SEQ 1879 | 0.75330 | 1.04 |
| TCONS_00050115 | SEQ 1817 | 0.75330 | 1.00 |
| TCONS_00066517 | SEQ 2082 | 0.75330 | 0.96 |
| TCONS_00008889 | SEQ 1172 | 0.75330 | 0.95 |
| TCONS_00024818 | SEQ 1399 | 0.75330 | 0.88 |
| TCONS_00040697 | SEQ 1701 | 0.75330 | 0.85 |
| TCONS_00028140 | SEQ 1532 | 0.75330 | 0.82 |
| TCONS_00024808 | SEQ 1394 | 0.75330 | 0.78 |
| TCONS_00059185 | SEQ 1927 | 0.75330 | 0.76 |
| TCONS_00019685 | SEQ 1289 | 0.75330 | 0.70 |
| TCONS_00024812 | SEQ 1397 | 0.75330 | 0.64 |

TABLE 7-continued

The 1091 novel lncRNAs identified by the invention and fold change and p-value
(differential expression in AD group versus healthy control group).

| lncRNA | SEQ | p-value | FC |
| --- | --- | --- | --- |
| TCONS_00055414 | SEQ 1883 | 0.79625 | 0.32 |
| TCONS_00068985 | SEQ 2108 | 0.79625 | 1.50 |
| TCONS_00045134 | SEQ 1793 | 0.79717 | <0.01 |
| TCONS_00066372 | SEQ 2075 | 0.79717 | <0.01 |
| TCONS_00014398 | SEQ 1241 | 0.79717 | 0.41 |
| TCONS_00019846 | SEQ 1293 | 0.79717 | 0.28 |
| TCONS_00037193 | SEQ 1658 | 0.79717 | 0.09 |
| TCONS_00045108 | SEQ 1783 | 0.82306 | 0.56 |
| TCONS_00026535 | SEQ 1406 | 0.82366 | 0.70 |
| TCONS_00026562 | SEQ 1415 | 0.82881 | 0.67 |
| TCONS_00023171 | SEQ 1367 | 0.82936 | 3.24 |
| TCONS_00059213 | SEQ 1937 | 0.82936 | 1.57 |
| TCONS_00019869 | SEQ 1296 | 0.82936 | 1.50 |
| TCONS_00040700 | SEQ 1703 | 0.82936 | 1.29 |
| TCONS_00008901 | SEQ 1173 | 0.83148 | 0.32 |
| TCONS_00024904 | SEQ 1401 | 0.83148 | 2.25 |
| TCONS_00000121 | SEQ 1030 | 0.83148 | 1.17 |
| TCONS_00062636 | SEQ 2035 | 0.83200 | 1.11 |
| TCONS_00023219 | SEQ 1378 | 0.83252 | 0.32 |
| TCONS_00027819 | SEQ 1441 | 0.83252 | 2.35 |
| TCONS_00044998 | SEQ 1763 | 0.83252 | 1.57 |
| TCONS_00045396 | SEQ 1788 | 0.83252 | 1.32 |
| TCONS_00045394 | SEQ 1787 | 0.83252 | 1.23 |
| TCONS_00062458 | SEQ 2048 | 0.83252 | 1.18 |
| TCONS_00066383 | SEQ 2080 | 0.83252 | 0.78 |
| TCONS_00027705 | SEQ 1528 | 0.83252 | 0.71 |
| TCONS_00059433 | SEQ 1953 | 0.83303 | 0.12 |
| TCONS_00008716 | SEQ 1168 | 0.83353 | 0.49 |
| TCONS_00045024 | SEQ 1767 | 0.83353 | 2.93 |
| TCONS_00040829 | SEQ 1723 | 0.83353 | 1.89 |
| TCONS_00055425 | SEQ 1886 | 0.83353 | 1.37 |
| TCONS_00008905 | SEQ 1174 | 0.83353 | 1.35 |
| TCONS_00005111 | SEQ 1144 | 0.83353 | 1.15 |
| TCONS_00055652 | SEQ 1884 | 0.83353 | 1.13 |
| TCONS_00011967 | SEQ 1215 | 0.83353 | 1.12 |
| TCONS_00017420 | SEQ 1283 | 0.83353 | 0.91 |
| TCONS_00045003 | SEQ 1765 | 0.83353 | 0.78 |
| TCONS_00027533 | SEQ 1493 | 0.83404 | 1.18 |
| TCONS_00062369 | SEQ 2032 | 0.83404 | 1.14 |
| TCONS_00008955 | SEQ 1179 | 0.83404 | 1.06 |
| TCONS_00036780 | SEQ 1615 | 0.83404 | 1.03 |
| TCONS_00066327 | SEQ 2060 | 0.83404 | 0.92 |
| TCONS_00000826 | SEQ 1093 | 0.83404 | 0.83 |
| TCONS_00021579 | SEQ 1338 | 0.83404 | 0.80 |
| TCONS_00012010 | SEQ 1186 | 0.83404 | 0.65 |
| TCONS_00062411 | SEQ 2036 | 0.83404 | 0.64 |
| TCONS_00045214 | SEQ 1744 | 0.84127 | 0.33 |
| TCONS_00008880 | SEQ 1171 | 0.84127 | 2.77 |
| TCONS_00014402 | SEQ 1243 | 0.84127 | 1.82 |
| TCONS_00036891 | SEQ 1639 | 0.84127 | 1.66 |
| TCONS_00033686 | SEQ 1557 | 0.84127 | 1.60 |
| TCONS_00012031 | SEQ 1196 | 0.84127 | 1.54 |
| TCONS_00044995 | SEQ 1754 | 0.84127 | 1.47 |
| TCONS_00023324 | SEQ 1360 | 0.84127 | 1.40 |
| TCONS_00037122 | SEQ 1647 | 0.84127 | 1.39 |
| TCONS_00040917 | SEQ 1691 | 0.84127 | 1.35 |
| TCONS_00050198 | SEQ 1840 | 0.84127 | 1.33 |
| TCONS_00037148 | SEQ 1653 | 0.84127 | 1.32 |
| TCONS_00059205 | SEQ 1933 | 0.84127 | 1.31 |
| TCONS_00037198 | SEQ 1659 | 0.84127 | 1.31 |
| TCONS_00005001 | SEQ 1125 | 0.84127 | 1.30 |
| TCONS_00014417 | SEQ 1247 | 0.84127 | 1.29 |
| TCONS_00050274 | SEQ 1863 | 0.84127 | 1.28 |
| TCONS_00062556 | SEQ 1992 | 0.84127 | 1.27 |
| TCONS_00055750 | SEQ 1904 | 0.84127 | 1.25 |
| TCONS_00059386 | SEQ 1940 | 0.84127 | 1.22 |
| TCONS_00028112 | SEQ 1514 | 0.84127 | 1.22 |
| TCONS_00000041 | SEQ 1017 | 0.84127 | 1.21 |
| TCONS_00045078 | SEQ 1777 | 0.84127 | 1.21 |
| TCONS_00050275 | SEQ 1864 | 0.84127 | 1.18 |
| TCONS_00005140 | SEQ 1107 | 0.84127 | 1.18 |
| TCONS_00040821 | SEQ 1722 | 0.84127 | 1.17 |
| TCONS_00050193 | SEQ 1838 | 0.84127 | 1.17 |
| TCONS_00036032 | SEQ 1609 | 0.84127 | 1.17 |
| TCONS_00036900 | SEQ 1645 | 0.84127 | 1.16 |

TABLE 7-continued

The 1091 novel lncRNAs identified by the invention and fold change and p-value
(differential expression in AD group versus healthy control group).

| lncRNA | SEQ | p-value | FC |
| --- | --- | --- | --- |
| TCONS_00026539 | SEQ 1409 | 0.84127 | 1.16 |
| TCONS_00023164 | SEQ 1365 | 0.84127 | 1.16 |
| TCONS_00036886 | SEQ 1637 | 0.84127 | 1.15 |
| TCONS_00000727 | SEQ 1060 | 0.84127 | 1.15 |
| TCONS_00062577 | SEQ 2016 | 0.84127 | 1.14 |
| TCONS_00014408 | SEQ 1246 | 0.84127 | 1.14 |
| TCONS_00028114 | SEQ 1516 | 0.84127 | 1.13 |
| TCONS_00050609 | SEQ 1862 | 0.84127 | 1.13 |
| TCONS_00014465 | SEQ 1258 | 0.84127 | 1.12 |
| TCONS_00000628 | SEQ 1039 | 0.84127 | 1.12 |
| TCONS_00062574 | SEQ 2013 | 0.84127 | 1.12 |
| TCONS_00014168 | SEQ 1228 | 0.84127 | 1.12 |
| TCONS_00005006 | SEQ 1128 | 0.84127 | 1.11 |
| TCONS_00062301 | SEQ 1982 | 0.84127 | 1.11 |
| TCONS_00050673 | SEQ 1878 | 0.84127 | 1.11 |
| TCONS_00027497 | SEQ 1473 | 0.84127 | 1.11 |
| TCONS_00055751 | SEQ 1905 | 0.84127 | 1.10 |
| TCONS_00012069 | SEQ 1206 | 0.84127 | 1.10 |
| TCONS_00062345 | SEQ 2020 | 0.84127 | 1.09 |
| TCONS_00021571 | SEQ 1337 | 0.84127 | 1.09 |
| TCONS_00000439 | SEQ 1099 | 0.84127 | 1.08 |
| TCONS_00050474 | SEQ 1816 | 0.84127 | 1.06 |
| TCONS_00000180 | SEQ 1038 | 0.84127 | 1.06 |
| TCONS_00023199 | SEQ 1373 | 0.84127 | 1.05 |
| TCONS_00012021 | SEQ 1193 | 0.84127 | 1.05 |
| TCONS_00062575 | SEQ 2014 | 0.84127 | 1.04 |
| TCONS_00017371 | SEQ 1272 | 0.84127 | 1.02 |
| TCONS_00023325 | SEQ 1361 | 0.84127 | 1.01 |
| TCONS_00027938 | SEQ 1477 | 0.84127 | 1.01 |
| TCONS_00017408 | SEQ 1279 | 0.84127 | 1.00 |
| TCONS_00028093 | SEQ 1509 | 0.84127 | 1.00 |
| TCONS_00045472 | SEQ 1800 | 0.84127 | 0.99 |
| TCONS_00000032 | SEQ 1015 | 0.84127 | 0.99 |
| TCONS_00005340 | SEQ 1143 | 0.84127 | 0.98 |
| TCONS_00008833 | SEQ 1151 | 0.84127 | 0.95 |
| TCONS_00062359 | SEQ 2028 | 0.84127 | 0.95 |
| TCONS_00050129 | SEQ 1821 | 0.84127 | 0.93 |
| TCONS_00066371 | SEQ 2074 | 0.84127 | 0.92 |
| TCONS_00021405 | SEQ 1325 | 0.84127 | 0.91 |
| TCONS_00062307 | SEQ 1990 | 0.84127 | 0.90 |
| TCONS_00000733 | SEQ 1065 | 0.84127 | 0.89 |
| TCONS_00035023 | SEQ 1568 | 0.84127 | 0.89 |
| TCONS_00050262 | SEQ 1859 | 0.84127 | 0.89 |
| TCONS_00059274 | SEQ 1950 | 0.84127 | 0.88 |
| TCONS_00033688 | SEQ 1559 | 0.84127 | 0.88 |
| TCONS_00062421 | SEQ 2039 | 0.84127 | 0.86 |
| TCONS_00036132 | SEQ 1606 | 0.84127 | 0.85 |
| TCONS_00036919 | SEQ 1650 | 0.84127 | 0.84 |
| TCONS_00000347 | SEQ 1080 | 0.84127 | 0.83 |
| TCONS_00005011 | SEQ 1132 | 0.84127 | 0.81 |
| TCONS_00035105 | SEQ 1584 | 0.84127 | 0.80 |
| TCONS_00024809 | SEQ 1395 | 0.84127 | 0.80 |
| TCONS_00062350 | SEQ 2025 | 0.84127 | 0.79 |
| TCONS_00021416 | SEQ 1328 | 0.84127 | 0.78 |
| TCONS_00035973 | SEQ 1593 | 0.84127 | 0.77 |
| TCONS_00066532 | SEQ 2087 | 0.84127 | 0.77 |
| TCONS_00000537 | SEQ 1022 | 0.84127 | 0.76 |
| TCONS_00027954 | SEQ 1489 | 0.84127 | 0.72 |
| TCONS_00045402 | SEQ 1791 | 0.84127 | 0.71 |
| TCONS_00036031 | SEQ 1608 | 0.84127 | 0.69 |
| TCONS_00008840 | SEQ 1157 | 0.84127 | 0.66 |
| TCONS_00005136 | SEQ 1103 | 0.84127 | 0.65 |
| TCONS_00036816 | SEQ 1626 | 0.84127 | 0.65 |
| TCONS_00000440 | SEQ 1100 | 0.84127 | 0.60 |
| TCONS_00040802 | SEQ 1718 | 0.84127 | 0.59 |
| TCONS_00027586 | SEQ 1501 | 0.84127 | 0.53 |
| TCONS_00021419 | SEQ 1329 | 0.91098 | 1.42 |
| TCONS_00027825 | SEQ 1446 | 0.91418 | 0.96 |
| TCONS_00005121 | SEQ 1146 | 0.91553 | 0.47 |
| TCONS_00027470 | SEQ 1452 | 0.91553 | 0.45 |
| TCONS_00066456 | SEQ 2056 | 0.91553 | 2.45 |
| TCONS_00021397 | SEQ 1321 | 0.91553 | 1.52 |
| TCONS_00040996 | SEQ 1714 | 0.91605 | 1.11 |
| TCONS_00045110 | SEQ 1786 | 0.91631 | 4.00 |
| TCONS_00026688 | SEQ 1412 | 0.91631 | 2.52 |

TABLE 7-continued

The 1091 novel lncRNAs identified by the invention and fold change and p-value
(differential expression in AD group versus healthy control group).

| lncRNA | SEQ | p-value | FC |
| --- | --- | --- | --- |
| TCONS_00000553 | SEQ 1025 | 0.91631 | 1.52 |
| TCONS_00055512 | SEQ 1900 | 0.91631 | 0.96 |
| TCONS_00055543 | SEQ 1912 | 0.91631 | 0.96 |
| TCONS_00033770 | SEQ 1550 | 0.91631 | 0.94 |
| TCONS_00027706 | SEQ 1529 | 0.91631 | 0.91 |
| TCONS_00059333 | SEQ 1961 | 0.91656 | 0.41 |
| TCONS_00028099 | SEQ 1510 | 0.91656 | 0.38 |
| TCONS_00000792 | SEQ 1088 | 0.91656 | 2.28 |
| TCONS_00062664 | SEQ 2037 | 0.91656 | 1.67 |
| TCONS_00000552 | SEQ 1024 | 0.91656 | 1.34 |
| TCONS_00066463 | SEQ 2062 | 0.91656 | 1.34 |
| TCONS_00008683 | SEQ 1156 | 0.91656 | 1.32 |
| TCONS_00000315 | SEQ 1068 | 0.91656 | 1.27 |
| TCONS_00005264 | SEQ 1123 | 0.91656 | 1.20 |
| TCONS_00000420 | SEQ 1092 | 0.91656 | 1.10 |
| TCONS_00050059 | SEQ 1805 | 0.91656 | 1.10 |
| TCONS_00059183 | SEQ 1925 | 0.91656 | 1.08 |
| TCONS_00000461 | SEQ 1013 | 0.91656 | 1.01 |
| TCONS_00059435 | SEQ 1954 | 0.91656 | 0.99 |
| TCONS_00011961 | SEQ 1212 | 0.91656 | 0.95 |
| TCONS_00000559 | SEQ 1028 | 0.91656 | 0.92 |
| TCONS_00066444 | SEQ 2104 | 0.91656 | 0.87 |
| TCONS_00066318 | SEQ 2057 | 0.91656 | 0.61 |
| TCONS_00011903 | SEQ 1207 | 1.00000 | 0.50 |
| TCONS_00045299 | SEQ 1768 | 1.00000 | 0.48 |
| TCONS_00059464 | SEQ 1958 | 1.00000 | 0.32 |
| TCONS_00017426 | SEQ 1284 | 1.00000 | 0.27 |
| TCONS_00050543 | SEQ 1834 | 1.00000 | 0.24 |
| TCONS_00062333 | SEQ 2006 | 1.00000 | 0.14 |
| TCONS_00027922 | SEQ 1456 | 1.00000 | 0.07 |
| TCONS_00069000 | SEQ 2114 | 1.00000 | 56.73 |
| TCONS_00004967 | SEQ 1119 | 1.00000 | 11.00 |
| TCONS_00004966 | SEQ 1117 | 1.00000 | 5.60 |
| TCONS_00000732 | SEQ 1064 | 1.00000 | 3.88 |
| TCONS_00008879 | SEQ 1170 | 1.00000 | 2.91 |
| TCONS_00023170 | SEQ 1366 | 1.00000 | 2.68 |
| TCONS_00012016 | SEQ 1188 | 1.00000 | 2.66 |
| TCONS_00050175 | SEQ 1827 | 1.00000 | 1.90 |
| TCONS_00000793 | SEQ 1089 | 1.00000 | 1.79 |
| TCONS_00050502 | SEQ 1822 | 1.00000 | 1.73 |
| TCONS_00005241 | SEQ 1116 | 1.00000 | 1.65 |
| TCONS_00005010 | SEQ 1131 | 1.00000 | 1.59 |
| TCONS_00000203 | SEQ 1043 | 1.00000 | 1.52 |
| TCONS_00021599 | SEQ 1340 | 1.00000 | 1.48 |
| TCONS_00062343 | SEQ 2019 | 1.00000 | 1.39 |
| TCONS_00040834 | SEQ 1725 | 1.00000 | 1.39 |
| TCONS_00000837 | SEQ 1102 | 1.00000 | 1.38 |
| TCONS_00062520 | SEQ 1974 | 1.00000 | 1.38 |
| TCONS_00055634 | SEQ 1922 | 1.00000 | 1.37 |
| TCONS_00036922 | SEQ 1651 | 1.00000 | 1.36 |
| TCONS_00050295 | SEQ 1868 | 1.00000 | 1.36 |
| TCONS_00021481 | SEQ 1342 | 1.00000 | 1.36 |
| TCONS_00024798 | SEQ 1390 | 1.00000 | 1.35 |
| TCONS_00036838 | SEQ 1631 | 1.00000 | 1.33 |
| TCONS_00050214 | SEQ 1848 | 1.00000 | 1.31 |
| TCONS_00014187 | SEQ 1231 | 1.00000 | 1.28 |
| TCONS_00062454 | SEQ 2047 | 1.00000 | 1.28 |
| TCONS_00017352 | SEQ 1266 | 1.00000 | 1.27 |
| TCONS_00035075 | SEQ 1590 | 1.00000 | 1.26 |
| TCONS_00012032 | SEQ 1197 | 1.00000 | 1.24 |
| TCONS_00036985 | SEQ 1665 | 1.00000 | 1.24 |
| TCONS_00000348 | SEQ 1081 | 1.00000 | 1.24 |
| TCONS_00000300 | SEQ 1061 | 1.00000 | 1.23 |
| TCONS_00004987 | SEQ 1122 | 1.00000 | 1.22 |
| TCONS_00026734 | SEQ 1419 | 1.00000 | 1.21 |
| TCONS_00050526 | SEQ 1824 | 1.00000 | 1.20 |
| TCONS_00011994 | SEQ 1222 | 1.00000 | 1.20 |
| TCONS_00008682 | SEQ 1155 | 1.00000 | 1.20 |
| TCONS_00026557 | SEQ 1413 | 1.00000 | 1.18 |
| TCONS_00019797 | SEQ 1304 | 1.00000 | 1.18 |
| TCONS_00045042 | SEQ 1770 | 1.00000 | 1.16 |
| TCONS_00011830 | SEQ 1190 | 1.00000 | 1.16 |
| TCONS_00037176 | SEQ 1656 | 1.00000 | 1.16 |
| TCONS_00041064 | SEQ 1726 | 1.00000 | 1.15 |
| TCONS_00017376 | SEQ 1277 | 1.00000 | 1.15 |

TABLE 7-continued

The 1091 novel lncRNAs identified by the invention and fold change and p-value (differential expression in AD group versus healthy control group).

| lncRNA | SEQ | p-value | FC |
| --- | --- | --- | --- |
| TCONS_00037147 | SEQ 1652 | 1.00000 | 1.14 |
| TCONS_00033755 | SEQ 1547 | 1.00000 | 1.14 |
| TCONS_00017375 | SEQ 1276 | 1.00000 | 1.13 |
| TCONS_00005274 | SEQ 1133 | 1.00000 | 1.13 |
| TCONS_00037212 | SEQ 1661 | 1.00000 | 1.13 |
| TCONS_00036781 | SEQ 1617 | 1.00000 | 1.13 |
| TCONS_00036095 | SEQ 1599 | 1.00000 | 1.12 |
| TCONS_00037152 | SEQ 1654 | 1.00000 | 1.12 |
| TCONS_00027948 | SEQ 1485 | 1.00000 | 1.11 |
| TCONS_00066382 | SEQ 2079 | 1.00000 | 1.11 |
| TCONS_00050168 | SEQ 1825 | 1.00000 | 1.10 |
| TCONS_00008698 | SEQ 1162 | 1.00000 | 1.10 |
| TCONS_00037000 | SEQ 1669 | 1.00000 | 1.09 |
| TCONS_00062548 | SEQ 1978 | 1.00000 | 1.09 |
| TCONS_00040916 | SEQ 1690 | 1.00000 | 1.08 |
| TCONS_00062552 | SEQ 1983 | 1.00000 | 1.08 |
| TCONS_00014387 | SEQ 1235 | 1.00000 | 1.06 |
| TCONS_00059500 | SEQ 1964 | 1.00000 | 1.06 |
| TCONS_00011969 | SEQ 1216 | 1.00000 | 1.05 |
| TCONS_00023276 | SEQ 1347 | 1.00000 | 1.05 |
| TCONS_00012043 | SEQ 1199 | 1.00000 | 1.05 |
| TCONS_00014237 | SEQ 1242 | 1.00000 | 1.05 |
| TCONS_00066440 | SEQ 2101 | 1.00000 | 1.05 |
| TCONS_00066373 | SEQ 2076 | 1.00000 | 1.04 |
| TCONS_00023115 | SEQ 1352 | 1.00000 | 1.04 |
| TCONS_00000349 | SEQ 1082 | 1.00000 | 1.04 |
| TCONS_00023218 | SEQ 1377 | 1.00000 | 1.04 |
| TCONS_00055486 | SEQ 1895 | 1.00000 | 1.04 |
| TCONS_00027760 | SEQ 1433 | 1.00000 | 1.04 |
| TCONS_00066370 | SEQ 2073 | 1.00000 | 1.04 |
| TCONS_00040762 | SEQ 1716 | 1.00000 | 1.03 |
| TCONS_00040893 | SEQ 1685 | 1.00000 | 1.03 |
| TCONS_00050604 | SEQ 1858 | 1.00000 | 1.03 |
| TCONS_00014165 | SEQ 1227 | 1.00000 | 1.03 |
| TCONS_00035022 | SEQ 1567 | 1.00000 | 1.03 |
| TCONS_00008675 | SEQ 1152 | 1.00000 | 1.02 |
| TCONS_00008699 | SEQ 1163 | 1.00000 | 1.02 |
| TCONS_00040890 | SEQ 1683 | 1.00000 | 1.02 |
| TCONS_00000224 | SEQ 1048 | 1.00000 | 1.02 |
| TCONS_00055758 | SEQ 1908 | 1.00000 | 1.02 |
| TCONS_00026652 | SEQ 1428 | 1.00000 | 1.02 |
| TCONS_00026558 | SEQ 1414 | 1.00000 | 1.02 |
| TCONS_00062589 | SEQ 2027 | 1.00000 | 1.01 |
| TCONS_00045341 | SEQ 1778 | 1.00000 | 1.01 |
| TCONS_00000655 | SEQ 1050 | 1.00000 | 1.01 |
| TCONS_00027670 | SEQ 1520 | 1.00000 | 1.01 |
| TCONS_00027708 | SEQ 1530 | 1.00000 | 1.00 |
| TCONS_00062581 | SEQ 2022 | 1.00000 | 1.00 |
| TCONS_00037199 | SEQ 1660 | 1.00000 | 0.99 |
| TCONS_00014388 | SEQ 1236 | 1.00000 | 0.99 |
| TCONS_00050301 | SEQ 1869 | 1.00000 | 0.99 |
| TCONS_00026766 | SEQ 1426 | 1.00000 | 0.98 |
| TCONS_00050728 | SEQ 1880 | 1.00000 | 0.97 |
| TCONS_00040670 | SEQ 1696 | 1.00000 | 0.97 |
| TCONS_00050653 | SEQ 1874 | 1.00000 | 0.97 |
| TCONS_00050536 | SEQ 1826 | 1.00000 | 0.96 |
| TCONS_00027752 | SEQ 1430 | 1.00000 | 0.96 |
| TCONS_00040692 | SEQ 1697 | 1.00000 | 0.96 |
| TCONS_00017410 | SEQ 1281 | 1.00000 | 0.96 |
| TCONS_00023300 | SEQ 1353 | 1.00000 | 0.96 |
| TCONS_00062337 | SEQ 2008 | 1.00000 | 0.96 |
| TCONS_00040918 | SEQ 1692 | 1.00000 | 0.95 |
| TCONS_00059276 | SEQ 1951 | 1.00000 | 0.95 |
| TCONS_00066553 | SEQ 2100 | 1.00000 | 0.95 |
| TCONS_00040901 | SEQ 1687 | 1.00000 | 0.95 |
| TCONS_00062578 | SEQ 2017 | 1.00000 | 0.95 |
| TCONS_00035061 | SEQ 1589 | 1.00000 | 0.95 |
| TCONS_00000281 | SEQ 1056 | 1.00000 | 0.95 |
| TCONS_00066505 | SEQ 2070 | 1.00000 | 0.94 |
| TCONS_00014293 | SEQ 1257 | 1.00000 | 0.94 |
| TCONS_00040974 | SEQ 1710 | 1.00000 | 0.94 |
| TCONS_00040857 | SEQ 1727 | 1.00000 | 0.94 |
| TCONS_00040922 | SEQ 1695 | 1.00000 | 0.94 |
| TCONS_00027709 | SEQ 1531 | 1.00000 | 0.94 |
| TCONS_00019822 | SEQ 1288 | 1.00000 | 0.94 |

TABLE 7-continued

The 1091 novel lncRNAs identified by the invention and fold change and p-value
(differential expression in AD group versus healthy control group).

| lncRNA | SEQ | p-value | FC |
|---|---|---|---|
| TCONS_00036143 | SEQ 1611 | 1.00000 | 0.94 |
| TCONS_00055516 | SEQ 1902 | 1.00000 | 0.94 |
| TCONS_00005003 | SEQ 1126 | 1.00000 | 0.93 |
| TCONS_00035036 | SEQ 1586 | 1.00000 | 0.93 |
| TCONS_00033779 | SEQ 1556 | 1.00000 | 0.93 |
| TCONS_00027753 | SEQ 1431 | 1.00000 | 0.89 |
| TCONS_00044942 | SEQ 1738 | 1.00000 | 0.88 |
| TCONS_00037139 | SEQ 1648 | 1.00000 | 0.88 |
| TCONS_00036041 | SEQ 1612 | 1.00000 | 0.86 |
| TCONS_00036835 | SEQ 1629 | 1.00000 | 0.86 |
| TCONS_00068992 | SEQ 2109 | 1.00000 | 0.85 |
| TCONS_00028116 | SEQ 1517 | 1.00000 | 0.85 |
| TCONS_00059207 | SEQ 1934 | 1.00000 | 0.85 |
| TCONS_00062561 | SEQ 2003 | 1.00000 | 0.84 |
| TCONS_00005060 | SEQ 1140 | 1.00000 | 0.84 |
| TCONS_00066323 | SEQ 2059 | 1.00000 | 0.79 |
| TCONS_00000199 | SEQ 1040 | 1.00000 | 0.78 |
| TCONS_00014424 | SEQ 1251 | 1.00000 | 0.77 |
| TCONS_00050206 | SEQ 1844 | 1.00000 | 0.73 |
| TCONS_00050096 | SEQ 1815 | 1.00000 | 0.72 |
| TCONS_00040833 | SEQ 1724 | 1.00000 | 0.71 |
| TCONS_00059322 | SEQ 1960 | 1.00000 | 0.67 |
| TCONS_00036887 | SEQ 1638 | 1.00000 | 0.61 |
| TCONS_00027663 | SEQ 1512 | 1.00000 | 0.61 |
| TCONS_00055573 | SEQ 1916 | 1.00000 | 0.58 |
| TCONS_00027826 | SEQ 1447 | 1.00000 | 0.52 |

Out of 1091 novel brain lncRNAs (Table 7), 492 lncRNAs showed a fold change >1.1 and 431 lncRNAs showed a fold change <0.9 and represent potential novel therapeutic candidates for silencing or to enhancing such lncRNA in the brain respectively, for treatment of brain disorder, in particular a cognitive disorder such as MCI and Alzheimer.

Out of the 1091 novel brain lncRNAs, some preferred novel lncRNA candidates for use for therapeutic applications with no or limited peripheral side effects are, for example, those novel brain lncRNAs with fold change <0.5 or ≥2 and p value <0.05 in brain and with low or no expression in the peripheral tissues and peripheral body fluids, such as blood.

Out of the total number of 10122 novel and lncRNAs from LINCipedia sequenced by the invention in the AD and control brains and having an expression >5 CPM (median), 1202 lncRNAs, including 42 novel lncRNAs, which all showed a statistically significant differential expression when comparing AD brains to HC brains were identified. These 1202 lncRNAs are listed in Table 8 and represent therapeutic candidates for treatment of cognitive disorders in particular MCI and Alzheimer.

TABLE 8

The 1202 lncRNAs with known sequence identified by the present invention having
a deficient expression (FC ≤ 0.84) or over-expression (FC ≥ 1.22) in human AD brain
temporal cortex versus human healthy control brain temporal cortex.

| lncRNA | SEQ | p-value | FC | AUC | lncRNA | SEQ | p-value | FC | AUC |
|---|---|---|---|---|---|---|---|---|---|
| MIR100HG:20 | SEQ2115 | 0.00794 | 0.01 | 1.00 | NIFK-AS1:24 | SEQ3168 | 0.01587 | 2.70 | 0.96 |
| lnc-CBSL-1:6 | SEQ2117 | 0.00794 | 0.04 | 1.00 | lnc-RABEP2-7:2 | SEQ3172 | 0.01587 | 2.74 | 0.96 |
| lnc-SMIM11B-4:3 | SEQ2118 | 0.00794 | 0.04 | 1.00 | lnc-ZBED4-7:1 | SEQ3173 | 0.01587 | 2.74 | 0.96 |
| CD27-AS1:18 | SEQ2123 | 0.00794 | 0.08 | 1.00 | lnc-GSG1L-1:12 | SEQ3175 | 0.01587 | 2.77 | 0.96 |
| lnc-ZRANB2-2:1 | SEQ0654 | 0.00794 | 0.09 | 1.00 | lnc-SBDS-4:11 | SEQ3176 | 0.01587 | 2.78 | 0.96 |
| MIR4500HG:2 | SEQ2125 | 0.00794 | 0.09 | 1.00 | lnc-OR4F21-3:4 | SEQ3178 | 0.01587 | 2.80 | 0.96 |
| LINC02338:2 | SEQ2127 | 0.00794 | 0.09 | 1.00 | LINC00574:9 | SEQ3179 | 0.01587 | 2.80 | 0.96 |
| lnc-GNA13-2:1 | SEQ2128 | 0.00794 | 0.10 | 1.00 | PSG8-AS1:2 | SEQ3188 | 0.01587 | 2.97 | 0.96 |
| lnc-FOXD4L6-1:5 | SEQ2129 | 0.00794 | 0.11 | 1.00 | lnc-TMEM144-3:1 | SEQ3189 | 0.01587 | 2.97 | 0.96 |
| lnc-ZNF644-1:16 | SEQ2130 | 0.00794 | 0.11 | 1.00 | lnc-RNF24-2:5 | SEQ3190 | 0.01587 | 2.97 | 0.96 |
| lnc-SYT16-4:9 | SEQ2131 | 0.00794 | 0.11 | 1.00 | lnc-ZNF236-7:1 | SEQ3191 | 0.01587 | 2.98 | 0.96 |
| THUMPD3-AS1:27 | SEQ2132 | 0.00794 | 0.12 | 1.00 | lnc-ZNF366-1:1 | SEQ3197 | 0.01587 | 3.05 | 0.96 |
| lnc-POM121L2-2:1 | SEQ2133 | 0.00794 | 0.12 | 1.00 | lnc-ZNF366-1:2 | SEQ3198 | 0.01587 | 3.05 | 0.96 |
| LY86-AS1:12 | SEQ2134 | 0.00794 | 0.13 | 1.00 | ITPKB-AS1:3 | SEQ3199 | 0.01587 | 3.06 | 0.96 |
| lnc-ZEB1-10:2 | SEQ2135 | 0.00794 | 0.14 | 1.00 | DUBR:16 | SEQ3200 | 0.01587 | 3.06 | 0.96 |
| lnc-SLC6A12-2:31 | SEQ2137 | 0.00794 | 0.15 | 1.00 | lnc-FAM71E1-2:9 | SEQ3219 | 0.01587 | 3.34 | 0.96 |
| lnc-SETSIP-2:8 | SEQ2141 | 0.00794 | 0.17 | 1.00 | lnc-ZNF131-1:24 | SEQ3221 | 0.01587 | 3.38 | 0.96 |
| lnc-ST3GAL4-10:12 | SEQ2143 | 0.00794 | 0.17 | 1.00 | XIST:8 | SEQ3227 | 0.01587 | 3.56 | 0.96 |
| lnc-DIS3-4:1 | SEQ2144 | 0.00794 | 0.18 | 1.00 | lnc-GOLGA6L6-14:1 | SEQ3228 | 0.01587 | 3.60 | 0.96 |
| lnc-PMM2-6:2 | SEQ2146 | 0.00794 | 0.18 | 1.00 | lnc-CAPN15-4:1 | SEQ3229 | 0.01587 | 3.66 | 0.96 |
| lnc-S100P-4:9 | SEQ2152 | 0.00794 | 0.20 | 1.00 | lnc-PAICS-3:5 | SEQ3230 | 0.01587 | 3.67 | 0.96 |

TABLE 8-continued

The 1202 lncRNAs with known sequence identified by the present invention having a deficient expression (FC ≤ 0.84) or over-expression (FC ≥ 1.22) in human AD brain temporal cortex versus human healthy control brain temporal cortex.

| lncRNA | SEQ | p-value | FC | AUC | lncRNA | SEQ | p-value | FC | AUC |
|---|---|---|---|---|---|---|---|---|---|
| lnc-KAAG1-1:1 | SEQ2154 | 0.00794 | 0.20 | 1.00 | XIST:10 | SEQ3233 | 0.01587 | 3.74 | 0.96 |
| lnc-POTEI-2:8 | SEQ2155 | 0.00794 | 0.21 | 1.00 | LINC01608:15 | SEQ3240 | 0.01587 | 4.17 | 0.96 |
| lnc-BANP-1:9 | SEQ2160 | 0.00794 | 0.23 | 1.00 | lnc-EMCN-1:1 | SEQ3241 | 0.01587 | 4.17 | 0.96 |
| lnc-ACSBG1-4:1 | SEQ2161 | 0.00794 | 0.23 | 1.00 | LINC02199:5 | SEQ3244 | 0.01587 | 4.21 | 0.96 |
| TPT1-AS1:42 | SEQ2164 | 0.00794 | 0.24 | 1.00 | lnc-ST18-4:2 | SEQ3245 | 0.01587 | 4.22 | 0.96 |
| RFPL1S:26 | SEQ2166 | 0.00794 | 0.24 | 1.00 | XIST:43 | SEQ3248 | 0.01587 | 4.46 | 0.96 |
| RFPL1S:5 | SEQ2167 | 0.00794 | 0.24 | 1.00 | LINC01608:16 | SEQ3250 | 0.01587 | 4.56 | 0.96 |
| lnc-ZMAT3-3:11 | SEQ2169 | 0.00794 | 0.24 | 1.00 | lnc-ENGASE-1:1 | SEQ3252 | 0.01587 | 4.89 | 0.96 |
| SNHG16:10 | SEQ2173 | 0.00794 | 0.25 | 1.00 | WAC-AS1:21 | SEQ3255 | 0.01587 | 5.31 | 0.96 |
| SNHG16:36 | SEQ2174 | 0.00794 | 0.25 | 1.00 | lnc-SLC38A8-4:5 | SEQ3261 | 0.01587 | 5.93 | 0.96 |
| LINC01122:9 | SEQ2175 | 0.00794 | 0.25 | 1.00 | lnc-SBDS-4:6 | SEQ3263 | 0.01587 | 6.66 | 0.96 |
| lnc-SVOP-1:1 | SEQ2179 | 0.00794 | 0.26 | 1.00 | lnc-EIF2AK3-1:6 | SEQ3267 | 0.01587 | 6.96 | 0.96 |
| lnc-ZNF644-1:29 | SEQ2180 | 0.00794 | 0.26 | 1.00 | lnc-LTBP3-2:2 | SEQ3275 | 0.01587 | 24.44 | 0.96 |
| PWRN1:28 | SEQ2187 | 0.00794 | 0.28 | 1.00 | lnc-LTBP3-2:3 | SEQ3277 | 0.01587 | 25.74 | 0.96 |
| RFPL1S:1 | SEQ2191 | 0.00794 | 0.29 | 1.00 | lnc-B3GNT5-11:1 | SEQ2120 | 0.03175 | 0.06 | 0.92 |
| LINC-PINT:16 | SEQ2192 | 0.00794 | 0.29 | 1.00 | lnc-DRICH1-3:22 | SEQ2122 | 0.03175 | 0.08 | 0.92 |
| lnc-LMF1-3:4 | SEQ2202 | 0.00794 | 0.30 | 1.00 | lnc-LAMTOR5-1:1 | SEQ2124 | 0.03175 | 0.09 | 0.92 |
| PWRN1:9 | SEQ2208 | 0.00794 | 0.31 | 1.00 | SLC26A4-AS1:17 | SEQ2136 | 0.03175 | 0.14 | 0.92 |
| ILF3-AS1:6 | SEQ2209 | 0.00794 | 0.31 | 1.00 | lnc-DGCR6-7:12 | SEQ2138 | 0.03175 | 0.16 | 0.92 |
| lnc-ACO1-10:1 | SEQ2213 | 0.00794 | 0.31 | 1.00 | LINC02389:3 | SEQ2140 | 0.03175 | 0.16 | 0.92 |
| lnc-LMF1-3:19 | SEQ2218 | 0.00794 | 0.32 | 1.00 | SNHG16:1 | SEQ2142 | 0.03175 | 0.17 | 0.92 |
| lnc-ZNF518B-2:2 | SEQ2224 | 0.00794 | 0.32 | 1.00 | lnc-SOWAHB-5:10 | SEQ2145 | 0.03175 | 0.18 | 0.92 |
| lnc-NEK6-2:2 | SEQ2226 | 0.00794 | 0.32 | 1.00 | lnc-GRAP-3:3 | SEQ2147 | 0.03175 | 0.18 | 0.92 |
| lnc-SPON2-1:2 | SEQ2237 | 0.00794 | 0.35 | 1.00 | lnc-GRAP-3:1 | SEQ2148 | 0.03175 | 0.18 | 0.92 |
| lnc-DFNA5-2:9 | SEQ2239 | 0.00794 | 0.35 | 1.00 | lnc-SRRD-1:6 | SEQ2149 | 0.03175 | 0.19 | 0.92 |
| lnc-DUSP1-2:1 | SEQ2242 | 0.00794 | 0.35 | 1.00 | lnc-POTEI-2:6 | SEQ2151 | 0.03175 | 0.20 | 0.92 |
| lnc-GABRA2-1:1 | SEQ2243 | 0.00794 | 0.36 | 1.00 | lnc-SNRPN-1:5 | SEQ2153 | 0.03175 | 0.20 | 0.92 |
| lnc-FNBP1L-2:6 | SEQ2246 | 0.00794 | 0.36 | 1.00 | DANT2:6 | SEQ2157 | 0.03175 | 0.21 | 0.92 |
| LY86-AS1:11 | SEQ2252 | 0.00794 | 0.36 | 1.00 | lnc-FBRSL1-3:6 | SEQ2162 | 0.03175 | 0.23 | 0.92 |
| SNHG8:9 | SEQ2255 | 0.00794 | 0.37 | 1.00 | lnc-GLB1L2-4:1 | SEQ2163 | 0.03175 | 0.24 | 0.92 |
| TTC28-AS1:1 | SEQ2262 | 0.00794 | 0.38 | 1.00 | LINC02009:2 | SEQ2170 | 0.03175 | 0.24 | 0.92 |
| lnc-ZCCHC7-2:24 | SEQ2279 | 0.00794 | 0.40 | 1.00 | lnc-FBXO28-1:12 | SEQ2181 | 0.03175 | 0.26 | 0.92 |
| lnc-IER5-3:1 | SEQ2286 | 0.00794 | 0.40 | 1.00 | lnc-EMP1-6:1 | SEQ2182 | 0.03175 | 0.26 | 0.92 |
| lnc-GABBR1-1:2 | SEQ2290 | 0.00794 | 0.40 | 1.00 | MRPL23-AS1:9 | SEQ2183 | 0.03175 | 0.26 | 0.92 |
| lnc-COMMD1-1:1 | SEQ2294 | 0.00794 | 0.41 | 1.00 | MAGI2-AS3:83 | SEQ2184 | 0.03175 | 0.26 | 0.92 |
| lnc-ZNF45-2:5 | SEQ2301 | 0.00794 | 0.41 | 1.00 | LINC00664:11 | SEQ2185 | 0.03175 | 0.27 | 0.92 |
| lnc-ATP6V1C1-12:1 | SEQ2310 | 0.00794 | 0.42 | 1.00 | lnc-ZNF721-4:1 | SEQ2186 | 0.03175 | 0.27 | 0.92 |
| lnc-KPNA2-6:15 | SEQ2322 | 0.00794 | 0.43 | 1.00 | lnc-NPBWR1-11:6 | SEQ2188 | 0.03175 | 0.28 | 0.92 |
| lnc-C11orf94-6:1 | SEQ2324 | 0.00794 | 0.43 | 1.00 | CADM3-AS1:3 | SEQ2189 | 0.03175 | 0.28 | 0.92 |
| lnc-COL3A1-3:1 | SEQ2332 | 0.00794 | 0.43 | 1.00 | lnc-COX7B2-1:1 | SEQ2190 | 0.03175 | 0.29 | 0.92 |
| lnc-AP3S1-4:15 | SEQ2335 | 0.00794 | 0.43 | 1.00 | LINC01476:4 | SEQ2193 | 0.03175 | 0.29 | 0.92 |
| lnc-PUM3-7:1 | SEQ2337 | 0.00794 | 0.44 | 1.00 | lnc-C14orf166-2:5 | SEQ2194 | 0.03175 | 0.30 | 0.92 |
| lnc-EML 1-1:1 | SEQ2344 | 0.00794 | 0.44 | 1.00 | LINC01007:2 | SEQ2196 | 0.03175 | 0.30 | 0.92 |
| lnc-TUBB2A-1:1 | SEQ2358 | 0.00794 | 0.45 | 1.00 | LINC01007:6 | SEQ2197 | 0.03175 | 0.30 | 0.92 |
| OTUD6B-AS1:11 | SEQ2360 | 0.00794 | 0.46 | 1.00 | LINC01007:4 | SEQ2198 | 0.03175 | 0.30 | 0.92 |
| OTUD6B-AS1:9 | SEQ2361 | 0.00794 | 0.46 | 1.00 | lnc-FZD4-1:5 | SEQ2199 | 0.03175 | 0.30 | 0.92 |
| lnc-PRSS22-4:1 | SEQ2362 | 0.00794 | 0.46 | 1.00 | lnc-WNT5A-3:4 | SEQ2200 | 0.03175 | 0.30 | 0.92 |
| lnc-FNDC10-1:4 | SEQ2367 | 0.00794 | 0.46 | 1.00 | lnc-SRGAP2C-5:2 | SEQ2201 | 0.03175 | 0.30 | 0.92 |
| ATP2B1-AS1:5 | SEQ2369 | 0.00794 | 0.46 | 1.00 | MIR4500HG:1 | SEQ2203 | 0.03175 | 0.31 | 0.92 |
| lnc-C7orf77-5:1 | SEQ2370 | 0.00794 | 0.46 | 1.00 | lnc-LRCH1-1:1 | SEQ0437 | 0.03175 | 0.31 | 0.92 |
| lnc-CMTM7-2:3 | SEQ2376 | 0.00794 | 0.46 | 1.00 | lnc-LIPI-11:1 | SEQ2204 | 0.03175 | 0.31 | 0.92 |
| lnc-TEX15-4:1 | SEQ2382 | 0.00794 | 0.46 | 1.00 | LINC00507:2 | SEQ2205 | 0.03175 | 0.31 | 0.92 |
| LINC01128:37 | SEQ2391 | 0.00794 | 0.47 | 1.00 | lnc-KCNA3-4:2 | SEQ2206 | 0.03175 | 0.31 | 0.92 |
| lnc-SNAPC2-2:2 | SEQ2400 | 0.00794 | 0.48 | 1.00 | COPG2IT1:2 | SEQ2207 | 0.03175 | 0.31 | 0.92 |
| lnc-DUSP1-2:2 | SEQ2407 | 0.00794 | 0.48 | 1.00 | HTR5A-AS1:4 | SEQ2210 | 0.03175 | 0.31 | 0.92 |
| lnc-TINCR-3:1 | SEQ2415 | 0.00794 | 0.48 | 1.00 | lnc-KCNA3-4:1 | SEQ2212 | 0.03175 | 0.31 | 0.92 |
| lnc-VSTM5-1:13 | SEQ2419 | 0.00794 | 0.49 | 1.00 | lnc-APH1B-1:1 | SEQ2215 | 0.03175 | 0.31 | 0.92 |
| lnc-MACROD1-5:1 | SEQ2422 | 0.00794 | 0.49 | 1.00 | lnc-NPY5R-4:1 | SEQ0823 | 0.03175 | 0.31 | 0.92 |
| lnc-MASTL-6:1 | SEQ2430 | 0.00794 | 0.49 | 1.00 | lnc-ABCD2-4:1 | SEQ2216 | 0.03175 | 0.32 | 0.92 |
| ZNF529-AS1:14 | SEQ2434 | 0.00794 | 0.49 | 1.00 | lnc-NOL6-6:1 | SEQ2217 | 0.03175 | 0.32 | 0.92 |
| lnc-DPP7-2:2 | SEQ2436 | 0.00794 | 0.49 | 1.00 | lnc-ACOD1-5:1 | SEQ2222 | 0.03175 | 0.32 | 0.92 |
| lnc-EMC3-3:4 | SEQ2441 | 0.00794 | 0.50 | 1.00 | lnc-SIPA1L1-5:1 | SEQ2225 | 0.03175 | 0.32 | 0.92 |
| LINC00667:14 | SEQ2442 | 0.00794 | 0.50 | 1.00 | lnc-CADPS-1:1 | SEQ2227 | 0.03175 | 0.32 | 0.92 |
| lnc-SCPEP1-3:1 | SEQ2448 | 0.00794 | 0.50 | 1.00 | lnc-HDX-2:1 | SEQ2228 | 0.03175 | 0.33 | 0.92 |
| lnc-BBOX1-1:11 | SEQ2450 | 0.00794 | 0.50 | 1.00 | lnc-ZNF816-2:17 | SEQ2229 | 0.03175 | 0.33 | 0.92 |
| lnc-DFNB59-2:22 | SEQ2451 | 0.00794 | 0.50 | 1.00 | lnc-SENP6-3:11 | SEQ2230 | 0.03175 | 0.33 | 0.92 |
| lnc-MTMR2-4:1 | SEQ2456 | 0.00794 | 0.51 | 1.00 | lnc-KCNH5-3:1 | SEQ2232 | 0.03175 | 0.34 | 0.92 |
| lnc-KLHL10-2:1 | SEQ2459 | 0.00794 | 0.51 | 1.00 | lnc-TENM1-4:2 | SEQ2234 | 0.03175 | 0.34 | 0.92 |
| lnc-CCDC7-2:2 | SEQ2460 | 0.00794 | 0.51 | 1.00 | lnc-NYAP2-2:2 | SEQ2236 | 0.03175 | 0.34 | 0.92 |
| RASSF8-AS1:42 | SEQ2467 | 0.00794 | 0.51 | 1.00 | lnc-IL 12RB2-1:1 | SEQ2238 | 0.03175 | 0.35 | 0.92 |
| lnc-POTEI-2:7 | SEQ2476 | 0.00794 | 0.52 | 1.00 | lnc-FAM106A-2:10 | SEQ2240 | 0.03175 | 0.35 | 0.92 |
| lnc-SLC10A7-8:1 | SEQ2484 | 0.00794 | 0.53 | 1.00 | lnc-ENC1-5:1 | SEQ2244 | 0.03175 | 0.36 | 0.92 |
| lnc-TRIML 1-9:1 | SEQ2490 | 0.00794 | 0.53 | 1.00 | lnc-MYF5-2:3 | SEQ2245 | 0.03175 | 0.36 | 0.92 |
| VLDLR-AS1:21 | SEQ2501 | 0.00794 | 0.53 | 1.00 | lnc-TGS1-3:1 | SEQ2251 | 0.03175 | 0.36 | 0.92 |

TABLE 8-continued

The 1202 lncRNAs with known sequence identified by the present invention having a deficient expression (FC ≤ 0.84) or over-expression (FC ≥ 1.22) in human AD brain temporal cortex versus human healthy control brain temporal cortex.

| lncRNA | SEQ | p-value | FC | AUC | lncRNA | SEQ | p-value | FC | AUC |
|---|---|---|---|---|---|---|---|---|---|
| lnc-VAT1-4:1 | SEQ2511 | 0.00794 | 0.54 | 1.00 | lnc-UBE2B-2:1 | SEQ2253 | 0.03175 | 0.37 | 0.92 |
| lnc-NPIPB4-3:2 | SEQ2518 | 0.00794 | 0.54 | 1.00 | lnc-XKR4-3:1 | SEQ2254 | 0.03175 | 0.37 | 0.92 |
| CASC15:17 | SEQ2522 | 0.00794 | 0.54 | 1.00 | lnc-MPPED2-4:1 | SEQ2256 | 0.03175 | 0.37 | 0.92 |
| lnc-PCSK1N-3:3 | SEQ2523 | 0.00794 | 0.54 | 1.00 | LINC01197:31 | SEQ2258 | 0.03175 | 0.37 | 0.92 |
| lnc-MAVS-3:1 | SEQ2534 | 0.00794 | 0.55 | 1.00 | lnc-SMARCA5-4:18 | SEQ0253 | 0.03175 | 0.37 | 0.92 |
| lnc-LRRC57-1:1 | SEQ2537 | 0.00794 | 0.55 | 1.00 | MIR583HG:2 | SEQ2260 | 0.03175 | 0.38 | 0.92 |
| lnc-ESCO2-1:3 | SEQ2554 | 0.00794 | 0.56 | 1.00 | lnc-COL9A2-1:3 | SEQ2261 | 0.03175 | 0.38 | 0.92 |
| lnc-IL31RA-2:1 | SEQ2557 | 0.00794 | 0.56 | 1.00 | lnc-POM121L2-2:3 | SEQ2263 | 0.03175 | 0.38 | 0.92 |
| lnc-ATG12-3:2 | SEQ2558 | 0.00794 | 0.56 | 1.00 | lnc-SYT16-4:15 | SEQ2264 | 0.03175 | 0.38 | 0.92 |
| lnc-FGFBP3-2:3 | SEQ2559 | 0.00794 | 0.56 | 1.00 | lnc-NAA50-3:1 | SEQ2266 | 0.03175 | 0.38 | 0.92 |
| lnc-SPOPL-10:1 | SEQ2567 | 0.00794 | 0.57 | 1.00 | lnc-CTXN1-1:1 | SEQ2267 | 0.03175 | 0.38 | 0.92 |
| lnc-EIF5-2:1 | SEQ2571 | 0.00794 | 0.57 | 1.00 | lnc-DNAH9-4:1 | SEQ2270 | 0.03175 | 0.39 | 0.92 |
| lnc-RAI2-5:1 | SEQ2575 | 0.00794 | 0.57 | 1.00 | lnc-SNRPN-8:19 | SEQ2271 | 0.03175 | 0.39 | 0.92 |
| lnc-MAP1B-2:1 | SEQ2587 | 0.00794 | 0.58 | 1.00 | lnc-PKIA-3:2 | SEQ2273 | 0.03175 | 0.39 | 0.92 |
| lnc-ABTB2-4:2 | SEQ2589 | 0.00794 | 0.58 | 1.00 | lnc-CALN1-2:1 | SEQ2274 | 0.03175 | 0.39 | 0.92 |
| lnc-EIF2B1-1:1 | SEQ2595 | 0.00794 | 0.59 | 1.00 | lnc-CXorf67-1:5 | SEQ2275 | 0.03175 | 0.39 | 0.92 |
| lnc-CHD1L-5:1 | SEQ2596 | 0.00794 | 0.59 | 1.00 | lnc-CES5A-3:14 | SEQ2276 | 0.03175 | 0.39 | 0.92 |
| lnc-ERAL 1-3:2 | SEQ2598 | 0.00794 | 0.59 | 1.00 | SLC8A1-AS1:1 | SEQ2277 | 0.03175 | 0.39 | 0.92 |
| lnc-ERAL 1-3:4 | SEQ2599 | 0.00794 | 0.59 | 1.00 | lnc-STRAP-5:1 | SEQ2280 | 0.03175 | 0.40 | 0.92 |
| lnc-CCDC85C-2:1 | SEQ2601 | 0.00794 | 0.59 | 1.00 | KRTAP5-AS1:12 | SEQ2281 | 0.03175 | 0.40 | 0.92 |
| lnc-DUXA-4:1 | SEQ2603 | 0.00794 | 0.59 | 1.00 | lnc-FAM110C-1:11 | SEQ2282 | 0.03175 | 0.40 | 0.92 |
| lnc-CHMP2B-1:11 | SEQ0679 | 0.00794 | 0.60 | 1.00 | lnc-SOWAHB-5:3 | SEQ2283 | 0.03175 | 0.40 | 0.92 |
| lnc-SSTR2-1:2 | SEQ2604 | 0.00794 | 0.60 | 1.00 | lnc-NEUROD1-3:1 | SEQ2284 | 0.03175 | 0.40 | 0.92 |
| lnc-PAX1-5:1 | SEQ2611 | 0.00794 | 0.60 | 1.00 | lnc-SV2B-3:1 | SEQ2285 | 0.03175 | 0.40 | 0.92 |
| lnc-ASPHD2-2:2 | SEQ2612 | 0.00794 | 0.60 | 1.00 | lnc-METTL22-5:1 | SEQ2287 | 0.03175 | 0.40 | 0.92 |
| lnc-CDC42SE2-1:10 | SEQ2613 | 0.00794 | 0.60 | 1.00 | lnc-LINGO2-2:3 | SEQ2288 | 0.03175 | 0.40 | 0.92 |
| lnc-TMEM154-2:1 | SEQ2616 | 0.00794 | 0.60 | 1.00 | lnc-SPIDR-1:1 | SEQ2292 | 0.03175 | 0.40 | 0.92 |
| lnc-FEM1B-4:1 | SEQ2624 | 0.00794 | 0.61 | 1.00 | lnc-KNSTRN-2:1 | SEQ2293 | 0.03175 | 0.41 | 0.92 |
| lnc-PYGO1-1:1 | SEQ2626 | 0.00794 | 0.61 | 1.00 | lnc-TACR1-1:5 | SEQ2295 | 0.03175 | 0.41 | 0.92 |
| lnc-F2RL2-6:1 | SEQ2628 | 0.00794 | 0.61 | 1.00 | lnc-MYF5-2:4 | SEQ2296 | 0.03175 | 0.41 | 0.92 |
| LINC00205:7 | SEQ2630 | 0.00794 | 0.61 | 1.00 | lnc-SYT16-1:1 | SEQ2297 | 0.03175 | 0.41 | 0.92 |
| THUMPD3-AS1:78 | SEQ2636 | 0.00794 | 0.62 | 1.00 | lnc-FAAP100-2:1 | SEQ2299 | 0.03175 | 0.41 | 0.92 |
| lnc-SLC35F5-3:11 | SEQ2639 | 0.00794 | 0.62 | 1.00 | lnc-DLG5-5:1 | SEQ2302 | 0.03175 | 0.41 | 0.92 |
| lnc-SH3BGRL2-2:14 | SEQ2644 | 0.00794 | 0.62 | 1.00 | lnc-GTF2F2-14:1 | SEQ2304 | 0.03175 | 0.41 | 0.92 |
| lnc-NEMF-2:2 | SEQ2656 | 0.00794 | 0.63 | 1.00 | lnc-ITFG1-2:1 | SEQ2307 | 0.03175 | 0.41 | 0.92 |
| lnc-CCNG1-1:4 | SEQ2660 | 0.00794 | 0.63 | 1.00 | lnc-SYNE2-4:1 | SEQ2308 | 0.03175 | 0.42 | 0.92 |
| lnc-NEMF-2:1 | SEQ2662 | 0.00794 | 0.64 | 1.00 | lnc-CD59-2:5 | SEQ2309 | 0.03175 | 0.42 | 0.92 |
| lnc-NPR2-2:3 | SEQ2685 | 0.00794 | 0.65 | 1.00 | lnc-TNFRSF13B-2:1 | SEQ2311 | 0.03175 | 0.42 | 0.92 |
| lnc-HDGFL2-6:2 | SEQ2688 | 0.00794 | 0.65 | 1.00 | lnc-CHRM3-1:1 | SEQ2312 | 0.03175 | 0.42 | 0.92 |
| lnc-PLEKHA8-3:8 | SEQ2689 | 0.00794 | 0.65 | 1.00 | lnc-PPP5D1-1:1 | SEQ2313 | 0.03175 | 0.42 | 0.92 |
| lnc-TIMM21-5:8 | SEQ2693 | 0.00794 | 0.65 | 1.00 | lnc-ZNF674-1:12 | SEQ2314 | 0.03175 | 0.42 | 0.92 |
| lnc-EYA3-2:2 | SEQ2694 | 0.00794 | 0.65 | 1.00 | lnc-CBLN2-1:1 | SEQ2318 | 0.03175 | 0.43 | 0.92 |
| lnc-ATP6V1C2-2:2 | SEQ2695 | 0.00794 | 0.66 | 1.00 | lnc-SCN2A-7:1 | SEQ2321 | 0.03175 | 0.43 | 0.92 |
| lnc-RBPMS2-3:1 | SEQ2697 | 0.00794 | 0.66 | 1.00 | lnc-ZSCAN2-5:11 | SEQ2323 | 0.03175 | 0.43 | 0.92 |
| lnc-ADAM30-1:1 | SEQ2698 | 0.00794 | 0.66 | 1.00 | lnc-PPFIA4-1:1 | SEQ2325 | 0.03175 | 0.43 | 0.92 |
| lnc-GPR39-9:1 | SEQ2704 | 0.00794 | 0.67 | 1.00 | lnc-XRCC5-3:1 | SEQ2326 | 0.03175 | 0.43 | 0.92 |
| lnc-ITGB8-10:1 | SEQ2706 | 0.00794 | 0.67 | 1.00 | lnc-PLEKHB2-4:3 | SEQ2327 | 0.03175 | 0.43 | 0.92 |
| lnc-ANKRD55-6:1 | SEQ2711 | 0.00794 | 0.68 | 1.00 | LINC00665:2 | SEQ2328 | 0.03175 | 0.43 | 0.92 |
| lnc-CCDC186-1:1 | SEQ2713 | 0.00794 | 0.68 | 1.00 | lnc-CTAGE6-1:1 | SEQ2329 | 0.03175 | 0.43 | 0.92 |
| lnc-YIF1A-8:3 | SEQ2715 | 0.00794 | 0.68 | 1.00 | lnc-MEST-2:1 | SEQ2333 | 0.03175 | 0.43 | 0.92 |
| lnc-NUDT3-1:3 | SEQ2725 | 0.00794 | 0.69 | 1.00 | LINC00630:5 | SEQ2334 | 0.03175 | 0.43 | 0.92 |
| lnc-NAXD-4:1 | SEQ2736 | 0.00794 | 0.70 | 1.00 | MEF2C-AS1:49 | SEQ2336 | 0.03175 | 0.44 | 0.92 |
| lnc-AMMECR1L-1:2 | SEQ2743 | 0.00794 | 0.72 | 1.00 | THAP9-AS1:24 | SEQ2338 | 0.03175 | 0.44 | 0.92 |
| lnc-ZNF718-5:1 | SEQ2744 | 0.00794 | 0.73 | 1.00 | lnc-NHS-2:1 | SEQ2339 | 0.03175 | 0.44 | 0.92 |
| lnc-FAM72D-8:1 | SEQ2753 | 0.00794 | 0.75 | 1.00 | SNHG1:49 | SEQ2340 | 0.03175 | 0.44 | 0.92 |
| DLEU2:32 | SEQ2776 | 0.00794 | 1.32 | 1.00 | lnc-POM121L2-2:2 | SEQ2341 | 0.03175 | 0.44 | 0.92 |
| lnc-FAAH2-1:9 | SEQ2785 | 0.00794 | 1.38 | 1.00 | LIMD1-AS1:5 | SEQ2342 | 0.03175 | 0.44 | 0.92 |
| lnc-NEK6-2:4 | SEQ2786 | 0.00794 | 1.38 | 1.00 | lnc-APOL5-4:1 | SEQ2343 | 0.03175 | 0.44 | 0.92 |
| lnc-NEK6-2:1 | SEQ2787 | 0.00794 | 1.38 | 1.00 | lnc-PAM-1:10 | SEQ2345 | 0.03175 | 0.44 | 0.92 |
| lnc-PTPN14-2:6 | SEQ2790 | 0.00794 | 1.40 | 1.00 | lnc-ZFP69B-1:2 | SEQ2346 | 0.03175 | 0.44 | 0.92 |
| lnc-MAFF-6:1 | SEQ2792 | 0.00794 | 1.41 | 1.00 | lnc-ZFP69B-1:1 | SEQ2347 | 0.03175 | 0.44 | 0.92 |
| lnc-ANXA2R-6:1 | SEQ2793 | 0.00794 | 1.41 | 1.00 | lnc-PDK3-1:1 | SEQ2348 | 0.03175 | 0.44 | 0.92 |
| lnc-SPATA21-4:6 | SEQ2798 | 0.00794 | 1.42 | 1.00 | lnc-KBTBD6-2:1 | SEQ2349 | 0.03175 | 0.45 | 0.92 |
| lnc-ECHDC3-8:1 | SEQ2799 | 0.00794 | 1.44 | 1.00 | lnc-VPS33B-6:1 | SEQ2350 | 0.03175 | 0.45 | 0.92 |
| lnc-RBM19-2:1 | SEQ2800 | 0.00794 | 1.45 | 1.00 | lnc-SMURF1-2:1 | SEQ2351 | 0.03175 | 0.45 | 0.92 |
| CAHM:3 | SEQ2810 | 0.00794 | 1.49 | 1.00 | lnc-CLEC18B-7:5 | SEQ2353 | 0.03175 | 0.45 | 0.92 |
| lnc-OSBPL7-3:2 | SEQ2813 | 0.00794 | 1.49 | 1.00 | lnc-UGT3A2-3:1 | SEQ0389 | 0.03175 | 0.45 | 0.92 |
| lnc-ZNF331-1:1 | SEQ2814 | 0.00794 | 1.49 | 1.00 | lnc-PTPMT1-2:1 | SEQ2354 | 0.03175 | 0.45 | 0.92 |
| lnc-ZNF124-2:4 | SEQ2822 | 0.00794 | 1.52 | 1.00 | lnc-KIF1C-1:14 | SEQ2355 | 0.03175 | 0.45 | 0.92 |
| lnc-MID1-1:14 | SEQ2829 | 0.00794 | 1.53 | 1.00 | lnc-WBP4-2:9 | SEQ2356 | 0.03175 | 0.45 | 0.92 |
| lnc-DERL3-6:1 | SEQ2835 | 0.00794 | 1.55 | 1.00 | LINC01963:3 | SEQ2357 | 0.03175 | 0.45 | 0.92 |
| lnc-NPIPA8-3:1 | SEQ2836 | 0.00794 | 1.55 | 1.00 | LINC-PINT:59 | SEQ2363 | 0.03175 | 0.46 | 0.92 |
| lnc-PIGP-6:2 | SEQ2843 | 0.00794 | 1.56 | 1.00 | lnc-NMD3-1:1 | SEQ2364 | 0.03175 | 0.46 | 0.92 |
| lnc-LRRC56-1:4 | SEQ2844 | 0.00794 | 1.57 | 1.00 | lnc-MPPE1-8:2 | SEQ2365 | 0.03175 | 0.46 | 0.92 |

TABLE 8-continued

The 1202 lncRNAs with known sequence identified by the present invention having a deficient expression (FC ≤ 0.84) or over-expression (FC ≥ 1.22) in human AD brain temporal cortex versus human healthy control brain temporal cortex.

| lncRNA | SEQ | p-value | FC | AUC | lncRNA | SEQ | p-value | FC | AUC |
|---|---|---|---|---|---|---|---|---|---|
| lnc-C19orf47-1:1 | SEQ2848 | 0.00794 | 1.58 | 1.00 | NIPBL-AS1:8 | SEQ2366 | 0.03175 | 0.46 | 0.92 |
| lnc-OCIAD2-3:5 | SEQ2849 | 0.00794 | 1.58 | 1.00 | lnc-HIST2H3D-1:1 | SEQ2368 | 0.03175 | 0.46 | 0.92 |
| lnc-KCNRG-1:1 | SEQ2856 | 0.00794 | 1.59 | 1.00 | lnc-ERCC4-7:1 | SEQ2371 | 0.03175 | 0.46 | 0.92 |
| lnc-ZNF 169-7:4 | SEQ2857 | 0.00794 | 1.59 | 1.00 | lnc-PPP5C-1:2 | SEQ2372 | 0.03175 | 0.46 | 0.92 |
| lnc-NMS-4:1 | SEQ2859 | 0.00794 | 1.59 | 1.00 | lnc-GCGR-1:2 | SEQ2373 | 0.03175 | 0.46 | 0.92 |
| ASAP1-IT2:1 | SEQ2868 | 0.00794 | 1.61 | 1.00 | lnc-TBL1XR1-17:1 | SEQ2374 | 0.03175 | 0.46 | 0.92 |
| lnc-WDR4-2:5 | SEQ2874 | 0.00794 | 1.62 | 1.00 | lnc-AKAP12-2:1 | SEQ2375 | 0.03175 | 0.46 | 0.92 |
| lnc-MAP3K2-4:1 | SEQ2875 | 0.00794 | 1.62 | 1.00 | lnc-KHDC3L-2:3 | SEQ2377 | 0.03175 | 0.46 | 0.92 |
| LINC01000:7 | SEQ2877 | 0.00794 | 1.62 | 1.00 | lnc-RBMS2-4:1 | SEQ2378 | 0.03175 | 0.46 | 0.92 |
| lnc-C19orf47-3:1 | SEQ2881 | 0.00794 | 1.63 | 1.00 | lnc-CACNA2D1-1:1 | SEQ0897 | 0.03175 | 0.46 | 0.92 |
| lnc-ZNF778-1:10 | SEQ2882 | 0.00794 | 1.64 | 1.00 | lnc-IPO5-7:1 | SEQ0521 | 0.03175 | 0.46 | 0.92 |
| LCMT1-AS1:9 | SEQ2883 | 0.00794 | 1.64 | 1.00 | lnc-SOWAHB-5:4 | SEQ2381 | 0.03175 | 0.46 | 0.92 |
| lnc-BIN3-2:1 | SEQ2884 | 0.00794 | 1.64 | 1.00 | MIF-AS1:8 | SEQ2383 | 0.03175 | 0.46 | 0.92 |
| lnc-FABP2-1:1 | SEQ2886 | 0.00794 | 1.65 | 1.00 | lnc-NXNL 1-5:1 | SEQ2384 | 0.03175 | 0.47 | 0.92 |
| lnc-WDR70-5:4 | SEQ2893 | 0.00794 | 1.67 | 1.00 | lnc-ARHGAP6-2:1 | SEQ2385 | 0.03175 | 0.47 | 0.92 |
| lnc-ILKAP-6:1 | SEQ2895 | 0.00794 | 1.68 | 1.00 | lnc-CACNB2-1:1 | SEQ2386 | 0.03175 | 0.47 | 0.92 |
| lnc-CYP2E1-13:1 | SEQ2901 | 0.00794 | 1.69 | 1.00 | lnc-FAM120C-1:1 | SEQ2388 | 0.03175 | 0.47 | 0.92 |
| lnc-ZFP36L1-2:13 | SEQ2904 | 0.00794 | 1.70 | 1.00 | lnc-CENPVL2-3:1 | SEQ2389 | 0.03175 | 0.47 | 0.92 |
| lnc-SCAF11-4:1 | SEQ2908 | 0.00794 | 1.71 | 1.00 | LINC00884:15 | SEQ2390 | 0.03175 | 0.47 | 0.92 |
| lnc-NMRAL 1-4:1 | SEQ2910 | 0.00794 | 1.71 | 1.00 | lnc-LINC00890-7:1 | SEQ2393 | 0.03175 | 0.47 | 0.92 |
| lnc-MNX1-10:1 | SEQ0322 | 0.00794 | 1.72 | 1.00 | lnc-TMCC2-2:1 | SEQ2395 | 0.03175 | 0.47 | 0.92 |
| CACTIN-AS1:5 | SEQ2914 | 0.00794 | 1.73 | 1.00 | lnc-ZNF333-4:2 | SEQ2397 | 0.03175 | 0.48 | 0.92 |
| lnc-FAHD2B-1:2 | SEQ2915 | 0.00794 | 1.73 | 1.00 | PEG3-AS1:1 | SEQ2398 | 0.03175 | 0.48 | 0.92 |
| lnc-LHFPL 1-2:1 | SEQ2916 | 0.00794 | 1.73 | 1.00 | lnc-APTX-3:1 | SEQ2399 | 0.03175 | 0.48 | 0.92 |
| lnc-TAF9-2:3 | SEQ2917 | 0.00794 | 1.74 | 1.00 | lnc-PSEN2-4:1 | SEQ2403 | 0.03175 | 0.48 | 0.92 |
| lnc-PAG1-4:1 | SEQ2928 | 0.00794 | 1.76 | 1.00 | lnc-CMBL-8:2 | SEQ2404 | 0.03175 | 0.48 | 0.92 |
| lnc-ARMCX4-3:1 | SEQ2939 | 0.00794 | 1.79 | 1.00 | LINC00174:21 | SEQ2406 | 0.03175 | 0.48 | 0.92 |
| lnc-ZNF852-2:3 | SEQ2944 | 0.00794 | 1.79 | 1.00 | lnc-C8B-4:1 | SEQ2410 | 0.03175 | 0.48 | 0.92 |
| lnc-STARD10-1:6 | SEQ0840 | 0.00794 | 1.80 | 1.00 | lnc-EVX1-15:1 | SEQ2412 | 0.03175 | 0.48 | 0.92 |
| lnc-SERPIND1-2:1 | SEQ2948 | 0.00794 | 1.80 | 1.00 | lnc-BICD1-1:1 | SEQ2413 | 0.03175 | 0.48 | 0.92 |
| lnc-PMM2-2:4 | SEQ2955 | 0.00794 | 1.82 | 1.00 | lnc-SESN1-5:1 | SEQ2414 | 0.03175 | 0.48 | 0.92 |
| lnc-CRYM-4:1 | SEQ2958 | 0.00794 | 1.84 | 1.00 | lnc-DTNA-5:1 | SEQ2416 | 0.03175 | 0.48 | 0.92 |
| lnc-PRR26-5:1 | SEQ2961 | 0.00794 | 1.85 | 1.00 | MIR 100HG:97 | SEQ2417 | 0.03175 | 0.49 | 0.92 |
| lnc-THAP3-2:2 | SEQ2979 | 0.00794 | 1.91 | 1.00 | OIP5-AS1:4 | SEQ2423 | 0.03175 | 0.49 | 0.92 |
| lnc-NOP9-1:2 | SEQ2990 | 0.00794 | 1.94 | 1.00 | lnc-AP3S1-4:3 | SEQ2424 | 0.03175 | 0.49 | 0.92 |
| lnc-PRPF40B-1:2 | SEQ2997 | 0.00794 | 1.95 | 1.00 | lnc-SCAF4-1:2 | SEQ2425 | 0.03175 | 0.49 | 0.92 |
| lnc-SAMD11-14:1 | SEQ3001 | 0.00794 | 1.97 | 1.00 | lnc-SNRPN-8:5 | SEQ2426 | 0.03175 | 0.49 | 0.92 |
| lnc-STX8-4:1 | SEQ3002 | 0.00794 | 1.97 | 1.00 | lnc-SRPRB-1:1 | SEQ2427 | 0.03175 | 0.49 | 0.92 |
| lnc-NRDE2-3:1 | SEQ3003 | 0.00794 | 1.98 | 1.00 | lnc-SLC3A2-6:1 | SEQ2428 | 0.03175 | 0.49 | 0.92 |
| lnc-SLC29A4-5:5 | SEQ3004 | 0.00794 | 1.99 | 1.00 | lnc-TMEM185B-9:1 | SEQ2432 | 0.03175 | 0.49 | 0.92 |
| lnc-SZT2-2:3 | SEQ3006 | 0.00794 | 2.00 | 1.00 | lnc-FGF13-1:1 | SEQ2435 | 0.03175 | 0.49 | 0.92 |
| lnc-SLC39A11-1:34 | SEQ3008 | 0.00794 | 2.00 | 1.00 | lnc-CHMP2B-5:1 | SEQ2437 | 0.03175 | 0.50 | 0.92 |
| lnc-MAFF-2:1 | SEQ3013 | 0.00794 | 2.01 | 1.00 | lnc-LASP1-5:1 | SEQ2438 | 0.03175 | 0.50 | 0.92 |
| lnc-ATP6VOE2-1:1 | SEQ3014 | 0.00794 | 2.01 | 1.00 | lnc-DAPP1-8:3 | SEQ2439 | 0.03175 | 0.50 | 0.92 |
| lnc-PHB2-7:1 | SEQ3018 | 0.00794 | 2.02 | 1.00 | SOX1-OT:5 | SEQ2440 | 0.03175 | 0.50 | 0.92 |
| lnc-AGRP-1:26 | SEQ3020 | 0.00794 | 2.04 | 1.00 | lnc-AADACL2-4:1 | SEQ2443 | 0.03175 | 0.50 | 0.92 |
| lnc-PPARA-3:13 | SEQ3022 | 0.00794 | 2.04 | 1.00 | SLC8A1-AS1:32 | SEQ2444 | 0.03175 | 0.50 | 0.92 |
| lnc-USP6-2:20 | SEQ3027 | 0.00794 | 2.05 | 1.00 | SNHG6:10 | SEQ2446 | 0.03175 | 0.50 | 0.92 |
| lnc-CANX-1:10 | SEQ3029 | 0.00794 | 2.06 | 1.00 | lnc-SLC25A3-7:1 | SEQ2447 | 0.03175 | 0.50 | 0.92 |
| lnc-ZMYND19-2:1 | SEQ3032 | 0.00794 | 2.06 | 1.00 | lnc-GBP2-1:2 | SEQ2449 | 0.03175 | 0.50 | 0.92 |
| lnc-DHRS7B-1:6 | SEQ3034 | 0.00794 | 2.06 | 1.00 | lnc-MRPS14-1:6 | SEQ2452 | 0.03175 | 0.50 | 0.92 |
| lnc-LEF1-3:13 | SEQ3036 | 0.00794 | 2.07 | 1.00 | lnc-FZD4-1:6 | SEQ2454 | 0.03175 | 0.51 | 0.92 |
| SMCR5:1 | SEQ3037 | 0.00794 | 2.07 | 1.00 | lnc-ZNF275-4:1 | SEQ2455 | 0.03175 | 0.51 | 0.92 |
| SRP14-AS1:20 | SEQ3039 | 0.00794 | 2.08 | 1.00 | lnc-CIB1-1:1 | SEQ2457 | 0.03175 | 0.51 | 0.92 |
| lnc-ERMARD-2:6 | SEQ3042 | 0.00794 | 2.09 | 1.00 | lnc-TMEM57-1:2 | SEQ2461 | 0.03175 | 0.51 | 0.92 |
| lnc-C8orf48-7:1 | SEQ3046 | 0.00794 | 2.10 | 1.00 | lnc-FOXM1-1:1 | SEQ2462 | 0.03175 | 0.51 | 0.92 |
| lnc-PPARA-3:7 | SEQ3050 | 0.00794 | 2.12 | 1.00 | lnc-CKAP2L-2:1 | SEQ2463 | 0.03175 | 0.51 | 0.92 |
| lnc-MISP3-5:1 | SEQ3052 | 0.00794 | 2.13 | 1.00 | RNF219-AS1:17 | SEQ2464 | 0.03175 | 0.51 | 0.92 |
| lnc-NAV1-9:6 | SEQ3053 | 0.00794 | 2.13 | 1.00 | lnc-DEFB115-5:2 | SEQ2465 | 0.03175 | 0.51 | 0.92 |
| lnc-HEATR4-5:1 | SEQ3063 | 0.00794 | 2.16 | 1.00 | lnc-POLD3-1:2 | SEQ2469 | 0.03175 | 0.52 | 0.92 |
| lnc-TEF-1:1 | SEQ3075 | 0.00794 | 2.21 | 1.00 | lnc-ZNF587-2:1 | SEQ2470 | 0.03175 | 0.52 | 0.92 |
| lnc-ZNF541-4:1 | SEQ3078 | 0.00794 | 2.21 | 1.00 | lnc-CENPM-4:1 | SEQ2475 | 0.03175 | 0.52 | 0.92 |
| HDAC2-AS2:10 | SEQ3080 | 0.00794 | 2.22 | 1.00 | lnc-MTA3-7:2 | SEQ2477 | 0.03175 | 0.52 | 0.92 |
| lnc-CAND2-2:5 | SEQ3083 | 0.00794 | 2.23 | 1.00 | lnc-GPR180-8:1 | SEQ2478 | 0.03175 | 0.52 | 0.92 |
| lnc-CAND2-2:6 | SEQ3084 | 0.00794 | 2.23 | 1.00 | lnc-DNAL 1-1:1 | SEQ2480 | 0.03175 | 0.52 | 0.92 |
| lnc-CD40LG-2:9 | SEQ3085 | 0.00794 | 2.24 | 1.00 | lnc-SUMF1-18:1 | SEQ2482 | 0.03175 | 0.52 | 0.92 |
| lnc-PHYHD1-1:1 | SEQ3086 | 0.00794 | 2.24 | 1.00 | lnc-BAZ1A-2:1 | SEQ2485 | 0.03175 | 0.53 | 0.92 |
| lnc-PDYN-1:9 | SEQ3089 | 0.00794 | 2.26 | 1.00 | lnc-POTEI-2:11 | SEQ2488 | 0.03175 | 0.53 | 0.92 |
| lnc-MB-6:1 | SEQ3094 | 0.00794 | 2.27 | 1.00 | lnc-AACS-5:1 | SEQ2489 | 0.03175 | 0.53 | 0.92 |
| lnc-DNAL4-4:1 | SEQ3095 | 0.00794 | 2.28 | 1.00 | lnc-MOCS1-3:1 | SEQ2491 | 0.03175 | 0.53 | 0.92 |
| lnc-CTXN1-6:1 | SEQ3096 | 0.00794 | 2.28 | 1.00 | lnc-TFRC-7:2 | SEQ2492 | 0.03175 | 0.53 | 0.92 |
| lnc-TUBA1C-1:14 | SEQ3099 | 0.00794 | 2.29 | 1.00 | lnc-PSMC5-4:1 | SEQ2496 | 0.03175 | 0.53 | 0.92 |
| lnc-SHC3-5:3 | SEQ3102 | 0.00794 | 2.30 | 1.00 | lnc-CCDC125-1:6 | SEQ2497 | 0.03175 | 0.53 | 0.92 |
| lnc-SNRNP35-2:1 | SEQ3103 | 0.00794 | 2.30 | 1.00 | lnc-NDUFAB1-1:1 | SEQ2498 | 0.03175 | 0.53 | 0.92 |

TABLE 8-continued

The 1202 lncRNAs with known sequence identified by the present invention having a deficient expression (FC ≤ 0.84) or over-expression (FC ≥ 1.22) in human AD brain temporal cortex versus human healthy control brain temporal cortex.

| lncRNA | SEQ | p-value | FC | AUC | lncRNA | SEQ | p-value | FC | AUC |
|---|---|---|---|---|---|---|---|---|---|
| ATXN2-AS:5 | SEQ3104 | 0.00794 | 2.30 | 1.00 | lnc-ZNF41-2:1 | SEQ2499 | 0.03175 | 0.53 | 0.92 |
| lnc-CHRNE-4:1 | SEQ3106 | 0.00794 | 2.32 | 1.00 | lnc-C12orf40-1:1 | SEQ2500 | 0.03175 | 0.53 | 0.92 |
| lnc-MEGF6-2:1 | SEQ3107 | 0.00794 | 2.32 | 1.00 | lnc-EXTL3-2:2 | SEQ2502 | 0.03175 | 0.53 | 0.92 |
| lnc-CCDC146-4:6 | SEQ3108 | 0.00794 | 2.32 | 1.00 | lnc-ZFYVE9-2:2 | SEQ2503 | 0.03175 | 0.53 | 0.92 |
| lnc-UBE2H-2:3 | SEQ3112 | 0.00794 | 2.32 | 1.00 | lnc-PXN-1:1 | SEQ2506 | 0.03175 | 0.53 | 0.92 |
| lnc-SLC25A6-4:1 | SEQ3114 | 0.00794 | 2.32 | 1.00 | lnc-RPIA-1:4 | SEQ2507 | 0.03175 | 0.54 | 0.92 |
| lnc-POFUT2-5:1 | SEQ3120 | 0.00794 | 2.37 | 1.00 | lnc-REL-1:3 | SEQ2508 | 0.03175 | 0.54 | 0.92 |
| lnc-GNG13-5:1 | SEQ3121 | 0.00794 | 2.37 | 1.00 | lnc-SBDS-19:2 | SEQ2509 | 0.03175 | 0.54 | 0.92 |
| lnc-SEC24A-1:1 | SEQ3126 | 0.00794 | 2.41 | 1.00 | lnc-GFOD1-2:1 | SEQ2510 | 0.03175 | 0.54 | 0.92 |
| lnc-USP34-1:10 | SEQ3127 | 0.00794 | 2.42 | 1.00 | lnc-ZNF33B-6:1 | SEQ0394 | 0.03175 | 0.54 | 0.92 |
| lnc-RDH13-4:1 | SEQ3134 | 0.00794 | 2.44 | 1.00 | lnc-TACSTD2-2:4 | SEQ0020 | 0.03175 | 0.54 | 0.92 |
| lnc-PHB2-6:1 | SEQ3135 | 0.00794 | 2.45 | 1.00 | lnc-YTHDF3-6:3 | SEQ2514 | 0.03175 | 0.54 | 0.92 |
| lnc-DPH1-1:2 | SEQ3136 | 0.00794 | 2.45 | 1.00 | lnc-YTHDF3-6:1 | SEQ2515 | 0.03175 | 0.54 | 0.92 |
| lnc-BAZ1A-4:1 | SEQ3138 | 0.00794 | 2.46 | 1.00 | lnc-CENPV-2:1 | SEQ2516 | 0.03175 | 0.54 | 0.92 |
| lnc-PDE6B-1:11 | SEQ3140 | 0.00794 | 2.47 | 1.00 | lnc-DUSP1-6:1 | SEQ2517 | 0.03175 | 0.54 | 0.92 |
| lnc-SBDS-4:9 | SEQ3145 | 0.00794 | 2.50 | 1.00 | lnc-MOV10-2:1 | SEQ2519 | 0.03175 | 0.54 | 0.92 |
| lnc-PAXIP1-3:2 | SEQ3147 | 0.00794 | 2.50 | 1.00 | lnc-SHC3-1:2 | SEQ2520 | 0.03175 | 0.54 | 0.92 |
| lnc-NKX2-2-2:2 | SEQ3150 | 0.00794 | 2.52 | 1.00 | lnc-LEKR1-4:9 | SEQ2521 | 0.03175 | 0.54 | 0.92 |
| lnc-NLN-3:1 | SEQ3152 | 0.00794 | 2.53 | 1.00 | lnc-EIF2B1-6:1 | SEQ2524 | 0.03175 | 0.54 | 0.92 |
| lnc-SMG1-1:9 | SEQ3156 | 0.00794 | 2.57 | 1.00 | lnc-HSD11B2-1:1 | SEQ2525 | 0.03175 | 0.54 | 0.92 |
| lnc-RIPOR1-1:7 | SEQ3158 | 0.00794 | 2.57 | 1.00 | lnc-UGDH-3:3 | SEQ2526 | 0.03175 | 0.54 | 0.92 |
| lnc-SAMD11-10:1 | SEQ3159 | 0.00794 | 2.59 | 1.00 | lnc-CBY3-3:2 | SEQ2527 | 0.03175 | 0.54 | 0.92 |
| lnc-MOCS1-1:6 | SEQ3160 | 0.00794 | 2.59 | 1.00 | lnc-C14orf28-2:1 | SEQ2528 | 0.03175 | 0.54 | 0.92 |
| lnc-ANKRD9-1:1 | SEQ3162 | 0.00794 | 2.62 | 1.00 | lnc-FAM60A-3:1 | SEQ2531 | 0.03175 | 0.54 | 0.92 |
| MIR663AHG:66 | SEQ3165 | 0.00794 | 2.67 | 1.00 | lnc-DHX33-1:1 | SEQ2533 | 0.03175 | 0.55 | 0.92 |
| lnc-MOCS1-6:1 | SEQ3167 | 0.00794 | 2.70 | 1.00 | lnc-ARSG-2:8 | SEQ2535 | 0.03175 | 0.55 | 0.92 |
| lnc-HNRNPU-8:1 | SEQ3170 | 0.00794 | 2.72 | 1.00 | lnc-CA6-8:1 | SEQ2536 | 0.03175 | 0.55 | 0.92 |
| lnc-KIAA0141-1:2 | SEQ3171 | 0.00794 | 2.74 | 1.00 | lnc-DEFB115-5:3 | SEQ2538 | 0.03175 | 0.55 | 0.92 |
| lnc-HMOX1-2:2 | SEQ3174 | 0.00794 | 2.75 | 1.00 | lnc-PNLIPRP1-1:2 | SEQ2540 | 0.03175 | 0.55 | 0.92 |
| lnc-HDGFL2-7:1 | SEQ3180 | 0.00794 | 2.83 | 1.00 | lnc-FAM104A-2:1 | SEQ2542 | 0.03175 | 0.55 | 0.92 |
| lnc-UBASH3A-6:2 | SEQ3182 | 0.00794 | 2.91 | 1.00 | lnc-KCNA3-3:6 | SEQ2546 | 0.03175 | 0.55 | 0.92 |
| SLC2A1-AS1:15 | SEQ3183 | 0.00794 | 2.94 | 1.00 | lnc-PNLIPRP1-1:3 | SEQ2548 | 0.03175 | 0.55 | 0.92 |
| TRPM2-AS:5 | SEQ3184 | 0.00794 | 2.95 | 1.00 | lnc-KIAA1586-4:1 | SEQ2549 | 0.03175 | 0.55 | 0.92 |
| lnc-AGO2-2:3 | SEQ0668 | 0.00794 | 2.95 | 1.00 | lnc-H2AFJ-2:7 | SEQ2551 | 0.03175 | 0.56 | 0.92 |
| lnc-DENND1A-5:1 | SEQ3185 | 0.00794 | 2.96 | 1.00 | lnc-MED14-6:1 | SEQ2552 | 0.03175 | 0.56 | 0.92 |
| lnc-MOCS1-1:5 | SEQ3186 | 0.00794 | 2.96 | 1.00 | lnc-LRRC63-6:2 | SEQ2555 | 0.03175 | 0.56 | 0.92 |
| lnc-IL3RA-1:24 | SEQ3193 | 0.00794 | 3.02 | 1.00 | lnc-MAPK6-5:1 | SEQ2556 | 0.03175 | 0.56 | 0.92 |
| lnc-GRAP-1:1 | SEQ3195 | 0.00794 | 3.04 | 1.00 | lnc-CHN1-5:11 | SEQ0419 | 0.03175 | 0.56 | 0.92 |
| lnc-ANKRD13A-5:1 | SEQ3196 | 0.00794 | 3.05 | 1.00 | lnc-ARHGAP28-10:4 | SEQ2560 | 0.03175 | 0.56 | 0.92 |
| lnc-SPANXB1-5:4 | SEQ3202 | 0.00794 | 3.10 | 1.00 | lnc-AIDA-1:1 | SEQ2562 | 0.03175 | 0.56 | 0.92 |
| PACRG-AS3:6 | SEQ3204 | 0.00794 | 3.13 | 1.00 | lnc-CLDN19-3:1 | SEQ2564 | 0.03175 | 0.56 | 0.92 |
| lnc-ANKRD13A-5:3 | SEQ3206 | 0.00794 | 3.14 | 1.00 | lnc-TOR1AIP1-2:1 | SEQ2565 | 0.03175 | 0.57 | 0.92 |
| lnc-BCL2L13-4:1 | SEQ3208 | 0.00794 | 3.15 | 1.00 | lnc-DLGAP5-2:1 | SEQ2566 | 0.03175 | 0.57 | 0.92 |
| lnc-TFF3-1:1 | SEQ3209 | 0.00794 | 3.15 | 1.00 | lnc-TMEM55A-6:1 | SEQ2568 | 0.03175 | 0.57 | 0.92 |
| lnc-ZNF585B-5:7 | SEQ3212 | 0.00794 | 3.20 | 1.00 | lnc-ABTB1-1:1 | SEQ2569 | 0.03175 | 0.57 | 0.92 |
| MALAT1:25 | SEQ3213 | 0.00794 | 3.21 | 1.00 | lnc-KMT2C-1:1 | SEQ2570 | 0.03175 | 0.57 | 0.92 |
| lnc-ACSBG2-2:3 | SEQ3214 | 0.00794 | 3.23 | 1.00 | lnc-GNA14-3:1 | SEQ2572 | 0.03175 | 0.57 | 0.92 |
| lnc-HIPK2-1:1 | SEQ3215 | 0.00794 | 3.23 | 1.00 | lnc-ATG2B-9:2 | SEQ2576 | 0.03175 | 0.57 | 0.92 |
| LINC01159:14 | SEQ3216 | 0.00794 | 3.27 | 1.00 | lnc-IL 13RA2-3:1 | SEQ2577 | 0.03175 | 0.57 | 0.92 |
| lnc-TMEM53-2:1 | SEQ3218 | 0.00794 | 3.29 | 1.00 | lnc-SHB-4:1 | SEQ2579 | 0.03175 | 0.57 | 0.92 |
| MIR646HG:26 | SEQ3222 | 0.00794 | 3.38 | 1.00 | lnc-SLC25A32-9:1 | SEQ2581 | 0.03175 | 0.58 | 0.92 |
| lnc-MUSK-3:1 | SEQ3224 | 0.00794 | 3.39 | 1.00 | OIP5-AS1:10 | SEQ2582 | 0.03175 | 0.58 | 0.92 |
| lnc-TMEM53-1:1 | SEQ3226 | 0.00794 | 3.47 | 1.00 | OIP5-AS1:34 | SEQ2583 | 0.03175 | 0.58 | 0.92 |
| lnc-NAIP-5:1 | SEQ3231 | 0.00794 | 3.68 | 1.00 | lnc-SPRED2-22:1 | SEQ2584 | 0.03175 | 0.58 | 0.92 |
| lnc-ZNF236-1:7 | SEQ3232 | 0.00794 | 3.73 | 1.00 | NORAD:8 | SEQ2585 | 0.03175 | 0.58 | 0.92 |
| TSIX:1 | SEQ3234 | 0.00794 | 3.78 | 1.00 | lnc-PHIP-3:1 | SEQ2586 | 0.03175 | 0.58 | 0.92 |
| lnc-MPHOSPH10-2:1 | SEQ3236 | 0.00794 | 3.86 | 1.00 | lnc-MAN2A2-2:3 | SEQ2588 | 0.03175 | 0.58 | 0.92 |
| lnc-ENGASE-4:1 | SEQ3237 | 0.00794 | 3.97 | 1.00 | lnc-DCAF8-1:1 | SEQ2590 | 0.03175 | 0.58 | 0.92 |
| HDAC2-AS2:35 | SEQ3239 | 0.00794 | 4.10 | 1.00 | lnc-MBOAT4-2:1 | SEQ2592 | 0.03175 | 0.58 | 0.92 |
| lnc-SPANXB1-5:3 | SEQ3242 | 0.00794 | 4.19 | 1.00 | lnc-FOXD4L5-18:4 | SEQ2593 | 0.03175 | 0.58 | 0.92 |
| lnc-ZNF236-1:6 | SEQ3246 | 0.00794 | 4.26 | 1.00 | lnc-SPINK2-4:1 | SEQ2594 | 0.03175 | 0.59 | 0.92 |
| lnc-THOC1-3:1 | SEQ3247 | 0.00794 | 4.41 | 1.00 | lnc-MLH1-1:1 | SEQ2597 | 0.03175 | 0.59 | 0.92 |
| lnc-TARDBP-5:6 | SEQ3249 | 0.00794 | 4.51 | 1.00 | lnc-AHCY-4:1 | SEQ2600 | 0.03175 | 0.59 | 0.92 |
| lnc-GPR37-1:1 | SEQ0926 | 0.00794 | 4.72 | 1.00 | lnc-MCTS1-2:1 | SEQ2602 | 0.03175 | 0.59 | 0.92 |
| LINC01608:9 | SEQ3251 | 0.00794 | 4.76 | 1.00 | lnc-SCD-2:4 | SEQ2606 | 0.03175 | 0.60 | 0.92 |
| SRP14-AS1:28 | SEQ3253 | 0.00794 | 5.10 | 1.00 | lnc-FAM103A1-2:5 | SEQ2607 | 0.03175 | 0.60 | 0.92 |
| lnc-CXorf51B-1:1 | SEQ3257 | 0.00794 | 5.47 | 1.00 | lnc-SURF2-4:1 | SEQ2609 | 0.03175 | 0.60 | 0.92 |
| lnc-ZNF608-20:2 | SEQ3258 | 0.00794 | 5.65 | 1.00 | lnc-HAO2-2:26 | SEQ2610 | 0.03175 | 0.60 | 0.92 |
| lnc-LEF1-3:4 | SEQ3259 | 0.00794 | 5.77 | 1.00 | SNHG7:15 | SEQ2614 | 0.03175 | 0.60 | 0.92 |
| LINC01515:31 | SEQ3260 | 0.00794 | 5.90 | 1.00 | lnc-HMG20A-6:1 | SEQ2615 | 0.03175 | 0.60 | 0.92 |
| lnc-BCL2L13-5:2 | SEQ3262 | 0.00794 | 6.65 | 1.00 | lnc-PANK3-13:2 | SEQ2618 | 0.03175 | 0.60 | 0.92 |
| lnc-LTBP3-2:6 | SEQ3264 | 0.00794 | 6.67 | 1.00 | lnc-ATCAY-1:1 | SEQ2619 | 0.03175 | 0.60 | 0.92 |
| NR2F1-AS1:49 | SEQ3265 | 0.00794 | 6.78 | 1.00 | EIF3J-AS1:21 | SEQ0261 | 0.03175 | 0.61 | 0.92 |
| LINC01608:12 | SEQ3266 | 0.00794 | 6.91 | 1.00 | lnc-DNAH8-2:6 | SEQ2620 | 0.03175 | 0.61 | 0.92 |

TABLE 8-continued

The 1202 lncRNAs with known sequence identified by the present invention having a deficient expression (FC ≤ 0.84) or over-expression (FC ≥ 1.22) in human AD brain temporal cortex versus human healthy control brain temporal cortex.

| lncRNA | SEQ | p-value | FC | AUC | lncRNA | SEQ | p-value | FC | AUC |
|---|---|---|---|---|---|---|---|---|---|
| lnc-NMUR2-4:1 | SEQ3268 | 0.00794 | 6.99 | 1.00 | lnc-ATOX1-4:1 | SEQ2621 | 0.03175 | 0.61 | 0.92 |
| LINC-PINT:27 | SEQ3269 | 0.00794 | 8.08 | 1.00 | lnc-AGAP2-1:4 | SEQ2622 | 0.03175 | 0.61 | 0.92 |
| lnc-DRICH1-3:26 | SEQ3271 | 0.00794 | 8.28 | 1.00 | lnc-HRASLS-5:3 | SEQ2623 | 0.03175 | 0.61 | 0.92 |
| MALAT1:23 | SEQ3272 | 0.00794 | 10.88 | 1.00 | lnc-HMGCS1-3:1 | SEQ2627 | 0.03175 | 0.61 | 0.92 |
| MALAT1:48 | SEQ3273 | 0.00794 | 10.88 | 1.00 | lnc-PANK3-13:1 | SEQ2629 | 0.03175 | 0.61 | 0.92 |
| lnc-BAHCC1-2:1 | SEQ3274 | 0.00794 | 12.21 | 1.00 | lnc-FAM174A-6:2 | SEQ2631 | 0.03175 | 0.62 | 0.92 |
| lnc-NDUFB4-1:3 | SEQ2116 | 0.01116 | 0.02 | 1.00 | lnc-UCHL3-1:1 | SEQ2632 | 0.03175 | 0.62 | 0.92 |
| lnc-CTH-14:1 | SEQ2121 | 0.01193 | 0.07 | 1.00 | lnc-PALLD-8:1 | SEQ2633 | 0.03175 | 0.62 | 0.92 |
| lnc-ZNF717-4:8 | SEQ2119 | 0.01587 | 0.04 | 0.96 | lnc-ZNF596-9:2 | SEQ2634 | 0.03175 | 0.62 | 0.92 |
| lnc-PSMB9-6:1 | SEQ2126 | 0.01587 | 0.09 | 0.96 | lnc-PTAR1-4:1 | SEQ2638 | 0.03175 | 0.62 | 0.92 |
| lnc-SYT16-4:11 | SEQ2139 | 0.01587 | 0.16 | 0.96 | lnc-GLRX2-1:2 | SEQ2640 | 0.03175 | 0.62 | 0.92 |
| lnc-ZNF705B-3:1 | SEQ2150 | 0.01587 | 0.20 | 0.96 | lnc-PHOSPHO2-2:1 | SEQ2641 | 0.03175 | 0.62 | 0.92 |
| lnc-DIRC3-1:4 | SEQ2156 | 0.01587 | 0.21 | 0.96 | lnc-KLHL28-3:5 | SEQ2642 | 0.03175 | 0.62 | 0.92 |
| lnc-NID2-2:1 | SEQ2158 | 0.01587 | 0.22 | 0.96 | CASC2:1 | SEQ2645 | 0.03175 | 0.62 | 0.92 |
| lnc-SYT16-4:10 | SEQ2159 | 0.01587 | 0.23 | 0.96 | lnc-KIF1C-1:2 | SEQ2646 | 0.03175 | 0.62 | 0.92 |
| lnc-MED10-3:1 | SEQ2165 | 0.01587 | 0.24 | 0.96 | lnc-STARD8-3:1 | SEQ2647 | 0.03175 | 0.63 | 0.92 |
| lnc-PRSS27-4:24 | SEQ2168 | 0.01587 | 0.24 | 0.96 | lnc-ASXL 1-3:1 | SEQ2650 | 0.03175 | 0.63 | 0.92 |
| lnc-SCARB2-1:4 | SEQ2171 | 0.01587 | 0.25 | 0.96 | lnc-LPCAT3-1:1 | SEQ2652 | 0.03175 | 0.63 | 0.92 |
| lnc-GAPT-10:1 | SEQ2172 | 0.01587 | 0.25 | 0.96 | MCPH1-AS1:2 | SEQ0308 | 0.03175 | 0.63 | 0.92 |
| CERNA1:2 | SEQ2176 | 0.01587 | 0.25 | 0.96 | ZFAS1:23 | SEQ2657 | 0.03175 | 0.63 | 0.92 |
| lnc-HNRNPA2B1-15:16 | SEQ2177 | 0.01587 | 0.25 | 0.96 | lnc-SSB-2:1 | SEQ2661 | 0.03175 | 0.63 | 0.92 |
| THAP9-AS1:27 | SEQ2178 | 0.01587 | 0.25 | 0.96 | lnc-KANSL2-1:2 | SEQ2664 | 0.03175 | 0.64 | 0.92 |
| lnc-LIPI-7:1 | SEQ2195 | 0.01587 | 0.30 | 0.96 | lnc-BICRAL-3:1 | SEQ2666 | 0.03175 | 0.64 | 0.92 |
| lnc-PRDM4-6:5 | SEQ2211 | 0.01587 | 0.31 | 0.96 | lnc-USP53-8:5 | SEQ2668 | 0.03175 | 0.64 | 0.92 |
| lnc-SOCS6-10:1 | SEQ2214 | 0.01587 | 0.31 | 0.96 | LINC01124:11 | SEQ2670 | 0.03175 | 0.64 | 0.92 |
| lnc-UNC80-1:1 | SEQ2219 | 0.01587 | 0.32 | 0.96 | lnc-TARBP1-6:1 | SEQ2671 | 0.03175 | 0.64 | 0.92 |
| lnc-SYT16-4:3 | SEQ2220 | 0.01587 | 0.32 | 0.96 | lnc-MRPS16-2:4 | SEQ2674 | 0.03175 | 0.64 | 0.92 |
| lnc-SYT16-4:6 | SEQ2221 | 0.01587 | 0.32 | 0.96 | lnc-SIDT2-2:2 | SEQ2675 | 0.03175 | 0.64 | 0.92 |
| lnc-SMARCA5-4:7 | SEQ2223 | 0.01587 | 0.32 | 0.96 | lnc-C11orf94-1:1 | SEQ2676 | 0.03175 | 0.64 | 0.92 |
| lnc-USP17L7-1:1 | SEQ0746 | 0.01587 | 0.33 | 0.96 | lnc-GNA11-3:1 | SEQ2681 | 0.03175 | 0.65 | 0.92 |
| LINC00630:38 | SEQ2231 | 0.01587 | 0.33 | 0.96 | lnc-BTBD1-2:1 | SEQ2683 | 0.03175 | 0.65 | 0.92 |
| lnc-GUCY1A3-1:1 | SEQ0520 | 0.01587 | 0.34 | 0.96 | lnc-MZT2A-19:1 | SEQ2684 | 0.03175 | 0.65 | 0.92 |
| lnc-GLIPR1L1-2:3 | SEQ0427 | 0.01587 | 0.34 | 0.96 | lnc-SMC5-6:1 | SEQ2686 | 0.03175 | 0.65 | 0.92 |
| RFPL1S:11 | SEQ2233 | 0.01587 | 0.34 | 0.96 | lnc-NPIPB4-3:5 | SEQ2687 | 0.03175 | 0.65 | 0.92 |
| lnc-PPIE-5:1 | SEQ2235 | 0.01587 | 0.34 | 0.96 | lnc-TOX4-4:2 | SEQ2696 | 0.03175 | 0.66 | 0.92 |
| lnc-ITGBL 1-2:1 | SEQ2241 | 0.01587 | 0.35 | 0.96 | lnc-KCNT1-6:1 | SEQ2699 | 0.03175 | 0.66 | 0.92 |
| NR2F1-AS1:6 | SEQ2247 | 0.01587 | 0.36 | 0.96 | lnc-ATPIF1-2:1 | SEQ2700 | 0.03175 | 0.66 | 0.92 |
| RFPL1S:10 | SEQ2248 | 0.01587 | 0.36 | 0.96 | lnc-ITGB1BP2-2:1 | SEQ2701 | 0.03175 | 0.66 | 0.92 |
| CHMP1B-AS1:2 | SEQ2249 | 0.01587 | 0.36 | 0.96 | lnc-TMEM186-1:2 | SEQ2702 | 0.03175 | 0.66 | 0.92 |
| lnc-PPP1R3C-4:1 | SEQ2250 | 0.01587 | 0.36 | 0.96 | lnc-INAFM2-1:1 | SEQ2705 | 0.03175 | 0.67 | 0.92 |
| lnc-SUSD1-1:5 | SEQ0638 | 0.01587 | 0.37 | 0.96 | lnc-RGP D8-5:2 | SEQ2707 | 0.03175 | 0.67 | 0.92 |
| LINC01184:30 | SEQ2257 | 0.01587 | 0.37 | 0.96 | lnc-CDT1-1:1 | SEQ2708 | 0.03175 | 0.67 | 0.92 |
| lnc-TMSB15A-3:1 | SEQ2259 | 0.01587 | 0.37 | 0.96 | lnc-BTBD6-2:1 | SEQ2709 | 0.03175 | 0.67 | 0.92 |
| lnc-COPG2-3:1 | SEQ2265 | 0.01587 | 0.38 | 0.96 | lnc-CRHR2-3:1 | SEQ2710 | 0.03175 | 0.67 | 0.92 |
| lnc-SNRPN-8:36 | SEQ2268 | 0.01587 | 0.38 | 0.96 | PINK1-AS:1 | SEQ2712 | 0.03175 | 0.68 | 0.92 |
| lnc-TYRO3-3:1 | SEQ2269 | 0.01587 | 0.39 | 0.96 | lnc-GUSB-4:1 | SEQ2716 | 0.03175 | 0.68 | 0.92 |
| lnc-ZNF736-1:2 | SEQ2272 | 0.01587 | 0.39 | 0.96 | lnc-GP1BA-1:1 | SEQ2718 | 0.03175 | 0.68 | 0.92 |
| lnc-NT5E-11:3 | SEQ2278 | 0.01587 | 0.39 | 0.96 | lnc-EDEM3-7:3 | SEQ0272 | 0.03175 | 0.68 | 0.92 |
| lnc-MUC20-5:2 | SEQ2289 | 0.01587 | 0.40 | 0.96 | lnc-PRCP-1:1 | SEQ2720 | 0.03175 | 0.68 | 0.92 |
| lnc-FANCM-8:3 | SEQ2291 | 0.01587 | 0.40 | 0.96 | lnc-ALX4-17:1 | SEQ2722 | 0.03175 | 0.68 | 0.92 |
| lnc-FSHR-4:1 | SEQ2298 | 0.01587 | 0.41 | 0.96 | lnc-AP3S1-1:3 | SEQ2723 | 0.03175 | 0.68 | 0.92 |
| lnc-LIPI-4:6 | SEQ2300 | 0.01587 | 0.41 | 0.96 | lnc-FUT9-1:1 | SEQ2724 | 0.03175 | 0.69 | 0.92 |
| lnc-VPREB1-7:3 | SEQ2303 | 0.01587 | 0.41 | 0.96 | lnc-CHD2-13:2 | SEQ2726 | 0.03175 | 0.69 | 0.92 |
| lnc-KHDC3L-2:16 | SEQ2305 | 0.01587 | 0.41 | 0.96 | lnc-BAG3-1:1 | SEQ2727 | 0.03175 | 0.69 | 0.92 |
| lnc-CHST7-2:1 | SEQ2306 | 0.01587 | 0.41 | 0.96 | lnc-TMEM243-1:1 | SEQ2728 | 0.03175 | 0.69 | 0.92 |
| lnc-PARD3B-4:1 | SEQ2315 | 0.01587 | 0.42 | 0.96 | lnc-RPS6KB1-1:7 | SEQ2729 | 0.03175 | 0.69 | 0.92 |
| SNHG3:5 | SEQ2316 | 0.01587 | 0.42 | 0.96 | lnc-ZC3HC1-4:1 | SEQ2731 | 0.03175 | 0.70 | 0.92 |
| lnc-ZNF704-7:6 | SEQ2317 | 0.01587 | 0.42 | 0.96 | lnc-PINK1-2:1 | SEQ2734 | 0.03175 | 0.70 | 0.92 |
| lnc-PRMT6-9:1 | SEQ2319 | 0.01587 | 0.43 | 0.96 | lnc-RTL9-2:1 | SEQ2735 | 0.03175 | 0.70 | 0.92 |
| lnc-GNA13-2:13 | SEQ2320 | 0.01587 | 0.43 | 0.96 | lnc-MAML3-2:1 | SEQ0438 | 0.03175 | 0.71 | 0.92 |
| lnc-FGFBP3-2:2 | SEQ2330 | 0.01587 | 0.43 | 0.96 | lnc-NOB1-1:1 | SEQ2738 | 0.03175 | 0.71 | 0.92 |
| lnc-NOL4-6:1 | SEQ2331 | 0.01587 | 0.43 | 0.96 | lnc-ANAPC11-2:9 | SEQ2739 | 0.03175 | 0.71 | 0.92 |
| IDI2-AS1:5 | SEQ2352 | 0.01587 | 0.45 | 0.96 | lnc-C14orf177-5:1 | SEQ2740 | 0.03175 | 0.72 | 0.92 |
| lnc-ZNF316-3:8 | SEQ2359 | 0.01587 | 0.45 | 0.96 | lnc-ACTRT3-5:1 | SEQ2741 | 0.03175 | 0.72 | 0.92 |
| ADIRF-AS1:2 | SEQ2379 | 0.01587 | 0.46 | 0.96 | lnc-GPBP1L1-1:8 | SEQ2745 | 0.03175 | 0.73 | 0.92 |
| lnc-CA6-8:2 | SEQ2380 | 0.01587 | 0.46 | 0.96 | lnc-ZNF221-2:6 | SEQ2746 | 0.03175 | 0.73 | 0.92 |
| lnc-DCAF4L1-2:1 | SEQ2387 | 0.01587 | 0.47 | 0.96 | lnc-LEAP2-2:1 | SEQ2749 | 0.03175 | 0.74 | 0.92 |
| SNAI3-AS1:6 | SEQ2392 | 0.01587 | 0.47 | 0.96 | lnc-CIB3-1:2 | SEQ2750 | 0.03175 | 0.74 | 0.92 |
| lnc-COX7B-2:1 | SEQ2394 | 0.01587 | 0.47 | 0.96 | lnc-SLTM-1:2 | SEQ0982 | 0.03175 | 0.75 | 0.92 |
| lnc-TAOK3-9:1 | SEQ2396 | 0.01587 | 0.48 | 0.96 | lnc-NR2C2-1:1 | SEQ2751 | 0.03175 | 0.75 | 0.92 |
| LINC01006:1 | SEQ2401 | 0.01587 | 0.48 | 0.96 | lnc-DFFA-12:2 | SEQ2754 | 0.03175 | 0.75 | 0.92 |
| LINC01006:2 | SEQ2402 | 0.01587 | 0.48 | 0.96 | lnc-PLEKHA8-3:5 | SEQ0962 | 0.03175 | 0.75 | 0.92 |
| lnc-AP3S1-1:2 | SEQ2405 | 0.01587 | 0.48 | 0.96 | lnc-PGBD5-1:1 | SEQ2755 | 0.03175 | 0.75 | 0.92 |
| OIP5-AS1:2 | SEQ2408 | 0.01587 | 0.48 | 0.96 | lnc-CDH8-4:1 | SEQ2756 | 0.03175 | 0.76 | 0.92 |

TABLE 8-continued

The 1202 lncRNAs with known sequence identified by the present invention having a deficient expression (FC ≤ 0.84) or over-expression (FC ≥ 1.22) in human AD brain temporal cortex versus human healthy control brain temporal cortex.

| lncRNA | SEQ | p-value | FC | AUC | lncRNA | SEQ | p-value | FC | AUC |
|---|---|---|---|---|---|---|---|---|---|
| lnc-FAM172A-7:8 | SEQ2409 | 0.01587 | 0.48 | 0.96 | lnc-TCTA-2:1 | SEQ2757 | 0.03175 | 0.76 | 0.92 |
| lnc-PMM2-6:4 | SEQ2411 | 0.01587 | 0.48 | 0.96 | lnc-ERVV-2-9:1 | SEQ2758 | 0.03175 | 0.76 | 0.92 |
| UGDH-AS1:10 | SEQ0407 | 0.01587 | 0.49 | 0.96 | lnc-DDX49-1:1 | SEQ2759 | 0.03175 | 0.76 | 0.92 |
| lnc-S100P-4:13 | SEQ2418 | 0.01587 | 0.49 | 0.96 | lnc-HSD11B1L-1:1 | SEQ2760 | 0.03175 | 0.77 | 0.92 |
| lnc-ZNF449-3:5 | SEQ2420 | 0.01587 | 0.49 | 0.96 | lnc-MOGAT2-4:1 | SEQ2762 | 0.03175 | 0.78 | 0.92 |
| lnc-ZNF449-3:4 | SEQ2421 | 0.01587 | 0.49 | 0.96 | lnc-C20orf96-1:1 | SEQ2764 | 0.03175 | 0.79 | 0.92 |
| lnc-GRAP2-2:1 | SEQ2429 | 0.01587 | 0.49 | 0.96 | lnc-TRIM59-1:1 | SEQ2766 | 0.03175 | 0.79 | 0.92 |
| lnc-TPTE2-4:1 | SEQ2431 | 0.01587 | 0.49 | 0.96 | lnc-GSDMB-1:1 | SEQ2767 | 0.03175 | 0.84 | 0.92 |
| lnc-H2AFV-3:1 | SEQ2433 | 0.01587 | 0.49 | 0.96 | lnc-RFNG-1:7 | SEQ2768 | 0.03175 | 1.22 | 0.92 |
| lnc-XXYLT1-5:1 | SEQ0221 | 0.01587 | 0.50 | 0.96 | lnc-SCRN1-1:5 | SEQ2769 | 0.03175 | 1.25 | 0.92 |
| lnc-EPC1-5:1 | SEQ2445 | 0.01587 | 0.50 | 0.96 | lnc-RRN3-3:5 | SEQ2770 | 0.03175 | 1.26 | 0.92 |
| lnc-NUB1-4:1 | SEQ0126 | 0.01587 | 0.50 | 0.96 | lnc-ANKS3-2:1 | SEQ2771 | 0.03175 | 1.28 | 0.92 |
| lnc-GPRIN2-2:1 | SEQ2453 | 0.01587 | 0.50 | 0.96 | lnc-ADAT3-5:1 | SEQ2772 | 0.03175 | 1.28 | 0.92 |
| lnc-ACTR10-6:1 | SEQ2458 | 0.01587 | 0.51 | 0.96 | lnc-TMC8-4:1 | SEQ2775 | 0.03175 | 1.32 | 0.92 |
| lnc-KCNE4-7:1 | SEQ2466 | 0.01587 | 0.51 | 0.96 | EP300-AS1:13 | SEQ2778 | 0.03175 | 1.34 | 0.92 |
| lnc-RMDN2-3:24 | SEQ2468 | 0.01587 | 0.52 | 0.96 | lnc-SLC22A18-1:1 | SEQ2779 | 0.03175 | 1.34 | 0.92 |
| OTUD6B-AS1:5 | SEQ2471 | 0.01587 | 0.52 | 0.96 | lnc-PARVG-5:1 | SEQ2781 | 0.03175 | 1.35 | 0.92 |
| lnc-CGREF1-2:1 | SEQ2472 | 0.01587 | 0.52 | 0.96 | lnc-MRPL3-2:6 | SEQ2782 | 0.03175 | 1.36 | 0.92 |
| lnc-FGF23-5:3 | SEQ2473 | 0.01587 | 0.52 | 0.96 | DUBR:25 | SEQ2783 | 0.03175 | 1.38 | 0.92 |
| lnc-FGF23-5:1 | SEQ2474 | 0.01587 | 0.52 | 0.96 | HDHD5-AS1:6 | SEQ2784 | 0.03175 | 1.38 | 0.92 |
| lnc-DLK1-18:121 | SEQ2479 | 0.01587 | 0.52 | 0.96 | lnc-NPIPB12-1:1 | SEQ0822 | 0.03175 | 1.39 | 0.92 |
| lnc-SMARCC2-5:1 | SEQ2481 | 0.01587 | 0.52 | 0.96 | lnc-CMTM3-1:1 | SEQ2789 | 0.03175 | 1.39 | 0.92 |
| lnc-ARHGAP15-2:3 | SEQ2483 | 0.01587 | 0.52 | 0.96 | lnc-SSH3-5:1 | SEQ2791 | 0.03175 | 1.40 | 0.92 |
| EIF3J-AS1:1 | SEQ2486 | 0.01587 | 0.53 | 0.96 | WDFY3-AS2:5 | SEQ2794 | 0.03175 | 1.41 | 0.92 |
| SNHG22:7 | SEQ2487 | 0.01587 | 0.53 | 0.96 | LINC00342:1 | SEQ2795 | 0.03175 | 1.41 | 0.92 |
| lnc-ST7L-5:1 | SEQ2493 | 0.01587 | 0.53 | 0.96 | lnc-TMEM211-1:1 | SEQ2797 | 0.03175 | 1.42 | 0.92 |
| NORAD:9 | SEQ2494 | 0.01587 | 0.53 | 0.96 | lnc-USP35-11:2 | SEQ2802 | 0.03175 | 1.45 | 0.92 |
| lnc-LEKR1-4:10 | SEQ2495 | 0.01587 | 0.53 | 0.96 | lnc-DHX38-4:13 | SEQ2803 | 0.03175 | 1.45 | 0.92 |
| lnc-CT47A1-1:1 | SEQ2504 | 0.01587 | 0.53 | 0.96 | lnc-RPP25-3:1 | SEQ2804 | 0.03175 | 1.46 | 0.92 |
| lnc-SOCS2-1:2 | SEQ2505 | 0.01587 | 0.53 | 0.96 | SEMA6A-AS1:1 | SEQ2805 | 0.03175 | 1.47 | 0.92 |
| lnc-ADGRA3-7:1 | SEQ2512 | 0.01587 | 0.54 | 0.96 | TRAF3IP2-AS1:58 | SEQ2806 | 0.03175 | 1.47 | 0.92 |
| lnc-CHODL-2:2 | SEQ2513 | 0.01587 | 0.54 | 0.96 | lnc-HBEGF-2:8 | SEQ2807 | 0.03175 | 1.47 | 0.92 |
| lnc-SSR3-11:1 | SEQ2529 | 0.01587 | 0.54 | 0.96 | HYI-AS1:3 | SEQ2809 | 0.03175 | 1.48 | 0.92 |
| NORAD:3 | SEQ2530 | 0.01587 | 0.54 | 0.96 | lnc-WDFY4-2:1 | SEQ2812 | 0.03175 | 1.49 | 0.92 |
| NORAD:4 | SEQ2532 | 0.01587 | 0.55 | 0.96 | lnc-KLHDC4-2:2 | SEQ2815 | 0.03175 | 1.49 | 0.92 |
| lnc-CIB3-6:1 | SEQ2539 | 0.01587 | 0.55 | 0.96 | lnc-CTNS-1:1 | SEQ2816 | 0.03175 | 1.50 | 0.92 |
| lnc-LRRK2-1:5 | SEQ2541 | 0.01587 | 0.55 | 0.96 | lnc-TRPM1-3:1 | SEQ0388 | 0.03175 | 1.51 | 0.92 |
| LINC01537:4 | SEQ2543 | 0.01587 | 0.55 | 0.96 | lnc-AUNIP-1:12 | SEQ2821 | 0.03175 | 1.52 | 0.92 |
| lnc-ANAPC11-2:12 | SEQ2544 | 0.01587 | 0.55 | 0.96 | lnc-MYOM1-4:5 | SEQ2823 | 0.03175 | 1.52 | 0.92 |
| lnc-COL20A1-3:2 | SEQ2545 | 0.01587 | 0.55 | 0.96 | lnc-SPATA21-6:3 | SEQ2824 | 0.03175 | 1.52 | 0.92 |
| lnc-JAG1-6:1 | SEQ2547 | 0.01587 | 0.55 | 0.96 | lnc-AGBL3-2:1 | SEQ2825 | 0.03175 | 1.52 | 0.92 |
| NORAD:1 | SEQ2550 | 0.01587 | 0.55 | 0.96 | lnc-NPIPB12-2:1 | SEQ2827 | 0.03175 | 1.53 | 0.92 |
| lnc-WDR77-1:2 | SEQ2553 | 0.01587 | 0.56 | 0.96 | lnc-C11orf95-1:2 | SEQ2828 | 0.03175 | 1.53 | 0.92 |
| lnc-TBCB-1:2 | SEQ2561 | 0.01587 | 0.56 | 0.96 | lnc-TPT1-2:1 | SEQ2830 | 0.03175 | 1.54 | 0.92 |
| lnc-ARMCX1-2:1 | SEQ2563 | 0.01587 | 0.56 | 0.96 | lnc-SLC25A16-1:2 | SEQ2831 | 0.03175 | 1.54 | 0.92 |
| lnc-SRD5A1-2:1 | SEQ2573 | 0.01587 | 0.57 | 0.96 | lnc-USP6-2:22 | SEQ2832 | 0.03175 | 1.54 | 0.92 |
| lnc-ZNF613-7:1 | SEQ2574 | 0.01587 | 0.57 | 0.96 | lnc-MED9-1:2 | SEQ2833 | 0.03175 | 1.54 | 0.92 |
| lnc-MPPE1-8:3 | SEQ2578 | 0.01587 | 0.57 | 0.96 | lnc-NOP14-3:4 | SEQ2834 | 0.03175 | 1.54 | 0.92 |
| lnc-RSPH10B2-1:3 | SEQ2580 | 0.01587 | 0.57 | 0.96 | lnc-ADAP1-1:1 | SEQ2837 | 0.03175 | 1.55 | 0.92 |
| GABPB1-IT1:5 | SEQ2591 | 0.01587 | 0.58 | 0.96 | lnc-ZFP3-3:1 | SEQ2838 | 0.03175 | 1.55 | 0.92 |
| lnc-ARHGEF2-3:4 | SEQ2605 | 0.01587 | 0.60 | 0.96 | KIAA1614-AS1:1 | SEQ2839 | 0.03175 | 1.56 | 0.92 |
| lnc-WASHC4-4:1 | SEQ2608 | 0.01587 | 0.60 | 0.96 | lnc-PLD3-3:1 | SEQ2840 | 0.03175 | 1.56 | 0.92 |
| lnc-ZNF639-4:1 | SEQ2617 | 0.01587 | 0.60 | 0.96 | lnc-TARBP2-2:1 | SEQ2845 | 0.03175 | 1.57 | 0.92 |
| lnc-MFSD4A-1:1 | SEQ2625 | 0.01587 | 0.61 | 0.96 | LINC01410:8 | SEQ2846 | 0.03175 | 1.57 | 0.92 |
| OIP5-AS1:1 | SEQ2635 | 0.01587 | 0.62 | 0.96 | lnc-CYP4F22-5:1 | SEQ2850 | 0.03175 | 1.58 | 0.92 |
| lnc-ZNF613-6:1 | SEQ2637 | 0.01587 | 0.62 | 0.96 | PPP3CB-AS1:22 | SEQ2852 | 0.03175 | 1.58 | 0.92 |
| lnc-SNX20-5:3 | SEQ2643 | 0.01587 | 0.62 | 0.96 | lnc-PPARA-3:8 | SEQ2854 | 0.03175 | 1.58 | 0.92 |
| lnc-KDM3A-1:3 | SEQ2648 | 0.01587 | 0.63 | 0.96 | lnc-MTG1-2:1 | SEQ2858 | 0.03175 | 1.59 | 0.92 |
| lnc-NOL6-6:2 | SEQ2649 | 0.01587 | 0.63 | 0.96 | DLEU2:26 | SEQ0862 | 0.03175 | 1.60 | 0.92 |
| lnc-FGL2-4:1 | SEQ2651 | 0.01587 | 0.63 | 0.96 | lnc-ABCE1-5:1 | SEQ2862 | 0.03175 | 1.60 | 0.92 |
| lnc-EIF1AD-1:1 | SEQ2653 | 0.01587 | 0.63 | 0.96 | IRAIN:2 | SEQ2863 | 0.03175 | 1.60 | 0.92 |
| lnc-TEX37-1:2 | SEQ2654 | 0.01587 | 0.63 | 0.96 | IRAIN:3 | SEQ2864 | 0.03175 | 1.60 | 0.92 |
| lnc-TEX37-1:1 | SEQ2655 | 0.01587 | 0.63 | 0.96 | lnc-ZNF778-1:4 | SEQ2865 | 0.03175 | 1.60 | 0.92 |
| lnc-POM121-2:5 | SEQ2658 | 0.01587 | 0.63 | 0.96 | MAGI2-AS3:85 | SEQ2867 | 0.03175 | 1.61 | 0.92 |
| lnc-SLC16A11-7:7 | SEQ2659 | 0.01587 | 0.63 | 0.96 | TPT1-AS1:54 | SEQ2870 | 0.03175 | 1.61 | 0.92 |
| lnc-PIGU-3:1 | SEQ2663 | 0.01587 | 0.64 | 0.96 | LINC02482:2 | SEQ2871 | 0.03175 | 1.61 | 0.92 |
| lnc-AGAP4-2:1 | SEQ2665 | 0.01587 | 0.64 | 0.96 | lnc-PPP6R2-2:2 | SEQ2876 | 0.03175 | 1.62 | 0.92 |
| lnc-URGCP-MRPS24-2:1 | SEQ2667 | 0.01587 | 0.64 | 0.96 | lnc-CLEC18B-5:1 | SEQ2878 | 0.03175 | 1.63 | 0.92 |
| lnc-EFEMP1-3:12 | SEQ2669 | 0.01587 | 0.64 | 0.96 | lnc-MYOZ1-1:2 | SEQ2879 | 0.03175 | 1.63 | 0.92 |
| lnc-SHISA5-1:2 | SEQ2672 | 0.01587 | 0.64 | 0.96 | LINC00599:13 | SEQ2880 | 0.03175 | 1.63 | 0.92 |
| lnc-GLOD4-3:1 | SEQ2673 | 0.01587 | 0.64 | 0.96 | LIMD1-AS1:2 | SEQ2885 | 0.03175 | 1.64 | 0.92 |
| lnc-STX10-3:1 | SEQ2677 | 0.01587 | 0.64 | 0.96 | lnc-TELO2-3:2 | SEQ2887 | 0.03175 | 1.65 | 0.92 |
| lnc-MAOA-5:1 | SEQ2678 | 0.01587 | 0.64 | 0.96 | lnc-DLK1-18:77 | SEQ2888 | 0.03175 | 1.65 | 0.92 |

TABLE 8-continued

The 1202 lncRNAs with known sequence identified by the present invention having a deficient expression (FC ≤ 0.84) or over-expression (FC ≥ 1.22) in human AD brain temporal cortex versus human healthy control brain temporal cortex.

| lncRNA | SEQ | p-value | FC | AUC | lncRNA | SEQ | p-value | FC | AUC |
|---|---|---|---|---|---|---|---|---|---|
| lnc-MB-5:1 | SEQ2679 | 0.01587 | 0.64 | 0.96 | lnc-MACC1-3:6 | SEQ2890 | 0.03175 | 1.66 | 0.92 |
| lnc-IL31RA-1:1 | SEQ2680 | 0.01587 | 0.64 | 0.96 | SVIL-AS1:39 | SEQ2891 | 0.03175 | 1.66 | 0.92 |
| lnc-FNTB-2:1 | SEQ2682 | 0.01587 | 0.65 | 0.96 | lnc-CELF4-10:1 | SEQ2892 | 0.03175 | 1.67 | 0.92 |
| lnc-FANCL-4:1 | SEQ2690 | 0.01587 | 0.65 | 0.96 | lnc-MED15-1:2 | SEQ0620 | 0.03175 | 1.68 | 0.92 |
| lnc-CES5A-1:2 | SEQ2691 | 0.01587 | 0.65 | 0.96 | lnc-LIPG-11:1 | SEQ2894 | 0.03175 | 1.68 | 0.92 |
| lnc-NOP53-2:1 | SEQ2692 | 0.01587 | 0.65 | 0.96 | lnc-TOB2-3:1 | SEQ2902 | 0.03175 | 1.69 | 0.92 |
| lnc-CPM-3:1 | SEQ0228 | 0.01587 | 0.66 | 0.96 | lnc-PLA2G1B-2:3 | SEQ2905 | 0.03175 | 1.70 | 0.92 |
| lnc-PTBP3-7:1 | SEQ2703 | 0.01587 | 0.67 | 0.96 | lnc-SLC37A2-2:1 | SEQ2906 | 0.03175 | 1.71 | 0.92 |
| lnc-FAM228B-2:1 | SEQ2714 | 0.01587 | 0.68 | 0.96 | lnc-RNF208-3:1 | SEQ2911 | 0.03175 | 1.72 | 0.92 |
| lnc-ABCC6-11:1 | SEQ2717 | 0.01587 | 0.68 | 0.96 | lnc-ANKRD36B-3:9 | SEQ2913 | 0.03175 | 1.72 | 0.92 |
| lnc-VLDLR-4:1 | SEQ2719 | 0.01587 | 0.68 | 0.96 | lnc-CD40LG-2:12 | SEQ2919 | 0.03175 | 1.74 | 0.92 |
| lnc-CYTIP-2:1 | SEQ0200 | 0.01587 | 0.68 | 0.96 | lnc-EVI5L-3:1 | SEQ2920 | 0.03175 | 1.74 | 0.92 |
| lnc-EPM2AIP1-9:2 | SEQ2721 | 0.01587 | 0.68 | 0.96 | lnc-ZNF587-1:1 | SEQ2921 | 0.03175 | 1.74 | 0.92 |
| lnc-LYN-8:1 | SEQ0619 | 0.01587 | 0.69 | 0.96 | lnc-SERPINE3-2:1 | SEQ2922 | 0.03175 | 1.74 | 0.92 |
| lnc-PSMC3IP-5:1 | SEQ2730 | 0.01587 | 0.70 | 0.96 | lnc-SHC3-5:1 | SEQ2924 | 0.03175 | 1.75 | 0.92 |
| lnc-P4HTM-2:1 | SEQ2732 | 0.01587 | 0.70 | 0.96 | lnc-RABEP2-6:1 | SEQ2929 | 0.03175 | 1.77 | 0.92 |
| lnc-GDPD4-1:3 | SEQ2733 | 0.01587 | 0.70 | 0.96 | lnc-NUDT4P1-1:12 | SEQ2932 | 0.03175 | 1.78 | 0.92 |
| lnc-KIFC2-1:8 | SEQ2737 | 0.01587 | 0.70 | 0.96 | lnc-CRYM-3:1 | SEQ2933 | 0.03175 | 1.78 | 0.92 |
| lnc-GAMT-6:2 | SEQ2742 | 0.01587 | 0.72 | 0.96 | GEMIN7-AS1:2 | SEQ2934 | 0.03175 | 1.78 | 0.92 |
| lnc-PRPF4B-5:1 | SEQ2747 | 0.01587 | 0.73 | 0.96 | lnc-FGFR1OP-11:1 | SEQ2935 | 0.03175 | 1.78 | 0.92 |
| lnc-CXorf65-2:1 | SEQ2748 | 0.01587 | 0.74 | 0.96 | lnc-NTAN1-5:1 | SEQ2936 | 0.03175 | 1.78 | 0.92 |
| lnc-AGO1-1:1 | SEQ2752 | 0.01587 | 0.75 | 0.96 | lnc-GOLGA8F-7:1 | SEQ2938 | 0.03175 | 1.78 | 0.92 |
| lnc-PMM1-1:1 | SEQ2761 | 0.01587 | 0.77 | 0.96 | lnc-LTC4S-1:1 | SEQ2942 | 0.03175 | 1.79 | 0.92 |
| lnc-GPAT4-2:2 | SEQ2763 | 0.01587 | 0.78 | 0.96 | lnc-RIPOR1-1:6 | SEQ2943 | 0.03175 | 1.79 | 0.92 |
| BACE1-AS:5 | SEQ2765 | 0.01587 | 0.79 | 0.96 | lnc-TIGD5-1:1 | SEQ2945 | 0.03175 | 1.80 | 0.92 |
| lnc-MFSD14B-18:1 | SEQ2773 | 0.01587 | 1.30 | 0.96 | lnc-NAIP-4:1 | SEQ2946 | 0.03175 | 1.80 | 0.92 |
| lnc-RARRES2-2:2 | SEQ2774 | 0.01587 | 1.31 | 0.96 | lnc-OR4F29-8:25 | SEQ2949 | 0.03175 | 1.81 | 0.92 |
| lnc-DNAH10-2:1 | SEQ2777 | 0.01587 | 1.33 | 0.96 | lnc-BDH1-5:8 | SEQ2950 | 0.03175 | 1.81 | 0.92 |
| lnc-OR4F15-4:5 | SEQ2780 | 0.01587 | 1.35 | 0.96 | lnc-SKI-5:1 | SEQ2951 | 0.03175 | 1.81 | 0.92 |
| lnc-IL17RA-33:6 | SEQ2788 | 0.01587 | 1.39 | 0.96 | MIR9-3HG:11 | SEQ2957 | 0.03175 | 1.82 | 0.92 |
| lnc-SEPT7-4:1 | SEQ2796 | 0.01587 | 1.42 | 0.96 | lnc-C1orf198-6:3 | SEQ2959 | 0.03175 | 1.84 | 0.92 |
| lnc-CCL27-2:1 | SEQ2801 | 0.01587 | 1.45 | 0.96 | CCDC183-AS1:3 | SEQ2960 | 0.03175 | 1.85 | 0.92 |
| lnc-ZNF417-1:2 | SEQ2808 | 0.01587 | 1.48 | 0.96 | lnc-OAZ3-2:12 | SEQ2965 | 0.03175 | 1.86 | 0.92 |
| lnc-PPP6R2-5:1 | SEQ2811 | 0.01587 | 1.49 | 0.96 | LHX4-AS1:3 | SEQ2966 | 0.03175 | 1.86 | 0.92 |
| lnc-PNOC-2:1 | SEQ2817 | 0.01587 | 1.51 | 0.96 | lnc-EPHA6-1:2 | SEQ2967 | 0.03175 | 1.87 | 0.92 |
| lnc-SPATA21-4:8 | SEQ2818 | 0.01587 | 1.51 | 0.96 | UGDH-AS1:8 | SEQ2968 | 0.03175 | 1.87 | 0.92 |
| lnc-EFCAB12-2:17 | SEQ2819 | 0.01587 | 1.51 | 0.96 | lnc-GRINA-2:1 | SEQ2969 | 0.03175 | 1.87 | 0.92 |
| lnc-TCP11-2:6 | SEQ2820 | 0.01587 | 1.51 | 0.96 | lnc-SAMD11-12:3 | SEQ2970 | 0.03175 | 1.87 | 0.92 |
| lnc-PDGFB-2:1 | SEQ2826 | 0.01587 | 1.52 | 0.96 | lnc-PLA2G6-1:2 | SEQ2971 | 0.03175 | 1.88 | 0.92 |
| lnc-YRDC-3:1 | SEQ2841 | 0.01587 | 1.56 | 0.96 | SVIL-AS1:17 | SEQ2972 | 0.03175 | 1.88 | 0.92 |
| lnc-RIOX2-3:4 | SEQ2842 | 0.01587 | 1.56 | 0.96 | SVIL-AS1:35 | SEQ2973 | 0.03175 | 1.88 | 0.92 |
| lnc-KMT2C-3:1 | SEQ2847 | 0.01587 | 1.58 | 0.96 | LINC01372:8 | SEQ2975 | 0.03175 | 1.89 | 0.92 |
| lnc-SULT1A4-4:1 | SEQ2851 | 0.01587 | 1.58 | 0.96 | lnc-IGIP-5:1 | SEQ2977 | 0.03175 | 1.90 | 0.92 |
| lnc-TSPAN33-1:1 | SEQ2853 | 0.01587 | 1.58 | 0.96 | lnc-ELK4-1:4 | SEQ2978 | 0.03175 | 1.90 | 0.92 |
| lnc-HMGCS2-1:2 | SEQ2855 | 0.01587 | 1.59 | 0.96 | MAGI2-AS3:51 | SEQ2983 | 0.03175 | 1.92 | 0.92 |
| lnc-NTN3-1:2 | SEQ2860 | 0.01587 | 1.59 | 0.96 | lnc-ZNF467-4:1 | SEQ2985 | 0.03175 | 1.92 | 0.92 |
| lnc-LAT-2:1 | SEQ2861 | 0.01587 | 1.60 | 0.96 | lnc-PABPN1L-1:1 | SEQ2986 | 0.03175 | 1.93 | 0.92 |
| lnc-HIST3H2BB-1:8 | SEQ2866 | 0.01587 | 1.60 | 0.96 | lnc-IGSF9B-2:1 | SEQ2987 | 0.03175 | 1.93 | 0.92 |
| lnc-CPLX1-2:8 | SEQ2869 | 0.01587 | 1.61 | 0.96 | lnc-MC5R-11:1 | SEQ2989 | 0.03175 | 1.93 | 0.92 |
| lnc-CXorf40B-3:1 | SEQ2872 | 0.01587 | 1.62 | 0.96 | lnc-CLRN2-1:2 | SEQ2991 | 0.03175 | 1.94 | 0.92 |
| lnc-FXYD2-2:1 | SEQ2873 | 0.01587 | 1.62 | 0.96 | lnc-COPZ2-1:8 | SEQ2992 | 0.03175 | 1.94 | 0.92 |
| lnc-FAAP20-2:1 | SEQ2889 | 0.01587 | 1.66 | 0.96 | lnc-DHRS7B-1:7 | SEQ2993 | 0.03175 | 1.94 | 0.92 |
| lnc-ANKRD34B-4:1 | SEQ2896 | 0.01587 | 1.69 | 0.96 | lnc-FAM184B-4:1 | SEQ2994 | 0.03175 | 1.94 | 0.92 |
| lnc-CA7-4:3 | SEQ2897 | 0.01587 | 1.69 | 0.96 | lnc-ISOC2-3:1 | SEQ2996 | 0.03175 | 1.95 | 0.92 |
| NTM-AS1:3 | SEQ2898 | 0.01587 | 1.69 | 0.96 | lnc-CSPG4-1:12 | SEQ2998 | 0.03175 | 1.95 | 0.92 |
| NTM-AS1:4 | SEQ2899 | 0.01587 | 1.69 | 0.96 | lnc-PPM1H-6:1 | SEQ3011 | 0.03175 | 2.01 | 0.92 |
| lnc-TCP10L-2:1 | SEQ2900 | 0.01587 | 1.69 | 0.96 | lnc-TTYH3-2:1 | SEQ3012 | 0.03175 | 2.01 | 0.92 |
| lnc-NAA38-4:1 | SEQ2903 | 0.01587 | 1.70 | 0.96 | lnc-TMC5-3:1 | SEQ3015 | 0.03175 | 2.01 | 0.92 |
| lnc-FAAP20-3:1 | SEQ2907 | 0.01587 | 1.71 | 0.96 | lnc-TMEM211-7:1 | SEQ3023 | 0.03175 | 2.04 | 0.92 |
| lnc-PGAM2-1:1 | SEQ2909 | 0.01587 | 1.71 | 0.96 | lnc-NBPF1-1:6 | SEQ3026 | 0.03175 | 2.05 | 0.92 |
| lnc-FBXO11-1:10 | SEQ2912 | 0.01587 | 1.72 | 0.96 | lnc-ATG4B-2:1 | SEQ3030 | 0.03175 | 2.06 | 0.92 |
| lnc-NEUROD1-2:3 | SEQ2918 | 0.01587 | 1.74 | 0.96 | lnc-PRKN-17:1 | SEQ3031 | 0.03175 | 2.06 | 0.92 |
| lnc-KLHL18-6:1 | SEQ2923 | 0.01587 | 1.75 | 0.96 | lnc-ATAD5-2:1 | SEQ3035 | 0.03175 | 2.07 | 0.92 |
| CCDC183-AS1:5 | SEQ2925 | 0.01587 | 1.76 | 0.96 | CNTFR-AS1:14 | SEQ3038 | 0.03175 | 2.08 | 0.92 |
| lnc-CNTN2-4:1 | SEQ2926 | 0.01587 | 1.76 | 0.96 | lnc-TRUB2-8:1 | SEQ3040 | 0.03175 | 2.08 | 0.92 |
| lnc-TAX1BP3-1:2 | SEQ2927 | 0.01587 | 1.76 | 0.96 | ASB16-AS1:9 | SEQ3041 | 0.03175 | 2.08 | 0.92 |
| lnc-UNC5B-1:1 | SEQ2930 | 0.01587 | 1.77 | 0.96 | lnc-RNF24-2:8 | SEQ3043 | 0.03175 | 2.10 | 0.92 |
| LMCD1-AS1:11 | SEQ2931 | 0.01587 | 1.77 | 0.96 | lnc-DNAJB6-10:3 | SEQ3044 | 0.03175 | 2.10 | 0.92 |
| lnc-ATAD5-5:1 | SEQ2937 | 0.01587 | 1.78 | 0.96 | lnc-DNAJB6-10:2 | SEQ3045 | 0.03175 | 2.10 | 0.92 |
| lnc-CASP9-5:1 | SEQ2940 | 0.01587 | 1.79 | 0.96 | lnc-DNAAF5-1:6 | SEQ3048 | 0.03175 | 2.11 | 0.92 |
| lnc-PEX6-1:1 | SEQ2942 | 0.01587 | 1.79 | 0.96 | lnc-SCIMP-1:1 | SEQ3051 | 0.03175 | 2.13 | 0.92 |
| lnc-SMAD7-2:3 | SEQ2947 | 0.01587 | 1.80 | 0.96 | lnc-PFDN4-11:4 | SEQ3054 | 0.03175 | 2.13 | 0.92 |
| lnc-RHNO1-1:1 | SEQ0026 | 0.01587 | 1.81 | 0.96 | PPP3CB-AS1:5 | SEQ3057 | 0.03175 | 2.14 | 0.92 |
| lnc-GTF2H2C-3:1 | SEQ2952 | 0.01587 | 1.82 | 0.96 | lnc-MSLNL-3:1 | SEQ3059 | 0.03175 | 2.15 | 0.92 |

TABLE 8-continued

The 1202 lncRNAs with known sequence identified by the present invention having
a deficient expression (FC ≤ 0.84) or over-expression (FC ≥ 1.22) in human AD brain
temporal cortex versus human healthy control brain temporal cortex.

| lncRNA | SEQ | p-value | FC | AUC | lncRNA | SEQ | p-value | FC | AUC |
|---|---|---|---|---|---|---|---|---|---|
| lnc-PPEF1-7:2 | SEQ2953 | 0.01587 | 1.82 | 0.96 | lnc-HAS1-2:1 | SEQ3061 | 0.03175 | 2.15 | 0.92 |
| lnc-SDCCAG8-5:1 | SEQ2954 | 0.01587 | 1.82 | 0.96 | lnc-CPLX1-11:1 | SEQ3064 | 0.03175 | 2.16 | 0.92 |
| lnc-BDH1-5:11 | SEQ2956 | 0.01587 | 1.82 | 0.96 | lnc-PPDPF-2:1 | SEQ3067 | 0.03175 | 2.18 | 0.92 |
| lnc-CRYM-3:2 | SEQ2962 | 0.01587 | 1.85 | 0.96 | lnc-GLRX5-2:2 | SEQ3070 | 0.03175 | 2.20 | 0.92 |
| lnc-CRABP2-3:1 | SEQ2963 | 0.01587 | 1.86 | 0.96 | TNRC6C-AS1:1 | SEQ3072 | 0.03175 | 2.20 | 0.92 |
| lnc-PRKN-10:1 | SEQ2964 | 0.01587 | 1.86 | 0.96 | ITPK1-AS1:2 | SEQ3073 | 0.03175 | 2.20 | 0.92 |
| lnc-PACRG-2:1 | SEQ2974 | 0.01587 | 1.88 | 0.96 | ITPK1-AS1:1 | SEQ3074 | 0.03175 | 2.20 | 0.92 |
| PCBP1-AS1:201 | SEQ2976 | 0.01587 | 1.90 | 0.96 | lnc-SLC7A14-3:12 | SEQ3079 | 0.03175 | 2.22 | 0.92 |
| lnc-NPTX1-4:1 | SEQ2980 | 0.01587 | 1.91 | 0.96 | MALAT1:26 | SEQ3081 | 0.03175 | 2.23 | 0.92 |
| lnc-CHN2-2:4 | SEQ2981 | 0.01587 | 1.92 | 0.96 | lnc-GPC2-2:6 | SEQ3088 | 0.03175 | 2.25 | 0.92 |
| lnc-ZNF705D-6:1 | SEQ2982 | 0.01587 | 1.92 | 0.96 | lnc-GSG1L-1:9 | SEQ3090 | 0.03175 | 2.26 | 0.92 |
| lnc-PCIF1-1:1 | SEQ2984 | 0.01587 | 1.92 | 0.96 | lnc-COX19-2:1 | SEQ3091 | 0.03175 | 2.26 | 0.92 |
| lnc-OSGIN1-1:9 | SEQ2988 | 0.01587 | 1.93 | 0.96 | lnc-LGR6-8:1 | SEQ3092 | 0.03175 | 2.27 | 0.92 |
| lnc-PEX10-6:1 | SEQ2995 | 0.01587 | 1.95 | 0.96 | lnc-LRIG2-5:1 | SEQ3093 | 0.03175 | 2.27 | 0.92 |
| lnc-OTOA-3:4 | SEQ2999 | 0.01587 | 1.96 | 0.96 | lnc-IL3RA-1:22 | SEQ3101 | 0.03175 | 2.29 | 0.92 |
| ADNP-AS1:7 | SEQ3000 | 0.01587 | 1.96 | 0.96 | lnc-POM121L2-2:5 | SEQ3110 | 0.03175 | 2.32 | 0.92 |
| lnc-LRRK1-3:4 | SEQ0242 | 0.01587 | 1.97 | 0.96 | lnc-NMRK2-5:9 | SEQ3111 | 0.03175 | 2.32 | 0.92 |
| lnc-TMEM211-2:8 | SEQ0644 | 0.01587 | 1.99 | 0.96 | lnc-COA6-1:2 | SEQ3113 | 0.03175 | 2.32 | 0.92 |
| lnc-LRRC56-1:7 | SEQ3005 | 0.01587 | 2.00 | 0.96 | lnc-ATAD2B-2:1 | SEQ3116 | 0.03175 | 2.34 | 0.92 |
| lnc-OR4F29-8:23 | SEQ3007 | 0.01587 | 2.00 | 0.96 | lnc-SSH3-5:2 | SEQ3117 | 0.03175 | 2.35 | 0.92 |
| lnc-PILRB-1:5 | SEQ3009 | 0.01587 | 2.00 | 0.96 | ZMIZ1-AS1:22 | SEQ3122 | 0.03175 | 2.38 | 0.92 |
| lnc-CEP83-7:1 | SEQ3010 | 0.01587 | 2.01 | 0.96 | lnc-GLRX5-7:2 | SEQ3123 | 0.03175 | 2.38 | 0.92 |
| lnc-ALG12-5:3 | SEQ3016 | 0.01587 | 2.01 | 0.96 | lnc-FAM184B-6:1 | SEQ3128 | 0.03175 | 2.42 | 0.92 |
| lnc-GTPBP1-1:2 | SEQ3017 | 0.01587 | 2.02 | 0.96 | lnc-PRR26-2:1 | SEQ3129 | 0.03175 | 2.42 | 0.92 |
| lnc-PPIF-1:3 | SEQ3019 | 0.01587 | 2.02 | 0.96 | MALAT1:14 | SEQ3130 | 0.03175 | 2.43 | 0.92 |
| lnc-TOP1MT-5:1 | SEQ3021 | 0.01587 | 2.04 | 0.96 | lnc-SPANXB1-7:1 | SEQ3131 | 0.03175 | 2.44 | 0.92 |
| lnc-RPL12-1:3 | SEQ3024 | 0.01587 | 2.04 | 0.96 | lnc-CEL-5:2 | SEQ3132 | 0.03175 | 2.44 | 0.92 |
| lnc-NKPD1-1:1 | SEQ3025 | 0.01587 | 2.04 | 0.96 | lnc-CANT1-3:1 | SEQ3133 | 0.03175 | 2.44 | 0.92 |
| lnc-NEURL4-1:4 | SEQ3028 | 0.01587 | 2.05 | 0.96 | OLMALINC:4 | SEQ3137 | 0.03175 | 2.45 | 0.92 |
| DLG5-AS1:5 | SEQ3033 | 0.01587 | 2.06 | 0.96 | lnc-CRLF3-3:1 | SEQ3139 | 0.03175 | 2.46 | 0.92 |
| lnc-GRINA-3:1 | SEQ3047 | 0.01587 | 2.10 | 0.96 | LINC01759:10 | SEQ3141 | 0.03175 | 2.48 | 0.92 |
| lnc-PLPP2-2:1 | SEQ3049 | 0.01587 | 2.11 | 0.96 | lnc-RGS9-16:1 | SEQ3149 | 0.03175 | 2.52 | 0.92 |
| lnc-TMEM163-2:1 | SEQ3055 | 0.01587 | 2.14 | 0.96 | lnc-KCNQ2-2:2 | SEQ3151 | 0.03175 | 2.52 | 0.92 |
| lnc-LGALS7B-1:4 | SEQ3056 | 0.01587 | 2.14 | 0.96 | lnc-FAM104A-8:2 | SEQ3153 | 0.03175 | 2.56 | 0.92 |
| lnc-CNP-1:1 | SEQ3058 | 0.01587 | 2.14 | 0.96 | lnc-EMX1-1:1 | SEQ3154 | 0.03175 | 2.56 | 0.92 |
| lnc-HGH1-1:1 | SEQ3060 | 0.01587 | 2.15 | 0.96 | lnc-SPANXB1-7:5 | SEQ3157 | 0.03175 | 2.57 | 0.92 |
| lnc-ERV3-1-10:8 | SEQ3062 | 0.01587 | 2.16 | 0.96 | lnc-MINDY1-2:1 | SEQ3163 | 0.03175 | 2.66 | 0.92 |
| ZMIZ1-AS1:31 | SEQ3065 | 0.01587 | 2.17 | 0.96 | lnc-PLEKHA2-4:1 | SEQ3164 | 0.03175 | 2.67 | 0.92 |
| lnc-SPANXB1-7:7 | SEQ3066 | 0.01587 | 2.17 | 0.96 | lnc-CDCA2-4:1 | SEQ3166 | 0.03175 | 2.68 | 0.92 |
| lnc-ERLEC1-6:1 | SEQ3068 | 0.01587 | 2.18 | 0.96 | SNHG12:10 | SEQ3169 | 0.03175 | 2.71 | 0.92 |
| lnc-NAV1-8:1 | SEQ3069 | 0.01587 | 2.20 | 0.96 | lnc-TXNDC15-1:1 | SEQ3177 | 0.03175 | 2.79 | 0.92 |
| lnc-SELENON-2:2 | SEQ3071 | 0.01587 | 2.20 | 0.96 | lnc-LRRC56-1:11 | SEQ3181 | 0.03175 | 2.87 | 0.92 |
| lnc-MYO15B-3:1 | SEQ3076 | 0.01587 | 2.21 | 0.96 | lnc-DRICH1-3:35 | SEQ3187 | 0.03175 | 2.97 | 0.92 |
| lnc-ARFRP1-1:1 | SEQ3077 | 0.01587 | 2.21 | 0.96 | lnc-SNX20-8:1 | SEQ3192 | 0.03175 | 2.98 | 0.92 |
| lnc-RFPL3S-4:1 | SEQ3082 | 0.01587 | 2.23 | 0.96 | lnc-SLC7A7-1:6 | SEQ3194 | 0.03175 | 3.04 | 0.92 |
| lnc-NPC1-1:1 | SEQ3087 | 0.01587 | 2.24 | 0.96 | lnc-ST18-4:4 | SEQ3201 | 0.03175 | 3.09 | 0.92 |
| LINC01608:19 | SEQ3097 | 0.01587 | 2.29 | 0.96 | lnc-CANT1-2:5 | SEQ3203 | 0.03175 | 3.11 | 0.92 |
| lnc-DRICH1-3:51 | SEQ3098 | 0.01587 | 2.29 | 0.96 | lnc-TRUB2-8:2 | SEQ3205 | 0.03175 | 3.13 | 0.92 |
| lnc-KIF13B-2:1 | SEQ3100 | 0.01587 | 2.29 | 0.96 | lnc-SLC29A4-5:9 | SEQ3207 | 0.03175 | 3.15 | 0.92 |
| lnc-TCF19-1:54 | SEQ3105 | 0.01587 | 2.31 | 0.96 | lnc-DCP1B-6:1 | SEQ3210 | 0.03175 | 3.17 | 0.92 |
| lnc-CCL25-1:5 | SEQ3109 | 0.01587 | 2.32 | 0.96 | lnc-SFTPA2-6:1 | SEQ3211 | 0.03175 | 3.18 | 0.92 |
| lnc-GOLGA80-3:6 | SEQ3115 | 0.01587 | 2.32 | 0.96 | lnc-FAM187A-2:1 | SEQ3217 | 0.03175 | 3.28 | 0.92 |
| lnc-GRINA-1:1 | SEQ3118 | 0.01587 | 2.36 | 0.96 | DANT2:3 | SEQ3220 | 0.03175 | 3.36 | 0.92 |
| lnc-ANKRD20A3-19:1 | SEQ3119 | 0.01587 | 2.36 | 0.96 | lnc-BLM-6:5 | SEQ3223 | 0.03175 | 3.39 | 0.92 |
| lnc-CLRN2-1:1 | SEQ3124 | 0.01587 | 2.40 | 0.96 | lnc-OR4F3-5:9 | SEQ3225 | 0.03175 | 3.42 | 0.92 |
| NORAD:2 | SEQ3125 | 0.01587 | 2.41 | 0.96 | LINC00639:9 | SEQ3235 | 0.03175 | 3.85 | 0.92 |
| TNRC6C-AS1:5 | SEQ3142 | 0.01587 | 2.48 | 0.96 | lnc-SSTR2-5:1 | SEQ3238 | 0.03175 | 4.08 | 0.92 |
| TNRC6C-AS1:2 | SEQ3143 | 0.01587 | 2.48 | 0.96 | LINC01608:17 | SEQ3243 | 0.03175 | 4.20 | 0.92 |
| lnc-NBPF3-3:6 | SEQ3144 | 0.01587 | 2.49 | 0.96 | lnc-CD46-7:4 | SEQ3254 | 0.03175 | 5.19 | 0.92 |
| GSN-AS1:1 | SEQ3146 | 0.01587 | 2.50 | 0.96 | LINC01715:4 | SEQ3256 | 0.03175 | 5.35 | 0.92 |
| MIR646HG:31 | SEQ3148 | 0.01587 | 2.51 | 0.96 | TDRG1:6 | SEQ3270 | 0.03175 | 8.23 | 0.92 |
| lnc-IL3RA-1:18 | SEQ3155 | 0.01587 | 2.57 | 0.96 | MALAT1:11 | SEQ3276 | 0.03175 | 25.39 | 0.92 |
| lnc-SULT1A3-5:1 | SEQ3161 | 0.01587 | 2.59 | 0.96 | LINC00092:11 | SEQ3278 | 0.03175 | 41.83 | 0.92 |

386 lncRNAs comprising 28 novel lncRNAs showed (i) high expression in postmortem brain (CPM>25), (ii) significant differential expression in AD brain versus HC brain, and (iii) no or low expression (<5 CPM) in plasma and blood (Paxgene) of living AD patients or healthy controls. These 386 lncRNAs are listed and their profile included in Tables 7 and 8.

To identify for diagnostic and therapeutic applications, circulating lncRNAs in the peripheral body fluids, blood and plasma lncRNA signatures involved specifically in the pathogenesis of brain disorders, including but not limited to cognitive disorders such as mild cognitive impairment (MCI), Alzheimer (AD), frontotemporal (FTD) dementia and/or dementia with Lewy bodies (DLB), a total of 128,893 lncRNAs comprising the 1091 novel lncRNAs and the 127802 lncRNAs based on LNCipedia were screened and profiled in the brain from AD cases and from non-demented cases as well as in plasma and/or whole blood samples from different groups of subjects, including a group of patients with MCI, a group of patients with mild AD, a group of patients with moderate-to-severe AD, a group of patients with DLB and a group of patients with FTD as well as a control reference group of cognitively intact healthy controls having normal neurocognitive scores and with no brain imaging abnormalities, have been screened.

Subsequently, out of 128 894 lncRNAs in all samples, 53747 lncRNAs in brain samples, 35618 lncRNAs in plasma samples, 71132 lncRNAs in whole blood (Paxgene RNA tubes) samples have been detected with the level of at least one count in a sample among the samples included in the experiments. Further applying an additional threshold of expression level >5CPM in 50% of samples from at least one of the subject groups studied, the following numbers of lncRNAs were retained for Statistical analysis: 10122 brain lncRNAs, 3774 plasma lncRNAs and 9367 whole blood lncRNAs.

For each lncRNA, the differential expression level was determined by comparing the expression level between two groups (for example AD group and healthy control group), using a two-tailed Welch t test and/or Wilcoxon Mann-Whitney test. Significant differential expression was identified as $p<0.05$. 410 lncRNAs were differentially expressed in AD plasma versus HC plasma, with statistically significance ($p<0.05$, Wilcoxon test) and a fold change FC<0.80 or >1.20. Table 9 shows the 410 plasma lncRNAs.

TABLE 9

The 410 plasma lncRNAs that are differentially expressed in AD plasma versus HC plasma.

| lncRNA | SEQ | p value | FC | AUC | lncRNA | SEQ | p value | FC | AUC |
|---|---|---|---|---|---|---|---|---|---|
| lnc-KLHL36-2:2 | SEQ3279 | 0.0022 | 2.46 | 1.00 | lnc-PYDC2-5:1 | SEQ3459 | 0.0022 | 10.28 | 1.00 |
| LINC01000:5 | SEQ3280 | 0.0022 | 0.20 | 1.00 | lnc-PPIAL4D-5:7 | SEQ3460 | 0.0411 | 0.38 | 0.86 |
| lnc-ABCC5-3:1 | SEQ3281 | 0.0022 | 2.44 | 1.00 | lnc-REL-6:3 | SEQ3461 | 0.0043 | 13.49 | 0.97 |
| lnc-ABCC5-3:4 | SEQ3282 | 0.0022 | 3.49 | 1.00 | lnc-ZNF460-2:1 | SEQ0473 | 0.0450 | 6.14 | 0.86 |
| lnc-ANAPC11-2:8 | SEQ3283 | 0.0022 | 2.51 | 1.00 | lnc-TOP1-9:1 | SEQ3462 | 0.0260 | 4.56 | 0.89 |
| lnc-CLLU1-2:6 | SEQ3284 | 0.0022 | 3.65 | 1.00 | TCONS_00050494 | SEQ1818 | 0.0087 | 3.27 | 0.94 |
| lnc-CREB3L1-1:6 | SEQ3285 | 0.0022 | 0.30 | 1.00 | lnc-TAF9-10:1 | SEQ0639 | 0.0411 | 3.12 | 0.86 |
| lnc-FGL2-3:1 | SEQ3286 | 0.0022 | 3.99 | 1.00 | lnc-UROC1-1:1 | SEQ3463 | 0.0115 | 12.52 | 0.94 |
| lnc-HERC3-1:7 | SEQ3287 | 0.0022 | 2.87 | 1.00 | lnc-PMM2-6:4 | SEQ2411 | 0.0260 | 3.55 | 0.89 |
| lnc-IL9R-1:5 | SEQ3288 | 0.0022 | 0.00 | 1.00 | lnc-SPATA32-2:4 | SEQ3464 | 0.0411 | 4.81 | 0.86 |
| lnc-LCOR-4:3 | SEQ3289 | 0.0022 | 4.31 | 1.00 | lnc-ZNF843-2:4 | SEQ3465 | 0.0303 | 347 | 0.89 |
| lnc-LRRC10-1:1 | SEQ3290 | 0.0022 | 3.26 | 1.00 | lnc-RIPOR2-7:1 | SEQ3466 | 0.0411 | 3.56 | 0.86 |
| lnc-MAGEE2-2:1 | SEQ3291 | 0.0050 | 5.09 | 1.00 | lnc-NUTM1-6:4 | SEQ3467 | 0.0043 | 6.40 | 0.97 |
| lnc-NEK6-2:1 | SEQ2787 | 0.0022 | 5.82 | 1.00 | lnc-PFDN6-2:3 | SEQ3468 | 0.0411 | 3.59 | 0.86 |
| lnc-NEK6-2:4 | SEQ2786 | 0.0022 | 4.65 | 1.00 | lnc-SSH3-5:1 | SEQ2791 | 0.0152 | 2.07 | 0.92 |
| CCDC183-AS1:5 | SEQ2925 | 0.0260 | 4.07 | 0.89 | lnc-USP47-2:1 | SEQ3469 | 0.0022 | 3.87 | 1.00 |
| CRTC3-AS1:3 | SEQ3292 | 0.0022 | 3.33 | 1.00 | lnc-STX10-2:1 | SEQ3470 | 0.0022 | 6.21 | 1.00 |
| FGD5-AS1:14 | SEQ3293 | 0.0152 | 2.71 | 0.92 | lnc-SMN2-4:2 | SEQ3471 | 0.0022 | 19.3 | 1.00 |
| LINC02288:8 | SEQ3294 | 0.0087 | 5.60 | 0.94 | lnc-TCF7-1:3 | SEQ0990 | 0.0022 | 3.05 | 1.00 |
| lnc-ABTB2-3:1 | SEQ3295 | 0.0129 | 4.23 | 0.94 | lnc-SBK1-1:1 | SEQ3472 | 0.0050 | 6.05 | 1.00 |
| lnc-ARAF-4:1 | SEQ3296 | 0.0260 | 2.34 | 0.89 | lnc-RBM12B-10:1 | SEQ3473 | 0.0087 | 0.42 | 0.94 |
| lnc-ATP6V1C2-2:2 | SEQ2695 | 0.0260 | 4.33 | 0.89 | lnc-RNF39-9:1 | SEQ3474 | 0.0087 | 1.54 | 0.94 |
| lnc-ATXN2-1:1 | SEQ0099 | 0.0087 | 1.62 | 0.94 | lnc-ZC3H12B-1:5 | SEQ3475 | 0.0043 | 0.51 | 0.97 |
| lnc-BORA-25:1 | SEQ3297 | 0.0260 | 3.39 | 0.89 | lnc-RMDN2-3:24 | SEQ2468 | 0.0022 | 2.35 | 1.00 |
| lnc-DEFB115-5:1 | SEQ3298 | 0.0081 | 174.03 | 0.97 | lnc-ZNF552-3:1 | SEQ3476 | 0.0022 | 2.28 | 1.00 |
| lnc-DTX1-1:1 | SEQ3299 | 0.0450 | 3.40 | 0.86 | lnc-SPRYD3-1:17 | SEQ3477 | 0.0043 | 2.84 | 0.97 |
| lnc-EXOSC6-1:2 | SEQ3300 | 0.0411 | 3.95 | 0.86 | lnc-ROM1-7:1 | SEQ3478 | 0.0022 | 2.57 | 1.00 |
| lnc-FAM174A-6:2 | SEQ2631 | 0.0411 | 2.87 | 0.86 | lnc-OSBPL7-1:1 | SEQ3479 | 0.0050 | 4.81 | 1.00 |
| lnc-GCN1-3:1 | SEQ3301 | 0.0450 | 3.14 | 0.86 | lnc-ZNF559-ZNF177-1:1 | SEQ3480 | 0.0043 | 11.85 | 1.00 |
| lnc-GIMAP5-1:1 | SEQ3302 | 0.0152 | 6.09 | 0.92 | lnc-SLC45A3-3:1 | SEQ3481 | 0.0022 | 3.96 | 1.00 |
| lnc-IL18BP-1:1 | SEQ3303 | 0.0411 | 2.29 | 0.86 | lnc-PMM2-2:1 | SEQ3482 | 0.0028 | Inf | 1.00 |
| lnc-MIS12-3:1 | SEQ3304 | 0.0260 | 1.66 | 0.89 | SNHG12:13 | SEQ3483 | 0.0022 | 26.17 | 1.00 |
| lnc-NLRC4-3:3 | SEQ3305 | 0.0087 | 3.16 | 0.94 | TSPOAP1-AS1:39 | SEQ3484 | 0.0022 | 169 | 1.00 |
| lnc-NPIPB13-3:1 | SEQ3306 | 0.0152 | 3.15 | 0.92 | TCONS_00019798 | SEQ1305 | 0.0022 | 4.07 | 1.00 |
| CA3-AS1:13 | SEQ3307 | 0.0087 | 0.25 | 0.94 | lnc-PAPLN-1:1 | SEQ3485 | 0.0411 | 2.41 | 0.86 |
| CSTF3-AS1:10 | SEQ3308 | 0.0152 | 2.30 | 0.92 | lnc-SYCP1-7:1 | SEQ3486 | 0.0260 | 1.50 | 0.89 |
| EP300-AS1:13 | SEQ2778 | 0.0043 | 0.45 | 0.97 | lnc-RABL2B-3:1 | SEQ3487 | 0.0411 | 6.26 | 0.86 |
| FAM239A:16 | SEQ3309 | 0.0260 | 2.85 | 0.89 | lnc-SIAH1-1:1 | SEQ3488 | 0.0152 | 1.80 | 0.92 |
| FGD5-AS1:29 | SEQ3310 | 0.0260 | 3.67 | 0.89 | lnc-RAB17-2:1 | SEQ3489 | 0.0087 | 2.41 | 0.94 |
| FGD5-AS1:8 | SEQ3311 | 0.0411 | 0.10 | 0.86 | lnc-ZCCHC7-2:12 | SEQ3490 | 0.0260 | 7.75 | 0.89 |
| GAS5:31 | SEQ3312 | 0.0411 | 4.65 | 0.86 | lnc-NRGN-1:6 | SEQ3491 | 0.0411 | 0.41 | 0.86 |
| H1FX-AS1:15 | SEQ3313 | 0.0260 | 3.93 | 0.89 | lnc-TEKT1-2:1 | SEQ3492 | 0.0087 | 2.51 | 0.94 |
| HCG11:10 | SEQ3314 | 0.0043 | 30.61 | 0.97 | TCONS_00066544 | SEQ2098 | 0.0303 | 6.13 | 0.89 |
| HCG11:2 | SEQ3315 | 0.0043 | 30.61 | 0.97 | lnc-REL-1:3 | SEQ2508 | 0.0260 | 2.57 | 0.89 |
| HCG11:9 | SEQ3316 | 0.0043 | 30.61 | 0.97 | lnc-SATB1-8:1 | SEQ3493 | 0.0043 | 4.01 | 0.97 |
| IL10RB-AS1:3 | SEQ3317 | 0.0022 | 4.E+11 | 1.00 | lnc-RNMT-8:1 | SEQ3494 | 0.0284 | 0.00 | 0.83 |
| IQCH-AS1:17 | SEQ3318 | 0.0129 | 6.46 | 0.94 | lnc-YPEL5-5:1 | SEQ0750 | 0.0152 | 2.94 | 0.92 |
| JHDM1D-AS1:2 | SEQ3319 | 0.0260 | 0.07 | 0.89 | THRIL:1 | SEQ3495 | 0.0115 | 30.93 | 0.94 |
| LINC00869:69 | SEQ3320 | 0.0411 | 0.23 | 0.86 | TCONS_00050563 | SEQ1836 | 0.0411 | 2.84 | 0.86 |
| LINC00909:10 | SEQ3321 | 0.0411 | 4.91 | 0.86 | lnc-SYNJ2-1:1 | SEQ3496 | 0.0152 | 2.94 | 0.92 |
| LINC00926:6 | SEQ3322 | 0.0260 | 27.17 | 0.89 | lnc-STAT1-2:4 | SEQ3497 | 0.0087 | 2.75 | 0.94 |
| LINC01000:15 | SEQ3323 | 0.0411 | 2.95 | 0.86 | TCONS_00023171 | SEQ1367 | 0.0284 | Inf | 0.83 |
| LINC01419:1 | SEQ3324 | 0.0411 | 7.61 | 0.86 | PSMA3-AS1:27 | SEQ3498 | 0.0152 | 0.41 | 0.92 |
| LINC01473:6 | SEQ3325 | 0.0078 | 0.07 | 0.97 | TCONS_00045364 | SEQ1785 | 0.0152 | 3.23 | 0.92 |

TABLE 9-continued

The 410 plasma lncRNAs that are differentially expressed in AD plasma versus HC plasma.

| lncRNA | SEQ | p value | FC | AUC | lncRNA | SEQ | p value | FC | AUC |
|---|---|---|---|---|---|---|---|---|---|
| LINC01952:8 | SEQ3326 | 0.0411 | 1.90 | 0.86 | LRRC75A-AS1:3 | SEQ3499 | 0.0260 | 4.37 | 0.89 |
| LINC02062:2 | SEQ3327 | 0.0152 | 179.88 | 0.92 | lnc-TEAD2-2:4 | SEQ3500 | 0.0260 | 3.19 | 0.89 |
| LINC02397:10 | SEQ3328 | 0.0152 | 8.19 | 0.92 | lnc-YY1AP1-2:1 | SEQ3501 | 0.0303 | 3.93 | 0.89 |
| LIX1-AS1:2 | SEQ3329 | 0.0152 | 13.41 | 0.92 | lnc-STPG1-3:4 | SEQ3502 | 0.0087 | 4.72 | 0.94 |
| lnc-ACOT9-2:1 | SEQ3330 | 0.0087 | 2.32 | 0.94 | lnc-SH3D19-2:1 | SEQ3503 | 0.0260 | 2.86 | 0.89 |
| lnc-ADAM30-1:1 | SEQ2698 | 0.0295 | 6.92 | 0.89 | lnc-TRDMT1-5:3 | SEQ3504 | 0.0087 | 2.45 | 0.94 |
| lnc-AGO1-1:1 | SEQ2752 | 0.0129 | 5.66 | 0.94 | NNT-AS1:11 | SEQ3505 | 0.0411 | 0.18 | 0.86 |
| lnc-AGO3-3:1 | SEQ3331 | 0.0411 | 3.66 | 0.86 | lnc-OST4-6:2 | SEQ0954 | 0.0260 | 6.67 | 0.89 |
| lnc-AHSA2-5:6 | SEQ3332 | 0.0438 | 6.26 | 0.86 | lnc-SMG1-3:1 | SEQ3506 | 0.0200 | 3.60 | 0.92 |
| lnc-AIM2-3:3 | SEQ3333 | 0.0411 | 2.53 | 0.86 | lnc-ZNF613-2:1 | SEQ3507 | 0.0438 | 2.87 | 0.86 |
| lnc-AKAP12-2:1 | SEQ2375 | 0.0260 | 2.25 | 0.89 | lnc-ZNF891-1:1 | SEQ3508 | 0.0260 | 5.52 | 0.89 |
| lnc-AMPH-10:8 | SEQ3334 | 0.0115 | 7.51 | 0.94 | lnc-PTPA-3:4 | SEQ3509 | 0.0152 | 6.31 | 0.92 |
| lnc-ANAPC11-2:2 | SEQ3335 | 0.0411 | 3.91 | 0.86 | lnc-RAB37-1:6 | SEQ3510 | 0.0152 | 2.19 | 0.92 |
| lnc-ANGPTL1-2:1 | SEQ3336 | 0.0411 | 2.22 | 0.86 | lnc-TMEM212-1:4 | SEQ3511 | 0.0152 | 0.09 | 0.92 |
| lnc-ANKRD13A-4:1 | SEQ3337 | 0.0048 | 8.02 | 1.00 | lnc-RPL39L-3:1 | SEQ3512 | 0.0303 | 4.08 | 0.89 |
| lnc-ANKRD20A2-22:3 | SEQ3338 | 0.0411 | 3.36 | 0.86 | lnc-SLC25A47-5:1 | SEQ3513 | 0.0043 | 2.75 | 0.97 |
| lnc-ANO8-1:2 | SEQ3339 | 0.0250 | 22.08 | 0.89 | lnc-PLEKHA3-20:1 | SEQ3514 | 0.0260 | 2.39 | 0.89 |
| lnc-APBA2-5:4 | SEQ3340 | 0.0129 | 6.87 | 0.94 | lnc-TMEM30B-9:2 | SEQ3515 | 0.0411 | 4.59 | 0.86 |
| lnc-APTX-3:1 | SEQ2399 | 0.0411 | 1.92 | 0.86 | THAP9-AS1:28 | SEQ3516 | 0.0043 | 5.97 | 0.97 |
| lnc-ARF6-3:1 | SEQ3341 | 0.0087 | 2.93 | 0.94 | lnc-PAX8-6:1 | SEQ3517 | 0.0200 | 7.45 | 0.92 |
| lnc-ARL14EP-4:1 | SEQ3342 | 0.0043 | 10.23 | 1.00 | lnc-TAF1B-2:1 | SEQ3518 | 0.0167 | 162 | 0.90 |
| lnc-BCL2L13-3:1 | SEQ3343 | 0.0260 | 2.56 | 0.89 | lnc-ZNF121-1:1 | SEQ3519 | 0.0043 | 3.91 | 0.97 |
| lnc-BLACE-2:15 | SEQ3344 | 0.0087 | 0.27 | 0.94 | TCONS_00011972 | SEQ1217 | 0.0087 | 2.22 | 0.94 |
| lnc-BLACE-2:5 | SEQ3345 | 0.0152 | 0.03 | 0.92 | lnc-TIGD5-3:1 | SEQ3520 | 0.0087 | 2.50 | 0.94 |
| lnc-C10orf10-2:22 | SEQ3346 | 0.0260 | 1.67 | 0.89 | lnc-ROM1-7:5 | SEQ3521 | 0.0411 | 2.36 | 0.86 |
| lnc-C10orf10-2:23 | SEQ3347 | 0.0260 | 1.67 | 0.89 | lnc-RNF123-1:3 | SEQ3522 | 0.0260 | 4.31 | 0.89 |
| lnc-C11orf21-3:1 | SEQ3348 | 0.0411 | 2.71 | 0.86 | UGDH-AS1:10 | SEQ0407 | 0.0411 | 6.05 | 0.86 |
| lnc-C12orf73-1:1 | SEQ3349 | 0.0411 | 2.02 | 0.86 | lnc-RAB3C-1:1 | SEQ3523 | 0.0411 | 2.75 | 0.86 |
| lnc-C1orf112-4:2 | SEQ3350 | 0.0200 | 4.47 | 0.92 | lnc-ZNF506-2:3 | SEQ3524 | 0.0152 | 5.13 | 0.92 |
| lnc-C1QBP-1:1 | SEQ3351 | 0.0438 | 3.96 | 0.86 | WAC-AS1:12 | SEQ3525 | 0.0043 | 3.99 | 0.97 |
| lnc-C20orf96-1:1 | SEQ2764 | 0.0152 | 2.76 | 0.92 | SNHG16:2 | SEQ3526 | 0.0411 | 7.48 | 0.86 |
| lnc-C6orf106-2:2 | SEQ3352 | 0.0043 | 1.79 | 0.97 | TCONS_00037052 | SEQ1619 | 0.0438 | 6.17 | 0.86 |
| lnc-C9orf152-5:1 | SEQ3353 | 0.0303 | 4.54 | 0.89 | lnc-TMTC3-1:1 | SEQ3527 | 0.0411 | 0.44 | 0.86 |
| lnc-C9orf57-1:1 | SEQ3354 | 0.0152 | 6.22 | 0.92 | lnc-TSTD3-1:3 | SEQ3528 | 0.0043 | 2.63 | 0.97 |
| lnc-CBARP-2:1 | SEQ3355 | 0.0411 | 2.34 | 0.86 | ZMYM4-AS1:1 | SEQ3529 | 0.0087 | 2.47 | 0.94 |
| lnc-CCT4-1:8 | SEQ3356 | 0.0411 | 2.60 | 0.86 | lnc-PPP4C-2:7 | SEQ3530 | 0.0087 | 2.23 | 0.94 |
| lnc-CDC42BPB-4:1 | SEQ3357 | 0.0411 | 3.25 | 0.86 | lnc-TM2D2-1:1 | SEQ3531 | 0.0260 | 2.74 | 0.89 |
| lnc-CDH20-3:1 | SEQ3358 | 0.0087 | 3.08 | 0.94 | lnc-PCED1B-5:3 | SEQ3532 | 0.0260 | 0.11 | 0.89 |
| lnc-CDIPT-1:11 | SEQ3359 | 0.0152 | 2.30 | 0.92 | lnc-ZGRF1-8:1 | SEQ3533 | 0.0260 | 2.15 | 0.89 |
| lnc-CDK12-2:5 | SEQ3360 | 0.0411 | 19.25 | 0.86 | lnc-SAG-3:1 | SEQ3534 | 0.0260 | 6.89 | 0.89 |
| lnc-CDK2AP1-1:9 | SEQ3361 | 0.0411 | 2.20 | 0.86 | lnc-ZCCHC7-2:1 | SEQ3535 | 0.0411 | 2.28 | 0.86 |
| lnc-CEACAM21-5:6 | SEQ3362 | 0.0087 | 5.09 | 0.94 | lnc-TMX2-1:1 | SEQ3536 | 0.0078 | 9.44 | 0.97 |
| lnc-CECR2-1:4 | SEQ3363 | 0.0152 | 74.37 | 0.92 | lnc-SULT1A4-1:30 | SEQ3537 | 0.0411 | 3.45 | 0.86 |
| lnc-CELA3A-5:11 | SEQ3364 | 0.0303 | 2.E+09 | 0.89 | lnc-TET3-2:2 | SEQ3538 | 0.0124 | 5.24 | 0.94 |
| lnc-CEMP1-5:1 | SEQ3365 | 0.0200 | 4.68 | 0.92 | NDUFA6-AS1:42 | SEQ3539 | 0.0260 | 2.90 | 0.89 |
| lnc-CISD2-1:3 | SEQ3366 | 0.0152 | 2.57 | 0.92 | lnc-UBAC1-2:2 | SEQ3540 | 0.0303 | 14.74 | 0.89 |
| lnc-CKS1B-3:1 | SEQ3367 | 0.0087 | 3.27 | 0.94 | lnc-SNX14-5:1 | SEQ3541 | 0.0152 | 2.14 | 0.92 |
| lnc-CLDN11-7:1 | SEQ3368 | 0.0260 | 0.32 | 0.89 | lnc-PPA2-1:1 | SEQ3542 | 0.0087 | 3.28 | 0.94 |
| lnc-CLEC2D-8:7 | SEQ3369 | 0.0152 | 4.52 | 0.92 | lnc-S1PR1-6:1 | SEQ3543 | 0.0260 | 2.34 | 0.89 |
| lnc-CNTRL-6:8 | SEQ3370 | 0.0250 | 5.E+05 | 0.89 | lnc-TARS-6:1 | SEQ3544 | 0.0260 | 2.32 | 0.89 |
| lnc-CPM-1:1 | SEQ3371 | 0.0048 | 21.75 | 1.00 | lnc-USP35-11:2 | SEQ2802 | 0.0411 | 1.87 | 0.86 |
| lnc-CTSV-3:1 | SEQ3372 | 0.0411 | 2.91 | 0.86 | PSMA3-AS1:8 | SEQ3545 | 0.0260 | 0.20 | 0.89 |
| lnc-CXCL2-3:1 | SEQ3373 | 0.0411 | 0.53 | 0.86 | TCONS_00027402 | SEQ1445 | 0.0295 | 0.07 | 0.89 |
| lnc-DALRD3-1:4 | SEQ3374 | 0.0260 | 3.91 | 0.89 | OR2A1-AS1:19 | SEQ3546 | 0.0129 | 24.12 | 0.94 |
| lnc-DAO-3:1 | SEQ0685 | 0.0043 | 1.70 | 0.97 | lnc-POLR3E-3:4 | SEQ3547 | 0.0152 | 1.71 | 0.92 |
| lnc-DCAF1-1:1 | SEQ3375 | 0.0087 | 2.54 | 0.94 | lnc-RMDN2-3:2 | SEQ3548 | 0.0411 | 3.24 | 0.86 |
| lnc-DEF8-1:1 | SEQ3376 | 0.0303 | 5.60 | 0.89 | lnc-SLC25A29-1:2 | SEQ3549 | 0.0081 | 8.76 | 0.97 |
| lnc-DNAL4-4:1 | SEQ3095 | 0.0411 | 4.63 | 0.86 | ZBTB11-AS1:9 | SEQ3550 | 0.0411 | 54.24 | 0.86 |
| lnc-DPH5-5:1 | SEQ3377 | 0.0048 | 17.28 | 1.00 | PEG13:2 | SEQ3551 | 0.0411 | 3.20 | 0.86 |
| lnc-DUSP26-14:1 | SEQ3378 | 0.0043 | 1.99 | 0.97 | lnc-PHF3-12:1 | SEQ3552 | 0.0152 | 2.20 | 0.92 |
| lnc-EBF3-6:2 | SEQ3379 | 0.0152 | 0.33 | 0.92 | lnc-ZNF16-2:11 | SEQ3553 | 0.0152 | 3.42 | 0.92 |
| lnc-EFCAB8-1:3 | SEQ3380 | 0.0411 | 2.73 | 0.86 | RAD51-AS1:7 | SEQ3554 | 0.0341 | 264.44 | 0.88 |
| lnc-EIF1AD-1:1 | SEQ2653 | 0.0152 | 2.12 | 0.92 | lnc-SLC17A5-1:7 | SEQ3555 | 0.0260 | 0.18 | 0.89 |
| lnc-ENOPH1-3:3 | SEQ3381 | 0.0087 | 2.42 | 0.94 | lnc-TMEM155-3:1 | SEQ3556 | 0.0043 | 3.02 | 0.97 |
| lnc-EPGN-4:1 | SEQ3382 | 0.0411 | 0.05 | 0.86 | SH3BP5-AS1:2 | SEQ3557 | 0.0260 | 2.54 | 0.89 |
| lnc-ERCC6L2-14:1 | SEQ3383 | 0.0152 | 2.20 | 0.92 | lnc-SPRED2-22:1 | SEQ2584 | 0.0260 | 2.44 | 0.89 |
| lnc-ESRP2-2:9 | SEQ3384 | 0.0260 | 2.54 | 0.89 | lnc-NSUN5-2:1 | SEQ3558 | 0.0411 | 2.72 | 0.86 |
| lnc-EXOC3L4-3:1 | SEQ3385 | 0.0043 | 13.96 | 0.97 | lnc-TAGLN-2:1 | SEQ3559 | 0.0043 | 2.88 | 0.97 |
| lnc-EYS-1:1 | SEQ3386 | 0.0411 | 3.12 | 0.86 | lnc-OR1A2-1:1 | SEQ3560 | 0.0411 | 2.72 | 0.86 |
| lnc-FAAP100-2:1 | SEQ2299 | 0.0260 | 1.40 | 0.89 | lnc-SYNGR1-5:1 | SEQ3561 | 0.0260 | 0.52 | 0.89 |
| lnc-FAM103A1-2:5 | SEQ2607 | 0.0087 | 2.37 | 0.94 | POT1-AS1:2 | SEQ3562 | 0.0260 | 5.77 | 0.89 |
| lnc-FAM156A-2:1 | SEQ3387 | 0.0129 | 3.46 | 0.94 | TCONS_00011974 | SEQ1218 | 0.0411 | 2.10 | 0.86 |
| lnc-FAM177B-1:1 | SEQ3388 | 0.0411 | 1.86 | 0.86 | lnc-TMEM234-1:4 | SEQ3563 | 0.0260 | 3.40 | 0.89 |
| lnc-FAM231C-7:6 | SEQ3389 | 0.0260 | 2.23 | 0.89 | lnc-RRN3-3:5 | SEQ2770 | 0.0043 | 3.61 | 0.97 |
| lnc-FAM72B-7:2 | SEQ3390 | 0.0152 | 4.07 | 0.92 | lnc-STAU2-3:4 | SEQ3564 | 0.0072 | 33.24 | 0.97 |
| lnc-FAM72D-4:1 | SEQ3391 | 0.0260 | 2.98 | 0.89 | lnc-PLA2G15-2:2 | SEQ3565 | 0.0411 | 2.29 | 0.86 |

TABLE 9-continued

The 410 plasma lncRNAs that are differentially expressed in AD plasma versus HC plasma.

| lncRNA | SEQ | p value | FC | AUC | lncRNA | SEQ | p value | FC | AUC |
|---|---|---|---|---|---|---|---|---|---|
| lnc-FANCL-4:1 | SEQ2690 | 0.0152 | 2.43 | 0.92 | lnc-PXN-1:1 | SEQ2506 | 0.0411 | 3.05 | 0.86 |
| lnc-FBN1-3:2 | SEQ3392 | 0.0043 | 7.16 | 0.97 | lnc-UBAC1-2:1 | SEQ3566 | 0.0411 | 4.42 | 0.86 |
| lnc-FER-6:1 | SEQ3393 | 0.0260 | 3.17 | 0.89 | TUG1:21 | SEQ3567 | 0.0411 | 0.36 | 0.86 |
| lnc-FKBP6-4:1 | SEQ3394 | 0.0152 | 2.65 | 0.92 | MIR4453HG:2 | SEQ3568 | 0.0411 | 2.78 | 0.86 |
| lnc-FNDC1-9:9 | SEQ3395 | 0.0411 | 2.55 | 0.86 | lnc-SUGT1-3:1 | SEQ0131 | 0.0341 | 56.87 | 0.88 |
| lnc-GAPT-6:2 | SEQ3396 | 0.0152 | 5.48 | 0.92 | lnc-OSBPL7-3:1 | SEQ3569 | 0.0260 | 0.44 | 0.89 |
| lnc-GAS2-1:15 | SEQ3397 | 0.0411 | 2.21 | 0.86 | lnc-SLA2-1:1 | SEQ3570 | 0.0411 | 2.70 | 0.86 |
| lnc-GDAP2-3:2 | SEQ3398 | 0.0411 | 1.82 | 0.86 | lnc-TRIM28-13:1 | SEQ3571 | 0.0152 | 3.75 | 0.92 |
| lnc-GNA11-3:1 | SEQ2681 | 0.0411 | 2.23 | 0.86 | lnc-ZBTB20-1:4 | SEQ3572 | 0.0411 | 3.11 | 0.86 |
| lnc-GNA11-3:2 | SEQ3399 | 0.0438 | 5.64 | 0.86 | PXN-AS1:15 | SEQ3573 | 0.0411 | 4.12 | 0.86 |
| lnc-GOLGA8F-8:1 | SEQ3400 | 0.0295 | 3.85 | 0.89 | PSMA3-AS1:6 | SEQ3574 | 0.0087 | 14.53 | 0.94 |
| lnc-GPR160-2:1 | SEQ3401 | 0.0411 | 1.49 | 0.86 | lnc-SP140-3:4 | SEQ3575 | 0.0124 | 11.42 | 0.94 |
| lnc-GPR37L1-7:4 | SEQ3402 | 0.0260 | 3.80 | 0.89 | VIM-AS1:7 | SEQ3576 | 0.0411 | 5.99 | 0.86 |
| lnc-GPR83-5:1 | SEQ3403 | 0.0043 | 1.86 | 0.97 | lnc-TUFM-3:3 | SEQ3577 | 0.0260 | 2.21 | 0.89 |
| lnc-GRB7-1:1 | SEQ3404 | 0.0043 | 48.62 | 0.97 | lnc-SLC45A4-8:1 | SEQ3578 | 0.0152 | 3.34 | 0.92 |
| lnc-GRINA-2:1 | SEQ2969 | 0.0411 | 2.10 | 0.86 | lnc-RLIM-4:1 | SEQ3579 | 0.0260 | 2.41 | 0.89 |
| lnc-GRK4-2:7 | SEQ3405 | 0.0411 | 1.97 | 0.86 | lnc-RACK1-1:2 | SEQ3580 | 0.0260 | 4.55 | 0.89 |
| lnc-HAAO-7:6 | SEQ3406 | 0.0411 | 0.25 | 0.86 | lnc-TRIM28-13:2 | SEQ3581 | 0.0260 | 10.16 | 0.89 |
| lnc-HAO2-2:1 | SEQ3407 | 0.0078 | 27.85 | 0.97 | lnc-SPOCK2-1:2 | SEQ3582 | 0.0416 | 2.43 | 0.86 |
| lnc-HARS-1:1 | SEQ3408 | 0.0411 | 0.50 | 0.86 | lnc-USP44-3:1 | SEQ3583 | 0.0411 | 3.20 | 0.86 |
| lnc-HBG2-1:1 | SEQ3409 | 0.0043 | 3.45 | 0.97 | ZNF341-AS1:10 | SEQ3584 | 0.0087 | 1.96 | 0.94 |
| lnc-HEATR4-6:1 | SEQ3410 | 0.0341 | 12.48 | 0.88 | lnc-RBM11-5:4 | SEQ3585 | 0.0278 | 6.38 | 0.89 |
| lnc-HELB-2:1 | SEQ3411 | 0.0260 | 3.55 | 0.89 | TCONS 00066563 | SEQ2107 | 0.0260 | 0.19 | 0.89 |
| lnc-HLA-DOB-1:1 | SEQ3412 | 0.0450 | 4.00 | 0.86 | lnc-ROM1-7:3 | SEQ3586 | 0.0152 | 2.37 | 0.92 |
| lnc-HMBOX1-1:1 | SEQ3413 | 0.0087 | 33.72 | 0.94 | lnc-WNT1-5:1 | SEQ3587 | 0.0411 | 2.54 | 0.86 |
| lnc-HMGA1-2:11 | SEQ3414 | 0.0411 | 5.75 | 0.86 | lnc-WDR45B-1:2 | SEQ3588 | 0.0194 | 9.06 | 0.92 |
| lnc-HMGA1-2:4 | SEQ3415 | 0.0260 | 2.70 | 0.89 | lnc-ROM1-7:6 | SEQ3589 | 0.0411 | 2.31 | 0.86 |
| lnc-HMGN5-3:1 | SEQ3416 | 0.0260 | 2.42 | 0.89 | ST7-AS1:1 | SEQ3590 | 0.0411 | 1.76 | 0.86 |
| lnc-HMHB1-6:2 | SEQ3417 | 0.0087 | 4.03 | 0.94 | lnc-TBP-3:1 | SEQ3591 | 0.0411 | 2.93 | 0.86 |
| lnc-HTR1B-1:4 | SEQ3418 | 0.0411 | 3.85 | 0.86 | lnc-RASGRP1-6:1 | SEQ3592 | 0.0200 | 6.95 | 0.92 |
| lnc-IER5-3:1 | SEQ2286 | 0.0284 | Inf | 0.83 | lnc-ZNF726-5:2 | SEQ3593 | 0.0260 | 2.69 | 0.89 |
| lnc-IFFO1-3:1 | SEQ3419 | 0.0152 | 1.35 | 0.92 | TUG1:9 | SEQ3594 | 0.0411 | 2.02 | 0.86 |
| lnc-IFNG-3:1 | SEQ3420 | 0.0450 | 5.01 | 0.86 | lnc-SLC9A3-1:2 | SEQ3595 | 0.0200 | 9.54 | 0.92 |
| lnc-IGIP-2:3 | SEQ3421 | 0.0087 | 3.95 | 0.94 | lnc-RBL2-4:3 | SEQ3596 | 0.0081 | 9.83 | 0.97 |
| lnc-IGSF9B-2:1 | SEQ2987 | 0.0152 | 3.85 | 0.92 | lnc-VSNL1-5:1 | SEQ3597 | 0.0260 | 2.45 | 0.89 |
| lnc-IL18BP-1:2 | SEQ3422 | 0.0411 | 2.29 | 0.86 | TCONS 00059492 | SEQ1962 | 0.0438 | 3.97 | 0.86 |
| lnc-IL18BP-1:3 | SEQ3423 | 0.0411 | 2.29 | 0.86 | lnc-RIPOR2-3:1 | SEQ3598 | 0.0411 | 2.37 | 0.86 |
| lnc-IL20RA-3:1 | SEQ3424 | 0.0260 | 0.27 | 0.89 | lnc-TCTA-2:1 | SEQ2757 | 0.0260 | 1.35 | 0.89 |
| lnc-ITGB4-2:3 | SEQ3425 | 0.0260 | 2.59 | 0.89 | lnc-PSMC3IP-1:1 | SEQ3599 | 0.0260 | 3.02 | 0.89 |
| lnc-JAM2-11:1 | SEQ3426 | 0.0152 | 1.77 | 0.92 | lnc-PROC-1:11 | SEQ3600 | 0.0152 | 4.36 | 0.92 |
| lnc-JMJD6-1:5 | SEQ3427 | 0.0411 | 4.30 | 0.86 | TP53TG1:3 | SEQ3601 | 0.0043 | 21.53 | 0.97 |
| lnc-JMJD7-PLA2G4B-2:8 | SEQ3428 | 0.0411 | 3.59 | 0.86 | MALAT1:11 | SEQ3276 | 0.0260 | 2.03 | 0.89 |
| lnc-KALRN-5:10 | SEQ3429 | 0.0260 | 3.54 | 0.89 | lnc-PCGF2-4:1 | SEQ3602 | 0.0260 | 6.82 | 0.89 |
| lnc-KIAA1644-1:1 | SEQ3430 | 0.0411 | 3.72 | 0.86 | lnc-SQSTM1-2:2 | SEQ3603 | 0.0411 | 1.77 | 0.86 |
| lnc-KLHDC9-5:4 | SEQ3431 | 0.0260 | 3.67 | 0.89 | TUG1:44 | SEQ3604 | 0.0411 | 6.33 | 0.86 |
| lnc-KLHL25-6:1 | SEQ3432 | 0.0152 | 2.93 | 0.92 | SH3BP5-AS1:6 | SEQ3605 | 0.0260 | 2.54 | 0.89 |
| lnc-KRT80-3:1 | SEQ3433 | 0.0438 | 3.65 | 0.86 | TRG-AS1:14 | SEQ3606 | 0.0152 | 20.18 | 0.92 |
| lnc-LAMA5-1:4 | SEQ3434 | 0.0022 | 10.44 | 1.00 | lnc-RSC1A1-1:1 | SEQ3607 | 0.0411 | 2.65 | 0.86 |
| lnc-LAMA5-4:1 | SEQ3435 | 0.0260 | 2.18 | 0.89 | lnc-NUP153-3:5 | SEQ3608 | 0.0450 | 3.13 | 0.86 |
| lnc-LHPP-6:6 | SEQ3436 | 0.0411 | 3.85 | 0.86 | lnc-TAOK1-4:1 | SEQ3609 | 0.0043 | 3.26 | 0.97 |
| lnc-LIN7A-3:1 | SEQ3437 | 0.0167 | 12.31 | 0.90 | lnc-ZBTB2-6:1 | SEQ3610 | 0.0411 | 3.43 | 0.86 |
| lnc-LPIN3-1:1 | SEQ3438 | 0.0124 | 5.66 | 0.94 | lnc-PILRB-1:3 | SEQ3611 | 0.0411 | 39.86 | 0.86 |
| lnc-LRCH1-6:1 | SEQ3439 | 0.0152 | 1.86 | 0.92 | lnc-RBMS2-4:1 | SEQ2378 | 0.0087 | 4.62 | 0.94 |
| lnc-LRIG2-10:1 | SEQ3440 | 0.0411 | 1.81 | 0.86 | lnc-SUGCT-4:1 | SEQ3612 | 0.0152 | 2.79 | 0.92 |
| lnc-LRR1-1:2 | SEQ0813 | 0.0411 | 0.29 | 0.86 | lnc-RNF24-3:1 | SEQ3613 | 0.0411 | 1.57 | 0.86 |
| lnc-LRR1-1:3 | SEQ0814 | 0.0411 | 0.81 | 0.86 | lnc-NUS1-5:1 | SEQ3614 | 0.0411 | 2.03 | 0.86 |
| lnc-LRRC10-1:2 | SEQ3441 | 0.0087 | 3.06 | 0.94 | ZNF341-AS1:9 | SEQ3615 | 0.0152 | 1.81 | 0.92 |
| lnc-LRRC37A3-5:8 | SEQ3442 | 0.0050 | 1.E+21 | 1.00 | lnc-STAR-1:2 | SEQ3616 | 0.0043 | 2.51 | 0.97 |
| lnc-MANBA-2:9 | SEQ3443 | 0.0260 | 2.39 | 0.89 | TRHDE-AS1:14 | SEQ3617 | 0.0087 | 0.23 | 0.94 |
| lnc-MARCH7-3:1 | SEQ3444 | 0.0260 | 3.61 | 0.89 | lnc-SLC3A2-6:1 | SEQ2428 | 0.0411 | 1.89 | 0.86 |
| lnc-MASTL-6:1 | SEQ2430 | 0.0278 | 5.38 | 0.89 | lnc-WRB-7:2 | SEQ3618 | 0.0411 | 2.32 | 0.86 |
| lnc-MAX-16:1 | SEQ3445 | 0.0260 | 1.68 | 0.89 | lnc-PSMB9-6:5 | SEQ3619 | 0.0260 | 3.91 | 0.89 |
| lnc-MCTP2-7:4 | SEQ3446 | 0.0411 | 3.33 | 0.86 | lnc-TIPIN-1:1 | SEQ3620 | 0.0303 | 5.03 | 0.89 |
| lnc-MEP1B-2:1 | SEQ3447 | 0.0260 | 2.36 | 0.89 | lnc-SPATA32-4:1 | SEQ3621 | 0.0087 | 3.81 | 0.94 |
| lnc-MFSD13A-2:1 | SEQ3448 | 0.0152 | 2.34 | 0.92 | lnc-VSIG4-2:1 | SEQ3622 | 0.0087 | 3.33 | 0.94 |
| lnc-MIEN1-1:1 | SEQ3449 | 0.0411 | 2.60 | 0.86 | lnc-TRAK1-1:1 | SEQ3623 | 0.0379 | 41.45 | 0.86 |
| lnc-MLLT1-2:1 | SEQ3450 | 0.0152 | 2.16 | 0.92 | lnc-TMEM178A-1:7 | SEQ3624 | 0.0295 | 21.47 | 0.89 |
| lnc-MLX-3:1 | SEQ3451 | 0.0087 | 3.16 | 0.94 | PITPNA-AS1:3 | SEQ3625 | 0.0260 | 3.07 | 0.89 |
| lnc-MNX1-11:1 | SEQ3452 | 0.0124 | 5.74 | 0.94 | lnc-RNF135-1:27 | SEQ3626 | 0.0129 | 117.53 | 0.94 |
| lnc-MROH6-1:1 | SEQ3453 | 0.0129 | 17.08 | 0.94 | lnc-OTULIN-1:1 | SEQ3627 | 0.0260 | 3.04 | 0.89 |
| lnc-MYOM1-6:3 | SEQ3454 | 0.0022 | 5.94 | 1.00 | PSMA3-AS1:40 | SEQ3628 | 0.0152 | 7.16 | 0.92 |
| lnc-NAMPT-1:2 | SEQ3455 | 0.0260 | 2.03 | 0.89 | lnc-TSSK6-1:1 | SEQ3629 | 0.0152 | 4.37 | 0.92 |
| lnc-NINJ1-2:1 | SEQ3456 | 0.0043 | 2.75 | 0.97 | lnc-PLPP2-5:3 | SEQ3630 | 0.0411 | 1.71 | 0.86 |

TABLE 9-continued

The 410 plasma lncRNAs that are differentially expressed in AD plasma versus HC plasma.

| lncRNA | SEQ | p value | FC | AUC | lncRNA | SEQ | p value | FC | AUC |
|---|---|---|---|---|---|---|---|---|---|
| lnc-NR2F6-5:1 | SEQ3457 | 0.0043 | 2.51 | 0.97 | lnc-STON2-5:1 | SEQ3631 | 0.0087 | 1.92 | 0.94 |
| PCBP1-AS1:217 | SEQ3458 | 0.0087 | 1.54 | 0.94 | ZNF528-AS1:16 | SEQ3632 | 0.0194 | 4.E+08 | 0.92 |

2847 lncRNAs were differentially expressed in whole blood (Paxgene RNA tube) of MCI group or mild AD group or moderate-to-severe AD group or both of these AD groups or FTD group or DLB group as compared to healthy control group, and having statistical significance (p value <0.05, Wilcoxon test) and a fold change FC≤0.80 or ≥1.20. These lncRNAs showed a differential expression with a statistical significance for at least one disease group when compared to healthy control group (p value<0.05, Wilcoxon). The 2847 lncRNAs are shown in Table 10.

TABLE 10

2847 whole blood (Paxgene RNA tube) lncRNAs differentially expressed in MCI group or mild AD group or moderate-to-severe AD group or both of these AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| DLB | A1BG-AS1:13 | SEQ5267 | 1.E-04 | 1.8 | DLB | lnc-MRPS5-2:2 | SEQ4304 | 1.E-03 | 1.8 |
| MCI | A1BG-AS1:13 | SEQ5267 | 5.E-04 | 1.6 | miAD | lnc-MRPS5-2:2 | SEQ4304 | 7.E-03 | 1.4 |
| DLB | A2M-AS1:3 | SEQ5584 | 2.E-04 | 2.5 | All AD | lnc-MRPS5-2:2 | SEQ4304 | 1.E-02 | 1.4 |
| DLB | AATBC:4 | SEQ4566 | 2.E-03 | 1.4 | MCI | lnc-MRPS5-2:3 | SEQ4165 | 1.E-04 | 2.1 |
| DLB | AATBC:5 | SEQ4567 | 2.E-03 | 1.4 | miAD | lnc-MRPS5-2:3 | SEQ4165 | 1.E-02 | 1.4 |
| DLB | ACBD3-AS1:14 | SEQ5759 | 8.E-05 | 2.2 | All AD | lnc-MRPS5-2:3 | SEQ4165 | 2.E-02 | 1.3 |
| msAD | ACTN1-AS1:6 | SEQ3638 | 3.E-02 | 1.2 | MCI | lnc-MRPS5-4:3 | SEQ5499 | 2.E-04 | 2.2 |
| All AD | ACTN1-AS1:6 | SEQ3638 | 4.E-02 | 1.2 | DLB | lnc-MTERF1-5:1 | SEQ4758 | 1.E-03 | 1.5 |
| All AD | ADAMTSL4-AS1:1 | SEQ3640 | 2.E-02 | 0.8 | All AD | lnc-MTFR1L-1:4 | SEQ5202 | 3.E-02 | 1.3 |
| msAD | ADAMTSL4-AS1:1 | SEQ3640 | 2.E-02 | 0.8 | FTD | lnc-MTHFD1-3:1 | SEQ4184 | 8.E-07 | 0.5 |
| FTD | ADNP-AS1:12 | SEQ0340 | 3.E-04 | 0.6 | All AD | lnc-MTHFD1-3:1 | SEQ4184 | 8.E-03 | 0.7 |
| MCI | AGAP2-AS1:1 | SEQ3643 | 4.E-05 | 2.0 | miAD | lnc-MTHFD1-3:1 | SEQ4184 | 1.E-02 | 0.6 |
| All AD | AGAP2-AS1:1 | SEQ3643 | 3.E-02 | 1.3 | FTD | lnc-MTPN-1:1 | SEQ4462 | 2.E-05 | 0.3 |
| All AD | AIRN:2 | SEQ3645 | 2.E-02 | 0.8 | miAD | lnc-MTPN-1:1 | SEQ4462 | 2.E-04 | 0.4 |
| FTD | ANKRD10-IT1:2 | SEQ5990 | 1.E-06 | 0.4 | All AD | lnc-MTPN-1:1 | SEQ4462 | 3.E-04 | 0.5 |
| FTD | ANKRD44-IT1:1 | SEQ4807 | 1.E-03 | 0.7 | msAD | lnc-MTPN-1:1 | SEQ4462 | 2.E-03 | 0.5 |
| DLB | APOBEC3B-AS1:2 | SEQ5079 | 2.E-05 | 0.4 | miAD | lnc-MTRNR2L3-1:2 | SEQ4241 | 1.E-02 | 1.3 |
| MCI | APOBEC3B-AS1:2 | SEQ5079 | 1.E-04 | 0.5 | All AD | lnc-MTRNR2L3-1:2 | SEQ4241 | 1.E-02 | 1.2 |
| FTD | APOBEC3B-AS1:2 | SEQ5079 | 6.E-04 | 0.5 | DLB | lnc-MTUS2-9:1 | SEQ4829 | 9.E-04 | 1.3 |
| miAD | APTR:15 | SEQ3651 | 4.E-03 | 0.7 | DLB | lnc-MUC17-4:1 | SEQ5244 | 5.E-04 | 1.4 |
| All AD | APTR:15 | SEQ3651 | 5.E-03 | 0.7 | DLB | lnc-MUC20-16:1 | SEQ4224 | 6.E-05 | 1.5 |
| msAD | APTR:15 | SEQ3651 | 3.E-02 | 0.8 | MCI | lnc-MUC20-16:1 | SEQ4224 | 6.E-05 | 1.5 |
| All AD | APTR:16 | SEQ3636 | 2.E-02 | 0.8 | miAD | lnc-MUC20-16:1 | SEQ4224 | 7.E-04 | 1.3 |
| msAD | APTR:16 | SEQ3636 | 5.E-02 | 0.8 | All AD | lnc-MUC20-16:1 | SEQ4224 | 1.E-03 | 1.3 |
| miAD | APTR:17 | SEQ0260 | 5.E-03 | 0.7 | msAD | lnc-MUC20-16:1 | SEQ4224 | 1.E-02 | 1.3 |
| All AD | APTR:17 | SEQ0260 | 9.E-03 | 0.7 | MCI | lnc-MUC20-16:2 | SEQ4127 | 4.E-07 | 2.1 |
| DLB | ARAP1-AS1:1 | SEQ4621 | 1.E-03 | 1.4 | DLB | lnc-MUC20-16:2 | SEQ4127 | 6.E-06 | 2.0 |
| MCI | ASH1L-AS1:1 | SEQ4883 | 9.E-04 | 2.3 | FTD | lnc-MUC20-16:2 | SEQ4127 | 1.E-05 | 1.9 |
| DLB | ATP1A1-AS1:5 | SEQ5498 | 2.E-04 | 2.0 | miAD | lnc-MUC20-16:2 | SEQ4127 | 2.E-03 | 1.4 |
| DLB | ATP2A1-AS1:12 | SEQ5180 | 5.E-04 | 1.4 | All AD | lnc-MUC20-16:2 | SEQ4127 | 2.E-03 | 1.3 |
| DLB | ATP6VOE2-AS1:1 | SEQ4643 | 1.E-03 | 1.6 | msAD | lnc-MUC20-16:2 | SEQ4127 | 1.E-02 | 1.3 |
| MCI | ATP6VOE2-AS1:14 | SEQ3659 | 3.E-06 | 2.3 | DLB | lnc-MUC5B-1:1 | SEQ5724 | 9.E-05 | 1.4 |
| FTD | ATP6VOE2-AS1:14 | SEQ3659 | 6.E-04 | 1.6 | DLB | lnc-MUSTN1-1:1 | SEQ5656 | 1.E-04 | 1.4 |
| miAD | ATP6VOE2-AS1:14 | SEQ3659 | 7.E-04 | 1.6 | FTD | lnc-MVB12B-7:1 | SEQ5716 | 1.E-04 | 0.5 |
| All AD | ATP6VOE2-AS1:14 | SEQ3659 | 2.E-02 | 1.3 | DLB | lnc-MVP-3:6 | SEQ5362 | 7.E-06 | 2.1 |
| DLB | ATP6VOE2-AS1:18 | SEQ3663 | 4.E-04 | 1.9 | MCI | lnc-MVP-3:6 | SEQ5362 | 1.E-05 | 2.3 |
| MCI | ATP6VOE2-AS1:18 | SEQ3663 | 2.E-03 | 1.6 | FTD | lnc-MVP-3:6 | SEQ5362 | 4.E-04 | 1.8 |
| msAD | ATP6VOE2-AS1:18 | SEQ3663 | 2.E-02 | 1.2 | msAD | lnc-MYBBP1A-2:1 | SEQ4100 | 1.E-02 | 1.4 |
| All AD | ATP6VOE2-AS1:18 | SEQ3663 | 2.E-02 | 1.2 | All AD | lnc-MYBBP1A-2:1 | SEQ4100 | 2.E-02 | 1.4 |
| MCI | ATP6VOE2-AS1:19 | SEQ4794 | 1.E-03 | 2.4 | FTD | lnc-MYF5-2:3 | SEQ2245 | 4.E-08 | 0.4 |
| DLB | ATP6VOE2-AS1:22 | SEQ5142 | 6.E-04 | 1.8 | DLB | lnc-MYF5-2:3 | SEQ2245 | 9.E-05 | 0.5 |
| MCI | ATP6VOE2-AS1:27 | SEQ5188 | 3.E-04 | 1.5 | MCI | lnc-MYF5-2:3 | SEQ2245 | 1.E-04 | 0.5 |
| DLB | ATP6VOE2-AS1:27 | SEQ5188 | 5.E-04 | 1.5 | miAD | lnc-MYF5-2:3 | SEQ2245 | 1.E-03 | 0.6 |
| FTD | BACH1-IT1:1 | SEQ5153 | 5.E-04 | 0.6 | All AD | lnc-MYF5-2:3 | SEQ2245 | 6.E-03 | 0.6 |
| DLB | BISPR:20 | SEQ5519 | 2.E-04 | 1.4 | FTD | lnc-MYF5-2:4 | SEQ2296 | 4.E-09 | 0.4 |
| miAD | BOLA3-AS1:14 | SEQ3673 | 9.E-05 | 2.3 | MCI | lnc-MYF5-2:4 | SEQ2296 | 3.E-05 | 0.4 |
| All AD | BOLA3-AS1:14 | SEQ3673 | 2.E-04 | 2.0 | DLB | lnc-MYF5-2:4 | SEQ2296 | 4.E-05 | 0.5 |
| FTD | BOLA3-AS1:14 | SEQ3673 | 3.E-04 | 2.8 | miAD | lnc-MYF5-2:4 | SEQ2296 | 2.E-04 | 0.5 |
| msAD | BOLA3-AS1:14 | SEQ3673 | 4.E-03 | 1.7 | All AD | lnc-MYF5-2:4 | SEQ2296 | 2.E-03 | 0.6 |
| FTD | BOLA3-AS1:25 | SEQ3677 | 1.E-05 | 0.6 | msAD | lnc-MYF5-2:4 | SEQ2296 | 4.E-02 | 0.6 |
| All AD | BOLA3-AS1:25 | SEQ3677 | 3.E-02 | 0.8 | FTD | lnc-MYF5-2:5 | SEQ4262 | 4.E-05 | 0.5 |
| DLB | C6orf47-AS1:1 | SEQ4838 | 9.E-04 | 1.4 | miAD | lnc-MYF5-2:5 | SEQ4262 | 9.E-03 | 0.7 |
| DLB | CACTIN-AS1:2 | SEQ3680 | 4.E-05 | 1.7 | All AD | lnc-MYF5-2:5 | SEQ4262 | 2.E-02 | 0.7 |
| msAD | CACTIN-AS1:2 | SEQ3680 | 1.E-03 | 1.3 | All AD | lnc-MYH9-1:1 | SEQ4021 | 1.E-02 | 0.7 |
| All AD | CACTIN-AS1:2 | SEQ3680 | 1.E-03 | 1.3 | msAD | lnc-MYH9-1:1 | SEQ4021 | 2.E-02 | 0.7 |
| MCI | CACTIN-AS1:2 | SEQ3680 | 1.E-03 | 1.3 | DLB | lnc-MYLPF-3:2 | SEQ5847 | 4.E-05 | 1.5 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| miAD | CACTIN-AS1:2 | SEQ3680 | 6.E-03 | 1.3 | MCI | lnc-MYO16-7:1 | SEQ4673 | 1.E-03 | 0.8 |
| DLB | CACTIN-AS1:5 | SEQ2914 | 3.E-04 | 1.7 | DLB | lnc-MYO1D-1:2 | SEQ5020 | 7.E-04 | 1.4 |
| MCI | CACTIN-AS1:5 | SEQ2914 | 7.E-03 | 1.7 | FTD | lnc-MYO6-1:1 | SEQ4205 | 8.E-06 | 0.5 |
| All AD | CACTIN-AS1:6 | SEQ3686 | 5.E-02 | 1.2 | miAD | lnc-MY06-1:1 | SEQ4205 | 1.E-02 | 0.7 |
| DLB | CAPN10-AS1:2 | SEQ5209 | 5.E-04 | 1.8 | All AD | lnc-MYO6-1:1 | SEQ4205 | 1.E-02 | 0.7 |
| DLB | CARD8-AS1:5 | SEQ4426 | 2.E-03 | 1.5 | FTD | lnc-MYOM1-6:2 | SEQ5872 | 3.E-05 | 0.6 |
| DLB | CASC2:1 | SEQ2645 | 5.E-05 | 1.5 | DLB | lnc-N4BP2-3:1 | SEQ3688 | 5.E-05 | 2.4 |
| All AD | CATIP-AS1:6 | SEQ3690 | 5.E-02 | 0.8 | All AD | lnc-N4BP2-3:1 | SEQ3688 | 3.E-02 | 1.3 |
| DLB | CCDC144NL-AS1:22 | SEQ4979 | 5.E-05 | 1.9 | msAD | lnc-N4BP2-3:1 | SEQ3688 | 5.E-02 | 1.3 |
| MCI | CCDC144NL-AS1:22 | SEQ4979 | 8.E-04 | 1.8 | DLB | lnc-N4BP2L1-4:1 | SEQ5458 | 3.E-04 | 2.0 |
| DLB | CCDC144NL-AS1:50 | SEQ3693 | 2.E-05 | 1.9 | All AD | lnc-NAA35-13:2 | SEQ5233 | 4.E-02 | 0.8 |
| MCI | CCDC144NL-AS1:50 | SEQ3693 | 2.E-05 | 2.1 | FTD | lnc-NAA38-5:1 | SEQ4193 | 5.E-04 | 0.7 |
| msAD | CCDC144NL-AS1:50 | SEQ3693 | 2.E-02 | 1.2 | miAD | lnc-NAA38-5:1 | SEQ4193 | 1.E-02 | 0.8 |
| All AD | CCDC144NL-AS1:50 | SEQ3693 | 4.E-02 | 1.2 | All AD | lnc-NAA38-5:1 | SEQ4193 | 4.E-02 | 0.8 |
| DLB | CCDC144NL-AS1:51 | SEQ3697 | 2.E-05 | 1.9 | FTD | lnc-NABP1-1:1 | SEQ5416 | 3.E-04 | 0.7 |
| MCI | CCDC144NL-AS1:51 | SEQ3697 | 4.E-05 | 2.0 | FTD | lnc-NABP1-1:2 | SEQ4356 | 1.E-05 | 0.6 |
| FTD | CCDC144NL-AS1:51 | SEQ3697 | 6.E-04 | 1.4 | miAD | lnc-NABP1-1:2 | SEQ4356 | 4.E-03 | 0.7 |
| All AD | CCDC144NL-AS1:51 | SEQ3697 | 1.E-02 | 1.2 | All AD | lnc-NABP1-1:2 | SEQ4356 | 1.E-02 | 0.7 |
| msAD | CCDC144NL-AS1:51 | SEQ3697 | 3.E-02 | 1.2 | MCI | lnc-NABP1-5:1 | SEQ4160 | 1.E-03 | 1.6 |
| DLB | CCDC183-AS1:4 | SEQ3701 | 2.E-05 | 1.5 | All AD | lnc-NABP1-5:1 | SEQ4160 | 7.E-03 | 1.3 |
| MCI | CCDC183-AS1:4 | SEQ3701 | 6.E-04 | 1.3 | msAD | lnc-NABP1-5:1 | SEQ4160 | 1.E-02 | 1.3 |
| All AD | CCDC183-AS1:4 | SEQ3701 | 2.E-02 | 1.1 | FTD | lnc-NAMPT-1:2 | SEQ3455 | 8.E-05 | 0.6 |
| msAD | CCDC183-AS1:4 | SEQ3701 | 2.E-02 | 1.1 | DLB | lnc-NAT1-7:2 | SEQ4687 | 1.E-03 | 1.4 |
| MCI | CCDC183-AS1:5 | SEQ2925 | 7.E-04 | 1.6 | FTD | lnc-NAT9-1:1 | SEQ4159 | 3.E-07 | 1.7 |
| All AD | CCDC18-AS1:45 | SEQ3706 | 5.E-02 | 1.3 | MCI | lnc-NAT9-1:1 | SEQ4159 | 1.E-06 | 2.1 |
| miAD | CD27-AS1:1 | SEQ3707 | 1.E-02 | 1.4 | DLB | lnc-NAT9-1:1 | SEQ4159 | 3.E-06 | 2.0 |
| All AD | CD27-AS1:1 | SEQ3707 | 2.E-02 | 1.3 | miAD | lnc-NAT9-1:1 | SEQ4159 | 1.E-02 | 1.2 |
| FTD | CEBPB-AS1:2 | SEQ4719 | 2.E-04 | 1.8 | All AD | lnc-NAT9-1:1 | SEQ4159 | 2.E-02 | 1.2 |
| MCI | CEBPB-AS1:2 | SEQ4719 | 5.E-04 | 1.9 | DLB | lnc-NAT9-1:4 | SEQ5013 | 7.E-04 | 1.4 |
| DLB | CEBPB-AS1:2 | SEQ4719 | 1.E-03 | 1.7 | MCI | lnc-NAV1-9:1 | SEQ5343 | 5.E-05 | 2.1 |
| miAD | CFAP58-AS1:4 | SEQ0109 | 1.E-02 | 0.7 | DLB | lnc-NAV1-9:1 | SEQ5343 | 4.E-04 | 2.2 |
| All AD | CFAP58-AS1:4 | SEQ0109 | 3.E-02 | 0.7 | DLB | lnc-NAXD-4:1 | SEQ2736 | 2.E-03 | 1.3 |
| FTD | CFLAR-AS1:22 | SEQ3712 | 2.E-05 | 0.6 | FTD | lnc-NBN-2:1 | SEQ3838 | 1.E-05 | 0.6 |
| All AD | CFLAR-AS1:22 | SEQ3712 | 2.E-02 | 0.7 | All AD | lnc-NBN-2:1 | SEQ3838 | 1.E-02 | 0.7 |
| FTD | CHMP1B-AS1:2 | SEQ2249 | 1.E-07 | 0.4 | miAD | lnc-NBN-2:1 | SEQ3838 | 1.E-02 | 0.7 |
| MCI | CHMP1B-AS1:2 | SEQ2249 | 4.E-04 | 0.4 | msAD | lnc-NBN-2:1 | SEQ3838 | 3.E-02 | 0.8 |
| DLB | CHMP1B-AS1:2 | SEQ2249 | 2.E-03 | 0.5 | DLB | lnc-NBPF1-1:12 | SEQ4728 | 2.E-04 | 3.1 |
| All AD | CHMP1B-AS1:2 | SEQ2249 | 2.E-02 | 0.6 | MCI | lnc-NBPF1-1:12 | SEQ4728 | 1.E-03 | 2.5 |
| miAD | CKMT2-AS1:32 | SEQ3713 | 3.E-03 | 1.7 | DLB | lnc-NBPF1-1:6 | SEQ3026 | 8.E-05 | 2.4 |
| All AD | CKMT2-AS1:32 | SEQ3713 | 9.E-03 | 1.5 | FTD | lnc-NBPF1-1:6 | SEQ3026 | 5.E-04 | 2.0 |
| MCI | CPEB2-AS1:4 | SEQ4788 | 1.E-03 | 1.8 | MCI | lnc-NBPF1-1:6 | SEQ3026 | 1.E-03 | 2.0 |
| DLB | CTBP1-AS:2 | SEQ4927 | 8.E-04 | 1.4 | FTD | lnc-NBPF15-1:2 | SEQ4591 | 1.E-03 | 1.6 |
| DLB | CTBP1-AS:3 | SEQ5245 | 2.E-05 | 1.6 | MCI | lnc-NBPF15-1:2 | SEQ4591 | 2.E-03 | 1.6 |
| MCI | CTBP1-AS:3 | SEQ5245 | 5.E-02 | 1.4 | DLB | lnc-NBPF15-1:2 | SEQ4591 | 2.E-02 | 1.8 |
| FTD | CYTOR:49 | SEQ3721 | 4.E-04 | 0.5 | MCI | lnc-NBPF3-3:6 | SEQ3144 | 1.E-03 | 1.7 |
| miAD | CYTOR:49 | SEQ3721 | 7.E-03 | 0.6 | MCI | lnc-NBPF3-3:7 | SEQ4651 | 2.E-04 | 1.8 |
| All AD | CYTOR:49 | SEQ3721 | 7.E-03 | 0.7 | DLB | lnc-NBPF3-3:7 | SEQ4651 | 1.E-03 | 1.8 |
| msAD | CYTOR:49 | SEQ3721 | 2.E-02 | 0.7 | miAD | lnc-NBPF3-8:1 | SEQ3929 | 4.E-03 | 0.6 |
| DLB | CYTOR:50 | SEQ5178 | 5.E-04 | 1.4 | All AD | lnc-NBPF3-8:1 | SEQ3929 | 5.E-03 | 0.7 |
| FTD | DARS-AS1:43 | SEQ3725 | 7.E-04 | 0.7 | msAD | lnc-NBPF3-8:1 | SEQ3929 | 3.E-02 | 0.7 |
| All AD | DARS-AS1:43 | SEQ3725 | 1.E-02 | 0.7 | FTD | lnc-NCKAP1-5:2 | SEQ4381 | 4.E-04 | 0.6 |
| msAD | DARS-AS1:43 | SEQ3725 | 3.E-02 | 0.7 | miAD | lnc-NCKAP1-5:2 | SEQ4381 | 4.E-03 | 0.7 |
| MCI | DDIT4-AS1:2 | SEQ5738 | 9.E-05 | 1.7 | All AD | lnc-NCKAP1-5:2 | SEQ4381 | 9.E-03 | 0.7 |
| DLB | DGUOK-AS1:7 | SEQ5186 | 5.E-04 | 1.5 | FTD | lnc-NCOA4-6:1 | SEQ5061 | 7.E-04 | 0.6 |
| FTD | DIAPH2-AS1:8 | SEQ4994 | 8.E-04 | 0.6 | FTD | lnc-NDFIP2-13:1 | SEQ4472 | 1.E-04 | 0.5 |
| FTD | DLEU1:2 | SEQ3732 | 3.E-07 | 0.5 | MCI | lnc-NDFIP2-13:1 | SEQ4472 | 2.E-03 | 0.6 |
| miAD | DLEU1:2 | SEQ3732 | 3.E-04 | 0.6 | All AD | lnc-NDFIP2-13:1 | SEQ4472 | 3.E-02 | 0.7 |
| MCI | DLEU1:2 | SEQ3732 | 2.E-03 | 0.6 | DLB | lnc-NDFIP2-26:2 | SEQ3696 | 4.E-04 | 1.4 |
| All AD | DLEU1:2 | SEQ3732 | 2.E-03 | 0.6 | All AD | lnc-NDFIP2-26:2 | SEQ3696 | 4.E-02 | 1.1 |
| msAD | DLEU1:2 | SEQ3732 | 3.E-02 | 0.7 | msAD | lnc-NDFIP2-26:2 | SEQ3696 | 5.E-02 | 1.1 |
| FTD | DLEU1:3 | SEQ3735 | 8.E-05 | 0.6 | DLB | lnc-NDRG1-2:1 | SEQ4828 | 2.E-04 | 1.4 |
| All AD | DLEU1:3 | SEQ3735 | 4.E-02 | 0.7 | MCI | lnc-NDRG1-2:1 | SEQ4828 | 9.E-04 | 1.3 |
| FTD | DLEU1:54 | SEQ3736 | 2.E-05 | 0.6 | DLB | lnc-NDRG1-5:1 | SEQ4864 | 2.E-05 | 1.8 |
| All AD | DLEU1:54 | SEQ3736 | 5.E-02 | 0.7 | MCI | lnc-NDRG1-5:1 | SEQ4864 | 9.E-04 | 1.6 |
| All AD | DLEU2:26 | SEQ0862 | 2.E-02 | 0.7 | DLB | lnc-NDRG1-7:2 | SEQ5432 | 3.E-04 | 1.4 |
| All AD | DLEU2:32 | SEQ2776 | 7.E-03 | 0.7 | MCI | lnc-NDRG1-7:2 | SEQ5432 | 3.E-04 | 1.4 |
| miAD | DLEU2:32 | SEQ2776 | 1.E-02 | 0.7 | DLB | lnc-NDRG1-7:4 | SEQ4677 | 2.E-04 | 1.3 |
| msAD | DLEU2:32 | SEQ2776 | 2.E-02 | 0.8 | MCI | lnc-NDRG1-7:4 | SEQ4677 | 1.E-03 | 1.3 |
| FTD | DLEU2:45 | SEQ0863 | 9.E-05 | 0.7 | All AD | lnc-NDUFA4-2:1 | SEQ5260 | 5.E-03 | 1.2 |
| All AD | DLEU2:45 | SEQ0863 | 2.E-03 | 0.7 | msAD | lnc-NDUFA6-2:2 | SEQ3899 | 3.E-02 | 1.2 |
| miAD | DLEU2:45 | SEQ0863 | 2.E-03 | 0.7 | DLB | lnc-NDUFAF8-1:3 | SEQ5031 | 7.E-04 | 1.5 |
| msAD | DLEU2:45 | SEQ0863 | 1.E-02 | 0.8 | DLB | lnc-NDUFAF8-1:4 | SEQ4629 | 1.E-03 | 1.4 |
| MCI | DLEU2:5 | SEQ5943 | 9.E-06 | 0.1 | FTD | lnc-NDUFB3-3:3 | SEQ3750 | 2.E-04 | 0.5 |
| FTD | DLG5-AS1:10 | SEQ5411 | 3.E-04 | 0.6 | miAD | lnc-NDUFB3-3:3 | SEQ3750 | 6.E-04 | 0.6 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
| --- | --- | --- | --- | --- | --- | --- | --- | --- | --- |
| DLB | DLGAP4-AS1:11 | SEQ4702 | 1.E-03 | 1.5 | All AD | lnc-NDUFB3-3:3 | SEQ3750 | 3.E-03 | 0.6 |
| MCI | DNAJC9-AS1:9 | SEQ4869 | 9.E-04 | 1.6 | msAD | lnc-NDUFB3-3:3 | SEQ3750 | 4.E-02 | 0.7 |
| DLB | DPP9-AS1:1 | SEQ4563 | 2.E-03 | 1.4 | DLB | lnc-NECAB3-1:1 | SEQ5198 | 3.E-04 | 1.8 |
| FTD | DPYD-AS1:3 | SEQ3747 | 5.E-05 | 0.7 | MCI | lnc-NECAB3-1:1 | SEQ5198 | 5.E-04 | 1.7 |
| All AD | DPYD-AS1:3 | SEQ3747 | 3.E-02 | 0.7 | DLB | lnc-NEIL1-1:2 | SEQ5266 | 7.E-06 | 1.7 |
| msAD | DPYD-AS1:3 | SEQ3747 | 4.E-02 | 0.8 | FTD | lnc-NEIL1-1:2 | SEQ5266 | 1.E-04 | 1.4 |
| FTD | DPYD-AS2:1 | SEQ4360 | 8.E-05 | 0.6 | All AD | lnc-NEIL1-1:2 | SEQ5266 | 4.E-02 | 1.2 |
| miAD | DPYD-AS2:1 | SEQ4360 | 4.E-03 | 0.7 | DLB | lnc-NEK5-1:3 | SEQ5482 | 2.E-04 | 1.5 |
| FTD | EAF1-AS1:15 | SEQ5886 | 3.E-05 | 0.7 | FTD | lnc-NEK7-4:1 | SEQ4217 | 4.E-06 | 0.5 |
| FTD | EIF1B-AS1:18 | SEQ5465 | 3.E-04 | 0.6 | miAD | lnc-NEK7-4:1 | SEQ4217 | 1.E-02 | 0.7 |
| FTD | EIF3J-AS1:21 | SEQ0261 | 9.E-04 | 0.6 | All AD | lnc-NEK7-4:1 | SEQ4217 | 2.E-02 | 0.7 |
| DLB | ELOA-AS1:4 | SEQ5251 | 5.E-04 | 1.5 | FTD | lnc-NEMF-1:4 | SEQ3674 | 3.E-11 | 4.2 |
| FTD | ENTPD1-AS1:12 | SEQ3757 | 9.E-04 | 0.6 | MCI | lnc-NEMF-1:4 | SEQ3674 | 3.E-05 | 3.0 |
| miAD | ENTPD1-AS1:12 | SEQ3757 | 3.E-03 | 0.6 | msAD | lnc-NEMF-1:4 | SEQ3674 | 5.E-02 | 1.3 |
| All AD | ENTPD1-AS1:12 | SEQ3757 | 8.E-03 | 0.7 | FTD | lnc-NEMF-2:2 | SEQ2656 | 6.E-08 | 5.6 |
| All AD | ENTPD1-AS1:23 | SEQ3758 | 3.E-02 | 0.8 | MCI | lnc-NEMF-2:2 | SEQ2656 | 6.E-05 | 4.1 |
| FTD | ENTPD1-AS1:34 | SEQ5552 | 2.E-04 | 0.7 | DLB | lnc-NEMF-2:2 | SEQ2656 | 2.E-03 | 3.0 |
| All AD | ENTPD1-AS1:5 | SEQ3760 | 5.E-02 | 0.8 | All AD | lnc-NEMF-2:2 | SEQ2656 | 2.E-02 | 2.3 |
| FTD | FAM13A-AS1:1 | SEQ3762 | 1.E-04 | 0.6 | DLB | lnc-NEMF-4:1 | SEQ4738 | 8.E-05 | 1.4 |
| All AD | FAM13A-AS1:1 | SEQ3762 | 8.E-03 | 0.7 | MCI | lnc-NEMF-4:1 | SEQ4738 | 1.E-03 | 1.3 |
| miAD | FAM13A-AS1:1 | SEQ3762 | 1.E-02 | 0.7 | DLB | lnc-NEMP2-4:1 | SEQ5668 | 1.E-04 | 1.7 |
| msAD | FAM13A-AS1:1 | SEQ3762 | 2.E-02 | 0.8 | FTD | lnc-NETO2-3:1 | SEQ5273 | 8.E-05 | 0.6 |
| DLB | FAM13A-AS1:5 | SEQ5865 | 4.E-05 | 3.2 | All AD | lnc-NETO2-3:1 | SEQ5273 | 4.E-02 | 0.8 |
| MCI | FAM157C:3 | SEQ5767 | 4.E-07 | 0.1 | DLB | lnc-NEURL4-1:3 | SEQ4617 | 1.E-03 | 1.4 |
| FTD | FAM157C:3 | SEQ5767 | 7.E-05 | 0.1 | DLB | lnc-NEURL4-1:4 | SEQ3028 | 1.E-04 | 1.6 |
| DLB | FAM182A:4 | SEQ4636 | 1.E-03 | 1.5 | MCI | lnc-NEURL4-1:4 | SEQ3028 | 2.E-04 | 1.6 |
| miAD | FAM198B-AS1:7 | SEQ3768 | 1.E-02 | 0.7 | MCI | lnc-NFAM1-4:1 | SEQ5147 | 1.E-04 | 2.0 |
| All AD | FAM198B-AS1:7 | SEQ3768 | 2.E-02 | 0.8 | DLB | lnc-NFAM1-4:1 | SEQ5147 | 6.E-04 | 2.0 |
| DLB | FAM215B:1 | SEQ4971 | 8.E-04 | 1.6 | All AD | lnc-NFAM1-4:1 | SEQ5147 | 3.E-02 | 1.2 |
| MCI | FAM239A:9 | SEQ3770 | 2.E-04 | 2.1 | DLB | lnc-NGFR-1:1 | SEQ3671 | 1.E-03 | 1.3 |
| DLB | FAM239A:9 | SEQ3770 | 2.E-03 | 1.8 | All AD | lnc-NGFR-1:1 | SEQ3671 | 1.E-02 | 1.2 |
| All AD | FAM239A:9 | SEQ3770 | 3.E-02 | 1.3 | msAD | lnc-NGFR-1:1 | SEQ3671 | 5.E-02 | 1.1 |
| msAD | FAM30A:2 | SEQ3772 | 1.E-02 | 1.6 | All AD | lnc-NHS-2:1 | SEQ2339 | 2.E-02 | 0.8 |
| All AD | FAM30A:2 | SEQ3772 | 2.E-02 | 1.5 | FTD | lnc-NID1-4:4 | SEQ4463 | 3.E-10 | 0.3 |
| DLB | FAM53B-AS1:1 | SEQ5494 | 2.E-04 | 1.8 | MCI | lnc-NID1-4:4 | SEQ4463 | 4.E-07 | 0.4 |
| miAD | FAM99A:4 | SEQ3775 | 7.E-03 | 0.6 | miAD | lnc-NID1-4:4 | SEQ4463 | 4.E-05 | 0.5 |
| All AD | FAM99A:4 | SEQ3775 | 2.E-02 | 0.7 | All AD | lnc-NID1-4:4 | SEQ4463 | 1.E-05 | 0.5 |
| miAD | FAM99B:7 | SEQ3777 | 1.E-02 | 0.7 | DLB | lnc-NID1-4:4 | SEQ4463 | 2.E-03 | 0.4 |
| All AD | FAM99B:7 | SEQ3777 | 3.E-02 | 0.7 | msAD | lnc-NID1-4:4 | SEQ4463 | 2.E-03 | 0.6 |
| FTD | FGD5-AS1:11 | SEQ3778 | 3.E-07 | 3.1 | FTD | lnc-NIF3L1-3:1 | SEQ5283 | 4.E-04 | 0.6 |
| MCI | FGD5-AS1:11 | SEQ3778 | 9.E-06 | 3.3 | All AD | lnc-NIF3L1-3:1 | SEQ5283 | 3.E-02 | 0.8 |
| DLB | FGD5-AS1:11 | SEQ3778 | 1.E-04 | 2.5 | miAD | lnc-NIN-1:1 | SEQ4149 | 1.E-02 | 0.6 |
| msAD | FGD5-AS1:11 | SEQ3778 | 1.E-02 | 1.4 | All AD | lnc-NIN-1:1 | SEQ4149 | 1.E-02 | 0.7 |
| All AD | FGD5-AS1:11 | SEQ3778 | 2.E-02 | 1.4 | FTD | lnc-NINJ2-3:1 | SEQ6000 | 3.E-07 | 0.4 |
| DLB | FGD5-AS1:28 | SEQ3782 | 5.E-04 | 2.4 | FTD | lnc-NIPBL-3:1 | SEQ5604 | 2.E-04 | 0.6 |
| All AD | FGD5-AS1:28 | SEQ3782 | 8.E-03 | 1.6 | msAD | lnc-NKAP-4:2 | SEQ4178 | 1.E-02 | 2.0 |
| msAD | FGD5-AS1:28 | SEQ3782 | 2.E-02 | 1.7 | All AD | lnc-NKX2-4-6:3 | SEQ4164 | 3.E-03 | 1.3 |
| FTD | FGD5-AS1:30 | SEQ3785 | 1.E-07 | 3.1 | msAD | lnc-NKX2-4-6:3 | SEQ4164 | 4.E-03 | 1.3 |
| MCI | FGD5-AS1:30 | SEQ3785 | 2.E-05 | 2.9 | miAD | lnc-NKX2-4-6:3 | SEQ4164 | 1.E-02 | 1.3 |
| DLB | FGD5-AS1:30 | SEQ3785 | 3.E-04 | 2.3 | DLB | lnc-NKX6-3-1:1 | SEQ5030 | 9.E-05 | 1.7 |
| All AD | FGD5-AS1:30 | SEQ3785 | 8.E-03 | 1.4 | MCI | lnc-NKX6-3-1:1 | SEQ5030 | 7.E-04 | 1.5 |
| msAD | FGD5-AS1:30 | SEQ3785 | 8.E-03 | 1.4 | All AD | lnc-NKX6-3-1:1 | SEQ5030 | 3.E-02 | 1.1 |
| MCI | FGD5-AS1:6 | SEQ4466 | 3.E-06 | 0.2 | FTD | lnc-NLN-2:1 | SEQ5286 | 4.E-06 | 0.5 |
| FTD | FGD5-AS1:6 | SEQ4466 | 9.E-04 | 0.2 | All AD | lnc-NLN-2:1 | SEQ5286 | 2.E-02 | 0.7 |
| DLB | FGD5-AS1:6 | SEQ4466 | 2.E-03 | 0.3 | FTD | lnc-NLRC4-3:3 | SEQ3305 | 3.E-04 | 0.7 |
| miAD | FGD5-AS1:7 | SEQ3784 | 2.E-03 | 0.4 | All AD | lnc-NLRC4-3:3 | SEQ3305 | 9.E-03 | 0.8 |
| All AD | FGD5-AS1:7 | SEQ3784 | 4.E-03 | 0.4 | miAD | lnc-NLRC4-3:3 | SEQ3305 | 1.E-02 | 0.7 |
| msAD | FGD5-AS1:7 | SEQ3784 | 4.E-02 | 0.5 | msAD | lnc-NLRC4-3:3 | SEQ3305 | 3.E-02 | 0.8 |
| DLB | FGD5-AS1:9 | SEQ4423 | 2.E-03 | 1.5 | MCI | lnc-NLRC4-4:1 | SEQ5821 | 2.E-05 | 1.9 |
| DLB | FLNB-AS1:1 | SEQ3796 | 2.E-04 | 1.9 | DLB | lnc-NLRC4-4:1 | SEQ5821 | 5.E-05 | 1.9 |
| MCI | FLNB-AS1:1 | SEQ3796 | 1.E-03 | 1.7 | DLB | lnc-NLRP12-1:12 | SEQ5265 | 5.E-04 | 1.6 |
| All AD | FLNB-AS1:1 | SEQ3796 | 3.E-03 | 1.5 | FTD | lnc-NMD3-1:1 | SEQ2364 | 4.E-04 | 0.6 |
| msAD | FLNB-AS1:1 | SEQ3796 | 6.E-03 | 1.5 | DLB | lnc-NME3-1:2 | SEQ5256 | 5.E-04 | 1.5 |
| miAD | FLNB-AS1:1 | SEQ3796 | 8.E-03 | 1.5 | DLB | lnc-NMT1-1:2 | SEQ3980 | 2.E-04 | 1.6 |
| DLB | FLNB-AS1:3 | SEQ3800 | 2.E-03 | 2.4 | MCI | lnc-NMT1-1:2 | SEQ3980 | 1.E-03 | 1.4 |
| MCI | FLNB-AS1:3 | SEQ3800 | 1.E-04 | 2.0 | All AD | lnc-NMT1-1:2 | SEQ3980 | 2.E-02 | 1.2 |
| All AD | FLNB-AS1:3 | SEQ3800 | 4.E-04 | 1.5 | msAD | lnc-NMT1-1:2 | SEQ3980 | 2.E-02 | 1.2 |
| msAD | FLNB-AS1:3 | SEQ3800 | 1.E-03 | 1.5 | FTD | lnc-NNT-3:5 | SEQ4905 | 9.E-04 | 0.7 |
| miAD | FLNB-AS1:3 | SEQ3800 | 1.E-03 | 1.6 | DLB | lnc-NOB1-1:1 | SEQ2738 | 1.E-03 | 1.5 |
| FTD | FOXP1-IT1:1 | SEQ3805 | 1.E-05 | 0.6 | All AD | lnc-NOB1-1:1 | SEQ2738 | 3.E-02 | 1.1 |
| miAD | FOXP1-IT1:1 | SEQ3805 | 1.E-02 | 0.7 | FTD | lnc-NOD1-1:1 | SEQ5295 | 2.E-05 | 0.6 |
| All AD | FOXP1-IT1:1 | SEQ3805 | 3.E-02 | 0.7 | All AD | lnc-NOD1-1:1 | SEQ5295 | 4.E-02 | 0.7 |
| FTD | FRY-AS1:6 | SEQ5829 | 5.E-05 | 0.6 | DLB | lnc-NOL6-7:1 | SEQ5516 | 2.E-04 | 1.4 |
| FTD | FTX:19 | SEQ3811 | 3.E-09 | 0.1 | DLB | lnc-NOP14-3:4 | SEQ2834 | 4.E-04 | 1.6 |

TABLE 10-continued 2847 whole blood (Paxgene RNA tube) lncRNAs differentially expressed in MCI group or mild AD group or moderate-to-severe AD group or both of these AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| MCI | FTX:19 | SEQ3811 | 2.E-07 | 0.1 | MCI | lnc-NOP16-2:6 | SEQ4973 | 5.E-04 | 1.7 |
| DLB | FTX:19 | SEQ3811 | 7.E-06 | 0.1 | DLB | lnc-NOP16-2:6 | SEQ4973 | 8.E-04 | 1.7 |
| All AD | FTX:19 | SEQ3811 | 4.E-03 | 0.1 | DLB | lnc-NOP9-1:2 | SEQ2990 | 3.E-04 | 1.4 |
| miAD | FTX:19 | SEQ3811 | 5.E-03 | 0.1 | DLB | lnc-NOS2-2:1 | SEQ4307 | 1.E-03 | 1.7 |
| msAD | FTX:19 | SEQ3811 | 1.E-02 | 0.2 | msAD | lnc-NOS2-2:1 | SEQ4307 | 7.E-03 | 1.4 |
| FTD | FTX:24 | SEQ5089 | 6.E-04 | 0.7 | All AD | lnc-NOS2-2:1 | SEQ4307 | 3.E-02 | 1.3 |
| FTD | FTX:28 | SEQ4395 | 1.E-04 | 0.5 | DLB | lnc-NPB-1:5 | SEQ4837 | 8.E-04 | 1.4 |
| MCI | FTX:28 | SEQ4395 | 2.E-03 | 0.5 | MCI | lnc-NPB-1:5 | SEQ4837 | 9.E-04 | 1.4 |
| All AD | FTX:37 | SEQ3814 | 3.E-02 | 0.7 | FTD | lnc-NPEPL1-3:1 | SEQ5470 | 3.E-04 | 0.7 |
| DLB | FTX:4 | SEQ4793 | 1.E-03 | 2.1 | MCI | lnc-NPIPA7-4:1 | SEQ4441 | 2.E-03 | 1.6 |
| DLB | FTX:44 | SEQ4642 | 1.E-03 | 1.6 | FTD | lnc-NPIPB12-2:2 | SEQ5357 | 4.E-04 | 0.6 |
| FTD | FTX:50 | SEQ3819 | 3.E-08 | 0.3 | FTD | lnc-NPIPB12-4:1 | SEQ5858 | 4.E-05 | 0.7 |
| MCI | FTX:50 | SEQ3819 | 8.E-05 | 0.4 | DLB | lnc-NPIPB3-1:1 | SEQ4519 | 6.E-05 | 1.7 |
| All AD | FTX:50 | SEQ3819 | 3.E-02 | 0.6 | MCI | lnc-NPIPB3-1:1 | SEQ4519 | 2.E-03 | 1.5 |
| DLB | FTX:52 | SEQ5282 | 3.E-05 | 2.2 | DLB | lnc-NPIPB3-2:1 | SEQ4765 | 1.E-03 | 1.5 |
| MCI | FTX:52 | SEQ5282 | 5.E-04 | 1.9 | All AD | lnc-NPL-2:1 | SEQ5306 | 2.E-02 | 0.7 |
| FTD | FTX:54 | SEQ4798 | 1.E-03 | 0.4 | FTD | lnc-NPL-2:2 | SEQ3740 | 3.E-04 | 0.6 |
| DLB | GABPB1-AS1:24 | SEQ3823 | 7.E-06 | 3.8 | All AD | lnc-NPL-2:2 | SEQ3740 | 1.E-02 | 0.7 |
| FTD | GABPB1-AS1:24 | SEQ3823 | 1.E-03 | 1.9 | msAD | lnc-NPL-2:2 | SEQ3740 | 4.E-02 | 0.8 |
| MCI | GABPB1-AS1:24 | SEQ3823 | 1.E-03 | 2.4 | FTD | lnc-NPM2-3:1 | SEQ5780 | 7.E-05 | 0.6 |
| miAD | GABPB1-AS1:24 | SEQ3823 | 3.E-03 | 1.6 | DLB | lnc-NPTX1-2:12 | SEQ4521 | 2.E-03 | 1.6 |
| All AD | GABPB1-AS1:24 | SEQ3823 | 8.E-03 | 1.4 | DLB | lnc-NPTX1-2:2 | SEQ5131 | 6.E-04 | 1.6 |
| FTD | GABPB1-IT1:2 | SEQ3828 | 2.E-04 | 2.4 | msAD | lnc-NPTX1-2:5 | SEQ4251 | 9.E-03 | 0.6 |
| All AD | GABPB1-IT1:2 | SEQ3828 | 4.E-02 | 1.3 | All AD | lnc-NPTX1-2:5 | SEQ4251 | 4.E-02 | 0.6 |
| miAD | GABPB1-IT1:5 | SEQ2591 | 7.E-03 | 1.6 | msAD | lnc-NPTX1-2:6 | SEQ3742 | 4.E-02 | 0.8 |
| All AD | GABPB1-IT1:5 | SEQ2591 | 1.E-02 | 1.4 | DLB | lnc-NPTX1-2:9 | SEQ5130 | 6.E-04 | 1.6 |
| msAD | GABPB1-IT1:5 | SEQ2591 | 5.E-02 | 1.3 | miAD | lnc-NR1D1-1:6 | SEQ4228 | 1.E-02 | 0.7 |
| DLB | GAS6-AS1:3 | SEQ5908 | 2.E-05 | 2.3 | All AD | lnc-NR1D1-1:6 | SEQ4228 | 4.E-02 | 0.8 |
| msAD | GFOD1-AS1:3 | SEQ3957 | 3.E-02 | 1.5 | FTD | lnc-NR1I2-3:1 | SEQ5229 | 5.E-04 | 0.6 |
| DLB | GHRLOS:9 | SEQ5051 | 7.E-04 | 2.0 | DLB | lnc-NR2C2-1:1 | SEQ2751 | 8.E-04 | 1.3 |
| miAD | GK-AS1:1 | SEQ3749 | 7.E-03 | 0.6 | DLB | lnc-NR2F6-5:1 | SEQ3457 | 6.E-04 | 1.4 |
| All AD | GK-AS1:1 | SEQ3749 | 9.E-03 | 0.7 | MCI | lnc-NR2F6-5:1 | SEQ3457 | 2.E-03 | 1.4 |
| msAD | GK-AS1:1 | SEQ3749 | 4.E-02 | 0.7 | FTD | lnc-NRBF2-2:1 | SEQ4087 | 1.E-08 | 0.4 |
| DLB | GLYCTK-AS1:7 | SEQ5124 | 6.E-04 | 1.6 | MCI | lnc-NRBF2-2:1 | SEQ4087 | 5.E-04 | 0.6 |
| DLB | GLYCTK-AS1:8 | SEQ5015 | 7.E-04 | 1.4 | miAD | lnc-NRBF2-2:1 | SEQ4087 | 2.E-03 | 0.5 |
| miAD | GSEC:2 | SEQ3835 | 4.E-03 | 0.6 | All AD | lnc-NRBF2-2:1 | SEQ4087 | 2.E-03 | 0.6 |
| All AD | GSEC:2 | SEQ3835 | 3.E-02 | 0.7 | msAD | lnc-NRBF2-2:1 | SEQ4087 | 1.E-02 | 0.6 |
| MCI | H1FX-AS1:15 | SEQ3313 | 2.E-05 | 1.6 | FTD | lnc-NRF1-2:1 | SEQ5313 | 4.E-05 | 0.5 |
| DLB | H1FX-AS1:15 | SEQ3313 | 5.E-05 | 1.6 | All AD | lnc-NRF1-2:1 | SEQ5313 | 4.E-02 | 0.7 |
| FTD | H1FX-AS1:15 | SEQ3313 | 2.E-04 | 1.5 | FTD | lnc-NT5C2-2:1 | SEQ3787 | 1.E-04 | 0.6 |
| All AD | H1FX-AS1:15 | SEQ3313 | 3.E-03 | 1.3 | miAD | lnc-NT5C2-2:1 | SEQ3787 | 6.E-03 | 0.7 |
| msAD | H1FX-AS1:15 | SEQ3313 | 5.E-03 | 1.3 | All AD | lnc-NT5C2-2:1 | SEQ3787 | 8.E-03 | 0.7 |
| miAD | H1FX-AS1:15 | SEQ3313 | 8.E-03 | 1.3 | msAD | lnc-NT5C2-2:1 | SEQ3787 | 4.E-02 | 0.8 |
| DLB | H1FX-AS1:16 | SEQ3841 | 2.E-04 | 1.8 | DLB | lnc-NT5M-1:3 | SEQ5274 | 5.E-04 | 1.7 |
| miAD | H1FX-AS1:16 | SEQ3841 | 1.E-03 | 1.5 | FTD | lnc-NTNG1-4:1 | SEQ4301 | 1.E-05 | 0.6 |
| All AD | H1FX-AS1:16 | SEQ3841 | 1.E-03 | 1.4 | miAD | lnc-NTNG1-4:1 | SEQ4301 | 7.E-03 | 0.7 |
| msAD | H1FX-AS1:16 | SEQ3841 | 8.E-03 | 1.4 | All AD | lnc-NTNG1-4:1 | SEQ4301 | 1.E-02 | 0.8 |
| DLB | HCG26:5 | SEQ5696 | 1.E-04 | 1.6 | DLB | lnc-NTNG2-2:1 | SEQ5661 | 1.E-04 | 1.5 |
| DLB | HCP5:1 | SEQ5322 | 4.E-04 | 1.5 | All AD | lnc-NUAK1-5:1 | SEQ5317 | 4.E-02 | 0.9 |
| DLB | HCP5:3 | SEQ5476 | 2.E-04 | 1.3 | FTD | lnc-NUCB2-1:1 | SEQ4907 | 9.E-04 | 0.7 |
| FTD | HCP5:4 | SEQ5344 | 3.E-04 | 2.4 | All AD | lnc-NUDT3-1:3 | SEQ2725 | 3.E-02 | 1.2 |
| MCI | HCP5:4 | SEQ5344 | 4.E-04 | 2.2 | FTD | lnc-NUDT4P1-1:11 | SEQ5954 | 7.E-06 | 0.5 |
| DLB | HCP5:7 | SEQ5321 | 4.E-04 | 1.5 | DLB | lnc-NUDT4P1-1:13 | SEQ4757 | 1.E-03 | 1.5 |
| FTD | HCP5:9 | SEQ5345 | 3.E-04 | 2.4 | DLB | lnc-NUDT4P1-1:2 | SEQ4564 | 2.E-03 | 1.4 |
| MCI | HCP5:9 | SEQ5345 | 4.E-04 | 2.2 | FTD | lnc-NUDT4P1-1:5 | SEQ5899 | 2.E-05 | 0.6 |
| FTD | HOTAIRM1:14 | SEQ3852 | 2.E-04 | 0.7 | FTD | lnc-NUDT4P1-9:1 | SEQ4171 | 1.E-07 | 0.5 |
| msAD | HOTAIRM1:14 | SEQ3852 | 9.E-03 | 0.7 | MCI | lnc-NUDT4P1-9:1 | SEQ4171 | 4.E-05 | 0.6 |
| All AD | HOTAIRM1:14 | SEQ3852 | 1.E-02 | 0.6 | All AD | lnc-NUDT4P1-9:1 | SEQ4171 | 3.E-03 | 0.7 |
| DLB | IL21R-AS1:1 | SEQ4596 | 2.E-03 | 1.7 | miAD | lnc-NUDT4P1-9:1 | SEQ4171 | 4.E-03 | 0.6 |
| DLB | IL21R-AS1:2 | SEQ5206 | 5.E-04 | 1.7 | msAD | lnc-NUDT4P1-9:1 | SEQ4171 | 1.E-02 | 0.7 |
| DLB | IL21R-AS1:3 | SEQ4595 | 2.E-03 | 1.7 | All AD | lnc-NUMB-1:11 | SEQ5325 | 2.E-02 | 0.8 |
| MCI | IRAIN:2 | SEQ2863 | 1.E-03 | 1.6 | All AD | lnc-NUMB-1:6 | SEQ5326 | 4.E-02 | 0.8 |
| MCI | IRAIN:3 | SEQ2864 | 1.E-03 | 1.6 | All AD | lnc-NUMB-2:1 | SEQ5327 | 2.E-02 | 0.8 |
| DLB | ITFG2-AS1:3 | SEQ5620 | 2.E-04 | 1.6 | DLB | lnc-NUP188-1:1 | SEQ4556 | 2.E-03 | 1.3 |
| DLB | ITPKB-IT1:1 | SEQ4587 | 2.E-03 | 1.6 | All AD | lnc-NUS1-5:1 | SEQ3614 | 2.E-02 | 1.2 |
| FTD | JMJD1C-AS1:6 | SEQ5643 | 1.E-04 | 0.6 | DLB | lnc-NXNL1-7:2 | SEQ4402 | 2.E-03 | 1.3 |
| FTD | JPX:13 | SEQ4473 | 3.E-07 | 0.5 | FTD | lnc-NXPH2-1:1 | SEQ4903 | 9.E-04 | 0.6 |
| MCI | JPX:13 | SEQ4473 | 2.E-03 | 0.7 | All AD | lnc-NXPH2-1:1 | SEQ4903 | 2.E-02 | 0.8 |
| FTD | JPX:20 | SEQ5292 | 4.E-04 | 0.6 | FTD | lnc-NXPH2-3:10 | SEQ4666 | 7.E-05 | 0.3 |
| FTD | JPX:22 | SEQ5885 | 3.E-05 | 0.5 | MCI | lnc-NXPH2-3:10 | SEQ4666 | 9.E-05 | 0.3 |
| FTD | KCNJ2-AS1:3 | SEQ3865 | 5.E-04 | 0.6 | DLB | lnc-NXPH2-3:10 | SEQ4666 | 1.E-03 | 0.3 |
| miAD | KCNJ2-AS1:3 | SEQ3865 | 2.E-03 | 0.6 | miAD | lnc-NXPH2-3:5 | SEQ3634 | 1.E-02 | 0.6 |
| All AD | KCNJ2-AS1:3 | SEQ3865 | 7.E-03 | 0.6 | All AD | lnc-NXPH2-3:5 | SEQ3634 | 1.E-02 | 0.7 |
| DLB | KCNQ10T1:1 | SEQ4434 | 2.E-03 | 1.5 | msAD | lnc-NXPH2-3:5 | SEQ3634 | 5.E-02 | 0.8 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| FTD | KCNQ1OT1:2 | SEQ5774 | 7.E-05 | 0.5 | MCI | lnc-OBSCN-AS1-2:1 | SEQ5039 | 7.E-04 | 1.6 |
| DLB | KCNQ1OT1:3 | SEQ4433 | 2.E-03 | 1.5 | DLB | lnc-OCM-3:4 | SEQ5076 | 2.E-08 | 3.3 |
| FTD | KCNQ1OT1:5 | SEQ5762 | 8.E-05 | 0.5 | MCI | lnc-OCM-3:4 | SEQ5076 | 4.E-08 | 3.1 |
| FTD | KCNQ1OT1:8 | SEQ0139 | 2.E-04 | 0.6 | msAD | lnc-OCM-3:4 | SEQ5076 | 6.E-05 | 1.7 |
| DLB | KDM4A-AS1:5 | SEQ4616 | 1.E-03 | 1.4 | All AD | lnc-OCM-3:4 | SEQ5076 | 7.E-05 | 1.7 |
| DLB | KIF9-AS1:9 | SEQ4492 | 2.E-03 | 1.4 | miAD | lnc-OCM-3:4 | SEQ5076 | 7.E-04 | 1.7 |
| DLB | LAMTOR5-AS1:1 | SEQ5672 | 1.E-04 | 1.7 | FTD | lnc-ODF1-9:1 | SEQ0824 | 2.E-06 | 0.6 |
| DLB | LCMT1-AS2:4 | SEQ4657 | 1.E-03 | 1.9 | DLB | lnc-OGDH-2:3 | SEQ4682 | 1.E-03 | 1.4 |
| MCI | LEF1-AS1:1 | SEQ3877 | 1.E-03 | 1.9 | DLB | lnc-OIP5-1:1 | SEQ5863 | 4.E-05 | 1.9 |
| DLB | LEF1-AS1:1 | SEQ3877 | 2.E-03 | 1.9 | FTD | lnc-OIT3-1:1 | SEQ5230 | 5.E-04 | 0.6 |
| miAD | LEF1-AS1:1 | SEQ3877 | 3.E-03 | 1.6 | msAD | lnc-OLIG1-3:2 | SEQ4101 | 1.E-02 | 1.6 |
| All AD | LEF1-AS1:1 | SEQ3877 | 4.E-03 | 1.5 | DLB | lnc-OPLAH-1:1 | SEQ5811 | 5.E-05 | 1.4 |
| msAD | LEF1-AS1:1 | SEQ3877 | 2.E-02 | 1.4 | miAD | lnc-OR10V1-1:1 | SEQ4329 | 6.E-03 | 0.8 |
| MCI | LEF1-AS1:2 | SEQ3882 | 3.E-04 | 2.3 | All AD | lnc-OR10V1-1:1 | SEQ4329 | 3.E-02 | 0.8 |
| DLB | LEF1-AS1:2 | SEQ3882 | 4.E-04 | 2.3 | DLB | lnc-OR1A2-1:1 | SEQ3560 | 1.E-03 | 1.4 |
| miAD | LEF1-AS1:2 | SEQ3882 | 2.E-03 | 1.7 | msAD | lnc-OR1J1-2:1 | SEQ3840 | 3.E-02 | 1.3 |
| All AD | LEF1-AS1:2 | SEQ3882 | 3.E-03 | 1.6 | DLB | lnc-OR4F15-4:5 | SEQ2780 | 4.E-07 | 1.7 |
| msAD | LEF1-AS1:2 | SEQ3882 | 2.E-02 | 1.5 | MCI | lnc-OR4F15-4:5 | SEQ2780 | 3.E-05 | 1.3 |
| All AD | LEF1-AS1:24 | SEQ3886 | 4.E-02 | 1.3 | FTD | lnc-OR4F15-4:5 | SEQ2780 | 8.E-04 | 1.3 |
| DLB | LIMD1-AS1:2 | SEQ2885 | 2.E-03 | 1.5 | msAD | lnc-OR4F15-4:5 | SEQ2780 | 1.E-02 | 1.2 |
| msAD | LINC00205:10 | SEQ3689 | 5.E-02 | 1.3 | All AD | lnc-OR4F15-4:5 | SEQ2780 | 4.E-02 | 1.1 |
| MCI | LINC00205:26 | SEQ4533 | 6.E-04 | 1.9 | All AD | lnc-OR4F16-15:5 | SEQ5342 | 5.E-02 | 0.7 |
| DLB | LINC00205:26 | SEQ4533 | 2.E-03 | 1.9 | FTD | lnc-OR4F17-5:1 | SEQ5002 | 8.E-04 | 0.7 |
| MCI | LINC00211:13 | SEQ4965 | 8.E-04 | 1.6 | miAD | lnc-OR4F17-8:1 | SEQ4085 | 3.E-03 | 0.6 |
| FTD | LINC00211:15 | SEQ3890 | 3.E-04 | 0.4 | All AD | lnc-OR4F17-8:1 | SEQ4085 | 3.E-03 | 0.6 |
| All AD | LINC00211:15 | SEQ3890 | 6.E-03 | 0.5 | msAD | lnc-OR4F17-8:1 | SEQ4085 | 1.E-02 | 0.6 |
| msAD | LINC00211:15 | SEQ3890 | 7.E-03 | 0.4 | All AD | lnc-OR4F29-1:10 | SEQ5346 | 4.E-02 | 0.6 |
| MCI | LINC00235:1 | SEQ3731 | 5.E-04 | 2.1 | DLB | lnc-OR4F29-11:1 | SEQ4438 | 2.E-03 | 1.5 |
| DLB | LINC00235:1 | SEQ3731 | 9.E-04 | 2.3 | DLB | lnc-OR4F29-11:5 | SEQ5967 | 4.E-06 | 1.9 |
| All AD | LINC00235:1 | SEQ3731 | 2.E-02 | 1.4 | DLB | lnc-OR4F29-11:6 | SEQ5611 | 2.E-04 | 1.4 |
| msAD | LINC00235:1 | SEQ3731 | 4.E-02 | 1.4 | miAD | lnc-OR4F29-3:11 | SEQ0044 | 2.E-03 | 0.5 |
| All AD | LINC00402:4 | SEQ3893 | 2.E-02 | 1.3 | All AD | lnc-OR4F29-3:11 | SEQ0044 | 4.E-03 | 0.6 |
| FTD | LINC00472:23 | SEQ4670 | 5.E-04 | 0.7 | msAD | lnc-OR4F29-3:11 | SEQ0044 | 4.E-02 | 0.7 |
| MCI | LINC00472:23 | SEQ4670 | 1.E-03 | 0.8 | miAD | lnc-OR4F29-3:7 | SEQ4602 | 1.E-03 | 0.6 |
| FTD | LINC00472:38 | SEQ5930 | 1.E-05 | 0.6 | All AD | lnc-OR4F29-3:7 | SEQ4602 | 7.E-03 | 0.7 |
| FTD | LINC00472:41 | SEQ3848 | 3.E-11 | 0.1 | All AD | lnc-OR4F29-8:3 | SEQ3836 | 2.E-02 | 0.7 |
| MCI | LINC00472:41 | SEQ3848 | 2.E-08 | 0.2 | msAD | lnc-OR4F29-8:3 | SEQ3836 | 3.E-02 | 0.7 |
| miAD | LINC00472:41 | SEQ3848 | 3.E-05 | 0.3 | DLB | lnc-OR4F29-8:30 | SEQ5241 | 5.E-04 | 1.4 |
| DLB | LINC00472:41 | SEQ3848 | 9.E-05 | 0.2 | FTD | lnc-OR4F29-8:48 | SEQ5882 | 3.E-05 | 0.4 |
| All AD | LINC00472:41 | SEQ3848 | 7.E-03 | 0.3 | All AD | lnc-OR4F3-5:4 | SEQ5350 | 3.E-02 | 0.6 |
| msAD | LINC00472:41 | SEQ3848 | 3.E-02 | 0.3 | msAD | lnc-OR4F4-4:3 | SEQ3996 | 2.E-02 | 1.7 |
| All AD | LINC00476:1 | SEQ3719 | 2.E-02 | 1.3 | miAD | lnc-OR4F5-2:1 | SEQ4371 | 4.E-03 | 0.6 |
| msAD | LINC00476:1 | SEQ3719 | 4.E-02 | 1.3 | All AD | lnc-OR4F5-2:1 | SEQ4371 | 8.E-03 | 0.6 |
| FTD | LINC00533:8 | SEQ3864 | 5.E-04 | 0.5 | DLB | lnc-OR4F6-1:1 | SEQ4266 | 6.E-05 | 2.0 |
| miAD | LINC00533:8 | SEQ3864 | 6.E-03 | 0.5 | msAD | lnc-OR4F6-1:1 | SEQ4266 | 9.E-03 | 1.4 |
| All AD | LINC00533:8 | SEQ3864 | 7.E-03 | 0.6 | All AD | lnc-OR4F6-1:1 | SEQ4266 | 2.E-02 | 1.3 |
| msAD | LINC00533:8 | SEQ3864 | 3.E-02 | 0.6 | msAD | lnc-OR52K2-1:1 | SEQ4300 | 7.E-03 | 0.7 |
| DLB | LINC00649:37 | SEQ5639 | 2.E-04 | 2.1 | All AD | lnc-OR52K2-1:1 | SEQ4300 | 1.E-02 | 0.8 |
| MCI | LINC00659:10 | SEQ4726 | 1.E-03 | 2.2 | DLB | lnc-OR6C65-3:1 | SEQ5441 | 3.E-04 | 1.5 |
| FTD | LINC00667:21 | SEQ5085 | 6.E-04 | 0.6 | DLB | lnc-OR7C2-1:2 | SEQ5740 | 9.E-05 | 1.9 |
| FTD | LINC00667:3 | SEQ5304 | 4.E-04 | 1.9 | MCI | lnc-OSBPL7-3:1 | SEQ3569 | 5.E-05 | 1.6 |
| DLB | LINC00677:6 | SEQ4555 | 2.E-03 | 1.3 | FTD | lnc-OSBPL7-3:1 | SEQ3569 | 1.E-04 | 1.6 |
| DLB | LINC00685:6 | SEQ4963 | 3.E-04 | 1.8 | DLB | lnc-OSBPL7-3:1 | SEQ3569 | 2.E-03 | 1.5 |
| MCI | LINC00685:6 | SEQ4963 | 8.E-04 | 1.6 | All AD | lnc-OSBPL7-3:2 | SEQ2813 | 4.E-02 | 0.8 |
| DLB | LINC00847:2 | SEQ4857 | 9.E-04 | 1.5 | FTD | lnc-OSBPL7-3:3 | SEQ0534 | 2.E-05 | 0.7 |
| miAD | LINC00847:3 | SEQ3912 | 5.E-03 | 1.7 | miAD | lnc-OSBPL7-3:3 | SEQ0534 | 1.E-02 | 0.8 |
| All AD | LINC00847:3 | SEQ3912 | 3.E-02 | 1.4 | All AD | lnc-OSBPL7-3:3 | SEQ0534 | 2.E-02 | 0.8 |
| FTD | LINC00861:6 | SEQ3915 | 3.E-08 | 5.9 | FTD | lnc-OSBPL7-3:4 | SEQ0535 | 4.E-05 | 0.7 |
| DLB | LINC00861:6 | SEQ3915 | 6.E-08 | 6.6 | FTD | lnc-OSBPL7-3:6 | SEQ0536 | 4.E-05 | 0.7 |
| MCI | LINC00861:6 | SEQ3915 | 3.E-06 | 5.1 | All AD | lnc-OSBPL7-3:6 | SEQ0536 | 3.E-02 | 0.8 |
| All AD | LINC00861:6 | SEQ3915 | 1.E-03 | 1.8 | msAD | lnc-OSMR-2:2 | SEQ4340 | 5.E-03 | 0.6 |
| miAD | LINC00861:6 | SEQ3915 | 3.E-04 | 1.8 | FTD | lnc-OTOA-1:2 | SEQ3943 | 1.E-04 | 0.5 |
| msAD | LINC00861:6 | SEQ3915 | 1.E-03 | 1.8 | All AD | lnc-OTOA-1:2 | SEQ3943 | 6.E-03 | 0.6 |
| MCI | LINC00869:68 | SEQ3730 | 3.E-04 | 2.1 | miAD | lnc-OTOA-1:2 | SEQ3943 | 7.E-03 | 0.6 |
| DLB | LINC00869:68 | SEQ3730 | 8.E-04 | 1.9 | msAD | lnc-OTOA-1:2 | SEQ3943 | 3.E-02 | 0.7 |
| miAD | LINC00869:68 | SEQ3730 | 1.E-03 | 1.7 | DLB | lnc-OTULIN-4:1 | SEQ5694 | 1.E-04 | 1.5 |
| All AD | LINC00869:68 | SEQ3730 | 4.E-03 | 1.5 | DLB | lnc-P4HTM-4:1 | SEQ5334 | 4.E-04 | 1.7 |
| msAD | LINC00869:68 | SEQ3730 | 4.E-02 | 1.4 | MCI | lnc-PABPC1L2B-3:1 | SEQ4448 | 3.E-04 | 1.7 |
| miAD | LINC00869:73 | SEQ3922 | 3.E-03 | 0.5 | DLB | lnc-PABPC1L2B-3:1 | SEQ4448 | 2.E-03 | 1.6 |
| All AD | LINC00869:73 | SEQ3922 | 3.E-03 | 0.6 | DLB | lnc-PABPN1L-1:1 | SEQ2986 | 2.E-03 | 1.6 |
| msAD | LINC00869:73 | SEQ3922 | 2.E-02 | 0.6 | MCI | lnc-PACSIN1-1:1 | SEQ5452 | 1.E-04 | 1.6 |
| All AD | LINC00877:15 | SEQ3743 | 3.E-02 | 0.8 | DLB | lnc-PACSIN1-1:1 | SEQ5452 | 3.E-04 | 1.8 |
| msAD | LINC00877:15 | SEQ3743 | 4.E-02 | 0.8 | DLB | lnc-PADI2-1:1 | SEQ5936 | 1.E-05 | 1.8 |
| FTD | LINC00894:50 | SEQ3925 | 6.E-05 | 0.6 | DLB | lnc-PAF1-3:1 | SEQ5113 | 6.E-04 | 1.4 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| All AD | LINC00894:50 | SEQ3925 | 4.E-02 | 0.7 | MCI | lnc-PAGR1-2:8 | SEQ5430 | 1.E-04 | 1.4 |
| msAD | LINC00910:32 | SEQ3926 | 2.E-02 | 1.3 | DLB | lnc-PAGR1-2:8 | SEQ5430 | 3.E-04 | 1.4 |
| All AD | LINC00910:32 | SEQ3926 | 4.E-02 | 1.2 | FTD | lnc-PAIP2B-2:1 | SEQ5874 | 3.E-05 | 0.6 |
| msAD | LINC00926:2 | SEQ3927 | 2.E-02 | 1.6 | FTD | lnc-PALLD-8:1 | SEQ2633 | 2.E-05 | 0.6 |
| All AD | LINC00926:2 | SEQ3927 | 4.E-02 | 1.5 | DLB | lnc-PANK3-13:1 | SEQ2629 | 5.E-04 | 1.5 |
| miAD | LINC00937:21 | SEQ3930 | 1.E-02 | 0.6 | FTD | lnc-PANK3-13:2 | SEQ2618 | 7.E-05 | 0.6 |
| All AD | LINC00937:21 | SEQ3930 | 2.E-02 | 0.7 | DLB | lnc-PANO1-1:1 | SEQ5485 | 2.E-04 | 1.5 |
| msAD | LINC00938:7 | SEQ3931 | 2.E-02 | 1.4 | MCI | lnc-PAPD5-2:1 | SEQ5851 | 4.E-05 | 1.8 |
| All AD | LINC00938:7 | SEQ3931 | 3.E-02 | 1.2 | DLB | lnc-PAPD5-2:1 | SEQ5851 | 4.E-05 | 1.9 |
| DLB | LINC00957:7 | SEQ5252 | 4.E-05 | 1.7 | FTD | lnc-PAPLN-2:1 | SEQ5163 | 5.E-04 | 0.8 |
| MCI | LINC00957:7 | SEQ5252 | 5.E-04 | 1.5 | FTD | lnc-PAPPA2-2:1 | SEQ4328 | 2.E-05 | 0.6 |
| MCI | LINC00963:12 | SEQ5349 | 2.E-04 | 0.5 | miAD | lnc-PAPPA2-2:1 | SEQ4328 | 6.E-03 | 0.7 |
| FTD | LINC00963:12 | SEQ5349 | 4.E-04 | 0.5 | All AD | lnc-PAPPA2-2:1 | SEQ4328 | 1.E-02 | 0.8 |
| DLB | LINC00963:7 | SEQ4528 | 2.E-03 | 1.7 | FTD | lnc-PAPPA2-6:1 | SEQ4247 | 5.E-04 | 0.7 |
| MCI | LINC00989:1 | SEQ3938 | 6.E-04 | 1.6 | miAD | lnc-PAPPA2-6:1 | SEQ4247 | 9.E-03 | 0.7 |
| msAD | LINC00989:1 | SEQ3938 | 4.E-03 | 1.4 | All AD | lnc-PAPPA2-6:1 | SEQ4247 | 1.E-02 | 0.8 |
| All AD | LINC00989:1 | SEQ3938 | 5.E-03 | 1.3 | FTD | lnc-PAPPA2-7:1 | SEQ0165 | 2.E-04 | 0.6 |
| DLB | LINCO1000:7 | SEQ2877 | 2.E-04 | 1.5 | All AD | lnc-PAPPA2-7:1 | SEQ0165 | 2.E-03 | 0.7 |
| MCI | LINC01002:1 | SEQ5287 | 3.E-02 | 0.6 | miAD | lnc-PAPPA2-7:1 | SEQ0165 | 2.E-03 | 0.7 |
| FTD | LINC01002:1 | SEQ5287 | 4.E-04 | 0.5 | msAD | lnc-PAPPA2-7:1 | SEQ0165 | 8.E-03 | 0.7 |
| miAD | LINC01002:27 | SEQ3945 | 2.E-03 | 0.5 | miAD | lnc-PAPSS2-10:1 | SEQ4072 | 1.E-02 | 0.7 |
| All AD | LINC01002:27 | SEQ3945 | 1.E-02 | 0.6 | All AD | lnc-PAPSS2-10:1 | SEQ4072 | 3.E-02 | 0.8 |
| miAD | LINC01002:9 | SEQ3759 | 5.E-03 | 0.5 | All AD | lnc-PATL2-9:1 | SEQ3944 | 1.E-02 | 0.7 |
| All AD | LINC01002:9 | SEQ3759 | 7.E-03 | 0.6 | msAD | lnc-PATL2-9:1 | SEQ3944 | 3.E-02 | 0.7 |
| msAD | LINC01002:9 | SEQ3759 | 4.E-02 | 0.7 | FTD | lnc-PAWR-14:1 | SEQ4343 | 3.E-05 | 0.5 |
| DLB | LINC01089:27 | SEQ5862 | 2.E-05 | 1.9 | miAD | lnc-PAWR-14:1 | SEQ4343 | 5.E-03 | 0.6 |
| MCI | LINC01089:27 | SEQ5862 | 4.E-05 | 1.9 | All AD | lnc-PAWR-14:1 | SEQ4343 | 7.E-03 | 0.6 |
| DLB | LINC01089:3 | SEQ5705 | 5.E-05 | 1.9 | All AD | lnc-PAXX-2:1 | SEQ3639 | 4.E-02 | 0.8 |
| MCI | LINC01089:3 | SEQ5705 | 1.E-04 | 1.8 | msAD | lnc-PAXX-2:1 | SEQ3639 | 5.E-02 | 0.9 |
| DLB | LINC01128:4 | SEQ3953 | 1.E-04 | 1.9 | miAD | lnc-PCBP1-2:1 | SEQ3999 | 2.E-03 | 0.6 |
| MCI | LINC01128:4 | SEQ3953 | 3.E-04 | 1.7 | All AD | lnc-PCBP1-2:1 | SEQ3999 | 3.E-03 | 0.6 |
| All AD | LINC01128:4 | SEQ3953 | 6.E-03 | 1.3 | msAD | lnc-PCBP1-2:1 | SEQ3999 | 2.E-02 | 0.6 |
| miAD | LINC01128:4 | SEQ3953 | 6.E-03 | 1.3 | FTD | lnc-PCDHGA1-1:3 | SEQ5923 | 1.E-05 | 0.6 |
| msAD | LINC01128:4 | SEQ3953 | 2.E-02 | 1.3 | FTD | lnc-PCDHGA1-1:4 | SEQ5922 | 1.E-05 | 0.6 |
| All AD | LINC01136:8 | SEQ3958 | 2.E-03 | 0.5 | FTD | lnc-PCDHGA1-3:2 | SEQ4819 | 4.E-07 | 0.4 |
| miAD | LINC01136:8 | SEQ3958 | 2.E-03 | 0.5 | MCI | lnc-PCDHGA1-3:2 | SEQ4819 | 4.E-04 | 0.5 |
| msAD | LINC01136:8 | SEQ3958 | 8.E-03 | 0.5 | miAD | lnc-PCDHGA1-3:2 | SEQ4819 | 1.E-03 | 0.5 |
| DLB | LINC01138:20 | SEQ3672 | 6.E-04 | 1.7 | DLB | lnc-PCGF2-3:1 | SEQ5700 | 1.E-04 | 1.6 |
| msAD | LINC01138:20 | SEQ3672 | 5.E-02 | 1.2 | DLB | lnc-PCGF2-4:1 | SEQ3602 | 4.E-05 | 1.5 |
| msAD | LINC01138:23 | SEQ3889 | 3.E-02 | 0.8 | FTD | lnc-PCNX4-3:1 | SEQ4285 | 1.E-08 | 0.5 |
| All AD | LINC01138:23 | SEQ3889 | 3.E-02 | 0.8 | MCI | lnc-PCNX4-3:1 | SEQ4285 | 8.E-05 | 0.5 |
| FTD | LINCO1154:11 | SEQ5747 | 9.E-05 | 0.7 | miAD | lnc-PCNX4-3:1 | SEQ4285 | 7.E-03 | 0.7 |
| MCI | LINC01215:3 | SEQ3963 | 2.E-04 | 2.5 | All AD | lnc-PCNX4-3:1 | SEQ4285 | 1.E-02 | 0.7 |
| msAD | LINC01215:3 | SEQ3963 | 1.E-02 | 1.5 | FTD | lnc-PCP4L1-3:2 | SEQ4902 | 9.E-04 | 0.6 |
| All AD | LINCO1215:3 | SEQ3963 | 4.E-02 | 1.3 | DLB | lnc-PCSK7-1:4 | SEQ5619 | 2.E-04 | 1.6 |
| DLB | LINCO1224:32 | SEQ5454 | 3.E-04 | 1.8 | FTD | lnc-PCYOX1-4:1 | SEQ5998 | 2.E-07 | 0.3 |
| DLB | LINC01224:33 | SEQ4653 | 2.E-04 | 2.1 | MCI | lnc-PCYOX1-4:1 | SEQ5998 | 4.E-07 | 0.4 |
| MCI | LINC01224:33 | SEQ4653 | 1.E-03 | 1.8 | FTD | lnc-PDCD4-6:1 | SEQ5384 | 2.E-05 | 0.6 |
| DLB | LINC01224:56 | SEQ5278 | 5.E-04 | 1.8 | All AD | lnc-PDCD4-6:1 | SEQ5384 | 5.E-02 | 0.8 |
| DLB | LINC01311:5 | SEQ3967 | 6.E-04 | 1.5 | FTD | lnc-PDCL2-4:1 | SEQ5475 | 2.E-07 | 0.6 |
| MCI | LINC01311:5 | SEQ3967 | 1.E-03 | 1.5 | MCI | lnc-PDCL2-4:1 | SEQ5475 | 2.E-04 | 0.7 |
| All AD | LINC01311:5 | SEQ3967 | 4.E-02 | 1.2 | msAD | lnc-PDE6D-3:1 | SEQ3793 | 4.E-02 | 1.3 |
| FTD | LINC01355:1 | SEQ5509 | 2.E-04 | 0.6 | MCI | lnc-PDGFA-6:2 | SEQ5057 | 4.E-08 | 6.3 |
| miAD | LINC01359:11 | SEQ3826 | 1.E-03 | 0.6 | FTD | lnc-PDGFA-6:2 | SEQ5057 | 7.E-06 | 3.3 |
| All AD | LINC01359:11 | SEQ3826 | 4.E-03 | 0.6 | DLB | lnc-PDGFA-6:2 | SEQ5057 | 7.E-04 | 3.1 |
| msAD | LINC01359:11 | SEQ3826 | 4.E-02 | 0.7 | All AD | lnc-PDGFA-6:5 | SEQ5389 | 4.E-02 | 0.6 |
| FTD | LINC01410:15 | SEQ5978 | 5.E-07 | 0.2 | miAD | lnc-PDGFA-6:6 | SEQ4378 | 3.E-03 | 0.7 |
| MCI | LINC01410:15 | SEQ5978 | 3.E-06 | 0.2 | All AD | lnc-PDGFA-6:6 | SEQ4378 | 1.E-02 | 0.7 |
| FTD | LINC01410:17 | SEQ3799 | 9.E-05 | 0.5 | DLB | lnc-PDGFB-2:1 | SEQ2826 | 5.E-04 | 1.6 |
| All AD | LINCO1410:17 | SEQ3799 | 1.E-02 | 0.6 | FTD | lnc-PDK3-1:1 | SEQ2348 | 7.E-04 | 0.7 |
| msAD | LINCO1410:17 | SEQ3799 | 4.E-02 | 0.7 | All AD | lnc-PDK3-1:1 | SEQ2348 | 3.E-02 | 0.8 |
| DLB | LINC01465:1 | SEQ4432 | 1.E-04 | 1.8 | FTD | lnc-PDS5B-2:1 | SEQ5392 | 5.E-06 | 0.6 |
| FTD | LINC01465:1 | SEQ4432 | 6.E-04 | 1.6 | All AD | lnc-PDS5B-2:1 | SEQ5392 | 3.E-02 | 0.8 |
| MCI | LINC01465:1 | SEQ4432 | 2.E-03 | 1.5 | FTD | lnc-PDSS1-4:1 | SEQ5363 | 1.E-08 | 0.5 |
| FTD | LINC01481:13 | SEQ5902 | 1.E-08 | 0.1 | MCI | lnc-PDSS1-4:1 | SEQ5363 | 2.E-06 | 0.5 |
| MCI | LINC01481:13 | SEQ5902 | 2.E-05 | 0.1 | miAD | lnc-PDSS1-4:1 | SEQ5363 | 4.E-04 | 0.7 |
| FTD | LINC01481:8 | SEQ0478 | 4.E-06 | 0.5 | All AD | lnc-PDSS1-4:1 | SEQ5363 | 4.E-03 | 0.7 |
| All AD | LINC01550:1 | SEQ3981 | 4.E-02 | 1.3 | FTD | lnc-PDSS1-6:1 | SEQ4152 | 2.E-07 | 0.5 |
| MCI | LINC01550:11 | SEQ5742 | 9.E-05 | 3.5 | miAD | lnc-PDSS1-6:1 | SEQ4152 | 1.E-02 | 0.6 |
| FTD | LINC01578:13 | SEQ3985 | 6.E-09 | 0.4 | FTD | lnc-PDSS1-7:1 | SEQ3851 | 2.E-04 | 0.6 |
| MCI | LINC01578:13 | SEQ3985 | 4.E-05 | 0.4 | miAD | lnc-PDSS1-7:1 | SEQ3851 | 7.E-03 | 0.7 |
| miAD | LINC01578:13 | SEQ3985 | 8.E-04 | 0.6 | All AD | lnc-PDSS1-7:1 | SEQ3851 | 8.E-03 | 0.7 |
| DLB | LINC01578:13 | SEQ3985 | 1.E-03 | 0.6 | msAD | lnc-PDSS1-7:1 | SEQ3851 | 3.E-02 | 0.7 |
| All AD | LINC01578:13 | SEQ3985 | 8.E-03 | 0.6 | FTD | lnc-PDSS1-9:1 | SEQ3667 | 4.E-05 | 0.7 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| FTD | LINC01578:2 | SEQ3987 | 2.E-04 | 0.6 | All AD | lnc-PDSS1-9:1 | SEQ3667 | 2.E-02 | 0.8 |
| All AD | LINC01578:2 | SEQ3987 | 3.E-02 | 0.7 | msAD | lnc-PDSS1-9:1 | SEQ3667 | 5.E-02 | 0.8 |
| DLB | LINC01623:9 | SEQ5725 | 9.E-05 | 1.4 | FTD | lnc-PDYN-1:13 | SEQ4327 | 6.E-04 | 0.6 |
| DLB | LINC01678:2 | SEQ5580 | 2.E-04 | 1.9 | miAD | lnc-PDYN-1:13 | SEQ4327 | 6.E-03 | 0.6 |
| DLB | LINC01715:4 | SEQ3256 | 1.E-05 | 0.4 | All AD | lnc-PDYN-1:13 | SEQ4327 | 2.E-02 | 0.7 |
| MCI | LINC01715:4 | SEQ3256 | 5.E-04 | 0.3 | miAD | lnc-PDYN-1:16 | SEQ4111 | 1.E-02 | 0.7 |
| DLB | LINC01762:6 | SEQ5671 | 1.E-04 | 1.7 | All AD | lnc-PDYN-1:16 | SEQ4111 | 3.E-02 | 0.7 |
| DLB | LINC01762:7 | SEQ5670 | 1.E-04 | 1.7 | All AD | lnc-PDYN-1:9 | SEQ3089 | 5.E-02 | 0.7 |
| FTD | LINC01814:4 | SEQ3869 | 9.E-04 | 0.7 | DLB | lnc-PDZD2-1:1 | SEQ3861 | 8.E-05 | 1.5 |
| miAD | LINC01814:4 | SEQ3869 | 2.E-03 | 0.6 | All AD | lnc-PDZD2-1:1 | SEQ3861 | 2.E-02 | 1.2 |
| All AD | LINC01814:4 | SEQ3869 | 4.E-03 | 0.7 | msAD | lnc-PDZD2-1:1 | SEQ3861 | 3.E-02 | 1.2 |
| msAD | LINC01814:4 | SEQ3869 | 3.E-02 | 0.8 | DLB | lnc-PEA15-1:2 | SEQ4931 | 8.E-04 | 1.4 |
| MCI | LINC01891:2 | SEQ4455 | 2.E-03 | 1.8 | DLB | lnc-PEBP4-1:3 | SEQ4055 | 2.E-04 | 1.4 |
| All AD | LINC02035:2 | SEQ3993 | 6.E-03 | 0.8 | msAD | lnc-PEBP4-1:3 | SEQ4055 | 2.E-02 | 1.2 |
| miAD | LINC02035:2 | SEQ3993 | 1.E-02 | 0.8 | MCI | lnc-PELP1-2:1 | SEQ5134 | 6.E-04 | 1.7 |
| msAD | LINC02035:2 | SEQ3993 | 2.E-02 | 0.8 | DLB | lnc-PER2-5:1 | SEQ5695 | 1.E-04 | 1.6 |
| msAD | LINC02035:4 | SEQ3780 | 4.E-02 | 1.3 | DLB | lnc-PEX11G-3:1 | SEQ5315 | 9.E-06 | 1.6 |
| FTD | LINC02062:11 | SEQ5912 | 2.E-05 | 0.5 | FTD | lnc-PEX11G-3:1 | SEQ5315 | 3.E-04 | 1.4 |
| FTD | LINC02062:12 | SEQ3998 | 8.E-05 | 0.6 | MCI | lnc-PEX11G-3:1 | SEQ5315 | 4.E-04 | 1.5 |
| miAD | LINC02062:12 | SEQ3998 | 9.E-03 | 0.7 | DLB | lnc-PEX11G-4:3 | SEQ5281 | 2.E-05 | 2.0 |
| All AD | LINC02062:12 | SEQ3998 | 2.E-02 | 0.7 | MCI | lnc-PEX11G-4:3 | SEQ5281 | 5.E-04 | 1.9 |
| miAD | LINC02068:5 | SEQ4145 | 1.E-02 | 0.6 | DLB | lnc-PEX6-1:1 | SEQ2942 | 6.E-05 | 1.6 |
| All AD | LINC02100:2 | SEQ4000 | 3.E-02 | 0.7 | FTD | lnc-PEX6-3:1 | SEQ5896 | 2.E-06 | 1.7 |
| FTD | LINC02100:8 | SEQ5150 | 5.E-04 | 0.6 | DLB | lnc-PEX6-3:1 | SEQ5896 | 4.E-06 | 1.8 |
| MCI | LINC02288:2 | SEQ5435 | 3.E-04 | 1.5 | MCI | lnc-PEX6-3:1 | SEQ5896 | 2.E-05 | 1.8 |
| MCI | LINC02288:4 | SEQ4002 | 2.E-05 | 2.1 | All AD | lnc-PEX7-1:4 | SEQ5402 | 3.E-02 | 0.8 |
| FTD | LINC02288:4 | SEQ4002 | 2.E-04 | 1.7 | FTD | lnc-PEX7-1:7 | SEQ5606 | 2.E-04 | 0.7 |
| DLB | LINC02288:4 | SEQ4002 | 5.E-04 | 1.8 | All AD | lnc-PEX7-4:1 | SEQ3855 | 1.E-02 | 0.8 |
| All AD | LINC02288:4 | SEQ4002 | 2.E-02 | 1.2 | msAD | lnc-PEX7-4:1 | SEQ3855 | 3.E-02 | 0.8 |
| FTD | LINC02328:9 | SEQ4007 | 3.E-05 | 0.5 | FTD | lnc-PFDN4-11:2 | SEQ5086 | 6.E-04 | 0.6 |
| All AD | LINC02328:9 | SEQ4007 | 1.E-02 | 0.7 | All AD | lnc-PFDN4-11:2 | SEQ5086 | 2.E-02 | 0.7 |
| msAD | LINC02328:9 | SEQ4007 | 1.E-02 | 0.7 | MCI | lnc-PFDN6-2:3 | SEQ3468 | 1.E-07 | 2.5 |
| MCI | LINC02361:3 | SEQ4009 | 2.E-04 | 1.7 | FTD | lnc-PFDN6-2:3 | SEQ3468 | 2.E-07 | 2.0 |
| All AD | LINC02361:3 | SEQ4009 | 3.E-02 | 1.2 | DLB | lnc-PFDN6-2:3 | SEQ3468 | 4.E-06 | 2.4 |
| miAD | LINC02362:13 | SEQ4012 | 1.E-02 | 0.6 | miAD | lnc-PFDN6-2:3 | SEQ3468 | 1.E-03 | 1.3 |
| All AD | LINC02362:13 | SEQ4012 | 2.E-02 | 0.7 | All AD | lnc-PFDN6-2:3 | SEQ3468 | 5.E-03 | 1.2 |
| miAD | LINC02362:14 | SEQ4014 | 1.E-02 | 0.6 | All AD | lnc-PFKFB3-3:5 | SEQ5408 | 5.E-02 | 0.7 |
| All AD | LINC02362:14 | SEQ4014 | 2.E-02 | 0.7 | DLB | lnc-PGAM2-1:1 | SEQ2909 | 6.E-04 | 1.5 |
| FTD | LINC02362:17 | SEQ4825 | 6.E-06 | 0.4 | FTD | lnc-PGAP1-2:1 | SEQ4147 | 1.E-09 | 0.4 |
| MCI | LINC02362:17 | SEQ4825 | 3.E-04 | 0.5 | MCI | lnc-PGAP1-2:1 | SEQ4147 | 4.E-05 | 0.5 |
| DLB | LINC02362:17 | SEQ4825 | 9.E-04 | 0.5 | miAD | lnc-PGAP1-2:1 | SEQ4147 | 1.E-02 | 0.6 |
| miAD | LINC02363:2 | SEQ4017 | 1.E-02 | 0.7 | All AD | lnc-PGAP1-2:1 | SEQ4147 | 2.E-02 | 0.7 |
| All AD | LINC02363:2 | SEQ4017 | 3.E-02 | 0.8 | DLB | lnc-PGBD5-1:1 | SEQ2755 | 4.E-04 | 1.5 |
| miAD | LINC02363:6 | SEQ4019 | 7.E-03 | 0.6 | FTD | lnc-PGGT1B-1:1 | SEQ5999 | 3.E-07 | 0.2 |
| All AD | LINC02363:6 | SEQ4019 | 3.E-02 | 0.7 | FTD | lnc-PGM1-1:1 | SEQ5646 | 1.E-04 | 0.6 |
| All AD | LINC02384:5 | SEQ4020 | 3.E-02 | 0.6 | DLB | lnc-PHB2-2:1 | SEQ4561 | 2.E-03 | 1.4 |
| All AD | LINC02397:10 | SEQ3328 | 3.E-02 | 1.5 | All AD | lnc-PHB2-4:3 | SEQ5414 | 3.E-02 | 1.3 |
| msAD | LINC02397:10 | SEQ3328 | 4.E-02 | 1.5 | FTD | lnc-PHF20L1-6:1 | SEQ4316 | 1.E-08 | 0.4 |
| msAD | LINC02397:15 | SEQ3901 | 3.E-02 | 1.5 | MCI | lnc-PHF20L1-6:1 | SEQ4316 | 6.E-05 | 0.5 |
| All AD | LINC02397:15 | SEQ3901 | 4.E-02 | 1.4 | miAD | lnc-PHF20L1-6:1 | SEQ4316 | 6.E-03 | 0.6 |
| FTD | LINC02422:5 | SEQ4022 | 6.E-05 | 0.7 | All AD | lnc-PHF20L1-6:1 | SEQ4316 | 1.E-02 | 0.6 |
| All AD | LINC02422:5 | SEQ4022 | 5.E-02 | 0.8 | FTD | lnc-PHLDA1-1:2 | SEQ5221 | 5.E-04 | 0.4 |
| miAD | LINC02471:3 | SEQ3866 | 2.E-03 | 0.6 | DLB | lnc-PHYHD1-1:1 | SEQ3086 | 8.E-05 | 1.7 |
| All AD | LINC02471:3 | SEQ3866 | 4.E-03 | 0.6 | All AD | lnc-PIGBOS1-2:1 | SEQ5417 | 3.E-02 | 0.8 |
| msAD | LINC02471:3 | SEQ3866 | 3.E-02 | 0.7 | All AD | lnc-PIGBOS1-3:1 | SEQ5418 | 4.E-02 | 0.8 |
| MCI | LINC02482:12 | SEQ3880 | 6.E-05 | 2.0 | FTD | lnc-PIGBOS1-4:1 | SEQ5062 | 7.E-04 | 0.6 |
| All AD | LINC02482:12 | SEQ3880 | 1.E-02 | 1.3 | FTD | lnc-PIGBOS1-5:1 | SEQ5546 | 2.E-04 | 0.6 |
| msAD | LINC02482:12 | SEQ3880 | 3.E-02 | 1.4 | msAD | lnc-PIGN-7:3 | SEQ4342 | 5.E-03 | 0.6 |
| FTD | LINC-PINT:10 | SEQ4029 | 4.E-04 | 0.7 | All AD | lnc-PIGN-7:3 | SEQ4342 | 8.E-03 | 0.6 |
| miAD | LINC-PINT:10 | SEQ4029 | 1.E-02 | 0.8 | FTD | lnc-PIK3AP1-2:1 | SEQ5136 | 5.E-04 | 1.6 |
| All AD | LINC-PINT:10 | SEQ4029 | 2.E-02 | 0.8 | MCI | lnc-PIK3AP1-2:1 | SEQ5136 | 6.E-04 | 1.7 |
| DLB | LINC-PINT:11 | SEQ5167 | 3.E-06 | 5.E-02 | All AD | lnc-PIK3AP1-2:1 | SEQ5136 | 4.E-02 | 1.2 |
| FTD | LINC-PINT:11 | SEQ5167 | 2.E-04 | 0.1 | miAD | lnc-PIK3IP1-2:1 | SEQ4299 | 7.E-03 | 0.7 |
| MCI | LINC-PINT:11 | SEQ5167 | 5.E-04 | 4.E-02 | All AD | lnc-PIK3IP1-2:1 | SEQ4299 | 1.E-02 | 0.7 |
| FTD | LINC-PINT:16 | SEQ2192 | 7.E-02 | 0.6 | MCI | lnc-PILRB-1:5 | SEQ3009 | 2.E-03 | 1.8 |
| FTD | LINC-PINT:25 | SEQ5971 | 4.E-08 | 0.2 | DLB | lnc-PILRB-1:5 | SEQ3009 | 3.E-04 | 1.7 |
| MCI | LINC-PINT:25 | SEQ5971 | 3.E-06 | 0.3 | FTD | lnc-PINK1-2:1 | SEQ2734 | 1.E-10 | 0.3 |
| All AD | LINC-PINT:33 | SEQ4036 | 1.E-02 | 0.7 | MCI | lnc-PINK1-2:1 | SEQ2734 | 3.E-05 | 0.3 |
| msAD | LINC-PINT:33 | SEQ4036 | 1.E-02 | 0.7 | DLB | lnc-PINK1-2:1 | SEQ2734 | 1.E-03 | 0.4 |
| MCI | LINC-PINT:36 | SEQ5836 | 4.E-05 | 0.1 | DLB | lnc-PKHD1-2:3 | SEQ4646 | 1.E-03 | 1.6 |
| FTD | LINC-PINT:39 | SEQ4999 | 8.E-04 | 0.7 | DLB | lnc-PKHD1-6:1 | SEQ4967 | 8.E-04 | 1.6 |
| DLB | LINC-PINT:4 | SEQ5555 | 2.E-04 | 0.2 | msAD | lnc-PKN2-5:1 | SEQ4089 | 1.E-02 | 0.7 |
| miAD | LINC-PINT:46 | SEQ4040 | 2.E-03 | 1.4 | FTD | lnc-PLA2G15-1:2 | SEQ3907 | 1.E-04 | 2.4 |
| All AD | LINC-PINT:46 | SEQ4040 | 7.E-03 | 1.3 | MCI | lnc-PLA2G15-1:2 | SEQ3907 | 2.E-04 | 2.3 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| FTD | LINC-PINT:70 | SEQ4033 | 3.E-07 | 0.2 | DLB | lnc-PLA2G15-1:2 | SEQ3907 | 2.E-03 | 2.1 |
| MCI | LINC-PINT:70 | SEQ4033 | 4.E-06 | 0.1 | msAD | lnc-PLA2G15-1:2 | SEQ3907 | 3.E-02 | 1.4 |
| msAD | LINC-PINT:70 | SEQ4033 | 2.E-02 | 0.3 | All AD | lnc-PLA2G15-1:2 | SEQ3907 | 5.E-02 | 1.3 |
| All AD | LINC-PINT:70 | SEQ4033 | 2.E-02 | 0.3 | DLB | lnc-PLA2G15-2:2 | SEQ3565 | 2.E-03 | 1.5 |
| FTD | LINC-PINT:71 | SEQ3665 | 7.E-06 | 0.6 | DLB | lnc-PLA2G6-1:2 | SEQ2971 | 2.E-04 | 1.6 |
| All AD | LINC-PINT:71 | SEQ3665 | 3.E-02 | 0.7 | MCI | lnc-PLA2G6-1:2 | SEQ2971 | 2.E-03 | 1.5 |
| msAD | LINC-PINT:71 | SEQ3665 | 5.E-02 | 0.8 | All AD | lnc-PLAGL2-6:1 | SEQ5429 | 5.E-02 | 0.8 |
| FTD | LINC-PINT:77 | SEQ4909 | 9.E-04 | 0.7 | DLB | lnc-PLCB1-1:7 | SEQ5490 | 7.E-07 | 1.8 |
| DLB | LIPE-AS1:16 | SEQ3727 | 6.E-05 | 2.0 | MCI | lnc-PLCB1-1:7 | SEQ5490 | 2.E-04 | 1.6 |
| MCI | LIPE-AS1:16 | SEQ3727 | 9.E-04 | 1.7 | DLB | lnc-PLCD3-4:4 | SEQ4841 | 9.E-04 | 1.4 |
| All AD | LIPE-AS1:16 | SEQ3727 | 3.E-02 | 1.2 | FTD | lnc-PLCD3-4:7 | SEQ5433 | 6.E-05 | 0.5 |
| msAD | LIPE-AS1:16 | SEQ3727 | 4.E-02 | 1.2 | All AD | lnc-PLCD3-4:7 | SEQ5433 | 4.E-02 | 0.6 |
| All AD | LMNB1-DT:3 | SEQ4051 | 5.E-03 | 1.3 | FTD | lnc-PLCG1-2:1 | SEQ5645 | 1.E-04 | 0.6 |
| miAD | LMNB1-DT:3 | SEQ4051 | 1.E-02 | 1.3 | FTD | lnc-PLEKHB2-4:3 | SEQ2327 | 1.E-05 | 0.6 |
| msAD | LMNB1-DT:3 | SEQ4051 | 1.E-02 | 1.3 | MCI | lnc-PLEKHB2-4:3 | SEQ2327 | 4.E-05 | 0.6 |
| DLB | lnc-A1BG-1:8 | SEQ4706 | 1.E-03 | 1.5 | FTD | lnc-PLEKHD1-4:1 | SEQ5353 | 4.E-04 | 0.6 |
| FTD | lnc-ABCA5-7:1 | SEQ0014 | 1.E-05 | 0.6 | All AD | lnc-PLEKHD1-4:1 | SEQ5353 | 4.E-02 | 0.7 |
| All AD | lnc-ABCA5-7:1 | SEQ0014 | 5.E-02 | 0.8 | DLB | lnc-PLEKHH2-4:1 | SEQ4483 | 2.E-03 | 1.3 |
| DLB | lnc-ABCC5-3:1 | SEQ3281 | 3.E-04 | 1.5 | DLB | lnc-PLEKHH2-4:2 | SEQ4482 | 2.E-03 | 1.3 |
| FTD | lnc-ABCC5-3:4 | SEQ3282 | 5.E-05 | 1.8 | DLB | lnc-PLPP2-5:5 | SEQ5632 | 2.E-04 | 1.8 |
| MCI | lnc-ABCC5-3:4 | SEQ3282 | 5.E-05 | 1.9 | FTD | lnc-PLPPR5-4:1 | SEQ5684 | 1.E-04 | 0.5 |
| DLB | lnc-ABCC5-3:4 | SEQ3282 | 2.E-03 | 1.7 | FTD | lnc-PLSCR2-2:1 | SEQ0964 | 2.E-05 | 0.5 |
| All AD | lnc-ABCC5-3:4 | SEQ3282 | 2.E-02 | 1.3 | All AD | lnc-PLSCR2-2:1 | SEQ0964 | 7.E-03 | 0.6 |
| DLB | lnc-ABCC6-11:1 | SEQ2717 | 2.E-03 | 1.4 | miAD | lnc-PLSCR2-2:1 | SEQ0964 | 8.E-03 | 0.6 |
| MCI | lnc-ABCF2-2:1 | SEQ5473 | 3.E-06 | 1.6 | msAD | lnc-PLSCR2-2:1 | SEQ0964 | 2.E-02 | 0.6 |
| DLB | lnc-ABCF2-2:1 | SEQ5473 | 2.E-05 | 1.6 | FTD | lnc-PLXND1-1:1 | SEQ5223 | 5.E-04 | 0.5 |
| FTD | lnc-ABCF2-2:1 | SEQ5473 | 3.E-04 | 1.4 | FTD | lnc-PLXND1-3:1 | SEQ5715 | 1.E-04 | 0.5 |
| miAD | lnc-ABHD12B-2:1 | SEQ4060 | 4.E-03 | 0.7 | FTD | lnc-PLXND1-3:2 | SEQ3703 | 3.E-10 | 0.3 |
| All AD | lnc-ABHD12B-2:1 | SEQ4060 | 8.E-03 | 0.7 | MCI | lnc-PLXND1-3:2 | SEQ3703 | 4.E-05 | 0.5 |
| msAD | lnc-ABTB1-2:1 | SEQ3881 | 3.E-02 | 1.4 | All AD | lnc-PLXND1-3:2 | SEQ3703 | 2.E-02 | 0.5 |
| All AD | lnc-ABTB1-2:1 | SEQ3881 | 5.E-02 | 1.3 | msAD | lnc-PLXND1-3:2 | SEQ3703 | 5.E-02 | 0.6 |
| MCI | lnc-ABTB2-4:1 | SEQ4062 | 6.E-06 | 1.6 | DLB | lnc-PMM2-2:1 | SEQ3482 | 6.E-04 | 1.5 |
| DLB | lnc-ABTB2-4:1 | SEQ4062 | 2.E-05 | 1.6 | DLB | lnc-PMM2-6:1 | SEQ4792 | 1.E-03 | 2.0 |
| FTD | lnc-ABTB2-4:1 | SEQ4062 | 1.E-04 | 1.4 | FTD | lnc-PMM2-6:3 | SEQ5443 | 2.E-09 | 0.2 |
| All AD | lnc-ABTB2-4:1 | SEQ4062 | 8.E-03 | 1.2 | DLB | lnc-PMM2-6:3 | SEQ5443 | 1.E-06 | 0.2 |
| msAD | lnc-ABTB2-4:1 | SEQ4062 | 1.E-02 | 1.2 | MCI | lnc-PMM2-6:3 | SEQ5443 | 3.E-06 | 0.2 |
| DLB | lnc-ACBD6-2:1 | SEQ5444 | 3.E-04 | 1.6 | All AD | lnc-PMM2-6:3 | SEQ5443 | 4.E-02 | 0.4 |
| msAD | lnc-ACO1-1:1 | SEQ0590 | 9.E-03 | 0.7 | FTD | lnc-PNMA2-1:1 | SEQ5162 | 5.E-04 | 0.7 |
| All AD | lnc-ACO1-1:1 | SEQ0590 | 1.E-02 | 0.7 | FTD | lnc-PNO1-1:1 | SEQ4348 | 9.E-10 | 0.4 |
| FTD | lnc-ACTA2-1:1 | SEQ5550 | 2.E-04 | 0.6 | MCI | lnc-PNO1-1:1 | SEQ4348 | 5.E-05 | 0.5 |
| DLB | lnc-ACTR2-11:1 | SEQ3921 | 6.E-06 | 1.6 | All AD | lnc-PNO1-1:1 | SEQ4348 | 1.E-03 | 0.6 |
| msAD | lnc-ACTR2-11:1 | SEQ3921 | 3.E-02 | 1.1 | miAD | lnc-PNO1-1:1 | SEQ4348 | 3.E-03 | 0.6 |
| All AD | lnc-ACTR2-11:1 | SEQ3921 | 3.E-02 | 1.1 | msAD | lnc-PNO1-1:1 | SEQ4348 | 5.E-03 | 0.7 |
| All AD | lnc-ACTR3-2:1 | SEQ4067 | 5.E-02 | 0.8 | miAD | lnc-PNOC-2:1 | SEQ2817 | 9.E-03 | 1.3 |
| miAD | lnc-ACTR6-4:1 | SEQ4069 | 8.E-03 | 0.7 | All AD | lnc-PNOC-2:1 | SEQ2817 | 1.E-02 | 1.2 |
| All AD | lnc-ACTR6-4:1 | SEQ4069 | 1.E-02 | 0.7 | FTD | lnc-POC5-4:2 | SEQ5161 | 5.E-04 | 0.7 |
| FTD | lnc-ACTRT3-2:5 | SEQ3699 | 6.E-04 | 1.7 | All AD | lnc-POLD3-2:1 | SEQ5447 | 5.E-02 | 0.9 |
| All AD | lnc-ACTRT3-2:5 | SEQ3699 | 2.E-02 | 1.3 | DLB | lnc-POLR2J2-2:1 | SEQ5533 | 2.E-04 | 1.8 |
| msAD | lnc-ACTRT3-2:5 | SEQ3699 | 5.E-02 | 1.2 | MCI | lnc-POLR2J2-2:1 | SEQ5533 | 2.E-04 | 1.7 |
| All AD | lnc-ACTRT3-5:1 | SEQ2741 | 5.E-02 | 1.2 | DLB | lnc-POLR3E-3:4 | SEQ3547 | 1.E-03 | 1.5 |
| All AD | lnc-ACY1-2:1 | SEQ4071 | 2.E-02 | 1.2 | DLB | lnc-POLR3GL-10:1 | SEQ4515 | 2.E-03 | 1.5 |
| FTD | lnc-ADAD1-3:1 | SEQ0774 | 9.E-10 | 0.4 | msAD | lnc-POLR3GL-6:4 | SEQ3974 | 2.E-02 | 1.5 |
| MCI | lnc-ADAD1-3:1 | SEQ0774 | 3.E-06 | 0.4 | DLB | lnc-POLR3K-1:7 | SEQ4703 | 1.E-03 | 1.5 |
| miAD | lnc-ADAD1-3:1 | SEQ0774 | 2.E-04 | 0.5 | DLB | lnc-POLR3K-1:9 | SEQ4481 | 2.E-03 | 1.3 |
| All AD | lnc-ADAD1-3:1 | SEQ0774 | 3.E-04 | 0.6 | All AD | lnc-POTEH-1:1 | SEQ4048 | 1.E-02 | 1.2 |
| msAD | lnc-ADAD1-3:1 | SEQ0774 | 3.E-03 | 0.6 | msAD | lnc-POTEH-1:1 | SEQ4048 | 2.E-02 | 1.2 |
| FTD | lnc-ADAM22-2:10 | SEQ4076 | 6.E-05 | 0.5 | FTD | lnc-POU5F2-5:1 | SEQ5608 | 2.E-04 | 0.7 |
| miAD | lnc-ADAM22-2:10 | SEQ4076 | 1.E-02 | 0.6 | DLB | lnc-PPARA-3:11 | SEQ5621 | 2.E-04 | 1.6 |
| All AD | lnc-ADAM22-2:10 | SEQ4076 | 2.E-03 | 0.6 | MCI | lnc-PPARA-3:8 | SEQ2854 | 2.E-03 | 1.5 |
| msAD | lnc-ADAM22-2:10 | SEQ4076 | 1.E-02 | 0.6 | DLB | lnc-PPARA-4:1 | SEQ4739 | 1.E-03 | 1.4 |
| FTD | lnc-ADAM22-2:13 | SEQ4079 | 3.E-04 | 0.6 | miAD | lnc-PPEF1-7:4 | SEQ4078 | 1.E-02 | 0.8 |
| miAD | lnc-ADAM22-2:13 | SEQ4079 | 2.E-03 | 0.5 | All AD | lnc-PPEF1-7:4 | SEQ4078 | 3.E-02 | 0.8 |
| All AD | lnc-ADAM22-2:13 | SEQ4079 | 2.E-03 | 0.6 | DLB | lnc-PPIAL4D-5:15 | SEQ5493 | 2.E-04 | 1.6 |
| msAD | lnc-ADAM22-2:13 | SEQ4079 | 1.E-02 | 0.6 | MCI | lnc-PPIAL4D-5:4 | SEQ3660 | 7.E-04 | 2.6 |
| miAD | lnc-ADAM30-1:1 | SEQ2698 | 1.E-02 | 0.7 | DLB | lnc-PPIAL4D-5:4 | SEQ3660 | 1.E-03 | 2.1 |
| All AD | lnc-ADAM30-1:1 | SEQ2698 | 2.E-02 | 0.7 | All AD | lnc-PPIAL4D-5:4 | SEQ3660 | 4.E-02 | 1.5 |
| DLB | lnc-ADAMTS12-2:6 | SEQ4081 | 1.E-03 | 1.8 | msAD | lnc-PPIAL4D-5:4 | SEQ3660 | 5.E-02 | 1.5 |
| MCI | lnc-ADAMTS12-2:6 | SEQ4081 | 1.E-03 | 1.7 | miAD | lnc-PPIAL4F-3:2 | SEQ0828 | 5.E-03 | 0.6 |
| All AD | lnc-ADAMTS12-2:6 | SEQ4081 | 3.E-02 | 1.2 | All AD | lnc-PPIAL4F-3:2 | SEQ0828 | 8.E-03 | 0.5 |
| miAD | lnc-ADAMTSL4-4:1 | SEQ3903 | 6.E-03 | 0.6 | msAD | lnc-PPIAL4F-3:2 | SEQ0828 | 2.E-02 | 0.5 |
| All AD | lnc-ADAMTSL4-4:1 | SEQ3903 | 6.E-03 | 0.7 | miAD | lnc-PPIAL4F-3:3 | SEQ3932 | 5.E-03 | 0.6 |
| msAD | lnc-ADAMTSL4-4:1 | SEQ3903 | 3.E-02 | 0.7 | All AD | lnc-PPIAL4F-3:3 | SEQ3932 | 6.E-03 | 0.5 |
| DLB | lnc-ADAMTSL4-7:2 | SEQ4676 | 1.E-03 | 1.3 | msAD | lnc-PPIAL4F-3:3 | SEQ3932 | 3.E-02 | 0.5 |
| miAD | lnc-ADAP2-1:1 | SEQ4086 | 1.E-02 | 0.7 | miAD | lnc-PPIAL4F-6:13 | SEQ4192 | 1.E-02 | 0.8 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| All AD | lnc-ADAP2-1:1 | SEQ4086 | 3.E−02 | 0.8 | All AD | lnc-PPIAL4F-6:13 | SEQ4192 | 3.E−02 | 0.8 |
| msAD | lnc-ADGRL4-6:1 | SEQ3810 | 4.E−02 | 0.6 | msAD | lnc-PPIAL4G-11:1 | SEQ3641 | 3.E−02 | 0.9 |
| FTD | lnc-ADGRV1-6:1 | SEQ4088 | 1.E−04 | 0.6 | FTD | lnc-PPIAL4G-3:5 | SEQ3650 | 3.E−04 | 0.6 |
| All AD | lnc-ADGRV1-6:1 | SEQ4088 | 4.E−02 | 0.7 | All AD | lnc-PPIAL4G-3:5 | SEQ3650 | 2.E−02 | 0.7 |
| FTD | lnc-ADGRV1-8:1 | SEQ4091 | 2.E−05 | 0.5 | msAD | lnc-PPIAL4G-3:5 | SEQ3650 | 5.E−02 | 0.8 |
| MCI | lnc-ADGRV1-8:1 | SEQ4091 | 1.E−03 | 0.6 | DLB | lnc-PPIL2-1:4 | SEQ4551 | 2.E−03 | 1.3 |
| All AD | lnc-ADGRV1-8:1 | SEQ4091 | 2.E−02 | 0.7 | DLB | lnc-PPIL4-9:1 | SEQ4781 | 1.E−03 | 1.7 |
| FTD | lnc-ADH5-6:1 | SEQ5409 | 3.E−04 | 0.6 | MCI | lnc-PPP1R10-1:3 | SEQ4826 | 2.E−06 | 0.6 |
| DLB | lnc-ADIPOQ-3:2 | SEQ4093 | 1.E−03 | 1.8 | FTD | lnc-PPP1R10-1:3 | SEQ4826 | 2.E−06 | 0.6 |
| All AD | lnc-ADIPOQ-3:2 | SEQ4093 | 5.E−02 | 1.2 | DLB | lnc-PPP1R10-1:3 | SEQ4826 | 9.E−04 | 0.6 |
| DLB | lnc-ADIPOQ-3:3 | SEQ5336 | 4.E−04 | 1.7 | All AD | lnc-PPP1R10-1:3 | SEQ4826 | 2.E−02 | 0.8 |
| miAD | lnc-ADO-2:1 | SEQ4096 | 1.E−03 | 0.7 | DLB | lnc-PPP1R1A-2:1 | SEQ5879 | 3.E−05 | 1.6 |
| All AD | lnc-ADO-2:1 | SEQ4096 | 3.E−02 | 0.8 | DLB | lnc-PPP1R27-2:1 | SEQ4761 | 4.E−05 | 1.6 |
| FTD | lnc-ADRB1-4:1 | SEQ0118 | 1.E−03 | 0.7 | FTD | lnc-PPP1R27-2:1 | SEQ4761 | 3.E−04 | 1.4 |
| miAD | lnc-ADRB2-1:1 | SEQ4099 | 9.E−03 | 0.7 | MCI | lnc-PPP1R27-2:1 | SEQ4761 | 1.E−03 | 1.5 |
| All AD | lnc-ADRB2-1:1 | SEQ4099 | 2.E−02 | 0.8 | All AD | lnc-PPP1R27-2:1 | SEQ4761 | 5.E−02 | 1.1 |
| All AD | lnc-ADSS-4:1 | SEQ3813 | 3.E−02 | 0.8 | DLB | lnc-PPP1R3B-11:4 | SEQ5277 | 5.E−04 | 1.8 |
| msAD | lnc-ADSS-4:1 | SEQ3813 | 4.E−02 | 0.8 | DLB | lnc-PPP4C-2:7 | SEQ3530 | 2.E−04 | 1.4 |
| DLB | lnc-AEBP1-1:1 | SEQ4975 | 2.E−04 | 1.6 | MCI | lnc-PPP4C-2:7 | SEQ3530 | 3.E−04 | 1.5 |
| MCI | lnc-AEBP1-1:1 | SEQ4975 | 8.E−04 | 1.7 | DLB | lnc-PPP4R1-18:3 | SEQ5377 | 3.E−04 | 1.5 |
| DLB | lnc-AES-6:3 | SEQ4772 | 9.E−06 | 1.7 | MCI | lnc-PPP4R1-18:3 | SEQ5377 | 3.E−04 | 1.5 |
| MCI | lnc-AES-6:3 | SEQ4772 | 1.E−03 | 1.5 | DLB | lnc-PPP5D1-1:1 | SEQ2313 | 1.E−03 | 1.3 |
| DLB | lnc-AES-8:1 | SEQ4930 | 8.E−04 | 1.4 | DLB | lnc-PPP6R2-5:1 | SEQ2811 | 1.E−05 | 1.7 |
| FTD | lnc-AFG1L-5:1 | SEQ0263 | 1.E−05 | 0.5 | FTD | lnc-PPP6R2-5:1 | SEQ2811 | 1.E−03 | 1.4 |
| FTD | lnc-AFG1L-7:1 | SEQ6011 | 3.E−10 | 0.1 | MCI | lnc-PPP6R2-5:1 | SEQ2811 | 2.E−03 | 1.4 |
| miAD | lnc-AFG1L-8:1 | SEQ4107 | 9.E−03 | 0.8 | All AD | lnc-PQLC1-9:1 | SEQ5467 | 3.E−02 | 1.2 |
| All AD | lnc-AFG1L-8:1 | SEQ4107 | 2.E−02 | 0.8 | DLB | lnc-PQLC2-1:1 | SEQ5794 | 6.E−05 | 1.7 |
| DLB | lnc-AGAP2-2:1 | SEQ4693 | 5.E−04 | 1.4 | DLB | lnc-PRAME-7:1 | SEQ4053 | 5.E−05 | 2.4 |
| MCI | lnc-AGAP2-2:1 | SEQ4693 | 1.E−03 | 1.4 | All AD | lnc-PRAME-7:1 | SEQ4053 | 2.E−02 | 1.3 |
| DLB | lnc-AGAP5-6:1 | SEQ5626 | 2.E−04 | 1.7 | msAD | lnc-PRAME-7:1 | SEQ4053 | 2.E−02 | 1.4 |
| FTD | lnc-AGAP5-6:4 | SEQ4803 | 1.E−03 | 0.5 | miAD | lnc-PRCD-2:2 | SEQ4106 | 1.E−02 | 0.6 |
| FTD | lnc-AGBL1-7:1 | SEQ5809 | 6.E−05 | 0.7 | All AD | lnc-PRCD-2:2 | SEQ4106 | 3.E−02 | 0.7 |
| DLB | lnc-AGBL2-1:1 | SEQ5126 | 6.E−04 | 1.6 | FTD | lnc-PRDM14-4:1 | SEQ6009 | 2.E−09 | 0.3 |
| FTD | lnc-AGBL3-1:1 | SEQ4046 | 1.E−06 | 0.5 | All AD | lnc-PRDM7-1:2 | SEQ5472 | 5.E−02 | 0.8 |
| MCI | lnc-AGBL3-1:1 | SEQ4046 | 2.E−03 | 0.7 | FTD | lnc-PRDX6-3:1 | SEQ4997 | 8.E−04 | 0.6 |
| All AD | lnc-AGBL3-1:1 | SEQ4046 | 4.E−03 | 0.7 | All AD | lnc-PRDX6-3:1 | SEQ4997 | 4.E−02 | 0.8 |
| miAD | lnc-AGBL3-1:1 | SEQ4046 | 4.E−03 | 0.7 | DLB | lnc-PRELID1-1:1 | SEQ5613 | 2.E−04 | 1.4 |
| msAD | lnc-AGBL3-1:1 | SEQ4046 | 2.E−02 | 0.7 | DLB | lnc-PRICKLE4-1:1 | SEQ5195 | 5.E−04 | 1.6 |
| All AD | lnc-AGO1-1:1 | SEQ2752 | 5.E−02 | 0.8 | MCI | lnc-PRKCQ-3:1 | SEQ4886 | 3.E−04 | 6.5 |
| DLB | lnc-AGO2-2:2 | SEQ0119 | 2.E−04 | 1.6 | DLB | lnc-PRKCQ-3:1 | SEQ4886 | 9.E−04 | 5.0 |
| DLB | lnc-AGRP-1:13 | SEQ4599 | 2.E−03 | 1.8 | FTD | lnc-PRKD3-2:1 | SEQ5911 | 2.E−05 | 0.5 |
| MCI | lnc-AGRP-1:8 | SEQ5330 | 9.E−05 | 1.6 | FTD | lnc-PRKN-4:1 | SEQ3854 | 4.E−05 | 0.6 |
| DLB | lnc-AGRP-1:8 | SEQ5330 | 4.E−04 | 1.6 | All AD | lnc-PRKN-4:1 | SEQ3854 | 1.E−02 | 0.8 |
| DLB | lnc-AHNAK2-1:1 | SEQ5698 | 1.E−04 | 1.6 | msAD | lnc-PRKN-4:1 | SEQ3854 | 3.E−02 | 0.8 |
| FTD | lnc-AHSA2-2:1 | SEQ5800 | 6.E−05 | 0.6 | FTD | lnc-PRLHR-2:1 | SEQ3635 | 3.E−07 | 0.6 |
| FTD | lnc-AHSA2-5:6 | SEQ3332 | 2.E−09 | 3.E−02 | miAD | lnc-PRLHR-2:1 | SEQ3635 | 1.E−02 | 0.7 |
| MCI | lnc-AHSA2-5:6 | SEQ3332 | 9.E−06 | 2.E−02 | All AD | lnc-PRLHR-2:1 | SEQ3635 | 1.E−02 | 0.7 |
| DLB | lnc-AHSA2-5:6 | SEQ3332 | 2.E−04 | 3.E−02 | msAD | lnc-PRLHR-2:1 | SEQ3635 | 5.E−02 | 0.8 |
| FTD | lnc-AIDA-2:1 | SEQ4124 | 3.E−04 | 0.7 | FTD | lnc-PRPF4B-1:1 | SEQ5654 | 5.E−07 | 0.5 |
| miAD | lnc-AIDA-2:1 | SEQ4124 | 8.E−03 | 0.8 | MCI | lnc-PRPF4B-1:1 | SEQ5654 | 1.E−04 | 0.6 |
| All AD | lnc-AIDA-2:1 | SEQ4124 | 2.E−02 | 0.8 | DLB | lnc-PRR14-1:7 | SEQ5531 | 2.E−04 | 1.6 |
| All AD | lnc-AIM2-3:2 | SEQ4125 | 5.E−02 | 0.8 | DLB | lnc-PRRG2-1:1 | SEQ4499 | 8.E−04 | 1.5 |
| FTD | lnc-AIM2-3:3 | SEQ3333 | 7.E−05 | 0.6 | MCI | lnc-PRRG2-1:1 | SEQ4499 | 2.E−03 | 1.4 |
| All AD | lnc-AIM2-3:3 | SEQ3333 | 4.E−03 | 0.7 | DLB | lnc-PRSS2-5:1 | SEQ5208 | 3.E−04 | 1.9 |
| miAD | lnc-AIM2-3:3 | SEQ3333 | 5.E−03 | 0.7 | MCI | lnc-PRSS2-5:1 | SEQ5208 | 5.E−04 | 1.8 |
| msAD | lnc-AIM2-3:3 | SEQ3333 | 2.E−02 | 0.7 | All AD | lnc-PRSS2-5:1 | SEQ5208 | 3.E−02 | 1.2 |
| All AD | lnc-AIM2-3:4 | SEQ4128 | 4.E−02 | 0.7 | DLB | lnc-PRSS27-2:20 | SEQ5557 | 1.E−03 | 1.3 |
| FTD | lnc-AIM2-3:5 | SEQ4130 | 5.E−05 | 0.6 | DLB | lnc-PRSS27-4:12 | SEQ5703 | 1.E−04 | 1.7 |
| All AD | lnc-AIM2-3:5 | SEQ4130 | 2.E−03 | 0.7 | DLB | lnc-PRSS27-4:14 | SEQ5216 | 5.E−04 | 2.0 |
| miAD | lnc-AIM2-3:5 | SEQ4130 | 2.E−03 | 0.7 | FTD | lnc-PRSS27-4:24 | SEQ2168 | 8.E−09 | 0.1 |
| msAD | lnc-AIM2-3:5 | SEQ4130 | 9.E−03 | 0.7 | MCI | lnc-PRSS27-4:24 | SEQ2168 | 3.E−08 | 0.1 |
| All AD | lnc-AK4-2:1 | SEQ3741 | 2.E−02 | 0.7 | All AD | lnc-PRSS27-4:24 | SEQ2168 | 4.E−04 | 0.1 |
| msAD | lnc-AK4-2:1 | SEQ3741 | 4.E−02 | 0.8 | DLB | lnc-PRSS27-4:6 | SEQ4532 | 2.E−03 | 1.9 |
| FTD | lnc-AK7-6:1 | SEQ4134 | 2.E−06 | 0.5 | DLB | lnc-PSMA7-1:1 | SEQ5951 | 7.E−06 | 1.9 |
| MCI | lnc-AK7-6:1 | SEQ4134 | 9.E−04 | 0.6 | DLB | lnc-PSMB1-1:1 | SEQ4416 | 2.E−03 | 1.4 |
| miAD | lnc-AK7-6:1 | SEQ4134 | 4.E−03 | 0.7 | DLB | lnc-PSMB7-2:1 | SEQ5622 | 2.E−04 | 1.6 |
| All AD | lnc-AK7-6:1 | SEQ4134 | 2.E−02 | 0.7 | DLB | lnc-PSMB9-6:3 | SEQ5503 | 2.E−04 | 2.9 |
| FTD | lnc-AKAP11-1:1 | SEQ5677 | 1.E−04 | 0.4 | DLB | lnc-PSMC3-1:1 | SEQ4929 | 2.E−04 | 1.5 |
| All AD | lnc-AKIRIN1-1:10 | SEQ4135 | 3.E−02 | 0.8 | MCI | lnc-PSMC3-1:1 | SEQ4929 | 5.E−04 | 1.4 |
| All AD | lnc-AKNAD1-3:1 | SEQ4136 | 2.E−02 | 0.8 | DLB | lnc-PSMC3IP-1:1 | SEQ3599 | 3.E−04 | 1.3 |
| FTD | lnc-AKR1D1-5:2 | SEQ0098 | 3.E−04 | 0.6 | MCI | lnc-PSMC3IP-3:1 | SEQ3754 | 8.E−05 | 1.7 |
| DLB | lnc-AKR7A2-2:1 | SEQ0145 | 1.E−03 | 1.4 | FTD | lnc-PSMC3IP-3:1 | SEQ3754 | 9.E−04 | 1.5 |
| FTD | lnc-AKTIP-3:1 | SEQ4139 | 1.E−05 | 0.6 | DLB | lnc-PSMC3IP-3:1 | SEQ3754 | 1.E−03 | 1.6 |
| All AD | lnc-AKTIP-3:1 | SEQ4139 | 3.E−02 | 0.8 | All AD | lnc-PSMC3IP-3:1 | SEQ3754 | 2.E−02 | 1.2 |

TABLE 10-continued 2847 whole blood (Paxgene RNA tube) lncRNAs differentially expressed in MCI group or mild AD group or moderate-to-severe AD group or both of these AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| FTD | lnc-ALB-7:2 | SEQ4141 | 1.E-07 | 0.4 | msAD | lnc-PSMC3IP-3:1 | SEQ3754 | 4.E-02 | 1.2 |
| MCI | lnc-ALB-7:2 | SEQ4141 | 2.E-04 | 0.5 | DLB | lnc-PSMC3IP-3:11 | SEQ4960 | 2.E-04 | 1.6 |
| miAD | lnc-ALB-7:2 | SEQ4141 | 7.E-03 | 0.6 | MCI | lnc-PSMC3IP-3:11 | SEQ4960 | 8.E-03 | 1.6 |
| All AD | lnc-ALB-7:2 | SEQ4141 | 2.E-02 | 0.7 | DLB | lnc-PSMC3IP-3:13 | SEQ3726 | 5.E-04 | 1.7 |
| MCI | lnc-ALDH3B2-1:1 | SEQ5648 | 1.E-04 | 2.4 | MCI | lnc-PSMC3IP-3:13 | SEQ3726 | 1.E-03 | 1.5 |
| FTD | lnc-ALDH3B2-1:1 | SEQ5648 | 1.E-04 | 1.8 | msAD | lnc-PSMC3IP-3:13 | SEQ3726 | 4.E-02 | 1.2 |
| DLB | lnc-ALG12-5:3 | SEQ3016 | 2.E-03 | 1.4 | All AD | lnc-PSMC3IP-3:13 | SEQ3726 | 5.E-02 | 1.2 |
| All AD | lnc-ALPK1-2:3 | SEQ4144 | 4.E-02 | 0.7 | FTD | lnc-PSMC3IP-3:6 | SEQ3982 | 2.E-04 | 1.6 |
| FTD | lnc-ALPK1-2:4 | SEQ4148 | 1.E-08 | 0.4 | MCI | lnc-PSMC3IP-3:6 | SEQ3982 | 2.E-04 | 1.6 |
| MCI | lnc-ALPK1-2:4 | SEQ4148 | 3.E-05 | 0.4 | DLB | lnc-PSMC3IP-3:6 | SEQ3982 | 1.E-03 | 1.6 |
| miAD | lnc-ALPK1-2:4 | SEQ4148 | 3.E-04 | 0.5 | All AD | lnc-PSMC3IP-3:6 | SEQ3982 | 6.E-03 | 1.3 |
| DLB | lnc-ALPK1-2:4 | SEQ4148 | 4.E-04 | 0.5 | miAD | lnc-PSMC3IP-3:6 | SEQ3982 | 8.E-03 | 1.3 |
| All AD | lnc-ALPK1-2:4 | SEQ4148 | 5.E-04 | 0.5 | msAD | lnc-PSMC3IP-3:6 | SEQ3982 | 2.E-02 | 1.2 |
| msAD | lnc-ALPK1-2:4 | SEQ4148 | 5.E-03 | 0.6 | FTD | lnc-PSMC6-1:1 | SEQ5982 | 2.E-06 | 0.4 |
| FTD | lnc-AMDHD1-1:2 | SEQ4073 | 3.E-05 | 0.6 | FTD | lnc-PSMD6-1:1 | SEQ5926 | 1.E-05 | 0.6 |
| MCI | lnc-AMDHD1-1:2 | SEQ4073 | 2.E-04 | 0.6 | DLB | lnc-PSMD7-2:1 | SEQ4720 | 1.E-03 | 1.8 |
| miAD | lnc-AMDHD1-1:2 | SEQ4073 | 1.E-02 | 0.7 | DLB | lnc-PSMG4-1:1 | SEQ3724 | 7.E-04 | 1.5 |
| All AD | lnc-AMDHD1-1:2 | SEQ4073 | 3.E-02 | 0.8 | All AD | lnc-PSMG4-1:1 | SEQ3724 | 2.E-02 | 1.2 |
| FTD | lnc-AMY1B-1:10 | SEQ5686 | 1.E-04 | 0.6 | msAD | lnc-PSMG4-1:1 | SEQ3724 | 4.E-02 | 1.2 |
| FTD | lnc-AMZ2-5:5 | SEQ4154 | 1.E-05 | 0.4 | FTD | lnc-PTBP2-11:1 | SEQ3669 | 7.E-06 | 0.6 |
| MCI | lnc-AMZ2-5:5 | SEQ4154 | 2.E-04 | 0.5 | All AD | lnc-PTBP2-11:1 | SEQ3669 | 3.E-02 | 0.8 |
| miAD | lnc-AMZ2-5:5 | SEQ4154 | 7.E-03 | 0.6 | msAD | lnc-PTBP2-11:1 | SEQ3669 | 5.E-02 | 0.8 |
| All AD | lnc-AMZ2-5:5 | SEQ4154 | 2.E-02 | 0.7 | DLB | lnc-PTBP3-7:1 | SEQ2703 | 5.E-04 | 1.3 |
| MCI | lnc-AMZ2-8:1 | SEQ4396 | 2.E-03 | 0.5 | FTD | lnc-PTP4A2-3:4 | SEQ5007 | 8.E-04 | 2.9 |
| All AD | lnc-ANAPC11-2:11 | SEQ3746 | 2.E-02 | 1.2 | FTD | lnc-PTP4A2-3:6 | SEQ5107 | 8.E-05 | 0.6 |
| msAD | lnc-ANAPC11-2:11 | SEQ3746 | 4.E-02 | 1.2 | MCI | lnc-PTP4A2-3:6 | SEQ5107 | 6.E-04 | 0.7 |
| MCI | lnc-ANAPC11-2:2 | SEQ3335 | 1.E-05 | 2.0 | DLB | lnc-PTPMT1-2:1 | SEQ2354 | 5.E-05 | 1.5 |
| FTD | lnc-ANAPC11-2:2 | SEQ3335 | 1.E-05 | 1.8 | DLB | lnc-PTPN23-1:2 | SEQ4934 | 8.E-04 | 1.4 |
| DLB | lnc-ANAPC11-2:2 | SEQ3335 | 3.E-05 | 2.1 | FTD | lnc-PUM3-2:1 | SEQ5291 | 4.E-04 | 0.6 |
| All AD | lnc-ANAPC11-2:2 | SEQ3335 | 2.E-03 | 1.3 | FTD | lnc-PUM3-7:1 | SEQ2337 | 8.E-04 | 0.6 |
| miAD | lnc-ANAPC11-2:2 | SEQ3335 | 3.E-03 | 1.3 | FTD | lnc-PUS7-2:1 | SEQ3909 | 4.E-08 | 0.5 |
| msAD | lnc-ANAPC11-2:2 | SEQ3335 | 9.E-03 | 1.2 | miAD | lnc-PUS7-2:1 | SEQ3909 | 1.E-03 | 0.6 |
| DLB | lnc-ANAPC11-2:8 | SEQ3283 | 1.E-05 | 1.5 | All AD | lnc-PUS7-2:1 | SEQ3909 | 3.E-03 | 0.7 |
| MCI | lnc-ANAPC11-2:8 | SEQ3283 | 4.E-05 | 1.4 | msAD | lnc-PUS7-2:1 | SEQ3909 | 3.E-02 | 0.7 |
| DLB | lnc-ANGPTL1-2:1 | SEQ3336 | 5.E-05 | 1.8 | FTD | lnc-PUS7-3:1 | SEQ6014 | 3.E-11 | 0.2 |
| FTD | lnc-ANKFY1-5:1 | SEQ5997 | 4.E-07 | 0.6 | DLB | lnc-PXDC1-12:3 | SEQ4641 | 1.E-03 | 1.5 |
| MCI | lnc-ANKH-1:8 | SEQ5053 | 3.E-04 | 2.3 | All AD | lnc-PXDC1-12:3 | SEQ4641 | 5.E-02 | 1.2 |
| FTD | lnc-ANKH-1:8 | SEQ5053 | 6.E-04 | 1.9 | DLB | lnc-PYCARD-1:2 | SEQ4964 | 8.E-04 | 1.6 |
| DLB | lnc-ANKH-1:8 | SEQ5053 | 7.E-04 | 2.6 | DLB | lnc-QPRT-3:1 | SEQ5329 | 4.E-04 | 1.6 |
| DLB | lnc-ANKRD20A2-22:3 | SEQ3338 | 1.E-05 | 1.7 | MCI | lnc-RAB1A-6:1 | SEQ5185 | 2.E-04 | 1.5 |
| FTD | lnc-ANKRD20A2-22:3 | SEQ3338 | 6.E-04 | 1.4 | DLB | lnc-RAB1A-6:1 | SEQ5185 | 5.E-04 | 1.5 |
| All AD | lnc-ANKRD20A2-22:3 | SEQ3338 | 5.E-02 | 1.1 | DLB | lnc-RAB23-20:13 | SEQ4851 | 9.E-04 | 1.5 |
| miAD | lnc-ANKRD20A4-5:4 | SEQ4167 | 7.E-03 | 0.7 | FTD | lnc-RAB2B-2:2 | SEQ5644 | 1.E-04 | 0.6 |
| All AD | lnc-ANKRD20A4-5:4 | SEQ4167 | 1.E-02 | 0.7 | DLB | lnc-RAB37-1:5 | SEQ5380 | 3.E-04 | 1.6 |
| miAD | lnc-ANKRD27-9:1 | SEQ4169 | 6.E-03 | 0.7 | DLB | lnc-RAB3A-5:1 | SEQ5567 | 2.E-04 | 1.6 |
| All AD | lnc-ANKRD27-9:1 | SEQ4169 | 4.E-02 | 0.8 | MCI | lnc-RABEP2-4:1 | SEQ5391 | 3.E-04 | 1.8 |
| msAD | lnc-ANKRD33B-2:1 | SEQ3825 | 4.E-02 | 1.4 | DLB | lnc-RABEP2-7:1 | SEQ5341 | 2.E-05 | 2.1 |
| FTD | lnc-ANKRD34B-2:12 | SEQ4174 | 8.E-05 | 0.6 | MCI | lnc-RABEP2-7:1 | SEQ5341 | 4.E-04 | 2.0 |
| MCI | lnc-ANKRD34B-2:12 | SEQ4174 | 9.E-04 | 0.6 | DLB | lnc-RABEP2-7:2 | SEQ3172 | 7.E-04 | 1.7 |
| miAD | lnc-ANKRD34B-2:12 | SEQ4174 | 5.E-03 | 0.7 | MCI | lnc-RACK1-1:2 | SEQ3580 | 9.E-06 | 1.6 |
| All AD | lnc-ANKRD34B-2:12 | SEQ4174 | 2.E-02 | 0.7 | DLB | lnc-RACK1-1:2 | SEQ3580 | 2.E-05 | 1.6 |
| FTD | lnc-ANKRD34B-2:13 | SEQ4176 | 8.E-05 | 0.6 | DLB | lnc-RADIL-1:1 | SEQ5262 | 9.E-05 | 1.6 |
| MCI | lnc-ANKRD34B-2:13 | SEQ4176 | 1.E-03 | 0.6 | MCI | lnc-RADIL-1:1 | SEQ5262 | 5.E-04 | 1.5 |
| miAD | lnc-ANKRD34B-2:13 | SEQ4176 | 5.E-03 | 0.7 | All AD | lnc-RAG1-4:1 | SEQ5504 | 4.E-02 | 0.8 |
| All AD | lnc-ANKRD34B-2:13 | SEQ4176 | 2.E-02 | 0.7 | DLB | lnc-RAI1-2:2 | SEQ5573 | 2.E-04 | 1.6 |
| FTD | lnc-ANKRD34B-2:7 | SEQ4179 | 1.E-04 | 0.5 | All AD | lnc-RAMP3-1:1 | SEQ5506 | 2.E-02 | 0.7 |
| miAD | lnc-ANKRD34B-2:7 | SEQ4179 | 7.E-04 | 0.6 | DLB | lnc-RANBP9-1:3 | SEQ4092 | 2.E-04 | 1.4 |
| All AD | lnc-ANKRD34B-2:7 | SEQ4179 | 1.E-02 | 0.7 | All AD | lnc-RANBP9-1:3 | SEQ4092 | 6.E-03 | 1.2 |
| FTD | lnc-ANKRD34B-2:8 | SEQ4181 | 3.E-04 | 0.4 | miAD | lnc-RANBP9-1:3 | SEQ4092 | 1.E-02 | 1.2 |
| MCI | lnc-ANKRD34B-2:8 | SEQ4181 | 1.E-03 | 0.5 | msAD | lnc-RANBP9-1:3 | SEQ4092 | 1.E-02 | 1.2 |
| All AD | lnc-ANKRD34B-2:8 | SEQ4181 | 4.E-02 | 0.6 | FTD | lnc-RAP2C-4:1 | SEQ4377 | 1.E-06 | 0.5 |
| miAD | lnc-ANKRD34B-4:1 | SEQ2896 | 4.E-03 | 1.2 | MCI | lnc-RAP2C-4:1 | SEQ4377 | 2.E-04 | 0.5 |
| All AD | lnc-ANKRD34B-4:1 | SEQ2896 | 5.E-03 | 1.2 | miAD | lnc-RAP2C-4:1 | SEQ4377 | 3.E-03 | 0.6 |
| msAD | lnc-ANKRD34B-4:1 | SEQ2896 | 2.E-02 | 1.2 | All AD | lnc-RAP2C-4:1 | SEQ4377 | 8.E-03 | 0.7 |
| All AD | lnc-ANKRD36-1:4 | SEQ4183 | 4.E-03 | 1.5 | DLB | lnc-RAPSN-1:1 | SEQ4610 | 1.E-03 | 1.3 |
| msAD | lnc-ANKRD36-1:4 | SEQ4183 | 8.E-03 | 1.5 | FTD | lnc-RARB-4:1 | SEQ5210 | 2.E-04 | 1.6 |
| miAD | lnc-ANKRD36-1:4 | SEQ4183 | 1.E-02 | 1.5 | MCI | lnc-RARB-4:1 | SEQ5210 | 3.E-04 | 2.0 |
| DLB | lnc-ANKRD39-1:1 | SEQ4491 | 2.E-03 | 1.4 | DLB | lnc-RARB-4:1 | SEQ5210 | 5.E-04 | 1.8 |
| FTD | lnc-ANKS1B-1:1 | SEQ3860 | 1.E-07 | 0.5 | MCI | lnc-RARRES2-2:2 | SEQ2774 | 4.E-06 | 1.6 |
| MCI | lnc-ANKS1B-1:1 | SEQ3860 | 6.E-05 | 0.6 | DLB | lnc-RARRES2-2:2 | SEQ2774 | 9.E-06 | 1.6 |
| All AD | lnc-ANKS1B-1:1 | SEQ3860 | 1.E-03 | 0.7 | FTD | lnc-RARRES2-2:2 | SEQ2774 | 6.E-05 | 1.4 |
| msAD | lnc-ANKS1B-1:1 | SEQ3860 | 3.E-02 | 0.8 | All AD | lnc-RARRES2-2:2 | SEQ2774 | 3.E-03 | 1.2 |
| DLB | lnc-ANKS3-2:1 | SEQ2771 | 2.E-03 | 1.5 | miAD | lnc-RARRES2-2:2 | SEQ2774 | 5.E-03 | 1.2 |
| All AD | lnc-ANLN-6:1 | SEQ4186 | 4.E-02 | 0.8 | msAD | lnc-RARRES2-2:2 | SEQ2774 | 8.E-03 | 1.2 |

TABLE 10-continued 2847 whole blood (Paxgene RNA tube) lncRNAs differentially expressed in MCI group or mild AD group or moderate-to-severe AD group or both of these AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| DLB | lnc-ANP32E-1:1 | SEQ4400 | 2.E-03 | 1.2 | DLB | lnc-RARRES2-5:1 | SEQ5383 | 2.E-04 | 1.7 |
| FTD | lnc-ANTXR2-1:8 | SEQ5547 | 2.E-04 | 0.6 | MCI | lnc-RARRES2-5:1 | SEQ5383 | 3.E-04 | 1.6 |
| FTD | lnc-ANXA3-7:1 | SEQ5781 | 7.E-05 | 0.6 | All AD | lnc-RARS2-4:1 | SEQ3642 | 3.E-02 | 0.8 |
| FTD | lnc-ANXA3-8:1 | SEQ0670 | 1.E-06 | 0.6 | msAD | lnc-RARS2-4:1 | SEQ3642 | 5.E-02 | 0.9 |
| MCI | lnc-ANXA3-8:1 | SEQ0670 | 1.E-04 | 0.6 | FTD | lnc-RASA2-1:1 | SEQ5294 | 4.E-04 | 0.7 |
| All AD | lnc-ANXA3-8:1 | SEQ0670 | 4.E-02 | 0.8 | miAD | lnc-RASSF3-1:1 | SEQ4155 | 1.E-02 | 0.7 |
| FTD | lnc-AP1AR-1:1 | SEQ4189 | 4.E-08 | 0.5 | All AD | lnc-RASSF3-1:1 | SEQ4155 | 2.E-02 | 0.8 |
| miAD | lnc-AP1AR-1:1 | SEQ4189 | 4.E-02 | 0.5 | DLB | lnc-RBAK-RBAKDN-2:13 | SEQ5129 | 6.E-04 | 1.6 |
| All AD | lnc-AP1AR-1:1 | SEQ4189 | 8.E-04 | 0.6 | MCI | lnc-RBBP8NL-2:1 | SEQ5128 | 6.E-04 | 1.6 |
| MCI | lnc-AP1AR-1:1 | SEQ4189 | 2.E-03 | 0.6 | FTD | lnc-RBL2-1:10 | SEQ4900 | 9.E-04 | 0.6 |
| msAD | lnc-AP1AR-1:1 | SEQ4189 | 9.E-03 | 0.6 | FTD | lnc-RBL2-1:11 | SEQ5587 | 2.E-02 | 0.5 |
| FTD | lnc-AP3S1-4:3 | SEQ2424 | 1.E-08 | 0.3 | MCI | lnc-RBL2-1:3 | SEQ4730 | 4.E-04 | 3.5 |
| MCI | lnc-AP3S1-4:3 | SEQ2424 | 1.E-04 | 0.4 | DLB | lnc-RBL2-1:3 | SEQ4730 | 1.E-03 | 2.7 |
| MCI | lnc-APAF1-3:1 | SEQ5059 | 2.E-05 | 0.4 | FTD | lnc-RBM12B-4:2 | SEQ5071 | 7.E-04 | 0.7 |
| FTD | lnc-APAF1-3:1 | SEQ5059 | 7.E-04 | 0.6 | MCI | lnc-RBM23-3:1 | SEQ4562 | 3.E-05 | 1.6 |
| miAD | lnc-APBB2-3:1 | SEQ4195 | 8.E-03 | 0.6 | DLB | lnc-RBM23-3:1 | SEQ4562 | 2.E-03 | 1.4 |
| All AD | lnc-APBB2-3:1 | SEQ4195 | 1.E-02 | 0.7 | DLB | lnc-RBM28-3:2 | SEQ5532 | 2.E-04 | 1.7 |
| DLB | lnc-APCDD1L-3:2 | SEQ5727 | 9.E-05 | 1.4 | FTD | lnc-RC3H1-2:1 | SEQ4355 | 6.E-08 | 0.5 |
| FTD | lnc-APLNR-3:1 | SEQ5227 | 5.E-04 | 0.6 | miAD | lnc-RC3H1-2:1 | SEQ4355 | 4.E-03 | 0.7 |
| All AD | lnc-APOBEC3A-2:1 | SEQ3666 | 2.E-02 | 0.8 | All AD | lnc-RC3H1-2:1 | SEQ4355 | 1.E-02 | 0.7 |
| msAD | lnc-APOBEC3A-2:1 | SEQ3666 | 5.E-02 | 0.8 | All AD | lnc-RC3H2-1:1 | SEQ5518 | 4.E-02 | 0.8 |
| DLB | lnc-APOBEC3H-3:1 | SEQ5259 | 4.E-04 | 1.5 | FTD | lnc-RCC1L-3:1 | SEQ3975 | 7.E-07 | 0.5 |
| DLB | lnc-APOC3-2:7 | SEQ4685 | 1.E-03 | 1.4 | MCI | lnc-RCC1L-3:1 | SEQ3975 | 2.E-05 | 0.6 |
| DLB | lnc-APOL2-5:1 | SEQ5264 | 5.E-04 | 1.6 | All AD | lnc-RCC1L-3:1 | SEQ3975 | 2.E-02 | 0.7 |
| msAD | lnc-APOL4-1:5 | SEQ4202 | 8.E-03 | 0.8 | msAD | lnc-RCC1L-3:1 | SEQ3975 | 2.E-02 | 0.7 |
| All AD | lnc-APOL4-1:5 | SEQ4202 | 1.E-02 | 0.8 | All AD | lnc-RCSD1-4:1 | SEQ0831 | 5.E-02 | 0.8 |
| MCI | lnc-APOL5-4:1 | SEQ2343 | 2.E-05 | 0.6 | FTD | lnc-RDH10-3:1 | SEQ5869 | 4.E-05 | 0.6 |
| FTD | lnc-APOL5-4:1 | SEQ2343 | 4.E-05 | 0.6 | DLB | lnc-RDH13-1:2 | SEQ0250 | 1.E-03 | 1.5 |
| All AD | lnc-APOL5-4:1 | SEQ2343 | 2.E-03 | 0.7 | DLB | lnc-REC8-2:1 | SEQ4479 | 9.E-06 | 1.5 |
| msAD | lnc-APOL5-4:1 | SEQ2343 | 3.E-03 | 0.6 | MCI | lnc-REC8-2:1 | SEQ4479 | 2.E-03 | 1.3 |
| miAD | lnc-APOL5-4:1 | SEQ2343 | 6.E-03 | 0.7 | FTD | lnc-REL-1:3 | SEQ2508 | 2.E-05 | 0.6 |
| All AD | lnc-AQP8-2:1 | SEQ3756 | 3.E-02 | 1.4 | FTD | lnc-REL-6:3 | SEQ3461 | 1.E-04 | 0.7 |
| msAD | lnc-AQP8-2:1 | SEQ3756 | 4.E-02 | 1.5 | All AD | lnc-REL-6:3 | SEQ3461 | 5.E-02 | 0.8 |
| DLB | lnc-AQP8-2:5 | SEQ4835 | 9.E-04 | 1.4 | msAD | lnc-REXO5-1:2 | SEQ4665 | 1.E-03 | 2.0 |
| DLB | lnc-ARAF-1:1 | SEQ5459 | 2.E-04 | 1.9 | All AD | lnc-REX05-1:2 | SEQ4665 | 5.E-03 | 1.7 |
| MCI | lnc-ARAF-1:1 | SEQ5459 | 3.E-04 | 2.0 | MCI | lnc-RFNG-1:7 | SEQ2768 | 3.E-05 | 1.5 |
| DLB | lnc-ARF5-7:1 | SEQ4756 | 1.E-05 | 1.6 | DLB | lnc-RFNG-1:7 | SEQ2768 | 4.E-05 | 1.4 |
| MCI | lnc-ARF5-7:1 | SEQ4756 | 1.E-03 | 1.4 | miAD | lnc-RFNG-1:7 | SEQ2768 | 6.E-03 | 1.2 |
| MCI | lnc-ARF6-1:1 | SEQ4542 | 3.E-05 | 2.E-04 | All AD | lnc-RFNG-1:7 | SEQ2768 | 2.E-02 | 1.1 |
| DLB | lnc-ARF6-1:1 | SEQ4542 | 2.E-03 | 2.E-04 | msAD | lnc-RFT1-3:1 | SEQ4061 | 2.E-02 | 1.5 |
| All AD | lnc-ARHGAP10-5:2 | SEQ3781 | 2.E-02 | 1.3 | All AD | lnc-RFT1-3:1 | SEQ4061 | 3.E-02 | 1.3 |
| msAD | lnc-ARHGAP10-5:2 | SEQ3781 | 4.E-02 | 1.3 | FTD | lnc-RGPD2-2:1 | SEQ5354 | 4.E-04 | 0.6 |
| MCI | lnc-ARHGEF1-5:1 | SEQ4210 | 1.E-05 | 1.6 | FTD | lnc-RGS6-3:1 | SEQ5974 | 3.E-02 | 0.6 |
| FTD | lnc-ARHGEF1-5:1 | SEQ4210 | 4.E-05 | 1.5 | FTD | lnc-RGS9-15:4 | SEQ4117 | 1.E-03 | 0.7 |
| DLB | lnc-ARHGEF1-5:1 | SEQ4210 | 2.E-04 | 1.5 | All AD | lnc-RGS9-15:4 | SEQ4117 | 1.E-02 | 0.8 |
| All AD | lnc-ARHGEF1-5:1 | SEQ4210 | 4.E-02 | 1.1 | miAD | lnc-RGS9-15:4 | SEQ4117 | 1.E-02 | 0.8 |
| FTD | lnc-ARHGEF39-1:1 | SEQ3834 | 6.E-05 | 1.5 | FTD | lnc-RICTOR-2:1 | SEQ5065 | 7.E-04 | 0.7 |
| All AD | lnc-ARHGEF39-1:1 | SEQ3834 | 3.E-02 | 1.2 | MCI | lnc-RIMBP3C-3:1 | SEQ5754 | 8.E-05 | 1.7 |
| msAD | lnc-ARHGEF39-1:1 | SEQ3834 | 3.E-02 | 1.2 | DLB | lnc-RIMBP3C-5:1 | SEQ4637 | 3.E-04 | 1.7 |
| FTD | lnc-ARHGEF39-1:3 | SEQ3718 | 2.E-04 | 1.5 | MCI | lnc-RIMBP3C-5:1 | SEQ4637 | 1.E-03 | 1.5 |
| All AD | lnc-ARHGEF39-1:3 | SEQ3718 | 4.E-02 | 1.2 | MCI | lnc-RIMKLB-6:5 | SEQ4663 | 1.E-03 | 3.4 |
| msAD | lnc-ARHGEF39-1:3 | SEQ3718 | 4.E-02 | 1.2 | msAD | lnc-RIPOR1-1:5 | SEQ3647 | 5.E-02 | 1.2 |
| MCI | lnc-ARID2-8:1 | SEQ3792 | 1.E-03 | 1.7 | DLB | lnc-RIPOR1-1:6 | SEQ2943 | 2.E-03 | 1.4 |
| DLB | lnc-ARID2-8:1 | SEQ3792 | 2.E-03 | 1.7 | DLB | lnc-RIPOR1-1:7 | SEQ3158 | 5.E-04 | 1.5 |
| All AD | lnc-ARID2-8:1 | SEQ3792 | 1.E-02 | 1.3 | DLB | lnc-RIPOR1-1:8 | SEQ4771 | 1.E-03 | 1.5 |
| miAD | lnc-ARID2-8:1 | SEQ3792 | 1.E-02 | 1.3 | DLB | lnc-RIPOR2-7:1 | SEQ3466 | 2.E-03 | 1.5 |
| msAD | lnc-ARID2-8:1 | SEQ3792 | 4.E-02 | 1.3 | DLB | lnc-RIPOR2-7:2 | SEQ4506 | 2.E-03 | 1.5 |
| MCI | lnc-ARID3B-4:1 | SEQ4216 | 3.E-04 | 1.6 | DLB | lnc-RIPOR3-1:1 | SEQ4925 | 8.E-04 | 1.4 |
| All AD | lnc-ARID3B-4:1 | SEQ4216 | 4.E-02 | 1.1 | DLB | lnc-RLBP1-3:1 | SEQ4750 | 1.E-03 | 1.4 |
| DLB | lnc-ARID5A-2:1 | SEQ4523 | 2.E-04 | 1.7 | DLB | lnc-RLIM-4:1 | SEQ3579 | 1.E-03 | 1.5 |
| MCI | lnc-ARID5A-2:1 | SEQ4523 | 2.E-03 | 1.6 | All AD | lnc-RMDN2-3:24 | SEQ2468 | 3.E-02 | 0.8 |
| MCI | lnc-ARL14-2:3 | SEQ4782 | 1.E-03 | 1.7 | All AD | lnc-RMI2-3:1 | SEQ5534 | 4.E-02 | 0.7 |
| DLB | lnc-ARL16-1:1 | SEQ5616 | 2.E-04 | 1.4 | MCI | lnc-RNASET2-1:4 | SEQ4516 | 2.E-04 | 1.5 |
| DLB | lnc-ARL16-1:2 | SEQ4559 | 1.E-04 | 1.5 | DLB | lnc-RNASET2-1:4 | SEQ4516 | 2.E-03 | 1.5 |
| MCI | lnc-ARL16-1:2 | SEQ4559 | 2.E-03 | 1.4 | FTD | lnc-RNASET2-1:5 | SEQ5545 | 2.E-04 | 0.6 |
| FTD | lnc-ARL5A-1:1 | SEQ5745 | 9.E-05 | 0.6 | FTD | lnc-RNASET2-1:9 | SEQ4282 | 4.E-08 | 0.3 |
| DLB | lnc-ARMC6-1:1 | SEQ4624 | 1.E-03 | 1.4 | MCI | lnc-RNASET2-1:9 | SEQ4282 | 1.E-03 | 0.5 |
| DLB | lnc-ARMC6-1:2 | SEQ4854 | 9.E-04 | 1.5 | miAD | lnc-RNASET2-1:9 | SEQ4282 | 3.E-03 | 0.5 |
| DLB | lnc-ARMC7-1:1 | SEQ5527 | 2.E-04 | 1.5 | All AD | lnc-RNASET2-1:9 | SEQ4282 | 1.E-02 | 0.6 |
| DLB | lnc-ARRDC2-3:1 | SEQ5618 | 2.E-04 | 1.6 | FTD | lnc-RNF111-3:1 | SEQ5468 | 3.E-04 | 0.6 |
| All AD | lnc-ARSG-2:8 | SEQ2535 | 3.E-02 | 0.6 | DLB | lnc-RNF123-1:1 | SEQ4013 | 2.E-04 | 1.6 |
| MCI | lnc-ARVCF-4:11 | SEQ5818 | 3.E-05 | 1.6 | MCI | lnc-RNF123-1:1 | SEQ4013 | 8.E-04 | 1.5 |
| DLB | lnc-ARVCF-4:11 | SEQ5818 | 5.E-05 | 1.6 | msAD | lnc-RNF123-1:1 | SEQ4013 | 2.E-02 | 1.2 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| MCI | lnc-ARVCF-4:13 | SEQ4194 | 1.E-05 | 2.0 | All AD | lnc-RNF123-1:1 | SEQ4013 | 3.E-02 | 1.2 |
| FTD | lnc-ARVCF-4:13 | SEQ4194 | 2.E-04 | 1.6 | miAD | lnc-RNF125-2:1 | SEQ4605 | 1.E-03 | 1.6 |
| All AD | lnc-ARVCF-4:13 | SEQ4194 | 4.E-03 | 1.2 | DLB | lnc-RNF125-2:2 | SEQ5760 | 8.E-05 | 2.3 |
| miAD | lnc-ARVCF-4:13 | SEQ4194 | 8.E-03 | 1.2 | FTD | lnc-RNF13-4:1 | SEQ5837 | 4.E-09 | 0.2 |
| msAD | lnc-ARVCF-4:13 | SEQ4194 | 1.E-02 | 1.2 | MCI | lnc-RNF13-4:1 | SEQ5837 | 6.E-08 | 0.3 |
| FTD | lnc-ASCC2-1:1 | SEQ3888 | 1.E-04 | 0.6 | DLB | lnc-RNF13-4:1 | SEQ5837 | 4.E-05 | 0.3 |
| All AD | lnc-ASCC2-1:1 | SEQ3888 | 8.E-03 | 0.7 | miAD | lnc-RNF149-3:1 | SEQ3914 | 1.E-03 | 0.7 |
| miAD | lnc-ASCC2-1:1 | SEQ3888 | 8.E-03 | 0.6 | All AD | lnc-RNF149-3:1 | SEQ3914 | 3.E-03 | 0.7 |
| msAD | lnc-ASCC2-1:1 | SEQ3888 | 3.E-02 | 0.8 | msAD | lnc-RNF149-3:1 | SEQ3914 | 3.E-02 | 0.8 |
| FTD | lnc-ASF1A-6:1 | SEQ4225 | 4.E-04 | 0.7 | FTD | lnc-RNF219-3:1 | SEQ5989 | 2.E-06 | 0.5 |
| MCI | lnc-ASF1A-6:1 | SEQ4225 | 5.E-04 | 0.7 | FTD | lnc-RNF219-6:1 | SEQ5653 | 4.E-07 | 0.5 |
| All AD | lnc-ASF1A-6:1 | SEQ4225 | 7.E-03 | 0.7 | MCI | lnc-RNF219-6:1 | SEQ5653 | 1.E-04 | 0.5 |
| msAD | lnc-ASF1A-6:1 | SEQ4225 | 8.E-03 | 0.7 | DLB | lnc-RNF24-2:5 | SEQ3190 | 5.E-04 | 1.7 |
| All AD | lnc-ASPHD2-2:2 | SEQ2612 | 4.E-03 | 1.1 | DLB | lnc-RNF24-2:9 | SEQ5790 | 6.E-05 | 1.5 |
| msAD | lnc-ASPHD2-2:2 | SEQ2612 | 5.E-03 | 1.2 | DLB | lnc-RNF40-1:1 | SEQ3839 | 8.E-05 | 1.6 |
| miAD | lnc-ASPHD2-2:2 | SEQ2612 | 1.E-02 | 1.1 | MCI | lnc-RNF40-1:1 | SEQ3839 | 6.E-04 | 1.5 |
| FTD | lnc-ASPRV1-2:1 | SEQ4229 | 4.E-05 | 0.6 | msAD | lnc-RNF40-1:1 | SEQ3839 | 3.E-02 | 1.2 |
| All AD | lnc-ASPRV1-2:1 | SEQ4229 | 3.E-02 | 0.8 | DLB | lnc-RNFT2-1:7 | SEQ4939 | 8.E-04 | 1.5 |
| DLB | lnc-ASXL1-3:1 | SEQ2650 | 3.E-04 | 1.5 | MCI | lnc-RNMT-7:1 | SEQ4875 | 8.E-04 | 1.8 |
| MCI | lnc-ASXL1-4:3 | SEQ4231 | 2.E-04 | 1.8 | DLB | lnc-RNMT-7:1 | SEQ4875 | 9.E-04 | 1.9 |
| DLB | lnc-ASXL1-4:3 | SEQ4231 | 7.E-04 | 1.8 | FTD | lnc-ROCK1-1:1 | SEQ5980 | 3.E-06 | 0.6 |
| All AD | lnc-ASXL1-4:3 | SEQ4231 | 4.E-02 | 1.2 | DLB | lnc-ROGDI-1:1 | SEQ5950 | 7.E-06 | 1.4 |
| DLB | lnc-ATAD2-1:1 | SEQ4447 | 2.E-03 | 1.6 | DLB | lnc-ROM1-4:1 | SEQ5258 | 5.E-04 | 1.5 |
| FTD | lnc-ATAD5-9:9 | SEQ3904 | 1.E-06 | 0.5 | DLB | lnc-ROM1-7:1 | SEQ3478 | 3.E-04 | 1.5 |
| miAD | lnc-ATAD5-9:9 | SEQ3904 | 4.E-03 | 0.7 | DLB | lnc-ROM1-7:3 | SEQ3586 | 2.E-04 | 1.6 |
| All AD | lnc-ATAD5-9:9 | SEQ3904 | 6.E-03 | 0.7 | DLB | lnc-ROM1-7:6 | SEQ3589 | 2.E-03 | 1.5 |
| msAD | lnc-ATAD5-9:9 | SEQ3904 | 3.E-02 | 0.7 | FTD | lnc-ROPN1L-2:2 | SEQ5554 | 3.E-08 | 0.5 |
| MCI | lnc-ATG12-3:2 | SEQ2558 | 2.E-03 | 1.8 | MCI | lnc-ROPN1L-2:2 | SEQ5554 | 2.E-05 | 0.6 |
| All AD | lnc-ATG3-1:1 | SEQ4191 | 5.E-03 | 0.7 | All AD | lnc-ROPN1L-2:2 | SEQ5554 | 4.E-02 | 0.7 |
| miAD | lnc-ATG3-1:1 | SEQ4191 | 1.E-02 | 0.7 | FTD | lnc-RORA-2:1 | SEQ3798 | 8.E-06 | 0.4 |
| msAD | lnc-ATG3-1:1 | SEQ4191 | 1.E-02 | 0.7 | All AD | lnc-RORA-2:1 | SEQ3798 | 2.E-02 | 0.7 |
| FTD | lnc-ATL1-4:1 | SEQ5001 | 8.E-04 | 0.7 | msAD | lnc-RORA-2:1 | SEQ3798 | 4.E-02 | 0.7 |
| FTD | lnc-ATOH7-3:3 | SEQ3867 | 3.E-07 | 0.5 | FTD | lnc-RPE-4:2 | SEQ5964 | 5.E-06 | 0.6 |
| MCI | lnc-ATOH7-3:3 | SEQ3867 | 6.E-04 | 0.6 | DLB | lnc-RPIA-4:2 | SEQ4656 | 1.E-03 | 1.9 |
| miAD | lnc-ATOH7-3:3 | SEQ3867 | 3.E-03 | 0.7 | DLB | lnc-RPIA-5:1 | SEQ4982 | 8.E-04 | 2.1 |
| All AD | lnc-ATOH7-3:3 | SEQ3867 | 5.E-03 | 0.7 | All AD | lnc-RPIA-5:1 | SEQ4982 | 3.E-02 | 1.3 |
| msAD | lnc-ATOH7-3:3 | SEQ3867 | 3.E-02 | 0.7 | DLB | lnc-RPL12-1:3 | SEQ3024 | 1.E-03 | 1.5 |
| DLB | lnc-ATOX1-4:1 | SEQ2621 | 1.E-03 | 1.4 | DLB | lnc-RPL13-5:1 | SEQ5446 | 3.E-04 | 1.6 |
| FTD | lnc-ATP11B-6:1 | SEQ4668 | 7.E-07 | 0.5 | DLB | lnc-RPL36AL-1:1 | SEQ4550 | 2.E-03 | 1.3 |
| MCI | lnc-ATP11B-6:1 | SEQ4668 | 1.E-03 | 0.6 | DLB | lnc-RPP38-5:1 | SEQ5046 | 7.E-04 | 1.8 |
| miAD | lnc-ATP1A1-1:2 | SEQ4077 | 1.E-02 | 0.8 | FTD | lnc-RPP38-6:2 | SEQ5782 | 7.E-05 | 0.6 |
| All AD | lnc-ATP1A1-1:2 | SEQ4077 | 2.E-02 | 0.8 | miAD | lnc-RPS12-1:1 | SEQ4218 | 1.E-02 | 0.7 |
| DLB | lnc-ATP6AP2-3:1 | SEQ5197 | 5.E-04 | 1.6 | All AD | lnc-RPS12-1:1 | SEQ4218 | 2.E-02 | 0.7 |
| FTD | lnc-ATP6V1C1-9:4 | SEQ3802 | 7.E-07 | 0.6 | MCI | lnc-RPS25-5:1 | SEQ4968 | 8.E-04 | 1.6 |
| All AD | lnc-ATP6V1C1-9:4 | SEQ3802 | 2.E-02 | 0.7 | MCI | lnc-RRN3-4:1 | SEQ4461 | 1.E-06 | 2.1 |
| msAD | lnc-ATP6V1C1-9:4 | SEQ3802 | 4.E-02 | 0.8 | DLB | lnc-RRN3-4:1 | SEQ4461 | 3.E-06 | 2.1 |
| MCI | lnc-ATP6V1E2-5:2 | SEQ4243 | 8.E-05 | 1.7 | FTD | lnc-RRN3-4:1 | SEQ4461 | 3.E-05 | 1.8 |
| DLB | lnc-ATP6V1E2-5:2 | SEQ4243 | 3.E-04 | 1.5 | miAD | lnc-RRN3-4:1 | SEQ4461 | 2.E-03 | 1.3 |
| All AD | lnc-ATP6V1E2-5:2 | SEQ4243 | 3.E-02 | 1.2 | All AD | lnc-RRN3-4:1 | SEQ4461 | 7.E-03 | 1.3 |
| DLB | lnc-ATP6V1G1-2:1 | SEQ5199 | 5.E-04 | 1.7 | FTD | lnc-RSBN1-1:1 | SEQ5104 | 1.E-05 | 0.5 |
| FTD | lnc-ATP6V1G3-2:1 | SEQ4045 | 3.E-07 | 0.5 | MCI | lnc-RSBN1-1:1 | SEQ5104 | 6.E-04 | 0.6 |
| MCI | lnc-ATP6V1G3-2:1 | SEQ4045 | 4.E-05 | 0.6 | DLB | lnc-RSPH10B2-1:3 | SEQ2580 | 1.E-03 | 1.5 |
| All AD | lnc-ATP6V1G3-2:1 | SEQ4045 | 5.E-03 | 0.7 | DLB | lnc-RSPH1-7:2 | SEQ4513 | 2.E-03 | 1.5 |
| miAD | lnc-ATP6V1G3-2:1 | SEQ4045 | 6.E-03 | 0.6 | DLB | lnc-RTL8B-1:2 | SEQ5693 | 1.E-04 | 1.5 |
| msAD | lnc-ATP6V1G3-2:1 | SEQ4045 | 2.E-02 | 0.7 | FTD | lnc-RTN4-1:1 | SEQ5361 | 4.E-04 | 0.7 |
| MCI | lnc-ATPAF2-2:1 | SEQ4451 | 2.E-03 | 1.6 | All AD | lnc-RTP2-1:1 | SEQ3786 | 1.E-02 | 0.7 |
| DLB | lnc-ATPAF2-2:1 | SEQ4451 | 2.E-03 | 1.7 | msAD | lnc-RTP2-1:1 | SEQ3786 | 3.E-02 | 0.7 |
| DLB | lnc-ATXN7L3-1:3 | SEQ4480 | 2.E-03 | 1.3 | miAD | lnc-RTP2-1:2 | SEQ3661 | 1.E-02 | 0.7 |
| DLB | lnc-AUNIP-1:1 | SEQ5492 | 2.E-04 | 1.6 | All AD | lnc-RTP2-1:2 | SEQ3661 | 1.E-02 | 0.7 |
| DLB | lnc-AUNIP-1:12 | SEQ2821 | 2.E-05 | 1.6 | msAD | lnc-RTP2-1:2 | SEQ3661 | 5.E-02 | 0.7 |
| msAD | lnc-AUNIP-1:12 | SEQ2821 | 7.E-03 | 1.2 | All AD | lnc-RTP4-5:2 | SEQ5563 | 4.E-02 | 0.8 |
| All AD | lnc-AUNIP-1:12 | SEQ2821 | 1.E-02 | 1.2 | FTD | lnc-RXFP2-2:2 | SEQ5941 | 1.E-05 | 0.6 |
| MCI | lnc-AUNIP-2:1 | SEQ4658 | 1.E-03 | 2.0 | FTD | lnc-RXFP2-3:1 | SEQ5289 | 4.E-04 | 0.6 |
| msAD | lnc-B2M-1:1 | SEQ3816 | 4.E-02 | 0.8 | MCI | lnc-SAG-3:1 | SEQ3534 | 2.E-03 | 1.8 |
| msAD | lnc-B2M-1:2 | SEQ3986 | 2.E-02 | 0.7 | FTD | lnc-SAMD11-12:4 | SEQ4200 | 8.E-07 | 0.2 |
| All AD | lnc-B2M-1:2 | SEQ3986 | 3.E-02 | 0.8 | MCI | lnc-SAMD11-12:4 | SEQ4200 | 1.E-06 | 0.2 |
| All AD | lnc-B4GALNT3-2:11 | SEQ4249 | 5.E-02 | 0.8 | DLB | lnc-SAMD11-12:4 | SEQ4200 | 4.E-05 | 0.3 |
| MCI | lnc-B4GALNT3-4:2 | SEQ4583 | 2.E-03 | 1.5 | All AD | lnc-SAMD11-12:4 | SEQ4200 | 4.E-03 | 0.5 |
| MCI | lnc-BANP-10:1 | SEQ4430 | 2.E-03 | 1.6 | msAD | lnc-SAMD11-12:4 | SEQ4200 | 9.E-03 | 0.6 |
| MCI | lnc-BANP-10:1 | SEQ4430 | 2.E-03 | 1.5 | miAD | lnc-SAMD11-12:4 | SEQ4200 | 1.E-02 | 0.5 |
| DLB | lnc-BASP1-1:1 | SEQ5255 | 5.E-04 | 1.5 | All AD | lnc-SAMD11-13:2 | SEQ3700 | 4.E-02 | 1.2 |
| MCI | lnc-BAZ1A-2:1 | SEQ2485 | 5.E-05 | 1.7 | msAD | lnc-SAMD11-13:2 | SEQ3700 | 5.E-02 | 1.3 |
| FTD | lnc-BAZ1A-2:1 | SEQ2485 | 1.E-04 | 1.7 | FTD | lnc-SAMD11-14:1 | SEQ3001 | 1.E-04 | 0.7 |
| miAD | lnc-BAZ1A-2:1 | SEQ2485 | 7.E-03 | 1.3 | MCI | lnc-SAMD11-14:1 | SEQ3001 | 1.E-03 | 0.7 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| All AD | lnc-BAZ1A-2:1 | SEQ2485 | 1.E-02 | 1.2 | FTD | lnc-SAMD12-4:1 | SEQ5404 | 3.E-04 | 0.6 |
| FTD | lnc-BAZ2B-1:7 | SEQ3737 | 7.E-05 | 0.6 | All AD | lnc-SAMD12-4:1 | SEQ5404 | 5.E-02 | 0.7 |
| miAD | lnc-BAZ2B-1:7 | SEQ3737 | 4.E-03 | 0.6 | DLB | lnc-SAMD4A-3:1 | SEQ4442 | 7.E-04 | 1.8 |
| All AD | lnc-BAZ2B-1:7 | SEQ3737 | 7.E-03 | 0.7 | MCI | lnc-SAMD4A-3:1 | SEQ4442 | 2.E-03 | 1.6 |
| msAD | lnc-BAZ2B-1:7 | SEQ3737 | 4.E-02 | 0.7 | FTD | lnc-SAMD5-1:10 | SEQ0090 | 3.E-06 | 0.5 |
| FTD | lnc-BAZ2B-2:1 | SEQ3649 | 3.E-05 | 0.6 | miAD | lnc-SAMD5-1:10 | SEQ0090 | 4.E-03 | 0.6 |
| miAD | lnc-BAZ2B-2:1 | SEQ3649 | 1.E-02 | 0.7 | msAD | lnc-SAMD9L-1:1 | SEQ4296 | 7.E-03 | 0.6 |
| All AD | lnc-BAZ2B-2:1 | SEQ3649 | 1.E-02 | 0.7 | All AD | lnc-SAMD9L-1:1 | SEQ4296 | 1.E-02 | 0.7 |
| msAD | lnc-BAZ2B-2:1 | SEQ3649 | 5.E-02 | 0.8 | FTD | lnc-SAR1B-1:1 | SEQ5839 | 1.E-05 | 0.5 |
| FTD | lnc-BCL2L11-3:1 | SEQ5605 | 2.E-04 | 0.7 | MCI | lnc-SAR1B-1:1 | SEQ5839 | 4.E-05 | 0.5 |
| FTD | lnc-BCL2L11-3:3 | SEQ5234 | 5.E-04 | 0.7 | FTD | lnc-SBDS-3:1 | SEQ5159 | 5.E-04 | 0.7 |
| All AD | lnc-BCL2L11-6:1 | SEQ4257 | 4.E-02 | 0.8 | DLB | lnc-SBDS-4:3 | SEQ5480 | 2.E-04 | 1.4 |
| All AD | lnc-BDH1-5:10 | SEQ4258 | 5.E-03 | 1.8 | DLB | lnc-SBDS-4:9 | SEQ3145 | 6.E-05 | 1.7 |
| msAD | lnc-BDH1-5:10 | SEQ4258 | 6.E-03 | 1.9 | FTD | lnc-SBF2-1:5 | SEQ4028 | 4.E-05 | 0.6 |
| FTD | lnc-BDH1-5:12 | SEQ4105 | 8.E-08 | 0.4 | All AD | lnc-SBF2-1:5 | SEQ4028 | 5.E-03 | 0.6 |
| miAD | lnc-BDH1-5:12 | SEQ4105 | 1.E-02 | 0.6 | miAD | lnc-SBF2-1:5 | SEQ4028 | 6.E-03 | 0.6 |
| All AD | lnc-BDH1-5:12 | SEQ4105 | 2.E-02 | 0.6 | msAD | lnc-SBF2-1:5 | SEQ4028 | 2.E-02 | 0.7 |
| MCI | lnc-BICD1-5:1 | SEQ4439 | 5.E-04 | 1.8 | DLB | lnc-SBK1-1:1 | SEQ3472 | 2.E-03 | 1.8 |
| DLB | lnc-BICD1-5:1 | SEQ4439 | 2.E-03 | 1.5 | DLB | lnc-SBNO1-1:1 | SEQ4866 | 9.E-04 | 1.6 |
| DLB | lnc-BICRAL-3:1 | SEQ2666 | 4.E-04 | 1.5 | DLB | lnc-SBNO2-1:3 | SEQ5440 | 3.E-04 | 1.5 |
| DLB | lnc-BIN3-1:1 | SEQ5614 | 2.E-04 | 1.4 | FTD | lnc-SCAF8-5:3 | SEQ5959 | 7.E-06 | 0.6 |
| DLB | lnc-BIN3-2:1 | SEQ2884 | 9.E-04 | 1.4 | DLB | lnc-SCARB1-4:1 | SEQ5040 | 7.E-04 | 1.6 |
| FTD | lnc-BIRC6-1:4 | SEQ0892 | 5.E-04 | 0.7 | MCI | lnc-SCEL-6:1 | SEQ3655 | 6.E-06 | 2.0 |
| FTD | lnc-BOLA2B-1:5 | SEQ5096 | 6.E-04 | 1.6 | DLB | lnc-SCEL-6:1 | SEQ3655 | 6.E-06 | 2.1 |
| DLB | lnc-BOLA2B-1:7 | SEQ4698 | 7.E-04 | 1.4 | FTD | lnc-SCEL-6:1 | SEQ3655 | 2.E-05 | 1.8 |
| MCI | lnc-BOLA2B-1:7 | SEQ4698 | 1.E-03 | 1.5 | All AD | lnc-SCEL-6:1 | SEQ3655 | 3.E-02 | 1.2 |
| DLB | lnc-BOLL-1:1 | SEQ3744 | 3.E-05 | 1.9 | msAD | lnc-SCEL-6:1 | SEQ3655 | 5.E-02 | 1.2 |
| MCI | lnc-BOLL-1:1 | SEQ3744 | 4.E-04 | 1.6 | DLB | lnc-SCG3-5:1 | SEQ4780 | 1.E-03 | 1.6 |
| All AD | lnc-BOLL-1:1 | SEQ3744 | 3.E-02 | 1.2 | DLB | lnc-SCGB2B2-11:1 | SEQ5561 | 5.E-05 | 1.6 |
| msAD | lnc-BOLL-1:1 | SEQ3744 | 4.E-02 | 1.2 | MCI | lnc-SCGB2B2-11:1 | SEQ5561 | 2.E-04 | 1.5 |
| FTD | lnc-BOLL-6:1 | SEQ5586 | 2.E-04 | 0.4 | msAD | lnc-SCGB3A1-3:5 | SEQ3842 | 3.E-02 | 1.3 |
| MCI | lnc-BORCS5-1:2 | SEQ3820 | 1.E-03 | 1.5 | All AD | lnc-SCGB3A1-3:5 | SEQ3842 | 4.E-02 | 1.3 |
| DLB | lnc-BORCS5-1:2 | SEQ3820 | 1.E-03 | 1.5 | All AD | lnc-SCO1-1:1 | SEQ5582 | 5.E-02 | 1.2 |
| msAD | lnc-BORCS5-1:2 | SEQ3820 | 4.E-02 | 1.2 | FTD | lnc-SCRN3-5:1 | SEQ3830 | 2.E-04 | 0.7 |
| DLB | lnc-BPNT1-2:5 | SEQ4510 | 2.E-03 | 1.5 | msAD | lnc-SCRN3-5:1 | SEQ3830 | 3.E-02 | 0.8 |
| MCI | lnc-BRAT1-2:1 | SEQ3709 | 1.E-04 | 2.0 | All AD | lnc-SCRN3-5:1 | SEQ3830 | 4.E-02 | 0.8 |
| DLB | lnc-BRAT1-2:1 | SEQ3709 | 1.E-03 | 1.6 | FTD | lnc-SCRN3-7:1 | SEQ5236 | 5.E-04 | 0.7 |
| All AD | lnc-BRAT1-2:1 | SEQ3709 | 3.E-02 | 1.3 | MCI | lnc-SCTR-2:1 | SEQ5676 | 3.E-05 | 2.4 |
| msAD | lnc-BRAT1-2:1 | SEQ3709 | 5.E-02 | 1.3 | FTD | lnc-SCTR-2:1 | SEQ5676 | 9.E-05 | 1.8 |
| msAD | lnc-BRD1-7:1 | SEQ3908 | 3.E-02 | 1.6 | DLB | lnc-SCTR-2:1 | SEQ5676 | 1.E-02 | 2.0 |
| DLB | lnc-BRF1-12:1 | SEQ4271 | 2.E-04 | 2.6 | All AD | lnc-SDCBP-2:8 | SEQ3720 | 4.E-02 | 0.8 |
| msAD | lnc-BRF1-12:1 | SEQ4271 | 8.E-04 | 1.9 | msAD | lnc-SDCBP-2:8 | SEQ3720 | 4.E-02 | 0.8 |
| All AD | lnc-BRF1-12:1 | SEQ4271 | 1.E-03 | 1.8 | FTD | lnc-SDE2-1:15 | SEQ5367 | 5.E-05 | 0.4 |
| miAD | lnc-BRF1-12:1 | SEQ4271 | 7.E-03 | 1.7 | MCI | lnc-SDE2-1:15 | SEQ5367 | 5.E-04 | 0.5 |
| DLB | lnc-BRF2-2:1 | SEQ5012 | 7.E-04 | 1.3 | MCI | lnc-SDE2-1:5 | SEQ5211 | 5.E-04 | 1.8 |
| DLB | lnc-BRI3-2:1 | SEQ4573 | 1.E-04 | 1.6 | FTD | lnc-SEC22C-2:12 | SEQ5469 | 3.E-04 | 0.6 |
| MCI | lnc-BRI3-2:1 | SEQ4573 | 2.E-03 | 1.5 | All AD | lnc-SEC22C-2:12 | SEQ5469 | 5.E-02 | 0.8 |
| FTD | lnc-BST1-2:1 | SEQ4736 | 7.E-04 | 0.7 | DLB | lnc-SEC24A-2:2 | SEQ4707 | 1.E-03 | 1.5 |
| MCI | lnc-BST1-2:1 | SEQ4736 | 1.E-03 | 0.6 | miAD | lnc-SELENOP-5:1 | SEQ5077 | 6.E-04 | 1.3 |
| FTD | lnc-BTBD1-2:1 | SEQ2683 | 4.E-04 | 0.7 | All AD | lnc-SELENOP-5:1 | SEQ5077 | 5.E-03 | 1.2 |
| DLB | lnc-BTBD6-2:1 | SEQ2709 | 2.E-05 | 1.7 | FTD | lnc-SEMA4B-6:2 | SEQ5588 | 2.E-04 | 0.5 |
| FTD | lnc-BTD-2:1 | SEQ5307 | 8.E-05 | 1.5 | All AD | lnc-SEMA4D-5:3 | SEQ5589 | 4.E-02 | 0.8 |
| MCI | lnc-BTD-2:1 | SEQ5307 | 4.E-04 | 1.3 | FTD | lnc-SENP6-12:1 | SEQ4188 | 5.E-06 | 0.5 |
| All AD | lnc-BTN2A2-1:1 | SEQ4230 | 9.E-03 | 0.7 | miAD | lnc-SENP6-12:1 | SEQ4188 | 1.E-02 | 0.7 |
| msAD | lnc-BTN2A2-1:1 | SEQ4230 | 1.E-02 | 0.7 | All AD | lnc-SENP6-12:1 | SEQ4188 | 2.E-02 | 0.7 |
| FTD | lnc-BTNL8-7:1 | SEQ4119 | 1.E-06 | 1.7 | DLB | lnc-SENP8-2:1 | SEQ3941 | 3.E-05 | 1.5 |
| MCI | lnc-BTNL8-7:1 | SEQ4119 | 1.E-05 | 2.0 | MCI | lnc-SENP8-2:1 | SEQ3941 | 1.E-03 | 1.4 |
| DLB | lnc-BTNL8-7:1 | SEQ4119 | 1.E-03 | 1.8 | All AD | lnc-SENP8-2:1 | SEQ3941 | 8.E-03 | 1.2 |
| miAD | lnc-BTNL8-7:1 | SEQ4119 | 1.E-02 | 1.2 | miAD | lnc-SENP8-2:1 | SEQ3941 | 1.E-02 | 1.2 |
| All AD | lnc-BTNL8-7:1 | SEQ4119 | 2.E-02 | 1.2 | msAD | lnc-SENP8-2:1 | SEQ3941 | 3.E-02 | 1.2 |
| DLB | lnc-BYSL-2:1 | SEQ3918 | 6.E-05 | 1.7 | DLB | lnc-SEPT14-4:1 | SEQ5254 | 5.E-04 | 1.5 |
| MCI | lnc-BYSL-2:1 | SEQ3918 | 4.E-04 | 1.6 | DLB | lnc-SEPT3-4:1 | SEQ4635 | 1.E-03 | 1.5 |
| FTD | lnc-BYSL-2:1 | SEQ3918 | 6.E-04 | 1.3 | MCI | lnc-SERF1B-1:4 | SEQ5583 | 9.E-05 | 2.4 |
| All AD | lnc-BYSL-2:1 | SEQ3918 | 2.E-02 | 1.2 | DLB | lnc-SERF1B-1:4 | SEQ5583 | 2.E-04 | 2.2 |
| msAD | lnc-BYSL-2:1 | SEQ3918 | 3.E-02 | 1.2 | All AD | lnc-SERF1B-1:4 | SEQ5583 | 5.E-02 | 1.2 |
| DLB | lnc-BYSL-3:2 | SEQ4613 | 1.E-03 | 1.3 | MCI | lnc-SERHL2-1:11 | SEQ3755 | 7.E-04 | 1.7 |
| miAD | lnc-BZW1-1:1 | SEQ4153 | 1.E-02 | 0.7 | DLB | lnc-SERHL2-1:11 | SEQ3755 | 2.E-03 | 1.7 |
| All AD | lnc-BZW1-1:1 | SEQ4153 | 4.E-02 | 0.8 | All AD | lnc-SERHL2-1:11 | SEQ3755 | 3.E-02 | 1.2 |
| DLB | lnc-C11orf54-1:1 | SEQ5712 | 1.E-03 | 2.1 | msAD | lnc-SERHL2-1:11 | SEQ3755 | 4.E-02 | 1.3 |
| FTD | lnc-C11orf63-5:4 | SEQ4816 | 1.E-03 | 1.4 | MCI | lnc-SERHL2-1:6 | SEQ4318 | 2.E-05 | 1.8 |
| FTD | lnc-C12orf40-7:1 | SEQ4278 | 3.E-06 | 0.5 | DLB | lnc-SERHL2-1:6 | SEQ4318 | 9.E-04 | 1.6 |
| All AD | lnc-C12orf40-7:1 | SEQ4278 | 2.E-04 | 0.6 | FTD | lnc-SERHL2-1:6 | SEQ4318 | 1.E-03 | 1.5 |
| miAD | lnc-C12orf40-7:1 | SEQ4278 | 3.E-04 | 0.5 | All AD | lnc-SERHL2-1:6 | SEQ4318 | 3.E-03 | 1.3 |
| msAD | lnc-C12orf40-7:1 | SEQ4278 | 2.E-03 | 0.6 | msAD | lnc-SERHL2-1:6 | SEQ4318 | 6.E-03 | 1.3 |

TABLE 10-continued 2847 whole blood (Paxgene RNA tube) lncRNAs differentially expressed in MCI group or mild AD group or moderate-to-severe AD group or both of these AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| DLB | lnc-C12orf73-1:1 | SEQ3349 | 2.E-05 | 1.5 | miAD | lnc-SERHL2-1:6 | SEQ4318 | 6.E-03 | 1.3 |
| miAD | lnc-C13orf42-1:1 | SEQ4110 | 1.E-02 | 0.7 | FTD | lnc-SERHL2-1:7 | SEQ4881 | 4.E-04 | 2.4 |
| All AD | lnc-C13orf42-1:1 | SEQ4110 | 3.E-02 | 0.7 | MCI | lnc-SERHL2-1:7 | SEQ4881 | 8.E-04 | 2.5 |
| FTD | lnc-C14orf28-2:1 | SEQ2528 | 6.E-05 | 0.5 | DLB | lnc-SERHL2-1:7 | SEQ4881 | 9.E-04 | 2.2 |
| All AD | lnc-C14orf28-2:1 | SEQ2528 | 2.E-02 | 0.7 | MCI | lnc-SERHL2-1:8 | SEQ0546 | 7.E-04 | 1.6 |
| msAD | lnc-C14orf28-2:1 | SEQ2528 | 5.E-02 | 0.7 | All AD | lnc-SERHL2-1:8 | SEQ0546 | 6.E-03 | 1.3 |
| msAD | lnc-C14orf79-5:1 | SEQ3897 | 3.E-02 | 1.2 | msAD | lnc-SERHL2-1:8 | SEQ0546 | 9.E-03 | 1.3 |
| All AD | lnc-C14orf79-5:1 | SEQ3897 | 4.E-02 | 1.2 | MCI | lnc-SERHL2-4:2 | SEQ4393 | 2.E-03 | 0.5 |
| All AD | lnc-C15orf39-1:1 | SEQ4281 | 2.E-02 | 0.8 | MCI | lnc-SERHL2-4:4 | SEQ4394 | 2.E-03 | 0.5 |
| DLB | lnc-C16orf45-4:1 | SEQ5312 | 4.E-04 | 1.4 | miAD | lnc-SERHL2-8:1 | SEQ4540 | 2.E-03 | 1.3 |
| DLB | lnc-C17orf97-5:2 | SEQ5523 | 2.E-04 | 1.4 | All AD | lnc-SERHL2-8:1 | SEQ4540 | 9.E-03 | 1.2 |
| DLB | lnc-C19orf44-5:1 | SEQ5788 | 6.E-05 | 1.5 | FTD | lnc-SERINC1-3:1 | SEQ5720 | 1.E-04 | 0.6 |
| DLB | lnc-C19orf44-8:3 | SEQ4697 | 1.E-03 | 1.5 | MCI | lnc-SERP1-4:1 | SEQ5692 | 2.E-05 | 1.4 |
| All AD | lnc-C19orf57-6:6 | SEQ4283 | 4.E-02 | 0.8 | DLB | lnc-SERP1-4:1 | SEQ5692 | 1.E-04 | 1.4 |
| All AD | lnc-C19orf57-6:7 | SEQ4284 | 3.E-02 | 0.8 | All AD | lnc-SERPINA1-1:1 | SEQ3844 | 2.E-02 | 0.7 |
| FTD | lnc-C1orf186-6:1 | SEQ6003 | 6.E-08 | 0.5 | msAD | lnc-SERPINA1-1:1 | SEQ3844 | 3.E-02 | 0.8 |
| MCI | lnc-C1orf35-3:1 | SEQ4052 | 8.E-05 | 1.7 | FTD | lnc-SERPINA11-1:1 | SEQ3698 | 1.E-04 | 2.0 |
| DLB | lnc-C1orf35-3:1 | SEQ4052 | 7.E-04 | 1.6 | MCI | lnc-SERPINA11-1:1 | SEQ3698 | 3.E-04 | 2.3 |
| msAD | lnc-C1orf35-3:1 | SEQ4052 | 2.E-02 | 1.2 | msAD | lnc-SERPINA11-1:1 | SEQ3698 | 5.E-02 | 1.2 |
| All AD | lnc-C1orf35-3:1 | SEQ4052 | 3.E-02 | 1.2 | DLB | lnc-SERPINB1-1:10 | SEQ5697 | 1.E-04 | 1.6 |
| MCI | lnc-C1orf35-3:2 | SEQ4274 | 4.E-05 | 1.7 | DLB | lnc-SERPINF1-1:1 | SEQ4683 | 1.E-03 | 1.4 |
| DLB | lnc-C1orf35-3:2 | SEQ4274 | 5.E-04 | 1.6 | DLB | lnc-SERTAD2-1:3 | SEQ5660 | 1.E-04 | 1.5 |
| msAD | lnc-C1orf35-3:2 | SEQ4274 | 8.E-03 | 1.3 | msAD | lnc-SERTAD2-3:4 | SEQ3883 | 3.E-02 | 1.5 |
| All AD | lnc-C1orf35-3:2 | SEQ4274 | 2.E-02 | 1.2 | FTD | lnc-SETD7-3:3 | SEQ5235 | 5.E-04 | 0.7 |
| DLB | lnc-C1QBP-1:1 | SEQ3351 | 8.E-04 | 1.5 | DLB | lnc-SFMBT2-3:1 | SEQ5024 | 7.E-04 | 1.5 |
| FTD | lnc-C1QTNF1-9:1 | SEQ3652 | 3.E-04 | 0.6 | DLB | lnc-SFPQ-2:1 | SEQ0169 | 1.E-03 | 1.5 |
| All AD | lnc-C1QTNF1-9:1 | SEQ3652 | 2.E-02 | 0.7 | FTD | lnc-SFPQ-2:2 | SEQ5549 | 2.E-04 | 0.6 |
| msAD | lnc-C1QTNF1-9:1 | SEQ3652 | 5.E-02 | 0.8 | DLB | lnc-SFPQ-2:4 | SEQ4721 | 1.E-03 | 1.8 |
| DLB | lnc-C1QTNF8-4:1 | SEQ5257 | 5.E-04 | 1.5 | miAD | lnc-SFRP4-3:1 | SEQ4187 | 1.E-02 | 0.7 |
| FTD | lnc-C1R-1:1 | SEQ4288 | 2.E-06 | 0.5 | All AD | lnc-SFRP4-3:1 | SEQ4187 | 1.E-02 | 0.7 |
| All AD | lnc-C1R-1:1 | SEQ4288 | 2.E-02 | 0.7 | FTD | lnc-SFRP4-3:3 | SEQ4215 | 4.E-04 | 0.6 |
| FTD | lnc-C20orf196-4:1 | SEQ4290 | 4.E-04 | 0.6 | All AD | lnc-SFRP4-3:3 | SEQ4215 | 4.E-03 | 0.7 |
| All AD | lnc-C20orf196-4:1 | SEQ4290 | 5.E-02 | 0.7 | msAD | lnc-SFRP4-3:3 | SEQ4215 | 9.E-03 | 0.7 |
| msAD | lnc-C20orf85-3:1 | SEQ3946 | 3.E-02 | 0.8 | miAD | lnc-SFRP4-3:3 | SEQ4215 | 1.E-02 | 0.6 |
| All AD | lnc-C20orf85-3:1 | SEQ3946 | 3.E-02 | 0.8 | DLB | lnc-SGCA-4:2 | SEQ5566 | 2.E-04 | 1.6 |
| DLB | lnc-C20orf96-1:1 | SEQ2764 | 3.E-05 | 1.5 | DLB | lnc-SGSM3-6:1 | SEQ4748 | 1.E-03 | 1.4 |
| DLB | lnc-C21orf58-1:2 | SEQ0033 | 2.E-04 | 1.7 | FTD | lnc-SGTB-5:1 | SEQ4353 | 1.E-04 | 0.6 |
| DLB | lnc-C21orf58-1:5 | SEQ5207 | 5.E-04 | 1.7 | miAD | lnc-SGTB-5:1 | SEQ4353 | 4.E-03 | 0.6 |
| All AD | lnc-C21orf58-1:8 | SEQ4293 | 4.E-02 | 1.4 | All AD | lnc-SGTB-5:1 | SEQ4353 | 2.E-02 | 0.7 |
| All AD | lnc-C5orf56-3:1 | SEQ4294 | 3.E-02 | 0.8 | MCI | lnc-SH2D7-3:1 | SEQ5864 | 7.E-06 | 2.1 |
| miAD | lnc-C6orf132-5:1 | SEQ4197 | 7.E-04 | 1.4 | DLB | lnc-SH2D7-3:1 | SEQ5864 | 4.E-05 | 2.1 |
| All AD | lnc-C6orf132-5:1 | SEQ4197 | 1.E-03 | 1.4 | FTD | lnc-SH3BGRL-1:1 | SEQ5743 | 9.E-05 | 0.6 |
| msAD | lnc-C6orf132-5:1 | SEQ4197 | 1.E-02 | 1.3 | DLB | lnc-SH3GL1-1:1 | SEQ5375 | 3.E-04 | 1.5 |
| FTD | lnc-C6orf201-6:2 | SEQ5871 | 3.E-05 | 0.5 | FTD | lnc-SH3KBP1-1:1 | SEQ5090 | 6.E-04 | 0.7 |
| FTD | lnc-C6orf222-4:2 | SEQ4297 | 4.E-04 | 0.7 | miAD | lnc-SHANK2-1:7 | SEQ4349 | 5.E-03 | 0.7 |
| miAD | lnc-C6orf222-4:2 | SEQ4297 | 4.E-03 | 0.6 | All AD | lnc-SHANK2-1:7 | SEQ4349 | 9.E-03 | 0.8 |
| All AD | lnc-C6orf222-4:2 | SEQ4297 | 1.E-02 | 0.7 | FTD | lnc-SHANK2-5:1 | SEQ4366 | 8.E-07 | 0.5 |
| FTD | lnc-C6orf62-1:1 | SEQ3990 | 4.E-07 | 0.5 | All AD | lnc-SHANK2-5:1 | SEQ4366 | 9.E-04 | 0.7 |
| MCI | lnc-C6orf62-1:1 | SEQ3990 | 8.E-04 | 0.6 | miAD | lnc-SHANK2-5:1 | SEQ4366 | 1.E-03 | 0.7 |
| All AD | lnc-C6orf62-1:1 | SEQ3990 | 8.E-03 | 0.7 | msAD | lnc-SHANK2-5:1 | SEQ4366 | 4.E-03 | 0.7 |
| miAD | lnc-C6orf62-1:1 | SEQ3990 | 1.E-02 | 0.6 | DLB | lnc-SHISA5-2:1 | SEQ4926 | 8.E-04 | 1.4 |
| msAD | lnc-C6orf62-1:1 | SEQ3990 | 2.E-02 | 0.7 | FTD | lnc-SHOC2-1:2 | SEQ4604 | 1.E-05 | 0.6 |
| All AD | lnc-C9orf3-6:1 | SEQ4302 | 3.E-02 | 0.8 | MCI | lnc-SHOC2-1:2 | SEQ4604 | 1.E-03 | 0.7 |
| All AD | lnc-CA4-2:1 | SEQ4303 | 2.E-02 | 0.8 | miAD | lnc-SHOC2-1:2 | SEQ4604 | 1.E-03 | 0.7 |
| DLB | lnc-CA6-8:1 | SEQ2536 | 2.E-04 | 1.4 | All AD | lnc-SHOC2-1:2 | SEQ4604 | 9.E-03 | 0.7 |
| miAD | lnc-CA6-8:1 | SEQ2536 | 2.E-04 | 1.3 | FTD | lnc-SHOC2-3:1 | SEQ5833 | 5.E-05 | 0.6 |
| All AD | lnc-CA6-8:1 | SEQ2536 | 2.E-03 | 1.2 | FTD | lnc-SHOC2-3:2 | SEQ5985 | 2.E-06 | 0.6 |
| msAD | lnc-CA6-8:1 | SEQ2536 | 2.E-03 | 1.2 | FTD | lnc-SHOX2-8:1 | SEQ5290 | 4.E-04 | 0.6 |
| DLB | lnc-CA6-8:2 | SEQ2380 | 4.E-06 | 1.6 | DLB | lnc-SIKE1-2:2 | SEQ5110 | 6.E-04 | 1.4 |
| FTD | lnc-CA6-8:2 | SEQ2380 | 4.E-05 | 1.3 | DLB | lnc-SIPA1-2:1 | SEQ5438 | 3.E-04 | 1.5 |
| MCI | lnc-CA6-8:2 | SEQ2380 | 4.E-05 | 1.5 | FTD | lnc-SIPA1L1-2:8 | SEQ5681 | 1.E-04 | 0.5 |
| msAD | lnc-CA6-8:2 | SEQ2380 | 2.E-04 | 1.2 | FTD | lnc-SIPA1L1-2:8 | SEQ5856 | 4.E-05 | 0.5 |
| All AD | lnc-CA6-8:2 | SEQ2380 | 5.E-04 | 1.2 | DLB | lnc-SIPA1L3-4:2 | SEQ4764 | 2.E-04 | 1.5 |
| miAD | lnc-CA6-8:2 | SEQ2380 | 6.E-03 | 1.2 | MCI | lnc-SIPA1L3-4:2 | SEQ4764 | 1.E-03 | 1.5 |
| FTD | lnc-CACNB2-1:1 | SEQ2386 | 5.E-04 | 0.6 | miAD | lnc-SIRPG-5:3 | SEQ4357 | 2.E-03 | 0.7 |
| FTD | lnc-CACNG1-1:2 | SEQ5592 | 2.E-04 | 0.6 | All AD | lnc-SIRPG-5:3 | SEQ4357 | 3.E-02 | 0.8 |
| FTD | lnc-CALCB-4:1 | SEQ5939 | 1.E-05 | 0.6 | DLB | lnc-SIVA1-1:1 | SEQ5249 | 5.E-04 | 1.5 |
| DLB | lnc-CALHM1-1:3 | SEQ3992 | 1.E-03 | 1.5 | FTD | lnc-SKIL-4:1 | SEQ3966 | 8.E-06 | 0.4 |
| All AD | lnc-CALHM1-1:3 | SEQ3992 | 2.E-02 | 1.2 | MCI | lnc-SKIL-4:1 | SEQ3966 | 6.E-04 | 0.4 |
| msAD | lnc-CALHM1-1:3 | SEQ3992 | 2.E-02 | 1.2 | All AD | lnc-SKIL-4:1 | SEQ3966 | 7.E-03 | 0.6 |
| DLB | lnc-CAMK2D-1:1 | SEQ4309 | 2.E-03 | 2.0 | miAD | lnc-SKIL-4:1 | SEQ3966 | 9.E-03 | 0.6 |
| All AD | lnc-CAMK2D-1:1 | SEQ4309 | 4.E-02 | 1.3 | msAD | lnc-SKIL-4:1 | SEQ3966 | 2.E-02 | 0.6 |
| FTD | lnc-CAND2-2:2 | SEQ5507 | 2.E-04 | 0.3 | DLB | lnc-SKIV2L2-1:2 | SEQ4745 | 1.E-03 | 1.4 |
| FTD | lnc-CAND2-2:4 | SEQ5098 | 2.E-04 | 0.2 | DLB | lnc-SLA2-1:1 | SEQ3570 | 2.E-03 | 1.4 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| MCI | lnc-CAND2-2:4 | SEQ5098 | 6.E-04 | 0.2 | FTD | lnc-SLAMF7-2:13 | SEQ5719 | 1.E-04 | 0.6 |
| MCI | lnc-CARD14-1:1 | SEQ4701 | 1.E-03 | 1.5 | DLB | lnc-SLC10A1-1:1 | SEQ5022 | 7.E-04 | 1.4 |
| MCI | lnc-CASC1-1:1 | SEQ4548 | 2.E-03 | 0.6 | DLB | lnc-SLC11A2-8:1 | SEQ4443 | 1.E-04 | 1.7 |
| FTD | lnc-CASC1-2:1 | SEQ4146 | 3.E-03 | 0.5 | MCI | lnc-SLC11A2-8:1 | SEQ4443 | 2.E-03 | 1.6 |
| miAD | lnc-CASC1-2:1 | SEQ4146 | 1.E-02 | 0.6 | FTD | lnc-SLC12A6-1:1 | SEQ4113 | 1.E-06 | 0.6 |
| All AD | lnc-CASC1-2:1 | SEQ4146 | 2.E-02 | 0.7 | miAD | lnc-SLC12A6-1:1 | SEQ4113 | 1.E-02 | 0.7 |
| FTD | lnc-CASC1-3:1 | SEQ4315 | 1.E-05 | 0.6 | All AD | lnc-SLC12A6-1:1 | SEQ4113 | 4.E-02 | 0.7 |
| miAD | lnc-CASC1-3:1 | SEQ4315 | 4.E-03 | 0.7 | FTD | lnc-SLC12A8-3:1 | SEQ5629 | 6.E-06 | 0.5 |
| All AD | lnc-CASC1-3:1 | SEQ4315 | 1.E-02 | 0.8 | All AD | lnc-SLC12A8-3:1 | SEQ5629 | 3.E-02 | 0.7 |
| FTD | lnc-CASP10-1:3 | SEQ4317 | 3.E-05 | 0.6 | DLB | lnc-SLC15A3-2:1 | SEQ5708 | 9.E-05 | 1.9 |
| All AD | lnc-CASP10-1:3 | SEQ4317 | 3.E-02 | 0.8 | MCI | lnc-SLC15A3-2:1 | SEQ5708 | 1.E-04 | 1.8 |
| DLB | lnc-CASTOR2-1:1 | SEQ4415 | 2.E-03 | 1.4 | DLB | lnc-SLC16A11-7:11 | SEQ4711 | 1.E-03 | 1.5 |
| DLB | lnc-CATSPERB-1:1 | SEQ4695 | 1.E-03 | 1.4 | FTD | lnc-SLC16A3-7:1 | SEQ5963 | 5.E-06 | 0.5 |
| FTD | lnc-CAV2-2:1 | SEQ5984 | 2.E-06 | 0.5 | All AD | lnc-SLC16A3-8:1 | SEQ3859 | 8.E-03 | 0.7 |
| FTD | lnc-CAVIN2-1:1 | SEQ4219 | 1.E-07 | 0.5 | miAD | lnc-SLC16A3-8:1 | SEQ3859 | 9.E-03 | 0.7 |
| miAD | lnc-CAVIN2-1:1 | SEQ4219 | 2.E-03 | 0.6 | msAD | lnc-SLC16A3-8:1 | SEQ3859 | 3.E-02 | 0.7 |
| All AD | lnc-CAVIN2-1:1 | SEQ4219 | 2.E-03 | 0.7 | FTD | lnc-SLC1A3-1:1 | SEQ0547 | 2.E-07 | 0.5 |
| msAD | lnc-CAVIN2-1:1 | SEQ4219 | 1.E-02 | 0.7 | MCI | lnc-SLC1A3-1:1 | SEQ0547 | 5.E-04 | 0.6 |
| DLB | lnc-CBARP-6:1 | SEQ5560 | 2.E-04 | 1.5 | All AD | lnc-SLC1A3-1:1 | SEQ0547 | 2.E-02 | 0.7 |
| FTD | lnc-CBR3-2:2 | SEQ5972 | 2.E-06 | 0.5 | miAD | lnc-SLC22A1-2:1 | SEQ4277 | 8.E-03 | 0.7 |
| MCI | lnc-CBR3-2:2 | SEQ5972 | 3.E-06 | 0.5 | All AD | lnc-SLC22A1-2:1 | SEQ4277 | 1.E-02 | 0.8 |
| DLB | lnc-CBS-2:1 | SEQ5386 | 3.E-04 | 1.7 | miAD | lnc-SLC22A1-3:2 | SEQ4114 | 1.E-02 | 0.7 |
| miAD | lnc-CBWD5-1:1 | SEQ3662 | 5.E-03 | 0.6 | All AD | lnc-SLC22A1-3:2 | SEQ4114 | 1.E-02 | 0.8 |
| All AD | lnc-CBWD5-1:1 | SEQ3662 | 8.E-03 | 0.7 | All AD | lnc-SLC22A2-1:1 | SEQ5638 | 5.E-02 | 0.8 |
| msAD | lnc-CBWD5-1:1 | SEQ3662 | 5.E-02 | 0.7 | miAD | lnc-SLC22A2-3:1 | SEQ4286 | 7.E-03 | 0.7 |
| All AD | lnc-CBX6-2:1 | SEQ3911 | 8.E-03 | 0.7 | All AD | lnc-SLC22A2-3:1 | SEQ4286 | 1.E-02 | 0.7 |
| miAD | lnc-CBX6-2:1 | SEQ3911 | 9.E-03 | 0.7 | DLB | lnc-SLC22A31-2:1 | SEQ4490 | 1.E-03 | 1.4 |
| msAD | lnc-CBX6-2:1 | SEQ3911 | 3.E-02 | 0.7 | MCI | lnc-SLC22A31-2:1 | SEQ4490 | 2.E-03 | 1.4 |
| DLB | lnc-CCDC146-1:12 | SEQ4553 | 2.E-03 | 1.3 | DLB | lnc-SLC22A31-4:1 | SEQ5559 | 2.E-04 | 1.4 |
| FTD | lnc-CCDC146-2:1 | SEQ5407 | 3.E-04 | 0.6 | FTD | lnc-SLC25A3-7:1 | SEQ2447 | 2.E-07 | 0.5 |
| FTD | lnc-CCDC150-3:1 | SEQ4325 | 1.E-06 | 0.6 | MCI | lnc-SLC25A3-7:1 | SEQ2447 | 2.E-05 | 0.6 |
| All AD | lnc-CCDC150-3:1 | SEQ4325 | 4.E-02 | 0.8 | All AD | lnc-SLC25A3-7:1 | SEQ2447 | 4.E-03 | 0.7 |
| FTD | lnc-CCDC150-4:1 | SEQ5948 | 8.E-06 | 0.6 | miAD | lnc-SLC25A3-7:1 | SEQ2447 | 5.E-03 | 0.7 |
| DLB | lnc-CCDC150-7:1 | SEQ5217 | 3.E-04 | 2.2 | msAD | lnc-SLC25A3-7:1 | SEQ2447 | 1.E-02 | 0.7 |
| MCI | lnc-CCDC150-7:1 | SEQ5217 | 5.E-04 | 2.0 | DLB | lnc-SLC25A39-2:1 | SEQ5393 | 4.E-05 | 0.2 |
| FTD | lnc-CCDC17-1:1 | SEQ5415 | 3.E-04 | 0.7 | MCI | lnc-SLC25A39-2:1 | SEQ5393 | 3.E-04 | 0.2 |
| DLB | lnc-CCDC173-6:1 | SEQ4524 | 2.E-03 | 1.6 | FTD | lnc-SLC25A39-2:1 | SEQ5393 | 3.E-04 | 0.2 |
| FTD | lnc-CCDC175-2:1 | SEQ4894 | 9.E-04 | 0.6 | DLB | lnc-SLC25A51-1:2 | SEQ4740 | 1.E-03 | 1.4 |
| DLB | lnc-CCDC22-1:1 | SEQ4414 | 2.E-03 | 1.4 | DLB | lnc-SLC25A6-4:1 | SEQ3114 | 2.E-04 | 1.6 |
| DLB | lnc-CCDC54-6:4 | SEQ5385 | 3.E-04 | 1.7 | MCI | lnc-SLC25A6-4:1 | SEQ3114 | 1.E-04 | 1.5 |
| FTD | lnc-CCDC68-1:1 | SEQ5424 | 7.E-07 | 0.4 | msAD | lnc-SLC25A6-4:1 | SEQ3114 | 3.E-02 | 1.2 |
| MCI | lnc-CCDC68-1:1 | SEQ5424 | 3.E-04 | 0.5 | MCI | lnc-SLC27A5-2:1 | SEQ4504 | 6.E-04 | 1.5 |
| DLB | lnc-CCDC69-1:1 | SEQ5374 | 3.E-04 | 1.5 | DLB | lnc-SLC27A5-2:1 | SEQ4504 | 2.E-03 | 1.4 |
| FTD | lnc-CCDC7-1:6 | SEQ3656 | 1.E-05 | 2.1 | DLB | lnc-SLC27A5-3:2 | SEQ4552 | 4.E-05 | 1.4 |
| MCI | lnc-CCDC7-1:6 | SEQ3656 | 8.E-05 | 2.1 | MCI | lnc-SLC27A5-3:2 | SEQ4552 | 2.E-03 | 1.3 |
| DLB | lnc-CCDC7-1:6 | SEQ3656 | 2.E-04 | 1.8 | FTD | lnc-SLC2A13-2:3 | SEQ4541 | 6.E-08 | 0.4 |
| All AD | lnc-CCDC7-1:6 | SEQ3656 | 2.E-02 | 1.3 | MCI | lnc-SLC2A13-2:3 | SEQ4541 | 6.E-05 | 0.4 |
| msAD | lnc-CCDC7-1:6 | SEQ3656 | 5.E-02 | 1.3 | All AD | lnc-SLC2A13-2:3 | SEQ4541 | 4.E-04 | 0.5 |
| FTD | lnc-CCDC71L-1:13 | SEQ4331 | 8.E-05 | 0.5 | msAD | lnc-SLC2A13-2:3 | SEQ4541 | 9.E-04 | 0.5 |
| All AD | lnc-CCDC71L-1:13 | SEQ4331 | 3.E-02 | 0.7 | miAD | lnc-SLC2A13-2:3 | SEQ4541 | 2.E-03 | 0.5 |
| FTD | lnc-CCDC71L-1:14 | SEQ4332 | 8.E-05 | 0.5 | DLB | lnc-SLC2A9-3:1 | SEQ5173 | 5.E-04 | 1.3 |
| All AD | lnc-CCDC71L-1:14 | SEQ4332 | 2.E-02 | 0.7 | DLB | lnc-SLC30A5-6:1 | SEQ4050 | 4.E-04 | 1.5 |
| DLB | lnc-CCDC74A-1:3 | SEQ3824 | 2.E-05 | 1.9 | MCI | lnc-SLC30A5-6:1 | SEQ4050 | 4.E-04 | 1.4 |
| MCI | lnc-CCDC74A-1:3 | SEQ3824 | 5.E-04 | 1.6 | miAD | lnc-SLC30A5-6:1 | SEQ4050 | 2.E-03 | 1.2 |
| msAD | lnc-CCDC74A-1:3 | SEQ3824 | 4.E-02 | 1.2 | All AD | lnc-SLC30A5-6:1 | SEQ4050 | 2.E-03 | 1.2 |
| MCI | lnc-CCDC78-4:1 | SEQ5880 | 3.E-05 | 1.7 | msAD | lnc-SLC30A5-6:1 | SEQ4050 | 2.E-02 | 1.2 |
| FTD | lnc-CCDC83-1:1 | SEQ4001 | 8.E-07 | 0.5 | FTD | lnc-SLC35E3-7:1 | SEQ5993 | 1.E-06 | 0.6 |
| miAD | lnc-CCDC83-1:1 | SEQ4001 | 2.E-03 | 0.6 | DLB | lnc-SLC35E3-8:1 | SEQ5769 | 2.E-07 | 0.3 |
| All AD | lnc-CCDC83-1:1 | SEQ4001 | 3.E-03 | 0.6 | MCI | lnc-SLC35E3-8:1 | SEQ5769 | 2.E-06 | 0.2 |
| msAD | lnc-CCDC83-1:1 | SEQ4001 | 2.E-02 | 0.7 | FTD | lnc-SLC35E3-8:1 | SEQ5769 | 7.E-05 | 0.2 |
| FTD | lnc-CCDC85C-2:1 | SEQ2601 | 3.E-04 | 0.7 | FTD | lnc-SLC35E3-8:2 | SEQ4267 | 8.E-07 | 0.4 |
| FTD | lnc-CCNB1IP1-1:2 | SEQ0903 | 1.E-07 | 1.8 | All AD | lnc-SLC35E3-8:2 | SEQ4267 | 3.E-03 | 0.5 |
| MCI | lnc-CCNB1IP1-1:2 | SEQ0903 | 4.E-05 | 1.7 | msAD | lnc-SLC35E3-8:2 | SEQ4267 | 7.E-03 | 0.6 |
| DLB | lnc-CCNB1IP1-1:2 | SEQ0903 | 2.E-04 | 1.5 | miAD | lnc-SLC35E3-8:2 | SEQ4267 | 8.E-03 | 0.5 |
| FTD | lnc-CCNB1IP1-1:3 | SEQ4026 | 4.E-08 | 0.5 | DLB | lnc-SLC35F5-3:11 | SEQ2639 | 1.E-04 | 1.3 |
| DLB | lnc-CCNB1IP1-1:3 | SEQ4026 | 4.E-05 | 0.6 | MCI | lnc-SLC35F5-3:11 | SEQ2639 | 5.E-04 | 1.2 |
| MCI | lnc-CCNB1IP1-1:3 | SEQ4026 | 2.E-04 | 0.6 | MCI | lnc-SLC35G3-1:3 | SEQ3900 | 1.E-04 | 2.9 |
| All AD | lnc-CCNB1IP1-1:3 | SEQ4026 | 6.E-03 | 0.7 | DLB | lnc-SLC35G3-1:3 | SEQ3900 | 6.E-04 | 2.5 |
| miAD | lnc-CCNB1IP1-1:3 | SEQ4026 | 1.E-02 | 0.7 | All AD | lnc-SLC35G3-1:3 | SEQ3900 | 1.E-02 | 1.5 |
| msAD | lnc-CCNB1IP1-1:3 | SEQ4026 | 2.E-02 | 0.7 | msAD | lnc-SLC35G3-1:3 | SEQ3900 | 3.E-02 | 1.5 |
| FTD | lnc-CCNB1IP1-1:4 | SEQ5261 | 1.E-07 | 1.9 | DLB | lnc-SLC37A2-2:1 | SEQ2906 | 2.E-04 | 1.5 |
| MCI | lnc-CCNB1IP1-1:4 | SEQ5261 | 3.E-05 | 1.7 | DLB | lnc-SLC38A3-1:1 | SEQ4724 | 6.E-05 | 2.3 |
| DLB | lnc-CCNB1IP1-1:4 | SEQ5261 | 5.E-04 | 1.5 | MCI | lnc-SLC38A3-1:1 | SEQ4724 | 1.E-03 | 1.9 |
| FTD | lnc-CCNB1IP1-1:5 | SEQ4027 | 2.E-08 | 0.5 | FTD | lnc-SLC39A10-10:1 | SEQ3806 | 6.E-08 | 1.7 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| DLB | lnc-CCNB1IP1-1:5 | SEQ4027 | 4.E-05 | 0.6 | MCI | lnc-SLC39A10-10:1 | SEQ3806 | 4.E-06 | 1.8 |
| MCI | lnc-CCNB1IP1-1:5 | SEQ4027 | 2.E-04 | 0.6 | DLB | lnc-SLC39A10-10:1 | SEQ3806 | 5.E-05 | 1.6 |
| All AD | lnc-CCNB1IP1-1:5 | SEQ4027 | 7.E-03 | 0.7 | miAD | lnc-SLC39A10-10:1 | SEQ3806 | 2.E-03 | 1.3 |
| miAD | lnc-CCNB1IP1-1:5 | SEQ4027 | 1.E-02 | 0.7 | All AD | lnc-SLC39A10-10:1 | SEQ3806 | 4.E-03 | 1.2 |
| msAD | lnc-CCNB1IP1-1:5 | SEQ4027 | 2.E-02 | 0.7 | msAD | lnc-SLC39A10-10:1 | SEQ3806 | 4.E-02 | 1.2 |
| FTD | lnc-CCNYL1-2:1 | SEQ5810 | 1.E-06 | 0.3 | FTD | lnc-SLC39A10-3:1 | SEQ3934 | 1.E-08 | 0.5 |
| MCI | lnc-CCNYL1-2:1 | SEQ5810 | 5.E-05 | 0.3 | MCI | lnc-SLC39A10-3:1 | SEQ3934 | 4.E-04 | 0.7 |
| FTD | lnc-CCNYL1-2:2 | SEQ4344 | 2.E-05 | 0.6 | All AD | lnc-SLC39A10-3:1 | SEQ3934 | 1.E-02 | 0.7 |
| All AD | lnc-CCNYL1-2:2 | SEQ4344 | 3.E-02 | 0.7 | msAD | lnc-SLC39A10-3:1 | SEQ3934 | 3.E-02 | 0.7 |
| DLB | lnc-CCT4-1:8 | SEQ3356 | 2.E-03 | 1.9 | miAD | lnc-SLC45A1-1:7 | SEQ4103 | 1.E-02 | 0.6 |
| miAD | lnc-CCT8-6:4 | SEQ4292 | 7.E-03 | 0.6 | All AD | lnc-SLC45A1-1:7 | SEQ4103 | 2.E-02 | 0.7 |
| All AD | lnc-CCT8-6:4 | SEQ4292 | 2.E-02 | 0.6 | All AD | lnc-SLC48A1-1:8 | SEQ3648 | 2.E-02 | 0.7 |
| miAD | lnc-CD300C-2:1 | SEQ4256 | 9.E-03 | 0.5 | msAD | lnc-SLC48A1-1:8 | SEQ3648 | 5.E-02 | 0.7 |
| All AD | lnc-CD300C-2:1 | SEQ4256 | 2.E-02 | 0.5 | DLB | lnc-SLC4A11-1:1 | SEQ5515 | 2.E-04 | 1.4 |
| DLB | lnc-CD3D-3:1 | SEQ4140 | 6.E-04 | 1.8 | DLB | lnc-SLC6A18-2:1 | SEQ4175 | 8.E-05 | 2.5 |
| MCI | lnc-CD3D-3:1 | SEQ4140 | 7.E-04 | 1.6 | All AD | lnc-SLC6A18-2:1 | SEQ4175 | 8.E-03 | 1.4 |
| miAD | lnc-CD3D-3:1 | SEQ4140 | 1.E-02 | 1.2 | msAD | lnc-SLC6A18-2:1 | SEQ4175 | 1.E-02 | 1.5 |
| FTD | lnc-CD47-8:1 | SEQ5884 | 3.E-05 | 0.5 | DLB | lnc-SLC6A9-6:1 | SEQ5663 | 1.E-04 | 1.7 |
| FTD | lnc-CD53-1:1 | SEQ5092 | 6.E-04 | 0.7 | All AD | lnc-SLC6A9-6:1 | SEQ5663 | 4.E-02 | 1.2 |
| DLB | lnc-CDC42-2:1 | SEQ4880 | 9.E-04 | 2.2 | DLB | lnc-SLC9A3-1:3 | SEQ5148 | 6.E-04 | 2.1 |
| DLB | lnc-CDC42BPB-4:3 | SEQ4486 | 2.E-03 | 1.4 | All AD | lnc-SLC9A3-1:3 | SEQ5148 | 4.E-02 | 1.3 |
| DLB | lnc-CDC42SE2-1:10 | SEQ2613 | 1.E-04 | 1.6 | DLB | lnc-SLC9A6-1:2 | SEQ4755 | 2.E-04 | 1.5 |
| MCI | lnc-CDC42SE2-1:10 | SEQ2613 | 7.E-04 | 1.5 | MCI | lnc-SLC9A6-1:2 | SEQ4755 | 1.E-03 | 1.4 |
| DLB | lnc-CDC42SE2-1:3 | SEQ4652 | 1.E-04 | 2.1 | All AD | lnc-SLC9A8-3:4 | SEQ5665 | 2.E-02 | 0.6 |
| MCI | lnc-CDC42SE2-1:3 | SEQ4652 | 1.E-03 | 1.8 | miAD | lnc-SLC9A8-3:5 | SEQ4190 | 1.E-02 | 0.7 |
| FTD | lnc-CDC73-5:1 | SEQ5969 | 4.E-06 | 0.6 | FTD | lnc-SLCO4C1-5:1 | SEQ3971 | 8.E-08 | 0.4 |
| DLB | lnc-CDC73-6:2 | SEQ4609 | 1.E-03 | 1.3 | miAD | lnc-SLCO4C1-5:1 | SEQ3971 | 5.E-04 | 0.5 |
| miAD | lnc-CDCA2-4:1 | SEQ3166 | 7.E-03 | 0.7 | MCI | lnc-SLCO4C1-5:1 | SEQ3971 | 9.E-04 | 0.5 |
| All AD | lnc-CDCA2-4:1 | SEQ3166 | 2.E-02 | 0.7 | All AD | lnc-SLCO4C1-5:1 | SEQ3971 | 2.E-03 | 0.6 |
| FTD | lnc-CDH26-9:1 | SEQ5746 | 9.E-05 | 0.7 | msAD | lnc-SLCO4C1-5:1 | SEQ3971 | 2.E-02 | 0.6 |
| All AD | lnc-CDHR3-7:1 | SEQ4352 | 5.E-02 | 0.7 | FTD | lnc-SLCO6A1-3:1 | SEQ5678 | 1.E-04 | 0.4 |
| DLB | lnc-CDIPT-1:11 | SEQ3359 | 2.E-03 | 1.4 | FTD | lnc-SLF1-4:2 | SEQ4985 | 8.E-06 | 0.5 |
| msAD | lnc-CDIPT-1:9 | SEQ3716 | 4.E-02 | 1.2 | miAD | lnc-SLF1-4:2 | SEQ4985 | 8.E-05 | 0.5 |
| FTD | lnc-CDIPT-2:1 | SEQ4354 | 8.E-08 | 1.5 | All AD | lnc-SLF1-4:2 | SEQ4985 | 5.E-03 | 0.6 |
| DLB | lnc-CDIPT-2:1 | SEQ4354 | 2.E-07 | 1.9 | FTD | lnc-SLF1-7:1 | SEQ3722 | 1.E-03 | 0.6 |
| MCI | lnc-CDIPT-2:1 | SEQ4354 | 6.E-07 | 1.7 | All AD | lnc-SLF1-7:1 | SEQ3722 | 1.E-02 | 0.8 |
| All AD | lnc-CDIPT-2:1 | SEQ4354 | 1.E-04 | 1.3 | miAD | lnc-SLF1-7:1 | SEQ3722 | 1.E-02 | 0.7 |
| msAD | lnc-CDIPT-2:1 | SEQ4354 | 2.E-04 | 1.3 | msAD | lnc-SLF1-7:1 | SEQ3722 | 4.E-02 | 0.8 |
| miAD | lnc-CDIPT-2:1 | SEQ4354 | 8.E-04 | 1.3 | DLB | lnc-SLFN12-1:1 | SEQ5272 | 5.E-04 | 1.7 |
| DLB | lnc-CDIPT-3:1 | SEQ3833 | 3.E-05 | 1.6 | DLB | lnc-SLFN14-2:1 | SEQ4717 | 2.E-04 | 1.9 |
| MCI | lnc-CDIPT-3:1 | SEQ3833 | 8.E-05 | 1.5 | MCI | lnc-SLFN14-2:1 | SEQ4717 | 1.E-03 | 1.7 |
| All AD | lnc-CDIPT-3:1 | SEQ3833 | 1.E-02 | 1.2 | FTD | lnc-SLTM-1:2 | SEQ0982 | 2.E-05 | 0.5 |
| msAD | lnc-CDIPT-3:1 | SEQ3833 | 3.E-02 | 1.2 | MCI | lnc-SLTM-1:2 | SEQ0982 | 3.E-04 | 0.6 |
| FTD | lnc-CDK19-4:1 | SEQ4090 | 7.E-05 | 0.6 | All AD | lnc-SLTM-1:2 | SEQ0982 | 5.E-02 | 0.8 |
| miAD | lnc-CDK19-4:1 | SEQ4090 | 2.E-03 | 0.6 | MCI | lnc-SMARCC2-3:2 | SEQ4314 | 6.E-06 | 1.7 |
| All AD | lnc-CDK19-4:1 | SEQ4090 | 3.E-03 | 0.7 | DLB | lnc-SMARCC2-3:2 | SEQ4314 | 3.E-05 | 1.6 |
| msAD | lnc-CDK19-4:1 | SEQ4090 | 1.E-02 | 0.8 | FTD | lnc-SMARCC2-3:2 | SEQ4314 | 1.E-04 | 1.5 |
| FTD | lnc-CDK2AP1-1:10 | SEQ4667 | 1.E-05 | 0.4 | All AD | lnc-SMARCC2-3:2 | SEQ4314 | 3.E-03 | 1.2 |
| MCI | lnc-CDK2AP1-1:10 | SEQ4667 | 1.E-03 | 0.5 | msAD | lnc-SMARCC2-3:2 | SEQ4314 | 6.E-03 | 1.3 |
| DLB | lnc-CDK2AP1-1:9 | SEQ3361 | 1.E-03 | 1.4 | miAD | lnc-SMARCC2-3:2 | SEQ4314 | 7.E-03 | 1.2 |
| FTD | lnc-CDNF-2:3 | SEQ4361 | 2.E-06 | 0.4 | DLB | lnc-SMARCC2-9:1 | SEQ4833 | 9.E-04 | 1.4 |
| MCI | lnc-CDNF-2:3 | SEQ4361 | 5.E-04 | 0.6 | MCI | lnc-SMC5-6:1 | SEQ2686 | 4.E-04 | 2.0 |
| All AD | lnc-CDNF-2:3 | SEQ4361 | 4.E-02 | 0.7 | FTD | lnc-SMCO1-2:2 | SEQ5398 | 3.E-04 | 0.6 |
| DLB | lnc-CDPF1-2:1 | SEQ4059 | 5.E-04 | 1.5 | All AD | lnc-SMCO1-2:2 | SEQ5398 | 2.E-02 | 0.7 |
| msAD | lnc-CDPF1-2:1 | SEQ4059 | 2.E-02 | 1.3 | MCI | lnc-SMCO4-3:1 | SEQ4543 | 2.E-03 | 0.6 |
| All AD | lnc-CDPF1-2:1 | SEQ4059 | 4.E-02 | 1.2 | DLB | lnc-SMCR8-1:1 | SEQ4498 | 8.E-05 | 1.5 |
| msAD | lnc-CDR2-1:4 | SEQ3808 | 4.E-02 | 1.3 | MCI | lnc-SMCR8-1:1 | SEQ4498 | 2.E-03 | 1.4 |
| DLB | lnc-CDR2-4:2 | SEQ5484 | 2.E-04 | 1.5 | FTD | lnc-SMG1-3:1 | SEQ3506 | 3.E-04 | 0.7 |
| DLB | lnc-CDS2-2:1 | SEQ4741 | 1.E-04 | 1.5 | MCI | lnc-SMIM11B-11:1 | SEQ3891 | 6.E-07 | 2.8 |
| MCI | lnc-CDS2-2:1 | SEQ4741 | 1.E-03 | 1.4 | DLB | lnc-SMIM11B-11:1 | SEQ3891 | 1.E-06 | 2.5 |
| FTD | lnc-CEACAM20-2:5 | SEQ5360 | 4.E-04 | 0.7 | FTD | lnc-SMIM11B-11:1 | SEQ3891 | 2.E-05 | 2.2 |
| MCI | lnc-CEBPB-13:10 | SEQ4547 | 2.E-03 | 0.6 | All AD | lnc-SMIM11B-11:1 | SEQ3891 | 9.E-03 | 1.4 |
| DLB | lnc-CEL-5:2 | SEQ3132 | 1.E-03 | 1.7 | miAD | lnc-SMIM11B-11:1 | SEQ3891 | 1.E-02 | 1.4 |
| MCI | lnc-CEMP1-1:1 | SEQ5146 | 3.E-04 | 2.1 | msAD | lnc-SMIM11B-11:1 | SEQ3891 | 3.E-02 | 1.3 |
| DLB | lnc-CEMP1-1:1 | SEQ5146 | 6.E-04 | 1.9 | miAD | lnc-SMIM13-5:1 | SEQ4279 | 8.E-03 | 0.8 |
| MCI | lnc-CEMP1-1:2 | SEQ5799 | 6.E-05 | 2.0 | All AD | lnc-SMIM13-5:1 | SEQ4279 | 2.E-02 | 0.8 |
| DLB | lnc-CEMP1-1:6 | SEQ4620 | 1.E-03 | 1.4 | msAD | lnc-SMTNL2-4:1 | SEQ3997 | 2.E-02 | 2.6 |
| DLB | lnc-CEMP1-1:7 | SEQ4876 | 9.E-04 | 2.0 | All AD | lnc-SMTNL2-4:1 | SEQ3997 | 3.E-02 | 2.2 |
| DLB | lnc-CEMP1-10:1 | SEQ4839 | 9.E-04 | 1.4 | DLB | lnc-SNAP47-2:1 | SEQ5143 | 2.E-04 | 2.1 |
| DLB | lnc-CEMP1-5:1 | SEQ3365 | 4.E-05 | 1.6 | MCI | lnc-SNAP47-2:1 | SEQ5143 | 6.E-04 | 1.8 |
| MCI | lnc-CEMP1-5:1 | SEQ3365 | 6.E-04 | 1.6 | FTD | lnc-SNAPC1-4:1 | SEQ5682 | 3.E-07 | 0.5 |
| All AD | lnc-CENPB-3:1 | SEQ4367 | 3.E-02 | 0.7 | All AD | lnc-SNAPC1-4:1 | SEQ5682 | 5.E-02 | 0.7 |
| All AD | lnc-CENPB-3:2 | SEQ4368 | 3.E-02 | 0.7 | DLB | lnc-SNAPC2-2:3 | SEQ4933 | 5.E-04 | 1.5 |
| DLB | lnc-CENPBD1-2:8 | SEQ4696 | 3.E-04 | 1.5 | MCI | lnc-SNAPC2-2:3 | SEQ4933 | 8.E-04 | 1.4 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| MCI | lnc-CENPBD1-2:8 | SEQ4696 | 1.E-03 | 1.4 | DLB | lnc-SNAPC5-1:2 | SEQ3920 | 5.E-04 | 1.6 |
| FTD | lnc-CENPT-1:5 | SEQ4369 | 3.E-07 | 2.3 | msAD | lnc-SNAPC5-1:2 | SEQ3920 | 3.E-02 | 1.3 |
| MCI | lnc-CENPT-1:5 | SEQ4369 | 4.E-06 | 2.5 | All AD | lnc-SNAPC5-1:2 | SEQ3920 | 4.E-02 | 1.2 |
| DLB | lnc-CENPT-1:5 | SEQ4369 | 1.E-05 | 2.0 | MCI | lnc-SNF8-1:3 | SEQ5169 | 5.E-04 | 0.8 |
| All AD | lnc-CENPT-1:5 | SEQ4369 | 9.E-04 | 1.3 | msAD | lnc-SNPH-5:1 | SEQ4233 | 1.E-02 | 2.4 |
| msAD | lnc-CENPT-1:5 | SEQ4369 | 2.E-03 | 1.3 | All AD | lnc-SNPH-5:1 | SEQ4233 | 3.E-02 | 1.7 |
| miAD | lnc-CENPT-1:5 | SEQ4369 | 2.E-03 | 1.3 | FTD | lnc-SNPH-6:5 | SEQ4544 | 3.E-06 | 0.6 |
| MCI | lnc-CENPT-1:6 | SEQ5048 | 2.E-04 | 1.8 | MCI | lnc-SNPH-6:5 | SEQ4544 | 2.E-03 | 0.6 |
| DLB | lnc-CENPT-1:6 | SEQ5048 | 7.E-04 | 1.8 | DLB | lnc-SNRPC-2:6 | SEQ3685 | 7.E-06 | 2.0 |
| All AD | lnc-CENPU-1:1 | SEQ4373 | 3.E-02 | 0.7 | MCI | lnc-SNRPC-2:6 | SEQ3685 | 2.E-05 | 1.8 |
| DLB | lnc-CENPVL2-3:1 | SEQ2389 | 2.E-03 | 1.6 | FTD | lnc-SNRPC-2:6 | SEQ3685 | 2.E-04 | 1.6 |
| DLB | lnc-CEP19-1:2 | SEQ5673 | 1.E-04 | 1.7 | All AD | lnc-SNRPC-2:6 | SEQ3685 | 1.E-02 | 1.2 |
| All AD | lnc-CEP350-3:4 | SEQ4375 | 4.E-02 | 0.8 | msAD | lnc-SNRPC-2:6 | SEQ3685 | 5.E-02 | 1.2 |
| FTD | lnc-CEP83-7:1 | SEQ3010 | 5.E-04 | 0.6 | FTD | lnc-SNRPN-8:18 | SEQ5060 | 7.E-04 | 0.6 |
| FTD | lnc-CERKL-7:1 | SEQ5970 | 4.E-06 | 0.6 | MCI | lnc-SNRPN-8:44 | SEQ4445 | 2.E-03 | 1.6 |
| DLB | lnc-CETP-2:2 | SEQ5324 | 4.E-04 | 1.6 | DLB | lnc-SNRPN-8:44 | SEQ4445 | 2.E-03 | 1.8 |
| FTD | lnc-CFAP36-3:10 | SEQ5826 | 5.E-05 | 0.4 | MCI | lnc-SNRPN-8:7 | SEQ5640 | 2.E-04 | 2.8 |
| FTD | lnc-CFAP36-3:2 | SEQ0786 | 7.E-04 | 0.6 | FTD | lnc-SNRPN-8:85 | SEQ5091 | 6.E-04 | 0.7 |
| DLB | lnc-CFAP36-3:3 | SEQ4977 | 8.E-04 | 1.8 | MCI | lnc-SNRPN-8:92 | SEQ5103 | 6.E-04 | 0.6 |
| DLB | lnc-CFAP36-3:4 | SEQ5451 | 3.E-04 | 1.7 | DLB | lnc-SNTG2-4:3 | SEQ4961 | 8.E-04 | 1.6 |
| miAD | lnc-CFLAR-1:4 | SEQ4116 | 1.E-02 | 0.7 | FTD | lnc-SNX11-2:1 | SEQ5679 | 1.E-04 | 0.5 |
| All AD | lnc-CFLAR-1:4 | SEQ4116 | 2.E-02 | 0.8 | FTD | lnc-SNX11-2:2 | SEQ5403 | 3.E-04 | 0.5 |
| DLB | lnc-CGA-2:2 | SEQ4437 | 2.E-03 | 1.5 | DLB | lnc-SNX2-1:2 | SEQ4824 | 3.E-06 | 0.4 |
| FTD | lnc-CGREF1-2:1 | SEQ2472 | 4.E-08 | 0.6 | MCI | lnc-SNX2-1:2 | SEQ4824 | 9.E-04 | 0.5 |
| MCI | lnc-CGREF1-2:1 | SEQ2472 | 5.E-05 | 0.7 | All AD | lnc-SNX33-6:1 | SEQ5691 | 3.E-02 | 1.2 |
| DLB | lnc-CGREF1-2:1 | SEQ2472 | 4.E-04 | 0.8 | FTD | lnc-SNX7-11:1 | SEQ4115 | 1.E-05 | 0.5 |
| DLB | lnc-CHADL-1:7 | SEQ5196 | 5.E-04 | 1.6 | All AD | lnc-SNX7-11:1 | SEQ4115 | 3.E-03 | 0.7 |
| FTD | lnc-CHIC2-2:1 | SEQ5765 | 8.E-05 | 0.7 | miAD | lnc-SNX7-11:1 | SEQ4115 | 3.E-03 | 0.6 |
| FTD | lnc-CHN2-5:1 | SEQ3761 | 6.E-06 | 0.6 | msAD | lnc-SNX7-11:1 | SEQ4115 | 1.E-02 | 0.7 |
| miAD | lnc-CHN2-5:1 | SEQ3761 | 1.E-03 | 0.6 | DLB | lnc-SNX8-1:1 | SEQ4465 | 7.E-06 | 2.1 |
| All AD | lnc-CHN2-5:1 | SEQ3761 | 3.E-03 | 0.7 | MCI | lnc-SNX8-1:1 | SEQ4465 | 7.E-04 | 1.6 |
| msAD | lnc-CHN2-5:1 | SEQ3761 | 4.E-02 | 0.7 | msAD | lnc-SNX8-1:1 | SEQ4465 | 2.E-03 | 1.3 |
| DLB | lnc-CHRAC1-6:1 | SEQ0420 | 4.E-04 | 1.7 | All AD | lnc-SNX8-1:1 | SEQ4465 | 1.E-02 | 1.2 |
| MCI | lnc-CHRAC1-6:1 | SEQ0420 | 1.E-03 | 1.6 | MCI | lnc-SOCS3-3:1 | SEQ5667 | 1.E-04 | 1.7 |
| MCI | lnc-CHRDL2-3:1 | SEQ4264 | 1.E-05 | 3.0 | FTD | lnc-SOCS6-10:1 | SEQ2214 | 2.E-04 | 0.5 |
| FTD | lnc-CHRDL2-3:1 | SEQ4264 | 2.E-03 | 2.4 | All AD | lnc-SOCS6-10:1 | SEQ2214 | 2.E-03 | 0.7 |
| miAD | lnc-CHRDL2-3:1 | SEQ4264 | 9.E-03 | 1.4 | msAD | lnc-SOCS6-10:1 | SEQ2214 | 2.E-03 | 0.7 |
| All AD | lnc-CHRDL2-3:1 | SEQ4264 | 2.E-02 | 1.3 | miAD | lnc-SOCS6-10:1 | SEQ2214 | 1.E-02 | 0.7 |
| miAD | lnc-CHRNA9-2:1 | SEQ4275 | 8.E-03 | 0.6 | FTD | lnc-SOWAHB-6:1 | SEQ5688 | 1.E-04 | 0.6 |
| All AD | lnc-CHRNA9-2:1 | SEQ4275 | 2.E-02 | 0.7 | DLB | lnc-SOX15-1:6 | SEQ5525 | 2.E-04 | 1.5 |
| msAD | lnc-CHRNE-3:3 | SEQ4054 | 2.E-02 | 1.5 | DLB | lnc-SP110-8:1 | SEQ5578 | 2.E-04 | 1.7 |
| All AD | lnc-CHRNE-3:3 | SEQ4054 | 2.E-02 | 1.4 | FTD | lnc-SP110-8:4 | SEQ3913 | 8.E-08 | 0.5 |
| All AD | lnc-CHST3-1:1 | SEQ3822 | 1.E-02 | 1.3 | MCI | lnc-SP110-8:4 | SEQ3913 | 5.E-05 | 0.6 |
| miAD | lnc-CHST3-1:1 | SEQ3822 | 1.E-02 | 1.3 | All AD | lnc-SP110-8:4 | SEQ3913 | 2.E-02 | 0.7 |
| msAD | lnc-CHST3-1:1 | SEQ3822 | 4.E-02 | 1.2 | msAD | lnc-SP110-8:4 | SEQ3913 | 3.E-02 | 0.7 |
| DLB | lnc-CIB3-1:1 | SEQ5176 | 5.E-04 | 1.4 | All AD | lnc-SP110-8:5 | SEQ3738 | 2.E-02 | 0.7 |
| DLB | lnc-CIB3-1:2 | SEQ2750 | 5.E-04 | 1.3 | msAD | lnc-SP110-8:5 | SEQ3738 | 4.E-02 | 0.7 |
| DLB | lnc-CIB3-1:3 | SEQ5179 | 5.E-04 | 1.4 | FTD | lnc-SP110-9:1 | SEQ5228 | 5.E-04 | 0.6 |
| FTD | lnc-CISD2-1:2 | SEQ4031 | 1.E-04 | 0.6 | All AD | lnc-SP140-3:4 | SEQ3575 | 4.E-02 | 0.8 |
| All AD | lnc-CISD2-1:2 | SEQ4031 | 7.E-03 | 0.7 | DLB | lnc-SP140-3:7 | SEQ5250 | 5.E-04 | 1.5 |
| miAD | lnc-CISD2-1:2 | SEQ4031 | 1.E-02 | 0.7 | miAD | lnc-SP9-13:4 | SEQ4245 | 9.E-03 | 0.6 |
| msAD | lnc-CISD2-1:2 | SEQ4031 | 2.E-02 | 0.7 | miAD | lnc-SP9-8:1 | SEQ4209 | 1.E-02 | 0.7 |
| FTD | lnc-CISD2-1:3 | SEQ3366 | 4.E-04 | 1.4 | FTD | lnc-SPACA5-1:1 | SEQ5830 | 5.E-05 | 0.6 |
| MCI | lnc-CISD2-1:3 | SEQ3366 | 5.E-04 | 1.3 | miAD | lnc-SPAG1-7:1 | SEQ4333 | 1.E-04 | 1.3 |
| DLB | lnc-CISD2-11:1 | SEQ3654 | 5.E-05 | 1.6 | All AD | lnc-SPAG1-7:1 | SEQ4333 | 4.E-04 | 1.3 |
| MCI | lnc-CISD2-11:1 | SEQ3654 | 2.E-03 | 1.5 | msAD | lnc-SPAG1-7:1 | SEQ4333 | 6.E-03 | 1.2 |
| msAD | lnc-CISD2-11:1 | SEQ3654 | 5.E-02 | 1.2 | DLB | lnc-SPATA21-3:1 | SEQ3769 | 6.E-05 | 1.5 |
| DLB | lnc-CKB-1:1 | SEQ4952 | 8.E-04 | 1.5 | msAD | lnc-SPATA21-3:1 | SEQ3769 | 4.E-02 | 1.1 |
| DLB | lnc-CKS1B-2:2 | SEQ5479 | 2.E-04 | 1.4 | DLB | lnc-SPATA21-4:9 | SEQ5177 | 5.E-04 | 1.4 |
| MCI | lnc-CKS1B-3:1 | SEQ3367 | 3.E-06 | 1.7 | DLB | lnc-SPATA21-6:3 | SEQ2824 | 2.E-04 | 1.6 |
| DLB | lnc-CKS1B-3:1 | SEQ3367 | 1.E-03 | 1.6 | All AD | lnc-SPATA31A1-3:1 | SEQ5702 | 4.E-02 | 0.7 |
| All AD | lnc-CKS1B-3:1 | SEQ3367 | 4.E-02 | 1.1 | MCI | lnc-SPATA32-1:1 | SEQ4779 | 1.E-03 | 1.6 |
| MCI | lnc-CKS1B-3:3 | SEQ5798 | 6.E-05 | 1.9 | All AD | lnc-SPATA32-2:16 | SEQ4238 | 7.E-03 | 0.8 |
| FTD | lnc-CLASP2-1:2 | SEQ4047 | 7.E-07 | 1.5 | msAD | lnc-SPATA32-2:16 | SEQ4238 | 1.E-02 | 0.8 |
| DLB | lnc-CLASP2-1:2 | SEQ4047 | 1.E-06 | 1.7 | DLB | lnc-SPATA32-2:4 | SEQ3464 | 2.E-03 | 1.8 |
| MCI | lnc-CLASP2-1:2 | SEQ4047 | 5.E-05 | 1.6 | All AD | lnc-SPATA32-2:7 | SEQ5704 | 4.E-02 | 0.8 |
| All AD | lnc-CLASP2-1:2 | SEQ4047 | 1.E-02 | 1.2 | FTD | lnc-SPERT-4:1 | SEQ5777 | 7.E-05 | 0.6 |
| msAD | lnc-CLASP2-1:2 | SEQ4047 | 2.E-02 | 1.2 | miAD | lnc-SPOCK2-1:2 | SEQ3582 | 1.E-03 | 1.4 |
| FTD | lnc-CLDN10-7:1 | SEQ5913 | 2.E-06 | 0.5 | All AD | lnc-SPOCK2-1:2 | SEQ3582 | 2.E-03 | 1.3 |
| DLB | lnc-CLDN4-2:1 | SEQ5371 | 3.E-04 | 1.4 | msAD | lnc-SPOCK2-1:2 | SEQ3582 | 1.E-02 | 1.3 |
| DLB | lnc-CLEC16A-1:1 | SEQ4387 | 5.E-05 | 1.8 | miAD | lnc-SPON2-1:2 | SEQ2237 | 1.E-02 | 0.7 |
| MCI | lnc-CLEC16A-1:1 | SEQ4387 | 2.E-03 | 1.5 | All AD | lnc-SPON2-1:2 | SEQ2237 | 2.E-02 | 0.7 |
| All AD | lnc-CLEC16A-1:1 | SEQ4387 | 2.E-02 | 1.3 | MCI | lnc-SPOPL-10:1 | SEQ2567 | 8.E-05 | 0.4 |
| DLB | lnc-CLEC18B-5:1 | SEQ2878 | 2.E-03 | 1.5 | DLB | lnc-SPOPL-10:1 | SEQ2567 | 8.E-04 | 0.4 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| miAD | lnc-CLEC2D-8:4 | SEQ4386 | 2.E-03 | 0.3 | FTD | lnc-SPOPL-2:3 | SEQ4138 | 8.E-04 | 0.6 |
| DLB | lnc-CLEC2D-8:7 | SEQ3369 | 3.E-04 | 1.6 | miAD | lnc-SPOPL-2:3 | SEQ4138 | 1.E-02 | 0.8 |
| MCI | lnc-CLEC2D-8:7 | SEQ3369 | 1.E-03 | 1.5 | All AD | lnc-SPOPL-2:3 | SEQ4138 | 2.E-02 | 0.8 |
| All AD | lnc-CLEC2D-8:7 | SEQ3369 | 4.E-03 | 1.3 | FTD | lnc-SPOPL-2:4 | SEQ5101 | 4.E-08 | 0.3 |
| msAD | lnc-CLEC2D-8:7 | SEQ3369 | 5.E-03 | 1.3 | miAD | lnc-SPOPL-2:4 | SEQ5101 | 3.E-04 | 0.4 |
| FTD | lnc-CLEC3A-2:2 | SEQ4802 | 1.E-03 | 0.5 | MCI | lnc-SPOPL-2:4 | SEQ5101 | 6.E-04 | 0.5 |
| FTD | lnc-CLIC6-5:1 | SEQ5544 | 2.E-04 | 0.6 | All AD | lnc-SPOPL-2:4 | SEQ5101 | 9.E-04 | 0.5 |
| All AD | lnc-CLK3-1:1 | SEQ4389 | 4.E-02 | 1.1 | FTD | lnc-SPPL2A-2:1 | SEQ4363 | 2.E-09 | 0.5 |
| DLB | lnc-CLLU1-2:1 | SEQ4390 | 2.E-03 | 1.2 | MCI | lnc-SPPL2A-2:1 | SEQ4363 | 3.E-06 | 0.5 |
| All AD | lnc-CLLU1-2:1 | SEQ4390 | 4.E-02 | 1.1 | All AD | lnc-SPPL2A-2:1 | SEQ4363 | 1.E-03 | 0.7 |
| msAD | lnc-CLLU1-2:2 | SEQ4016 | 2.E-02 | 1.4 | miAD | lnc-SPPL2A-2:1 | SEQ4363 | 2.E-03 | 0.7 |
| All AD | lnc-CLLU1-2:2 | SEQ4016 | 5.E-02 | 1.2 | msAD | lnc-SPPL2A-2:1 | SEQ4363 | 4.E-03 | 0.7 |
| All AD | lnc-CLSPN-2:1 | SEQ4392 | 4.E-02 | 0.8 | DLB | lnc-SPPL3-2:1 | SEQ5246 | 5.E-04 | 1.4 |
| DLB | lnc-CLUAP1-1:2 | SEQ4705 | 1.E-03 | 1.5 | DLB | lnc-SPPL3-3:1 | SEQ5726 | 9.E-05 | 1.4 |
| DLB | lnc-CLUAP1-8:2 | SEQ5247 | 6.E-05 | 1.5 | DLB | lnc-SPPL3-4:1 | SEQ4776 | 3.E-04 | 1.7 |
| MCI | lnc-CLUAP1-8:2 | SEQ5247 | 5.E-04 | 1.4 | MCI | lnc-SPPL3-4:1 | SEQ4776 | 1.E-03 | 1.6 |
| DLB | lnc-CLUAP1-9:1 | SEQ5428 | 3.E-04 | 1.4 | FTD | lnc-SPRTN-2:1 | SEQ4204 | 6.E-08 | 0.5 |
| FTD | lnc-CLUH-2:1 | SEQ4815 | 1.E-03 | 0.8 | miAD | lnc-SPRTN-2:1 | SEQ4204 | 1.E-03 | 0.6 |
| DLB | lnc-CMTM3-1:1 | SEQ2789 | 4.E-04 | 1.3 | MCI | lnc-SPRTN-2:1 | SEQ4204 | 1.E-03 | 0.6 |
| DLB | lnc-CMTM4-5:1 | SEQ5706 | 1.E-04 | 1.8 | All AD | lnc-SPRTN-2:1 | SEQ4204 | 2.E-03 | 0.6 |
| DLB | lnc-CMTM7-2:1 | SEQ3789 | 9.E-04 | 1.3 | msAD | lnc-SPRTN-2:1 | SEQ4204 | 1.E-02 | 0.6 |
| msAD | lnc-CMTM7-2:1 | SEQ3789 | 4.E-02 | 1.2 | DLB | lnc-SPRYD3-1:12 | SEQ3876 | 2.E-05 | 2.2 |
| FTD | lnc-CMTR1-10:1 | SEQ0788 | 4.E-09 | 0.4 | MCI | lnc-SPRYD3-1:12 | SEQ3876 | 3.E-05 | 2.0 |
| MCI | lnc-CMTR1-10:1 | SEQ0788 | 7.E-04 | 0.6 | FTD | lnc-SPRYD3-1:12 | SEQ3876 | 2.E-04 | 1.6 |
| miAD | lnc-CMTR1-10:1 | SEQ0788 | 1.E-02 | 0.5 | All AD | lnc-SPRYD3-1:12 | SEQ3876 | 9.E-03 | 1.3 |
| All AD | lnc-CMTR1-10:1 | SEQ0788 | 2.E-02 | 0.6 | miAD | lnc-SPRYD3-1:12 | SEQ3876 | 1.E-02 | 1.3 |
| DLB | lnc-CNN1-6:1 | SEQ5036 | 9.E-05 | 1.7 | msAD | lnc-SPRYD3-1:12 | SEQ3876 | 3.E-02 | 1.3 |
| MCI | lnc-CNN1-6:1 | SEQ5036 | 7.E-04 | 1.5 | DLB | lnc-SPRYD3-1:8 | SEQ4196 | 7.E-04 | 1.5 |
| DLB | lnc-CNP-1:1 | SEQ3058 | 6.E-04 | 1.5 | miAD | lnc-SPRYD3-1:8 | SEQ4196 | 1.E-02 | 1.3 |
| FTD | lnc-CNTNAP3B-10:1 | SEQ4987 | 8.E-04 | 0.4 | All AD | lnc-SPRYD3-1:8 | SEQ4196 | 3.E-02 | 1.2 |
| msAD | lnc-CNTRL-6:6 | SEQ3795 | 4.E-02 | 1.6 | DLB | lnc-SPTBN4-1:5 | SEQ3774 | 3.E-04 | 1.6 |
| DLB | lnc-COA6-4:1 | SEQ4752 | 3.E-05 | 1.5 | All AD | lnc-SPTBN4-1:5 | SEQ3774 | 3.E-02 | 1.2 |
| MCI | lnc-COA6-4:1 | SEQ4752 | 1.E-03 | 1.4 | msAD | lnc-SPTBN4-1:5 | SEQ3774 | 4.E-02 | 1.2 |
| DLB | lnc-COG7-1:1 | SEQ4630 | 1.E-03 | 1.5 | MCI | lnc-SQSTM1-2:3 | SEQ4572 | 4.E-04 | 1.7 |
| DLB | lnc-COG7-3:3 | SEQ5741 | 9.E-05 | 2.1 | DLB | lnc-SQSTM1-2:3 | SEQ4572 | 2.E-03 | 1.5 |
| DLB | lnc-COG8-2:1 | SEQ4580 | 8.E-05 | 1.7 | DLB | lnc-SQSTM1-4:1 | SEQ5526 | 2.E-04 | 1.5 |
| MCI | lnc-COG8-2:1 | SEQ4580 | 2.E-03 | 1.5 | FTD | lnc-SRD5A3-4:1 | SEQ5600 | 2.E-04 | 0.6 |
| All AD | lnc-COIL-7:1 | SEQ4411 | 4.E-02 | 0.8 | miAD | lnc-SRGN-4:1 | SEQ4157 | 1.E-02 | 0.8 |
| All AD | lnc-COPG1-2:3 | SEQ4412 | 3.E-02 | 0.7 | All AD | lnc-SRGN-4:1 | SEQ4157 | 3.E-02 | 0.8 |
| DLB | lnc-COPG1-1:3 | SEQ5135 | 6.E-04 | 1.7 | MCI | lnc-SRP54-1:2 | SEQ4762 | 1.E-03 | 1.5 |
| FTD | lnc-COPS5-2:1 | SEQ5834 | 5.E-05 | 0.7 | FTD | lnc-SRPK2-1:16 | SEQ5859 | 3.E-08 | 0.1 |
| DLB | lnc-COPS7A-4:3 | SEQ5655 | 1.E-04 | 1.4 | MCI | lnc-SRPK2-1:16 | SEQ5859 | 3.E-06 | 0.1 |
| msAD | lnc-COQ4-1:3 | SEQ3653 | 5.E-02 | 0.9 | DLB | lnc-SRPK2-1:16 | SEQ5859 | 4.E-05 | 0.1 |
| DLB | lnc-COQ9-1:1 | SEQ4440 | 2.E-03 | 1.6 | FTD | lnc-SRPK2-1:17 | SEQ4662 | 2.E-07 | 7.3 |
| MCI | lnc-COX19-2:1 | SEQ3091 | 8.E-05 | 2.1 | MCI | lnc-SRPK2-1:17 | SEQ4662 | 7.E-06 | 4.6 |
| DLB | lnc-COX19-2:1 | SEQ3091 | 5.E-04 | 1.8 | DLB | lnc-SRPK2-1:17 | SEQ4662 | 1.E-03 | 2.7 |
| DLB | lnc-COX4I1-6:1 | SEQ4446 | 2.E-03 | 1.6 | FTD | lnc-SRPK2-1:18 | SEQ5722 | 1.E-05 | 0.6 |
| miAD | lnc-COX6A2-5:1 | SEQ4280 | 8.E-05 | 0.8 | All AD | lnc-SRPK2-1:18 | SEQ5722 | 3.E-02 | 0.8 |
| All AD | lnc-COX6A2-5:1 | SEQ4280 | 2.E-02 | 0.8 | DLB | lnc-SRPK2-1:5 | SEQ4647 | 1.E-03 | 1.7 |
| MCI | lnc-COX7A2L-4:9 | SEQ4095 | 3.E-04 | 1.4 | FTD | lnc-SRPK2-1:7 | SEQ6004 | 5.E-08 | 0.2 |
| DLB | lnc-COX7A2L-4:9 | SEQ4095 | 8.E-04 | 1.5 | FTD | lnc-SRPK2-5:4 | SEQ5352 | 4.E-04 | 0.6 |
| All AD | lnc-COX7A2L-4:9 | SEQ4095 | 3.E-03 | 1.3 | FTD | lnc-SRPK2-6:1 | SEQ6012 | 2.E-10 | 0.3 |
| miAD | lnc-COX7A2L-4:9 | SEQ4095 | 3.E-03 | 1.3 | FTD | lnc-SRPK2-7:1 | SEQ5931 | 1.E-05 | 0.7 |
| msAD | lnc-COX7A2L-4:9 | SEQ4095 | 1.E-02 | 1.3 | FTD | lnc-SRPK2-8:1 | SEQ4380 | 7.E-06 | 0.4 |
| FTD | lnc-COX7B-4:2 | SEQ4421 | 1.E-04 | 0.6 | miAD | lnc-SRPK2-8:1 | SEQ4380 | 3.E-03 | 0.5 |
| All AD | lnc-COX7B-4:2 | SEQ4421 | 3.E-02 | 0.8 | DLB | lnc-SRRM2-1:2 | SEQ4244 | 5.E-04 | 2.1 |
| MCI | lnc-CPLX1-2:15 | SEQ5214 | 5.E-04 | 2.0 | FTD | lnc-SRRM2-1:2 | SEQ4244 | 7.E-04 | 2.1 |
| DLB | lnc-CPLX1-2:17 | SEQ5918 | 2.E-05 | 1.9 | All AD | lnc-SRRM2-1:2 | SEQ4244 | 9.E-03 | 1.5 |
| MCI | lnc-CPLX1-2:6 | SEQ5464 | 8.E-05 | 4.5 | msAD | lnc-SRRM2-1:2 | SEQ4244 | 1.E-02 | 1.5 |
| FTD | lnc-CPLX1-2:6 | SEQ5464 | 1.E-04 | 3.2 | MCI | lnc-SRSF12-2:1 | SEQ3670 | 1.E-06 | 1.8 |
| DLB | lnc-CPLX1-2:6 | SEQ5464 | 3.E-04 | 3.5 | DLB | lnc-SRSF12-2:1 | SEQ3670 | 3.E-04 | 1.8 |
| DLB | lnc-CPLX1-2:8 | SEQ2869 | 4.E-04 | 1.6 | FTD | lnc-SRSF12-2:1 | SEQ3670 | 6.E-04 | 1.4 |
| FTD | lnc-CPM-1:1 | SEQ3371 | 4.E-05 | 0.6 | miAD | lnc-SRSF12-2:1 | SEQ3670 | 4.E-03 | 1.1 |
| FTD | lnc-CPM-3:1 | SEQ0228 | 1.E-07 | 0.5 | All AD | lnc-SRSF12-2:1 | SEQ3670 | 8.E-03 | 1.1 |
| MCI | lnc-CPM-3:1 | SEQ0228 | 3.E-04 | 0.5 | msAD | lnc-SRSF12-2:1 | SEQ3670 | 5.E-02 | 1.1 |
| All AD | lnc-CPM-3:1 | SEQ0228 | 3.E-02 | 0.8 | DLB | lnc-SRSF2-1:1 | SEQ4861 | 9.E-04 | 1.5 |
| DLB | lnc-CPM-6:1 | SEQ5338 | 4.E-04 | 1.8 | MCI | lnc-SRSF2-10:1 | SEQ4626 | 2.E-04 | 1.5 |
| DLB | lnc-CPPED1-1:1 | SEQ3862 | 2.E-04 | 1.7 | DLB | lnc-SRSF2-10:1 | SEQ4626 | 1.E-03 | 1.4 |
| All AD | lnc-CPPED1-1:1 | SEQ3862 | 1.E-02 | 1.2 | DLB | lnc-SRSF2-9:1 | SEQ5120 | 6.E-04 | 1.5 |
| msAD | lnc-CPPED1-1:1 | SEQ3862 | 3.E-02 | 1.3 | MCI | lnc-SRSF2-9:2 | SEQ4935 | 2.E-04 | 1.6 |
| miAD | lnc-CPSF2-5:1 | SEQ4384 | 3.E-05 | 1.7 | DLB | lnc-SRSF2-9:2 | SEQ4935 | 8.E-04 | 1.4 |
| FTD | lnc-CPSF2-5:1 | SEQ4384 | 8.E-05 | 1.8 | DLB | lnc-SRY-11:1 | SEQ4418 | 2.E-03 | 1.4 |
| All AD | lnc-CPSF2-5:1 | SEQ4384 | 1.E-04 | 1.6 | DLB | lnc-SSBP4-2:1 | SEQ4638 | 1.E-03 | 1.5 |
| MCI | lnc-CPSF2-5:1 | SEQ4384 | 2.E-04 | 1.8 | All AD | lnc-SSH3-4:1 | SEQ5734 | 3.E-02 | 0.8 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| DLB | lnc-CPSF2-5:1 | SEQ4384 | 2.E-04 | 1.7 | DLB | lnc-SSH3-5:1 | SEQ2791 | 3.E-04 | 1.4 |
| msAD | lnc-CPSF2-5:1 | SEQ4384 | 3.E-03 | 1.4 | MCI | lnc-SSH3-5:1 | SEQ2791 | 7.E-04 | 1.3 |
| MCI | lnc-CRACR2A-5:2 | SEQ5302 | 2.E-04 | 1.6 | MCI | lnc-SSR2-1:4 | SEQ4922 | 8.E-03 | 0.7 |
| DLB | lnc-CRACR2A-5:2 | SEQ5302 | 3.E-04 | 1.6 | FTD | lnc-SSTR4-9:1 | SEQ4890 | 9.E-04 | 0.5 |
| FTD | lnc-CRACR2A-5:2 | SEQ5302 | 4.E-04 | 1.4 | DLB | lnc-ST3GAL2-1:1 | SEQ5310 | 4.E-04 | 1.4 |
| FTD | lnc-CRCP-1:1 | SEQ4805 | 1.E-03 | 0.6 | FTD | lnc-STARD8-3:1 | SEQ2647 | 2.E-04 | 0.7 |
| msAD | lnc-CREG1-3:1 | SEQ3949 | 3.E-02 | 1.2 | All AD | lnc-STARD8-3:1 | SEQ2647 | 1.E-02 | 0.8 |
| All AD | lnc-CREG1-3:1 | SEQ3949 | 3.E-02 | 1.2 | msAD | lnc-STARD8-3:1 | SEQ2647 | 3.E-02 | 0.8 |
| FTD | lnc-CRIPT-5:1 | SEQ5900 | 2.E-05 | 0.6 | FTD | lnc-STARD9-1:6 | SEQ5009 | 5.E-04 | 0.4 |
| DLB | lnc-CRLF1-1:2 | SEQ4674 | 1.E-03 | 1.3 | MCI | lnc-STARD9-1:6 | SEQ5009 | 7.E-04 | 0.4 |
| DLB | lnc-CRLF1-1:4 | SEQ4435 | 2.E-03 | 1.5 | FTD | lnc-STAT1-1:1 | SEQ5513 | 8.E-05 | 0.5 |
| FTD | lnc-CRYBA4-23:40 | SEQ4888 | 9.E-04 | 0.5 | MCI | lnc-STAT1-1:1 | SEQ5513 | 2.E-04 | 0.5 |
| FTD | lnc-CRYBB1-1:3 | SEQ4444 | 1.E-03 | 1.5 | All AD | lnc-STAT1-1:1 | SEQ5513 | 3.E-02 | 0.7 |
| All AD | lnc-CRYBB1-1:3 | SEQ4444 | 3.E-02 | 1.2 | DLB | lnc-STAT3-1:2 | SEQ4918 | 2.E-04 | 3.9 |
| DLB | lnc-CRYM-4:1 | SEQ2958 | 3.E-04 | 1.6 | FTD | lnc-STAT3-1:2 | SEQ4918 | 9.E-04 | 2.6 |
| FTD | lnc-CSNK1A1L-1:1 | SEQ3695 | 5.E-04 | 0.5 | FTD | lnc-STAT3-1:3 | SEQ3739 | 2.E-08 | 0.6 |
| miAD | lnc-CSNK1A1L-1:1 | SEQ3695 | 1.E-03 | 0.6 | All AD | lnc-STAT3-1:3 | SEQ3739 | 2.E-02 | 0.7 |
| All AD | lnc-CSNK1A1L-1:1 | SEQ3695 | 4.E-03 | 0.6 | msAD | lnc-STAT3-1:3 | SEQ3739 | 4.E-02 | 0.8 |
| msAD | lnc-CSNK1A1L-1:1 | SEQ3695 | 5.E-02 | 0.7 | FTD | lnc-STAU2-3:4 | SEQ3564 | 2.E-04 | 0.6 |
| FTD | lnc-CSNK1E-1:4 | SEQ4474 | 5.E-04 | 0.7 | miAD | lnc-STAU2-3:4 | SEQ3564 | 1.E-02 | 0.7 |
| MCI | lnc-CSNK1E-1:4 | SEQ4474 | 2.E-03 | 0.7 | All AD | lnc-STAU2-3:4 | SEQ3564 | 2.E-02 | 0.8 |
| DLB | lnc-CSNK1G2-4:2 | SEQ5529 | 5.E-05 | 1.7 | FTD | lnc-STEAP4-1:1 | SEQ3694 | 7.E-04 | 0.5 |
| MCI | lnc-CSNK1G2-4:2 | SEQ5529 | 2.E-04 | 1.6 | miAD | lnc-STEAP4-1:1 | SEQ3694 | 7.E-03 | 0.6 |
| FTD | lnc-CSPP1-1:5 | SEQ4452 | 4.E-05 | 1.8 | All AD | lnc-STEAP4-1:1 | SEQ3694 | 9.E-03 | 0.7 |
| MCI | lnc-CSPP1-1:5 | SEQ4452 | 4.E-05 | 1.8 | msAD | lnc-STEAP4-1:1 | SEQ3694 | 5.E-02 | 0.7 |
| DLB | lnc-CSPP1-1:5 | SEQ4452 | 1.E-04 | 1.8 | DLB | lnc-STK38-1:1 | SEQ5520 | 2.E-04 | 1.4 |
| All AD | lnc-CSPP1-1:5 | SEQ4452 | 4.E-02 | 1.2 | miAD | lnc-STK39-3:9 | SEQ3878 | 6.E-03 | 1.4 |
| FTD | lnc-CSRP2-1:1 | SEQ3936 | 5.E-04 | 0.7 | All AD | lnc-STK39-3:9 | SEQ3878 | 7.E-03 | 1.3 |
| miAD | lnc-CSRP2-1:1 | SEQ3936 | 2.E-03 | 0.7 | msAD | lnc-STK39-3:9 | SEQ3878 | 3.E-02 | 1.3 |
| All AD | lnc-CSRP2-1:1 | SEQ3936 | 3.E-03 | 0.7 | FTD | lnc-STK4-1:1 | SEQ5420 | 3.E-04 | 0.7 |
| msAD | lnc-CSRP2-1:1 | SEQ3936 | 3.E-02 | 0.8 | DLB | lnc-STOM-1:1 | SEQ4855 | 9.E-04 | 1.5 |
| DLB | lnc-CT47A1-1:1 | SEQ2504 | 4.E-06 | 1.6 | FTD | lnc-STON2-5:1 | SEQ3631 | 4.E-05 | 0.6 |
| FTD | lnc-CTAGE5-8:4 | SEQ4898 | 9.E-04 | 0.6 | MCI | lnc-STON2-5:1 | SEQ3631 | 3.E-04 | 0.6 |
| DLB | lnc-CTC1-2:8 | SEQ4631 | 7.E-04 | 1.5 | All AD | lnc-STON2-5:1 | SEQ3631 | 4.E-02 | 0.8 |
| MCI | lnc-CTC1-2:8 | SEQ4631 | 1.E-03 | 1.5 | FTD | lnc-STRN-1:1 | SEQ4399 | 1.E-06 | 0.6 |
| FTD | lnc-CTNNBIP1-1:1 | SEQ5155 | 5.E-04 | 0.6 | MCI | lnc-STRN-1:1 | SEQ4399 | 2.E-03 | 0.7 |
| DLB | lnc-CTNS-1:1 | SEQ2816 | 4.E-05 | 1.6 | DLB | lnc-STUB1-2:1 | SEQ5253 | 5.E-04 | 1.5 |
| msAD | lnc-CTNS-1:1 | SEQ2816 | 4.E-03 | 1.2 | DLB | lnc-STX10-2:1 | SEQ3470 | 9.E-06 | 1.6 |
| All AD | lnc-CTNS-1:1 | SEQ2816 | 9.E-03 | 1.1 | MCI | lnc-STX10-2:1 | SEQ3470 | 9.E-06 | 1.7 |
| All AD | lnc-CTSZ-2:11 | SEQ4037 | 1.E-02 | 1.4 | FTD | lnc-STX10-2:1 | SEQ3470 | 2.E-05 | 1.5 |
| msAD | lnc-CTSZ-2:11 | SEQ4037 | 2.E-02 | 1.4 | DLB | lnc-STX10-2:2 | SEQ4686 | 6.E-04 | 1.5 |
| FTD | lnc-CTSZ-7:1 | SEQ5690 | 3.E-07 | 0.5 | MCI | lnc-STX10-2:2 | SEQ4686 | 1.E-03 | 1.4 |
| MCI | lnc-CTSZ-7:1 | SEQ5690 | 1.E-04 | 0.6 | FTD | lnc-STX3-4:2 | SEQ4242 | 2.E-05 | 2.0 |
| DLB | lnc-CTU2-1:1 | SEQ5116 | 6.E-04 | 1.4 | DLB | lnc-STX3-4:2 | SEQ4242 | 4.E-05 | 2.2 |
| DLB | lnc-CTU2-3:2 | SEQ5540 | 2.E-04 | 2.0 | MCI | lnc-STX3-4:2 | SEQ4242 | 6.E-05 | 2.4 |
| MCI | lnc-CTU2-3:4 | SEQ5448 | 3.E-04 | 1.7 | All AD | lnc-STX3-4:2 | SEQ4242 | 2.E-03 | 1.5 |
| DLB | lnc-CTXN1-2:1 | SEQ5946 | 9.E-06 | 1.7 | msAD | lnc-STX3-4:2 | SEQ4242 | 3.E-03 | 1.6 |
| DLB | lnc-CUL2-3:5 | SEQ4848 | 9.E-04 | 1.5 | miAD | lnc-STX3-4:2 | SEQ4242 | 1.E-02 | 1.4 |
| FTD | lnc-CWC15-1:1 | SEQ4464 | 2.E-07 | 0.5 | All AD | lnc-STX3-4:7 | SEQ4065 | 8.E-03 | 0.7 |
| MCI | lnc-CWC15-1:1 | SEQ4464 | 4.E-05 | 0.5 | msAD | lnc-STX3-4:7 | SEQ4065 | 2.E-02 | 0.7 |
| All AD | lnc-CWC15-1:1 | SEQ4464 | 4.E-02 | 0.8 | FTD | lnc-STX3-4:8 | SEQ4268 | 8.E-04 | 0.6 |
| FTD | lnc-CWC15-1:2 | SEQ4374 | 2.E-06 | 3.4 | All AD | lnc-STX3-4:8 | SEQ4268 | 3.E-03 | 0.6 |
| DLB | lnc-CWC15-1:2 | SEQ4374 | 2.E-04 | 2.4 | msAD | lnc-STX3-4:8 | SEQ4268 | 7.E-03 | 0.6 |
| All AD | lnc-CWC15-1:2 | SEQ4374 | 7.E-04 | 1.6 | miAD | lnc-STX3-4:8 | SEQ4268 | 8.E-03 | 0.7 |
| miAD | lnc-CWC15-1:2 | SEQ4374 | 1.E-03 | 1.7 | FTD | lnc-STXBP4-1:2 | SEQ5962 | 6.E-06 | 0.4 |
| msAD | lnc-CWC15-1:2 | SEQ4374 | 3.E-03 | 1.6 | DLB | lnc-SUGCT-4:1 | SEQ3612 | 2.E-03 | 1.4 |
| DLB | lnc-CWC15-5:1 | SEQ4118 | 4.E-05 | 1.5 | FTD | lnc-SUGCT-5:1 | SEQ4035 | 6.E-06 | 0.5 |
| MCI | lnc-CWC15-5:1 | SEQ4118 | 2.E-03 | 1.3 | MCI | lnc-SUGCT-5:1 | SEQ4035 | 3.E-04 | 0.7 |
| miAD | lnc-CWC15-5:1 | SEQ4118 | 1.E-02 | 1.2 | All AD | lnc-SUGCT-5:1 | SEQ4035 | 9.E-03 | 0.7 |
| All AD | lnc-CWC15-5:1 | SEQ4118 | 2.E-02 | 1.2 | msAD | lnc-SUGCT-5:1 | SEQ4035 | 2.E-02 | 0.7 |
| FTD | lnc-CWF19L2-1:2 | SEQ5599 | 2.E-04 | 0.6 | DLB | lnc-SULT1A4-1:9 | SEQ4582 | 2.E-03 | 1.5 |
| miAD | lnc-CXorf21-2:1 | SEQ4180 | 1.E-02 | 0.6 | MCI | lnc-SUMF1-5:1 | SEQ5751 | 1.E-06 | 2.2 |
| All AD | lnc-CXorf21-2:1 | SEQ4180 | 2.E-02 | 0.7 | FTD | lnc-SUMF1-5:1 | SEQ5751 | 2.E-06 | 1.8 |
| DLB | lnc-CXorf65-2:1 | SEQ2748 | 3.E-05 | 1.5 | DLB | lnc-SUMF1-5:1 | SEQ5751 | 6.E-06 | 2.4 |
| FTD | lnc-CYB5D2-2:2 | SEQ5297 | 4.E-04 | 0.7 | All AD | lnc-SUMF1-5:1 | SEQ5751 | 4.E-02 | 1.2 |
| msAD | lnc-CYB5R2-3:10 | SEQ4322 | 6.E-03 | 1.4 | FTD | lnc-SUMO4-2:1 | SEQ5857 | 4.E-05 | 0.6 |
| All AD | lnc-CYB5R2-3:10 | SEQ4322 | 4.E-02 | 1.2 | FTD | lnc-SUPT16H-3:1 | SEQ4923 | 5.E-04 | 0.8 |
| DLB | lnc-CYGB-1:1 | SEQ5753 | 8.E-05 | 1.6 | MCI | lnc-SUPT16H-3:1 | SEQ4923 | 8.E-04 | 0.8 |
| msAD | lnc-CYGB-2:2 | SEQ3872 | 3.E-02 | 0.9 | FTD | lnc-SUPT16H-3:2 | SEQ4030 | 3.E-09 | 0.4 |
| DLB | lnc-CYGB-4:1 | SEQ5318 | 4.E-04 | 1.5 | MCI | lnc-SUPT16H-3:2 | SEQ4030 | 8.E-05 | 0.5 |
| miAD | lnc-CYP1B1-1:3 | SEQ4468 | 2.E-03 | 0.7 | All AD | lnc-SUPT16H-3:2 | SEQ4030 | 6.E-03 | 0.7 |
| All AD | lnc-CYP1B1-1:3 | SEQ4468 | 5.E-03 | 0.7 | miAD | lnc-SUPT16H-3:2 | SEQ4030 | 1.E-02 | 0.7 |
| DLB | lnc-CYP4F22-2:2 | SEQ5815 | 5.E-05 | 1.6 | msAD | lnc-SUPT16H-3:2 | SEQ4030 | 2.E-02 | 0.7 |
| DLB | lnc-CYP4F22-6:1 | SEQ5038 | 7.E-04 | 1.6 | DLB | lnc-SUPT6H-1:2 | SEQ5860 | 4.E-05 | 1.5 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| All AD | lnc-CYP4F8-1:1 | SEQ4470 | 4.E−02 | 1.2 | DLB | lnc-SUSD1-1:4 | SEQ5144 | 6.E−04 | 1.9 |
| All AD | lnc-CYP4F8-1:2 | SEQ4471 | 4.E−02 | 1.2 | FTD | lnc-SUSD1-1:5 | SEQ0638 | 6.E−04 | 0.6 |
| msAD | lnc-CYR61-3:5 | SEQ3687 | 5.E−02 | 1.2 | miAD | lnc-SUSD1-1:5 | SEQ0638 | 1.E−02 | 0.7 |
| FTD | lnc-CYTIP-2:1 | SEQ0200 | 9.E−04 | 0.7 | All AD | lnc-SUSD1-1:5 | SEQ0638 | 4.E−02 | 0.8 |
| DLB | lnc-DALRD3-1:11 | SEQ4791 | 1.E−03 | 1.9 | DLB | lnc-SWSAP1-4:1 | SEQ4126 | 4.E−05 | 1.5 |
| DLB | lnc-DALRD3-1:4 | SEQ3374 | 2.E−04 | 1.5 | All AD | lnc-SWSAP1-4:1 | SEQ4126 | 3.E−03 | 1.2 |
| DLB | lnc-DALRD3-6:1 | SEQ4475 | 1.E−04 | 1.5 | miAD | lnc-SWSAP1-4:1 | SEQ4126 | 4.E−03 | 1.2 |
| All AD | lnc-DALRD3-6:1 | SEQ4475 | 2.E−02 | 1.2 | msAD | lnc-SWSAP1-4:1 | SEQ4126 | 1.E−02 | 1.2 |
| FTD | lnc-DAPP1-8:3 | SEQ2439 | 5.E−04 | 0.6 | FTD | lnc-SYCE3-1:2 | SEQ3976 | 4.E−04 | 0.7 |
| FTD | lnc-DARS2-3:2 | SEQ4913 | 9.E−04 | 0.8 | msAD | lnc-SYCE3-1:2 | SEQ3976 | 2.E−02 | 0.7 |
| MCI | lnc-DAZAP2-3:1 | SEQ0056 | 2.E−03 | 1.6 | All AD | lnc-SYCE3-1:2 | SEQ3976 | 2.E−02 | 0.7 |
| DLB | lnc-DBT-3:1 | SEQ5340 | 4.E−05 | 1.9 | DLB | lnc-SYNE3-1:1 | SEQ5369 | 3.E−04 | 1.4 |
| MCI | lnc-DBT-3:1 | SEQ5340 | 4.E−04 | 1.8 | DLB | lnc-SYNE3-1:2 | SEQ5368 | 3.E−04 | 1.4 |
| All AD | lnc-DBX2-4:3 | SEQ4477 | 5.E−02 | 1.1 | DLB | lnc-SYNE3-1:3 | SEQ5309 | 4.E−04 | 1.4 |
| DLB | lnc-DCAF1-1:1 | SEQ3375 | 1.E−04 | 1.3 | All AD | lnc-SYNE3-5:1 | SEQ5757 | 3.E−02 | 1.4 |
| FTD | lnc-DCAF4L1-2:1 | SEQ2387 | 1.E−04 | 0.6 | MCI | lnc-SYT13-8:1 | SEQ3708 | 2.E−06 | 1.7 |
| All AD | lnc-DCAF4L1-2:1 | SEQ2387 | 1.E−02 | 0.7 | DLB | lnc-SYT13-8:1 | SEQ3708 | 1.E−05 | 1.6 |
| msAD | lnc-DCAF4L1-2:1 | SEQ2387 | 3.E−02 | 0.7 | All AD | lnc-SYT13-8:1 | SEQ3708 | 4.E−02 | 1.2 |
| MCI | lnc-DCLRE1B-3:1 | SEQ5928 | 2.E−06 | 0.4 | msAD | lnc-SYT13-8:1 | SEQ3708 | 5.E−02 | 1.2 |
| FTD | lnc-DCLRE1B-3:1 | SEQ5928 | 1.E−05 | 0.4 | DLB | lnc-SYT2-4:2 | SEQ5097 | 6.E−04 | 2.E−03 |
| FTD | lnc-DCUN1D1-10:1 | SEQ4291 | 1.E−09 | 0.3 | FTD | lnc-TAAR9-3:4 | SEQ5364 | 3.E−05 | 0.3 |
| MCI | lnc-DCUN1D1-10:1 | SEQ4291 | 2.E−05 | 0.4 | MCI | lnc-TAAR9-3:4 | SEQ5364 | 3.E−04 | 0.3 |
| DLB | lnc-DCUN1D1-10:1 | SEQ4291 | 9.E−05 | 0.4 | FTD | lnc-TAAR9-3:5 | SEQ4732 | 2.E−10 | 0.4 |
| miAD | lnc-DCUN1D1-10:1 | SEQ4291 | 7.E−03 | 0.4 | MCI | lnc-TAAR9-3:5 | SEQ4732 | 6.E−06 | 0.4 |
| All AD | lnc-DCUN1D1-10:1 | SEQ4291 | 1.E−02 | 0.5 | miAD | lnc-TAAR9-3:5 | SEQ4732 | 1.E−03 | 0.6 |
| DLB | lnc-DDB1-1:2 | SEQ5421 | 8.E−05 | 1.7 | All AD | lnc-TAAR9-3:5 | SEQ4732 | 6.E−03 | 0.6 |
| MCI | lnc-DDB1-1:2 | SEQ5421 | 2.E−04 | 1.6 | DLB | lnc-TAF12-5:1 | SEQ3964 | 2.E−04 | 1.4 |
| FTD | lnc-DDB1-1:2 | SEQ5421 | 3.E−02 | 1.5 | msAD | lnc-TAF12-5:1 | SEQ3964 | 2.E−02 | 1.2 |
| MCI | lnc-DDIAS-6:1 | SEQ3745 | 5.E−04 | 1.4 | DLB | lnc-TAF6-1:2 | SEQ5219 | 5.E−04 | 2.7 |
| DLB | lnc-DDIAS-6:1 | SEQ3745 | 7.E−04 | 1.6 | DLB | lnc-TAF9-1:8 | SEQ4558 | 2.E−03 | 1.3 |
| miAD | lnc-DDIAS-6:1 | SEQ3745 | 8.E−03 | 1.3 | miAD | lnc-TAF9-2:2 | SEQ4102 | 1.E−02 | 0.5 |
| All AD | lnc-DDIAS-6:1 | SEQ3745 | 1.E−02 | 1.2 | DLB | lnc-TAF9-6:6 | SEQ4969 | 8.E−04 | 1.6 |
| msAD | lnc-DDIAS-6:1 | SEQ3745 | 4.E−02 | 1.2 | DLB | lnc-TAGLN-2:1 | SEQ3559 | 4.E−04 | 1.4 |
| MCI | lnc-DDX39A-3:1 | SEQ4785 | 1.E−03 | 1.7 | FTD | lnc-TANC1-1:3 | SEQ5238 | 1.E−08 | 0.3 |
| FTD | lnc-DDX58-3:1 | SEQ4044 | 1.E−03 | 0.7 | miAD | lnc-TANC1-1:3 | SEQ5238 | 5.E−04 | 0.5 |
| All AD | lnc-DDX58-3:1 | SEQ4044 | 1.E−02 | 0.7 | FTD | lnc-TAOK1-4:1 | SEQ3609 | 7.E−04 | 0.7 |
| msAD | lnc-DDX58-3:1 | SEQ4044 | 2.E−02 | 0.7 | MCI | lnc-TAOK1-4:2 | SEQ5761 | 1.E−05 | 0.2 |
| DLB | lnc-DDX6-1:1 | SEQ5115 | 6.E−04 | 1.4 | FTD | lnc-TAOK1-4:2 | SEQ5761 | 8.E−05 | 0.2 |
| DLB | lnc-DEC1-7:1 | SEQ3804 | 2.E−04 | 1.6 | DLB | lnc-TAOK3-9:1 | SEQ2396 | 6.E−04 | 1.5 |
| MCI | lnc-DEC1-7:1 | SEQ3804 | 9.E−04 | 1.6 | miAD | lnc-TAOK3-9:1 | SEQ2396 | 2.E−03 | 1.3 |
| msAD | lnc-DEC1-7:1 | SEQ3804 | 4.E−02 | 1.2 | All AD | lnc-TAOK3-9:1 | SEQ2396 | 3.E−03 | 1.2 |
| DLB | lnc-DEFB115-3:1 | SEQ5595 | 9.E−06 | 2.4 | msAD | lnc-TAOK3-9:1 | SEQ2396 | 2.E−02 | 1.2 |
| FTD | lnc-DEFB115-3:1 | SEQ5595 | 2.E−04 | 1.8 | MCI | lnc-TARBP1-6:1 | SEQ2671 | 5.E−05 | 1.7 |
| DLB | lnc-DEFB115-5:2 | SEQ2465 | 8.E−05 | 2.0 | DLB | lnc-TARBP1-6:1 | SEQ2671 | 1.E−04 | 1.7 |
| FTD | lnc-DEFB115-5:2 | SEQ2465 | 6.E−04 | 1.7 | FTD | lnc-TARBP1-6:1 | SEQ2671 | 2.E−04 | 1.6 |
| All AD | lnc-DEFB115-5:2 | SEQ2465 | 4.E−02 | 1.3 | All AD | lnc-TARBP1-6:1 | SEQ2671 | 4.E−04 | 1.5 |
| All AD | lnc-DEFB131B-5:1 | SEQ3683 | 4.E−02 | 1.2 | msAD | lnc-TARBP1-6:1 | SEQ2671 | 1.E−03 | 1.4 |
| msAD | lnc-DEFB131B-5:1 | SEQ3683 | 5.E−02 | 1.2 | miAD | lnc-TARBP1-6:1 | SEQ2671 | 1.E−03 | 1.5 |
| DLB | lnc-DEGS2-2:2 | SEQ4003 | 9.E−06 | 1.6 | MCI | lnc-TARS-6:1 | SEQ3544 | 1.E−03 | 1.7 |
| FTD | lnc-DEGS2-2:2 | SEQ4003 | 9.E−04 | 1.4 | FTD | lnc-TAS2R30-1:2 | SEQ5288 | 4.E−04 | 0.6 |
| MCI | lnc-DEGS2-2:2 | SEQ4003 | 9.E−04 | 1.4 | FTD | lnc-TBC1D19-8:1 | SEQ5084 | 6.E−04 | 0.6 |
| All AD | lnc-DEGS2-2:2 | SEQ4003 | 8.E−03 | 1.2 | FTD | lnc-TBC1D19-8:2 | SEQ5960 | 6.E−06 | 4.E−02 |
| miAD | lnc-DEGS2-2:2 | SEQ4003 | 1.E−02 | 1.3 | FTD | lnc-TBC1D31-3:1 | SEQ5594 | 2.E−04 | 0.6 |
| msAD | lnc-DEGS2-2:2 | SEQ4003 | 2.E−02 | 1.2 | DLB | lnc-TBX19-2:1 | SEQ5795 | 6.E−05 | 1.7 |
| DLB | lnc-DENND1A-5:1 | SEQ3185 | 8.E−05 | 1.6 | DLB | lnc-TBX2-7:1 | SEQ5201 | 5.E−04 | 1.8 |
| MCI | lnc-DENND3-7:1 | SEQ4306 | 2.E−04 | 1.7 | MCI | lnc-TBX2-7:1 | SEQ5201 | 5.E−04 | 1.7 |
| DLB | lnc-DENND3-7:1 | SEQ4306 | 3.E−04 | 1.6 | DLB | lnc-TBXA2R-2:1 | SEQ4459 | 2.E−03 | 2.5 |
| msAD | lnc-DENND3-7:1 | SEQ4306 | 7.E−03 | 1.3 | FTD | lnc-TC2N-1:1 | SEQ4893 | 9.E−04 | 0.6 |
| All AD | lnc-DENND3-7:1 | SEQ4306 | 2.E−02 | 1.2 | FTD | lnc-TCEANC2-1:1 | SEQ5000 | 8.E−04 | 0.7 |
| DLB | lnc-DENND3-9:1 | SEQ4263 | 3.E−04 | 1.7 | All AD | lnc-TCF19-1:104 | SEQ5768 | 4.E−02 | 0.7 |
| MCI | lnc-DENND3-9:1 | SEQ4263 | 8.E−04 | 1.8 | FTD | lnc-TCF19-1:107 | SEQ5466 | 3.E−04 | 0.6 |
| msAD | lnc-DENND3-9:1 | SEQ4263 | 9.E−03 | 1.3 | All AD | lnc-TCF19-1:107 | SEQ5466 | 3.E−02 | 0.7 |
| All AD | lnc-DENND3-9:1 | SEQ4263 | 2.E−02 | 1.2 | DLB | lnc-TCF7-1:3 | SEQ0990 | 2.E−04 | 1.4 |
| DLB | lnc-DFNB59-2:28 | SEQ5937 | 1.E−05 | 2.4 | MCI | lnc-TCFL5-6:1 | SEQ5564 | 1.E−04 | 1.5 |
| DLB | lnc-DHRS7B-7:2 | SEQ5187 | 5.E−04 | 1.5 | FTD | lnc-TCFL5-6:1 | SEQ5564 | 2.E−04 | 1.3 |
| DLB | lnc-DHRSX-1:6 | SEQ5311 | 4.E−04 | 1.4 | DLB | lnc-TCFL5-6:1 | SEQ5564 | 2.E−04 | 1.5 |
| FTD | lnc-DHX33-1:1 | SEQ2533 | 6.E−04 | 0.7 | All AD | lnc-TCP1-4:1 | SEQ5772 | 1.E−02 | 0.8 |
| msAD | lnc-DHX38-4:13 | SEQ2803 | 5.E−02 | 1.2 | DLB | lnc-TCTA-1:1 | SEQ4966 | 8.E−04 | 1.6 |
| DLB | lnc-DLGAP5-2:1 | SEQ2566 | 9.E−04 | 1.3 | FTD | lnc-TCTA-2:1 | SEQ2757 | 1.E−05 | 0.7 |
| DLB | lnc-DMTN-5:1 | SEQ5269 | 2.E−05 | 1.8 | MCI | lnc-TCTA-2:1 | SEQ2757 | 7.E−04 | 0.8 |
| MCI | lnc-DMTN-5:1 | SEQ5269 | 5.E−04 | 1.6 | All AD | lnc-TCTN3-2:1 | SEQ5775 | 3.E−02 | 0.8 |
| All AD | lnc-DMXL1-7:1 | SEQ4018 | 1.E−02 | 1.2 | FTD | lnc-TDP1-6:2 | SEQ5680 | 1.E−04 | 0.5 |
| msAD | lnc-DMXL1-7:1 | SEQ4018 | 2.E−02 | 1.2 | miAD | lnc-TEAD2-2:4 | SEQ3500 | 8.E−03 | 1.3 |
| MCI | lnc-DNAH10OS-6:1 | SEQ5010 | 7.E−04 | 0.5 | All AD | lnc-TEAD2-2:4 | SEQ3500 | 9.E−03 | 1.3 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| DLB | lnc-DNAH10OS-8:2 | SEQ5044 | 7.E-04 | 1.7 | msAD | lnc-TEAD2-2:4 | SEQ3500 | 4.E-02 | 1.2 |
| DLB | lnc-DNAJA1-1:1 | SEQ5797 | 6.E-05 | 1.9 | MCI | lnc-TEC-2:1 | SEQ5141 | 5.E-05 | 1.8 |
| msAD | lnc-DNAJC15-5:1 | SEQ3843 | 3.E-02 | 0.6 | FTD | lnc-TEC-2:1 | SEQ5141 | 2.E-04 | 1.6 |
| msAD | lnc-DNAJC15-6:1 | SEQ3924 | 3.E-02 | 0.6 | DLB | lnc-TEC-2:1 | SEQ5141 | 6.E-04 | 1.8 |
| All AD | lnc-DNAJC15-6:1 | SEQ3924 | 3.E-02 | 0.6 | DLB | lnc-TEF-1:1 | SEQ3075 | 5.E-05 | 1.6 |
| DLB | lnc-DNAJC16-1:2 | SEQ4625 | 1.E-03 | 1.4 | MCI | lnc-TEF-1:1 | SEQ3075 | 7.E-04 | 1.5 |
| FTD | lnc-DNAJC19-8:1 | SEQ5867 | 4.E-05 | 0.6 | DLB | lnc-TEKT2-1:2 | SEQ4568 | 2.E-03 | 1.4 |
| DLB | lnc-DNAJC5-1:3 | SEQ5372 | 3.E-04 | 1.4 | DLB | lnc-TELO2-3:2 | SEQ2887 | 4.E-07 | 2.1 |
| FTD | lnc-DNAJC5B-1:3 | SEQ5405 | 3.E-04 | 0.6 | MCI | lnc-TELO2-3:2 | SEQ2887 | 1.E-05 | 2.0 |
| DLB | lnc-DNAJC7-1:1 | SEQ4518 | 9.E-06 | 1.6 | DLB | lnc-TELO2-3:3 | SEQ5003 | 4.E-06 | 1.7 |
| All AD | lnc-DNAJC7-1:1 | SEQ4518 | 5.E-02 | 1.1 | MCI | lnc-TELO2-3:3 | SEQ5003 | 2.E-05 | 1.6 |
| DLB | lnc-DNAL1-2:1 | SEQ4509 | 2.E-03 | 1.5 | FTD | lnc-TELO2-3:3 | SEQ5003 | 8.E-04 | 1.3 |
| MCI | lnc-DNAL4-4:1 | SEQ3095 | 4.E-05 | 1.7 | FTD | lnc-TENM1-6:1 | SEQ3849 | 1.E-05 | 0.5 |
| DLB | lnc-DNAL4-4:1 | SEQ3095 | 1.E-04 | 1.8 | miAD | lnc-TENM1-6:1 | SEQ3849 | 1.E-03 | 0.6 |
| DLB | lnc-DNASE1L2-2:11 | SEQ5947 | 9.E-06 | 1.7 | All AD | lnc-TENM1-6:1 | SEQ3849 | 3.E-03 | 0.6 |
| DLB | lnc-DNASE1L2-2:12 | SEQ4422 | 2.E-06 | 1.7 | msAD | lnc-TENM1-6:1 | SEQ3849 | 3.E-02 | 0.6 |
| MCI | lnc-DNASE1L2-2:12 | SEQ4422 | 2.E-03 | 1.4 | All AD | lnc-TEX37-1:1 | SEQ2655 | 4.E-02 | 1.2 |
| FTD | lnc-DOCK11-1:1 | SEQ5358 | 4.E-04 | 0.7 | All AD | lnc-TEX37-1:2 | SEQ2654 | 4.E-02 | 1.2 |
| FTD | lnc-DOCK7-7:1 | SEQ0015 | 3.E-05 | 0.6 | DLB | lnc-TFDP2-5:1 | SEQ4709 | 1.E-03 | 1.5 |
| DLB | lnc-DOLPP1-3:1 | SEQ4598 | 1.E-04 | 1.6 | DLB | lnc-TFEC-7:1 | SEQ4248 | 8.E-05 | 1.4 |
| MCI | lnc-DOLPP1-3:1 | SEQ4598 | 2.E-03 | 1.8 | MCI | lnc-TFEC-7:1 | SEQ4248 | 1.E-03 | 1.3 |
| FTD | lnc-DPP4-10:1 | SEQ5512 | 2.E-04 | 0.6 | All AD | lnc-TFEC-7:1 | SEQ4248 | 4.E-03 | 1.2 |
| DLB | lnc-DPP7-1:1 | SEQ4708 | 1.E-03 | 1.5 | msAD | lnc-TFEC-7:1 | SEQ4248 | 8.E-03 | 1.2 |
| DLB | lnc-DR1-2:1 | SEQ4684 | 1.E-03 | 1.4 | miAD | lnc-TFEC-7:1 | SEQ4248 | 9.E-03 | 1.2 |
| FTD | lnc-DR1-2:2 | SEQ5300 | 4.E-04 | 0.8 | DLB | lnc-TFPT-1:1 | SEQ4694 | 1.E-03 | 1.4 |
| miAD | lnc-DRD2-1:7 | SEQ3704 | 1.E-02 | 0.6 | FTD | lnc-TGFBR2-1:1 | SEQ5419 | 3.E-04 | 0.7 |
| All AD | lnc-DRD2-1:7 | SEQ3704 | 1.E-02 | 0.6 | FTD | lnc-TGM5-1:3 | SEQ5787 | 8.E-08 | 0.5 |
| msAD | lnc-DRD2-1:7 | SEQ3704 | 5.E-02 | 0.7 | MCI | lnc-TGM5-1:3 | SEQ5787 | 6.E-05 | 0.6 |
| DLB | lnc-DRD5-23:2 | SEQ5314 | 4.E-04 | 1.4 | All AD | lnc-TGM5-1:3 | SEQ5787 | 5.E-02 | 0.7 |
| msAD | lnc-DRD5-29:1 | SEQ3847 | 3.E-02 | 1.6 | FTD | lnc-TGM5-1:5 | SEQ6001 | 3.E-07 | 4.1 |
| DLB | lnc-DRICH1-3:10 | SEQ4972 | 1.E-04 | 1.7 | DLB | lnc-TGM6-4:1 | SEQ3919 | 1.E-03 | 1.5 |
| MCI | lnc-DRICH1-3:10 | SEQ4972 | 8.E-04 | 1.7 | All AD | lnc-TGM6-4:1 | SEQ3919 | 2.E-02 | 1.2 |
| FTD | lnc-DRICH1-3:9 | SEQ4454 | 6.E-04 | 1.6 | msAD | lnc-TGM6-4:1 | SEQ3919 | 3.E-02 | 1.2 |
| DLB | lnc-DRICH1-3:9 | SEQ4454 | 7.E-04 | 1.8 | All AD | lnc-TGS1-1:2 | SEQ5789 | 4.E-02 | 0.6 |
| MCI | lnc-DRICH1-3:9 | SEQ4454 | 2.E-03 | 1.7 | msAD | lnc-THBS1-7:1 | SEQ3779 | 4.E-02 | 1.3 |
| DLB | lnc-DSCR3-2:2 | SEQ4408 | 1.E-04 | 1.5 | DLB | lnc-THTPA-2:27 | SEQ5732 | 9.E-05 | 1.5 |
| MCI | lnc-DSCR3-2:2 | SEQ4408 | 2.E-03 | 1.4 | DLB | lnc-THTPA-2:28 | SEQ5733 | 9.E-05 | 1.5 |
| FTD | lnc-DSCR8-4:1 | SEQ4538 | 2.E-04 | 0.5 | DLB | lnc-THTPA-2:33 | SEQ5731 | 9.E-05 | 1.5 |
| All AD | lnc-DSCR8-4:1 | SEQ4538 | 3.E-02 | 0.6 | FTD | lnc-THUMPD2-2:1 | SEQ3837 | 3.E-04 | 0.5 |
| FTD | lnc-DTNBP1-14:1 | SEQ4539 | 2.E-05 | 0.6 | miAD | lnc-THUMPD2-2:1 | SEQ3837 | 9.E-03 | 0.6 |
| All AD | lnc-DTNBP1-14:1 | SEQ4539 | 3.E-02 | 0.7 | All AD | lnc-THUMPD2-2:1 | SEQ3837 | 9.E-03 | 0.6 |
| msAD | lnc-DTNBP1-5:22 | SEQ3658 | 5.E-02 | 1.5 | msAD | lnc-THUMPD2-2:1 | SEQ3837 | 3.E-02 | 0.8 |
| DLB | lnc-DTYMK-1:2 | SEQ5043 | 4.E-05 | 1.7 | FTD | lnc-THUMPD3-6:1 | SEQ4222 | 1.E-06 | 0.6 |
| MCI | lnc-DTYMK-1:2 | SEQ5043 | 7.E-04 | 1.7 | miAD | lnc-THUMPD3-6:1 | SEQ4222 | 1.E-02 | 0.7 |
| DLB | lnc-DUSP28-1:1 | SEQ4846 | 9.E-04 | 1.5 | DLB | lnc-TICAM1-1:2 | SEQ5514 | 4.E-06 | 1.4 |
| FTD | lnc-DUXA-4:1 | SEQ2603 | 5.E-07 | 0.5 | MCI | lnc-TICAM1-1:2 | SEQ5514 | 2.E-04 | 1.3 |
| All AD | lnc-DUXA-4:1 | SEQ2603 | 4.E-02 | 0.7 | All AD | lnc-TICAM1-1:2 | SEQ5514 | 3.E-02 | 1.1 |
| DLB | lnc-DYNLL2-3:1 | SEQ3803 | 2.E-05 | 1.4 | DLB | lnc-TIGD1-1:16 | SEQ5522 | 2.E-04 | 1.4 |
| All AD | lnc-DYNLL2-3:1 | SEQ3803 | 4.E-02 | 1.1 | FTD | lnc-TIGD4-3:1 | SEQ5397 | 3.E-04 | 0.6 |
| msAD | lnc-DYNLL2-3:1 | SEQ3803 | 4.E-02 | 1.1 | DLB | lnc-TIGD5-1:1 | SEQ2945 | 6.E-05 | 1.7 |
| MCI | lnc-DYNLL2-4:1 | SEQ4868 | 9.E-04 | 1.6 | All AD | lnc-TIGD5-1:1 | SEQ2945 | 3.E-02 | 1.2 |
| DLB | lnc-DYNLT1-1:1 | SEQ4431 | 2.E-03 | 1.5 | msAD | lnc-TIGD5-1:1 | SEQ2945 | 4.E-02 | 1.2 |
| FTD | lnc-DYSF-2:2 | SEQ5779 | 7.E-05 | 0.6 | All AD | lnc-TIMM9-4:1 | SEQ4177 | 3.E-03 | 1.8 |
| FTD | lnc-DYSF-4:1 | SEQ3751 | 7.E-05 | 0.6 | miAD | lnc-TIMM9-4:1 | SEQ4177 | 4.E-03 | 2.0 |
| miAD | lnc-DYSF-4:1 | SEQ3751 | 2.E-03 | 0.7 | msAD | lnc-TIMM9-4:1 | SEQ4177 | 1.E-02 | 1.6 |
| All AD | lnc-DYSF-4:1 | SEQ3751 | 5.E-03 | 0.7 | All AD | lnc-TLCD1-1:2 | SEQ5796 | 4.E-02 | 1.1 |
| msAD | lnc-DYSF-4:1 | SEQ3751 | 4.E-02 | 0.7 | DLB | lnc-TLDC2-4:1 | SEQ0555 | 5.E-05 | 1.7 |
| MCI | lnc-EBLN1-1:1 | SEQ3983 | 1.E-04 | 1.7 | MCI | lnc-TLR10-2:1 | SEQ4427 | 2.E-03 | 1.5 |
| FTD | lnc-EBLN1-1:1 | SEQ3983 | 7.E-04 | 1.7 | FTD | lnc-TLR1-1:1 | SEQ5944 | 3.E-08 | 0.4 |
| DLB | lnc-EBLN1-1:1 | SEQ3983 | 9.E-04 | 1.8 | MCI | lnc-TLR1-1:1 | SEQ5944 | 4.E-07 | 0.4 |
| msAD | lnc-EBLN1-1:1 | SEQ3983 | 2.E-03 | 1.3 | DLB | lnc-TLR1-1:1 | SEQ5944 | 9.E-06 | 0.4 |
| All AD | lnc-EBLN1-1:2 | SEQ4545 | 4.E-02 | 1.3 | FTD | lnc-TLR1-1:4 | SEQ3887 | 7.E-07 | 0.5 |
| All AD | lnc-EBPL-1:1 | SEQ4546 | 3.E-02 | 0.8 | All AD | lnc-TLR1-1:4 | SEQ3887 | 2.E-02 | 0.7 |
| miAD | lnc-ECE1-1:1 | SEQ4182 | 1.E-02 | 0.6 | msAD | lnc-TLR1-1:4 | SEQ3887 | 3.E-02 | 0.7 |
| All AD | lnc-ECE1-1:1 | SEQ4182 | 1.E-02 | 0.7 | MCI | lnc-TMA16-1:1 | SEQ4896 | 8.E-04 | 0.6 |
| DLB | lnc-ECSCR-2:5 | SEQ5431 | 8.E-05 | 1.6 | FTD | lnc-TMA16-1:1 | SEQ4896 | 9.E-04 | 0.6 |
| MCI | lnc-ECSCR-2:5 | SEQ5431 | 3.E-04 | 1.4 | FTD | lnc-TMC5-1:1 | SEQ4737 | 8.E-06 | 0.7 |
| MCI | lnc-EDC3-2:10 | SEQ5714 | 1.E-04 | 3.1 | MCI | lnc-TMC5-1:1 | SEQ4737 | 1.E-04 | 0.7 |
| MCI | lnc-EDC3-2:16 | SEQ4760 | 1.E-03 | 1.5 | DLB | lnc-TMC5-1:1 | SEQ4737 | 1.E-03 | 0.8 |
| All AD | lnc-EDEM3-7:3 | SEQ0272 | 3.E-02 | 0.7 | All AD | lnc-TMC5-1:1 | SEQ4737 | 3.E-02 | 0.9 |
| msAD | lnc-EDEM3-7:3 | SEQ0272 | 5.E-02 | 0.7 | DLB | lnc-TMEM105-1:1 | SEQ4951 | 8.E-04 | 1.5 |
| DLB | lnc-EFCAB12-2:16 | SEQ5894 | 2.E-05 | 1.7 | DLB | lnc-TMEM109-2:1 | SEQ5133 | 2.E-04 | 1.9 |
| DLB | lnc-EFCAB12-2:4 | SEQ4612 | 1.E-03 | 1.3 | MCI | lnc-TMEM109-2:1 | SEQ5133 | 6.E-04 | 1.6 |
| DLB | lnc-EFCAB12-2:8 | SEQ4436 | 2.E-03 | 1.5 | DLB | lnc-TMEM120B-4:2 | SEQ4586 | 2.E-03 | 1.6 |

TABLE 10-continued 2847 whole blood (Paxgene RNA tube) lncRNAs differentially expressed in MCI group or mild AD group or moderate-to-severe AD group or both of these AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| DLB | lnc-EFCAB8-1:3 | SEQ3380 | 5.E-04 | 1.4 | DLB | lnc-TMEM120B-4:4 | SEQ4853 | 9.E-04 | 1.5 |
| DLB | lnc-EFCAB9-5:2 | SEQ4496 | 2.E-03 | 1.4 | DLB | lnc-TMEM121-2:15 | SEQ4057 | 2.E-03 | 2.3 |
| FTD | lnc-EFHB-6:1 | SEQ4989 | 8.E-04 | 0.5 | All AD | lnc-TMEM121-2:15 | SEQ4057 | 1.E-02 | 1.6 |
| FTD | lnc-EFR3A-6:1 | SEQ5956 | 7.E-06 | 0.6 | msAD | lnc-TMEM121-2:15 | SEQ4057 | 2.E-02 | 1.6 |
| MCI | lnc-EGFL7-3:1 | SEQ4645 | 1.E-03 | 1.6 | DLB | lnc-TMEM121-2:16 | SEQ4214 | 8.E-04 | 1.8 |
| miAD | lnc-EGR2-5:1 | SEQ4460 | 2.E-03 | 0.6 | All AD | lnc-TMEM121-2:16 | SEQ4214 | 3.E-03 | 1.4 |
| All AD | lnc-EGR2-5:1 | SEQ4460 | 6.E-03 | 0.6 | miAD | lnc-TMEM121-2:16 | SEQ4214 | 3.E-03 | 1.5 |
| DLB | lnc-EIF1AD-1:1 | SEQ2653 | 5.E-04 | 1.4 | msAD | lnc-TMEM121-2:16 | SEQ4214 | 1.E-02 | 1.3 |
| All AD | lnc-EIF2AK3-26:2 | SEQ4334 | 2.E-03 | 1.3 | DLB | lnc-TMEM121-2:17 | SEQ4379 | 5.E-04 | 3.6 |
| msAD | lnc-EIF2AK3-26:2 | SEQ4334 | 4.E-03 | 1.1 | All AD | lnc-TMEM121-2:17 | SEQ4379 | 6.E-04 | 2.3 |
| miAD | lnc-EIF2AK3-26:2 | SEQ4334 | 6.E-03 | 1.5 | msAD | lnc-TMEM121-2:17 | SEQ4379 | 1.E-03 | 2.5 |
| DLB | lnc-EIF2AK3-4:58 | SEQ4358 | 1.E-03 | 3.1 | miAD | lnc-TMEM121-2:17 | SEQ4379 | 3.E-03 | 2.1 |
| miAD | lnc-EIF2AK3-4:58 | SEQ4358 | 4.E-03 | 1.9 | msAD | lnc-TMEM121-2:19 | SEQ3733 | 4.E-02 | 1.5 |
| All AD | lnc-EIF2AK3-4:58 | SEQ4358 | 2.E-02 | 1.7 | miAD | lnc-TMEM121-2:20 | SEQ4041 | 3.E-03 | 1.7 |
| DLB | lnc-EIF2AK3-4:59 | SEQ4232 | 2.E-04 | 2.8 | All AD | lnc-TMEM121-2:20 | SEQ4041 | 4.E-03 | 1.7 |
| FTD | lnc-EIF2AK3-4:59 | SEQ4232 | 6.E-04 | 2.8 | msAD | lnc-TMEM121-2:20 | SEQ4041 | 2.E-02 | 1.6 |
| msAD | lnc-EIF2AK3-4:59 | SEQ4232 | 1.E-02 | 1.7 | All AD | lnc-TMEM121-2:21 | SEQ5806 | 4.E-02 | 1.4 |
| All AD | lnc-EIF2AK3-4:59 | SEQ4232 | 1.E-02 | 1.6 | miAD | lnc-TMEM132D-5:1 | SEQ4212 | 1.E-02 | 0.7 |
| DLB | lnc-EIF2AK3-4:65 | SEQ3873 | 4.E-05 | 2.4 | All AD | lnc-TMEM132D-5:1 | SEQ4212 | 2.E-02 | 0.8 |
| MCI | lnc-EIF2AK3-4:65 | SEQ3873 | 1.E-03 | 1.8 | All AD | lnc-TMEM140-1:2 | SEQ5808 | 3.E-02 | 0.7 |
| All AD | lnc-EIF2AK3-4:65 | SEQ3873 | 1.E-02 | 1.1 | FTD | lnc-TMEM155-3:1 | SEQ3556 | 7.E-06 | 0.5 |
| msAD | lnc-EIF2AK3-4:65 | SEQ3873 | 3.E-02 | 1.1 | MCI | lnc-TMEM155-3:1 | SEQ3556 | 2.E-05 | 0.5 |
| miAD | lnc-EIF2AK3-4:75 | SEQ4250 | 9.E-03 | 1.4 | DLB | lnc-TMEM160-1:1 | SEQ5181 | 5.E-04 | 1.4 |
| All AD | lnc-EIF2AK3-4:75 | SEQ4250 | 1.E-02 | 1.3 | MCI | lnc-TMEM167B-1:2 | SEQ4004 | 7.E-07 | 2.4 |
| All AD | lnc-EIF2AK3-4:77 | SEQ4571 | 4.E-02 | 1.2 | FTD | lnc-TMEM167B-1:2 | SEQ4004 | 2.E-06 | 2.0 |
| MCI | lnc-EIF2B1-1:1 | SEQ2595 | 2.E-05 | 1.5 | DLB | lnc-TMEM167B-1:2 | SEQ4004 | 1.E-04 | 2.1 |
| FTD | lnc-EIF2B1-1:1 | SEQ2595 | 3.E-04 | 1.3 | miAD | lnc-TMEM167B-1:2 | SEQ4004 | 4.E-03 | 1.3 |
| All AD | lnc-EIF2B1-1:1 | SEQ2595 | 3.E-02 | 1.2 | All AD | lnc-TMEM167B-1:2 | SEQ4004 | 4.E-03 | 1.3 |
| DLB | lnc-EIF2D-3:1 | SEQ4850 | 9.E-04 | 1.5 | msAD | lnc-TMEM167B-1:2 | SEQ4004 | 2.E-02 | 1.2 |
| FTD | lnc-EIF2S3-1:1 | SEQ5351 | 4.E-04 | 0.6 | MCI | lnc-TMEM167B-1:3 | SEQ5635 | 1.E-06 | 2.2 |
| DLB | lnc-EIF3B-2:3 | SEQ3940 | 1.E-05 | 1.8 | FTD | lnc-TMEM167B-1:3 | SEQ5635 | 2.E-05 | 1.7 |
| MCI | lnc-EIF3B-2:3 | SEQ3940 | 2.E-05 | 1.5 | DLB | lnc-TMEM167B-1:3 | SEQ5635 | 2.E-04 | 1.9 |
| miAD | lnc-EIF3B-2:3 | SEQ3940 | 4.E-04 | 1.3 | All AD | lnc-TMEM167B-1:3 | SEQ5635 | 2.E-02 | 1.2 |
| FTD | lnc-EIF3B-2:3 | SEQ3940 | 8.E-04 | 1.3 | MCI | lnc-TMEM167B-1:4 | SEQ5541 | 3.E-06 | 2.1 |
| All AD | lnc-EIF3B-2:3 | SEQ3940 | 2.E-03 | 1.2 | FTD | lnc-TMEM167B-1:4 | SEQ5541 | 2.E-04 | 1.7 |
| msAD | lnc-EIF3B-2:3 | SEQ3940 | 3.E-03 | 1.2 | DLB | lnc-TMEM167B-1:4 | SEQ5541 | 2.E-04 | 2.0 |
| miAD | lnc-EIF4E3-2:1 | SEQ4132 | 1.E-02 | 0.6 | All AD | lnc-TMEM167B-1:4 | SEQ5541 | 4.E-02 | 1.2 |
| All AD | lnc-EIF4E3-2:1 | SEQ4132 | 1.E-02 | 0.7 | FTD | lnc-TMEM167B-1:5 | SEQ3821 | 2.E-06 | 1.9 |
| All AD | lnc-EIF4E3-2:2 | SEQ4579 | 3.E-02 | 0.7 | MCI | lnc-TMEM167B-1:5 | SEQ3821 | 6.E-06 | 2.4 |
| DLB | lnc-EIF4ENIF1-3:1 | SEQ3788 | 3.E-04 | 1.6 | DLB | lnc-TMEM167B-1:5 | SEQ3821 | 2.E-04 | 2.2 |
| MCI | lnc-EIF4ENIF1-3:1 | SEQ3788 | 2.E-03 | 1.4 | All AD | lnc-TMEM167B-1:5 | SEQ3821 | 1.E-02 | 1.2 |
| msAD | lnc-EIF4ENIF1-3:1 | SEQ3788 | 4.E-02 | 1.2 | miAD | lnc-TMEM167B-1:5 | SEQ3821 | 1.E-02 | 1.3 |
| All AD | lnc-EIF4G3-4:1 | SEQ4581 | 3.E-02 | 0.8 | msAD | lnc-TMEM167B-1:5 | SEQ3821 | 4.E-02 | 1.2 |
| MCI | lnc-EIF5-2:1 | SEQ2571 | 1.E-05 | 1.7 | DLB | lnc-TMEM173-3:3 | SEQ5194 | 5.E-04 | 1.6 |
| DLB | lnc-EIF5-2:1 | SEQ2571 | 5.E-05 | 1.9 | FTD | lnc-TMEM178A-5:1 | SEQ4104 | 1.E-04 | 0.5 |
| FTD | lnc-EIF5-2:1 | SEQ2571 | 1.E-04 | 1.4 | miAD | lnc-TMEM178A-5:1 | SEQ4104 | 1.E-02 | 0.6 |
| All AD | lnc-EIF5-2:1 | SEQ2571 | 2.E-02 | 1.1 | All AD | lnc-TMEM178A-5:1 | SEQ4104 | 3.E-02 | 0.7 |
| msAD | lnc-EIF5-2:1 | SEQ2571 | 3.E-02 | 1.1 | FTD | lnc-TMEM178A-6:5 | SEQ3797 | 3.E-05 | 0.5 |
| FTD | lnc-ELF2-5:2 | SEQ4109 | 1.E-04 | 0.6 | miAD | lnc-TMEM178A-6:5 | SEQ3797 | 5.E-03 | 0.5 |
| miAD | lnc-ELF2-5:2 | SEQ4109 | 1.E-02 | 0.7 | All AD | lnc-TMEM178A-6:5 | SEQ3797 | 7.E-03 | 0.6 |
| All AD | lnc-ELF2-5:2 | SEQ4109 | 3.E-02 | 0.7 | msAD | lnc-TMEM178A-6:5 | SEQ3797 | 4.E-02 | 0.6 |
| DLB | lnc-ELFN1-3:2 | SEQ4585 | 3.E-05 | 1.7 | msAD | lnc-TMEM183A-1:1 | SEQ3991 | 2.E-02 | 1.2 |
| All AD | lnc-ELFN1-3:2 | SEQ4585 | 4.E-02 | 1.2 | All AD | lnc-TMEM185B-1:6 | SEQ5817 | 5.E-02 | 0.8 |
| DLB | lnc-ELFN1-6:2 | SEQ4594 | 2.E-04 | 1.9 | msAD | lnc-TMEM185B-12:2 | SEQ4025 | 2.E-02 | 0.5 |
| MCI | lnc-ELFN1-6:2 | SEQ4594 | 2.E-03 | 1.7 | All AD | lnc-TMEM185B-12:2 | SEQ4025 | 2.E-02 | 0.6 |
| MCI | lnc-ELL3-1:2 | SEQ4383 | 2.E-06 | 1.7 | All AD | lnc-TMEM185B-12:3 | SEQ4226 | 8.E-03 | 0.6 |
| FTD | lnc-ELL3-1:2 | SEQ4383 | 8.E-06 | 1.6 | msAD | lnc-TMEM185B-12:3 | SEQ4226 | 1.E-02 | 0.5 |
| DLB | lnc-ELL3-1:2 | SEQ4383 | 9.E-05 | 1.7 | msAD | lnc-TMEM186-1:2 | SEQ2702 | 2.E-02 | 1.3 |
| miAD | lnc-ELL3-1:2 | SEQ4383 | 4.E-04 | 1.3 | DLB | lnc-TMEM202-2:2 | SEQ5373 | 3.E-04 | 1.5 |
| All AD | lnc-ELL3-1:2 | SEQ4383 | 4.E-04 | 1.3 | FTD | lnc-TMEM206-3:2 | SEQ3714 | 4.E-05 | 0.6 |
| msAD | lnc-ELL3-1:2 | SEQ4383 | 3.E-03 | 1.3 | miAD | lnc-TMEM206-3:2 | SEQ3714 | 1.E-02 | 0.7 |
| FTD | lnc-EMC3-2:1 | SEQ4593 | 2.E-04 | 0.7 | All AD | lnc-TMEM206-3:2 | SEQ3714 | 1.E-02 | 0.7 |
| All AD | lnc-EMC3-2:1 | SEQ4593 | 3.E-02 | 0.8 | msAD | lnc-TMEM206-3:2 | SEQ3714 | 4.E-02 | 0.8 |
| FTD | lnc-EMCN-4:1 | SEQ4137 | 1.E-04 | 0.6 | All AD | lnc-TMEM212-5:1 | SEQ5819 | 4.E-02 | 0.8 |
| miAD | lnc-EMCN-4:1 | SEQ4137 | 1.E-02 | 0.7 | DLB | lnc-TMEM231-2:1 | SEQ5792 | 6.E-05 | 1.6 |
| All AD | lnc-EMCN-4:1 | SEQ4137 | 3.E-02 | 0.8 | DLB | lnc-TMEM234-4:1 | SEQ5877 | 3.E-05 | 1.6 |
| All AD | lnc-EME2-1:1 | SEQ3682 | 2.E-02 | 1.2 | DLB | lnc-TMEM240-1:1 | SEQ4946 | 8.E-04 | 1.5 |
| msAD | lnc-EME2-1:1 | SEQ3682 | 5.E-02 | 1.2 | All AD | lnc-TMEM255B-5:13 | SEQ5820 | 3.E-02 | 1.5 |
| MCI | lnc-EMG1-1:1 | SEQ4928 | 8.E-04 | 1.4 | FTD | lnc-TMEM30B-9:1 | SEQ4108 | 6.E-11 | 0.3 |
| DLB | lnc-EMG1-1:2 | SEQ5636 | 2.E-04 | 1.9 | MCI | lnc-TMEM30B-9:1 | SEQ4108 | 7.E-06 | 0.4 |
| All AD | lnc-EML6-6:1 | SEQ3684 | 3.E-02 | 1.2 | DLB | lnc-TMEM30B-9:1 | SEQ4108 | 2.E-03 | 0.4 |
| msAD | lnc-EML6-6:1 | SEQ3684 | 5.E-02 | 1.2 | miAD | lnc-TMEM30B-9:1 | SEQ4108 | 1.E-02 | 0.6 |
| FTD | lnc-EMX2-3:4 | SEQ5359 | 4.E-04 | 0.7 | FTD | lnc-TMEM43-1:4 | SEQ5285 | 4.E-04 | 0.5 |
| DLB | lnc-ENC1-5:1 | SEQ2244 | 2.E-03 | 1.7 | DLB | lnc-TMEM50B-4:2 | SEQ4870 | 9.E-04 | 1.7 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| All AD | lnc-ENOPH1-3:3 | SEQ3381 | 3.E−03 | 1.2 | All AD | lnc-TMEM63A-2:1 | SEQ5822 | 3.E−02 | 1.2 |
| miAD | lnc-ENOPH1-3:3 | SEQ3381 | 3.E−03 | 1.3 | DLB | lnc-TMEM88B-6:1 | SEQ5055 | 2.E−05 | 3.8 |
| msAD | lnc-ENOPH1-3:3 | SEQ3381 | 1.E−02 | 1.2 | MCI | lnc-TMEM88B-6:1 | SEQ5055 | 7.E−04 | 2.7 |
| DLB | lnc-EPHA1-1:4 | SEQ5276 | 5.E−04 | 1.7 | FTD | lnc-TMTC3-13:11 | SEQ3765 | 2.E−05 | 0.6 |
| DLB | lnc-EPHA6-7:1 | SEQ4574 | 1.E−05 | 1.7 | miAD | lnc-TMTC3-13:11 | SEQ3765 | 9.E−03 | 0.7 |
| MCI | lnc-EPHA6-7:1 | SEQ4574 | 2.E−03 | 1.5 | All AD | lnc-TMTC3-13:11 | SEQ3765 | 1.E−02 | 0.7 |
| FTD | lnc-EPHB3-5:1 | SEQ4809 | 1.E−03 | 0.7 | msAD | lnc-TMTC3-13:11 | SEQ3765 | 4.E−02 | 0.7 |
| DLB | lnc-EPM2AIP1-5:2 | SEQ4648 | 1.E−03 | 1.7 | DLB | lnc-TMUB2-1:11 | SEQ5664 | 1.E−04 | 1.5 |
| FTD | lnc-EPN2-3:2 | SEQ4005 | 2.E−06 | 2.9 | DLB | lnc-TMUB2-2:1 | SEQ5814 | 5.E−05 | 1.5 |
| DLB | lnc-EPN2-3:2 | SEQ4005 | 2.E−04 | 2.5 | All AD | lnc-TNFAIP6-5:1 | SEQ5824 | 5.E−02 | 0.7 |
| MCI | lnc-EPN2-3:2 | SEQ4005 | 5.E−02 | 2.2 | DLB | lnc-TNFAIP8L1-2:1 | SEQ4950 | 8.E−04 | 1.5 |
| msAD | lnc-EPN2-3:2 | SEQ4005 | 2.E−02 | 1.2 | All AD | lnc-TNFAIP8L1-2:1 | SEQ4950 | 4.E−02 | 1.2 |
| All AD | lnc-EPN2-3:2 | SEQ4005 | 2.E−02 | 1.2 | FTD | lnc-TNFRSF11A-5:1 | SEQ5825 | 8.E−08 | 0.5 |
| FTD | lnc-EPN2-3:3 | SEQ5074 | 7.E−04 | 1.8 | All AD | lnc-TNFRSF11A-5:1 | SEQ5825 | 2.E−02 | 0.7 |
| FTD | lnc-ERAP2-4:3 | SEQ5601 | 2.E−04 | 0.6 | DLB | lnc-TNFRSF13C-1:1 | SEQ4142 | 3.E−04 | 2.2 |
| DLB | lnc-ERCC6L2-14:1 | SEQ3383 | 2.E−04 | 1.5 | All AD | lnc-TNFRSF13C-1:1 | SEQ4142 | 3.E−03 | 1.5 |
| MCI | lnc-ERCC6L2-14:1 | SEQ3383 | 8.E−04 | 1.4 | msAD | lnc-TNFRSF13C-1:1 | SEQ4142 | 4.E−03 | 1.6 |
| miAD | lnc-ERCC6L2-14:1 | SEQ3383 | 8.E−03 | 1.2 | miAD | lnc-TNFRSF13C-1:1 | SEQ4142 | 1.E−02 | 1.4 |
| All AD | lnc-ERCC6L2-14:1 | SEQ3383 | 9.E−03 | 1.2 | miAD | lnc-TNFRSF14-2:7 | SEQ4234 | 1.E−02 | 0.5 |
| msAD | lnc-ERCC6L2-14:1 | SEQ3383 | 4.E−02 | 1.2 | All AD | lnc-TNFRSF14-2:7 | SEQ4234 | 1.E−02 | 0.6 |
| FTD | lnc-ERRFI1-3:1 | SEQ5607 | 2.E−04 | 0.7 | MCI | lnc-TNFRSF14-4:2 | SEQ5213 | 4.E−07 | 1.9 |
| DLB | lnc-ERV3-1-1:4 | SEQ4405 | 2.E−03 | 1.3 | FTD | lnc-TNFRSF14-4:2 | SEQ5213 | 5.E−06 | 1.7 |
| FTD | lnc-ERV3-1-2:1 | SEQ3853 | 1.E−04 | 0.6 | miAD | lnc-TNFRSF14-4:2 | SEQ5213 | 8.E−04 | 1.5 |
| miAD | lnc-ERV3-1-2:1 | SEQ3853 | 4.E−03 | 0.7 | DLB | lnc-TNFRSF14-4:2 | SEQ5213 | 5.E−04 | 1.9 |
| All AD | lnc-ERV3-1-2:1 | SEQ3853 | 6.E−03 | 0.7 | All AD | lnc-TNFRSF14-4:2 | SEQ5213 | 3.E−03 | 1.4 |
| msAD | lnc-ERV3-1-2:1 | SEQ3853 | 3.E−02 | 0.8 | msAD | lnc-TNFRSF1A-3:1 | SEQ3977 | 2.E−02 | 0.7 |
| miAD | lnc-ESM1-3:3 | SEQ4203 | 1.E−02 | 0.6 | All AD | lnc-TNFRSF1A-3:1 | SEQ3977 | 3.E−02 | 0.7 |
| DLB | lnc-ESRP2-4:1 | SEQ4417 | 2.E−03 | 1.4 | DLB | lnc-TNFRSF8-2:1 | SEQ4710 | 1.E−03 | 1.5 |
| DLB | lnc-ESRRB-1:1 | SEQ4575 | 9.E−04 | 1.4 | FTD | lnc-TNFSF4-3:2 | SEQ5063 | 7.E−04 | 0.6 |
| MCI | lnc-ESRRB-1:1 | SEQ4575 | 2.E−03 | 1.5 | All AD | lnc-TNFSF4-3:2 | SEQ5063 | 4.E−02 | 0.7 |
| FTD | lnc-ESRRB-3:1 | SEQ4912 | 9.E−04 | 0.7 | DLB | lnc-TNIP2-1:1 | SEQ4845 | 9.E−04 | 1.4 |
| MCI | lnc-EVL-6:10 | SEQ4872 | 1.E−04 | 1.7 | All AD | lnc-TNRC6A-3:2 | SEQ5831 | 3.E−02 | 1.2 |
| DLB | lnc-EVL-6:10 | SEQ4872 | 9.E−04 | 1.7 | MCI | lnc-TNRC6C-3:1 | SEQ5627 | 2.E−05 | 1.9 |
| FTD | lnc-EVPL-1:1 | SEQ4064 | 1.E−04 | 0.5 | DLB | lnc-TNRC6C-3:1 | SEQ5627 | 2.E−04 | 1.7 |
| All AD | lnc-EVPL-1:1 | SEQ4064 | 5.E−03 | 0.6 | FTD | lnc-TOB1-4:1 | SEQ5647 | 1.E−04 | 0.7 |
| miAD | lnc-EVPL-1:1 | SEQ4064 | 7.E−03 | 0.6 | MCI | lnc-TOB2-2:1 | SEQ3968 | 2.E−04 | 1.4 |
| msAD | lnc-EVPL-1:1 | SEQ4064 | 2.E−02 | 0.7 | DLB | lnc-TOB2-2:1 | SEQ3968 | 2.E−03 | 1.4 |
| DLB | lnc-EVX1-15:1 | SEQ2412 | 4.E−05 | 1.3 | msAD | lnc-TOB2-2:1 | SEQ3968 | 2.E−02 | 1.2 |
| DLB | lnc-EVX2-8:1 | SEQ4082 | 2.E−04 | 1.7 | All AD | lnc-TOMM20-2:22 | SEQ5835 | 4.E−02 | 0.7 |
| miAD | lnc-EVX2-8:1 | SEQ4082 | 1.E−02 | 1.3 | DLB | lnc-TOMM22-2:2 | SEQ4766 | 9.E−04 | 1.4 |
| All AD | lnc-EVX2-8:1 | SEQ4082 | 3.E−02 | 1.2 | MCI | lnc-TOMM22-2:2 | SEQ4766 | 1.E−03 | 1.5 |
| All AD | lnc-EXOSC1-1:2 | SEQ4611 | 5.E−02 | 0.8 | DLB | lnc-TOR1AIP1-2:1 | SEQ2565 | 1.E−03 | 1.7 |
| FTD | lnc-EXOSC6-1:2 | SEQ3300 | 5.E−05 | 0.6 | FTD | lnc-TOX4-4:2 | SEQ2696 | 4.E−05 | 0.6 |
| DLB | lnc-EXOSC6-1:6 | SEQ5218 | 4.E−04 | 2.4 | DLB | lnc-TOX4-4:2 | SEQ2696 | 6.E−04 | 0.7 |
| MCI | lnc-EXOSC6-1:6 | SEQ5218 | 5.E−04 | 2.4 | miAD | lnc-TOX4-4:2 | SEQ2696 | 5.E−03 | 0.7 |
| All AD | lnc-EXOSC8-4:1 | SEQ4615 | 5.E−02 | 0.7 | All AD | lnc-TOX4-4:2 | SEQ2696 | 3.E−02 | 0.8 |
| FTD | lnc-EXTL2-2:1 | SEQ5225 | 5.E−04 | 0.6 | All AD | lnc-TP53BP2-8:2 | SEQ5838 | 3.E−02 | 0.7 |
| FTD | lnc-F2RL2-1:2 | SEQ3827 | 3.E−06 | 0.5 | MCI | lnc-TP53TG5-3:1 | SEQ4914 | 6.E−06 | 1.9 |
| miAD | lnc-F2RL2-1:2 | SEQ3827 | 9.E−03 | 0.7 | DLB | lnc-TP53TG5-3:1 | SEQ4914 | 4.E−05 | 1.8 |
| All AD | lnc-F2RL2-1:2 | SEQ3827 | 9.E−03 | 0.7 | FTD | lnc-TP53TG5-3:1 | SEQ4914 | 9.E−04 | 1.4 |
| msAD | lnc-F2RL2-1:2 | SEQ3827 | 4.E−02 | 0.8 | DLB | lnc-TPBGL-2:1 | SEQ4424 | 2.E−03 | 1.5 |
| DLB | lnc-FAAP100-2:1 | SEQ2299 | 5.E−04 | 1.3 | MCI | lnc-TPBGL-2:1 | SEQ4424 | 2.E−03 | 1.5 |
| MCI | lnc-FAAP20-2:1 | SEQ2889 | 4.E−04 | 1.7 | DLB | lnc-TPCN1-1:1 | SEQ4584 | 4.E−04 | 1.6 |
| DLB | lnc-FAAP20-2:1 | SEQ2889 | 5.E−04 | 1.7 | MCI | lnc-TPCN1-1:1 | SEQ4584 | 2.E−03 | 1.5 |
| DLB | lnc-FAHD2B-1:1 | SEQ5339 | 4.E−04 | 1.8 | FTD | lnc-TRAF5-8:1 | SEQ5763 | 8.E−05 | 0.6 |
| DLB | lnc-FAHD2B-1:2 | SEQ2915 | 2.E−04 | 1.9 | All AD | lnc-TRAF6-3:1 | SEQ5842 | 4.E−02 | 0.8 |
| All AD | lnc-FAM106A-2:10 | SEQ2240 | 7.E−03 | 0.5 | DLB | lnc-TRAPPC2L-2:4 | SEQ4777 | 1.E−03 | 1.6 |
| miAD | lnc-FAM106A-2:10 | SEQ2240 | 8.E−03 | 0.5 | MCI | lnc-TRDMT1-5:1 | SEQ4984 | 9.E−05 | 3.6 |
| msAD | lnc-FAM106A-2:10 | SEQ2240 | 3.E−02 | 0.6 | FTD | lnc-TRDMT1-5:1 | SEQ4984 | 2.E−04 | 2.5 |
| All AD | lnc-FAM106A-2:7 | SEQ4623 | 3.E−02 | 0.6 | DLB | lnc-TRDMT1-5:1 | SEQ4984 | 8.E−04 | 3.1 |
| DLB | lnc-FAM111B-1:3 | SEQ4406 | 2.E−03 | 1.3 | All AD | lnc-TRDMT1-5:1 | SEQ4984 | 4.E−02 | 1.4 |
| FTD | lnc-FAM114A1-1:1 | SEQ4326 | 6.E−08 | 0.5 | FTD | lnc-TREML2-4:1 | SEQ4995 | 8.E−04 | 0.6 |
| MCI | lnc-FAM114A1-1:1 | SEQ4326 | 7.E−04 | 0.6 | DLB | lnc-TREX1-10:5 | SEQ5200 | 5.E−04 | 1.7 |
| miAD | lnc-FAM114A1-1:1 | SEQ4326 | 6.E−03 | 0.6 | miAD | lnc-TREX1-5:1 | SEQ3723 | 1.E−02 | 0.8 |
| All AD | lnc-FAM114A1-1:1 | SEQ4326 | 1.E−02 | 0.7 | All AD | lnc-TREX1-5:1 | SEQ3723 | 3.E−02 | 0.8 |
| All AD | lnc-FAM126B-1:2 | SEQ3668 | 2.E−02 | 0.8 | msAD | lnc-TREX1-5:1 | SEQ3723 | 4.E−02 | 0.8 |
| msAD | lnc-FAM126B-1:2 | SEQ3668 | 5.E−02 | 0.8 | FTD | lnc-TRIL-3:1 | SEQ4347 | 2.E−04 | 0.5 |
| FTD | lnc-FAM131B-2:1 | SEQ3679 | 8.E−05 | 0.5 | miAD | lnc-TRIL-3:1 | SEQ4347 | 5.E−03 | 0.6 |
| miAD | lnc-FAM131B-2:1 | SEQ3679 | 1.E−02 | 0.6 | All AD | lnc-TRIL-3:1 | SEQ4347 | 3.E−02 | 0.7 |
| All AD | lnc-FAM131B-2:1 | SEQ3679 | 1.E−02 | 0.6 | miAD | lnc-TRIL-3:2 | SEQ4206 | 1.E−02 | 0.7 |
| msAD | lnc-FAM131B-2:1 | SEQ3679 | 5.E−02 | 0.6 | All AD | lnc-TRIL-3:2 | SEQ4206 | 2.E−02 | 0.7 |
| FTD | lnc-FAM133B-1:1 | SEQ5226 | 5.E−04 | 0.6 | FTD | lnc-TRIM23-1:1 | SEQ5102 | 1.E−08 | 0.5 |
| FTD | lnc-FAM13C-5:1 | SEQ4372 | 7.E−05 | 0.6 | MCI | lnc-TRIM23-1:1 | SEQ5102 | 6.E−04 | 0.5 |
| miAD | lnc-FAM13C-5:1 | SEQ4372 | 4.E−03 | 0.7 | All AD | lnc-TRIM25-1:1 | SEQ5849 | 1.E−02 | 0.7 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| All AD | lnc-FAM13C-5:1 | SEQ4372 | 9.E-03 | 0.7 | DLB | lnc-TRIM26-2:27 | SEQ4644 | 1.E-03 | 1.6 |
| DLB | lnc-FAM156A-1:2 | SEQ5434 | 3.E-04 | 1.4 | MCI | lnc-TRIM26-2:53 | SEQ5649 | 1.E-04 | 0.1 |
| DLB | lnc-FAM156A-3:5 | SEQ5881 | 3.E-03 | 1.7 | DLB | lnc-TRIM28-13:2 | SEQ3581 | 2.E-03 | 1.4 |
| FTD | lnc-FAM162A-2:12 | SEQ4634 | 7.E-05 | 0.7 | DLB | lnc-TRIM39-2:1 | SEQ5205 | 5.E-04 | 1.7 |
| All AD | lnc-FAM162A-2:12 | SEQ4634 | 4.E-02 | 0.8 | FTD | lnc-TRIM55-1:14 | SEQ4916 | 9.E-04 | 1.8 |
| FTD | lnc-FAM162A-2:6 | SEQ6002 | 8.E-08 | 0.3 | FTD | lnc-TRIM59-1:1 | SEQ2766 | 8.E-07 | 0.6 |
| FTD | lnc-FAM167A-5:2 | SEQ5898 | 2.E-05 | 0.5 | miAD | lnc-TRIM59-1:1 | SEQ2766 | 1.E-02 | 0.7 |
| DLB | lnc-FAM167B-2:1 | SEQ4453 | 2.E-03 | 1.7 | All AD | lnc-TRIM59-1:1 | SEQ2766 | 2.E-02 | 0.8 |
| DLB | lnc-FAM168A-1:1 | SEQ4858 | 9.E-04 | 1.5 | FTD | lnc-TRIM61-6:1 | SEQ5220 | 2.E-04 | 2.3 |
| FTD | lnc-FAM174A-6:1 | SEQ4639 | 5.E-05 | 0.5 | MCI | lnc-TRIM61-6:1 | SEQ5220 | 5.E-04 | 2.9 |
| All AD | lnc-FAM174A-6:1 | SEQ4639 | 3.E-02 | 0.7 | DLB | lnc-TRIM62-2:1 | SEQ5263 | 5.E-04 | 1.6 |
| All AD | lnc-FAM174A-6:6 | SEQ4640 | 5.E-02 | 0.6 | FTD | lnc-TRIM69-2:8 | SEQ4814 | 1.E-03 | 0.7 |
| FTD | lnc-FAM177B-1:1 | SEQ3388 | 1.E-04 | 0.6 | MCI | lnc-TRIM74-1:6 | SEQ4254 | 7.E-06 | 3.3 |
| miAD | lnc-FAM177B-1:1 | SEQ3388 | 8.E-03 | 0.7 | DLB | lnc-TRIM74-1:6 | SEQ4254 | 2.E-03 | 2.0 |
| All AD | lnc-FAM177B-1:1 | SEQ3388 | 1.E-02 | 0.8 | All AD | lnc-TRIM74-1:6 | SEQ4254 | 6.E-03 | 1.6 |
| DLB | lnc-FAM184B-1:2 | SEQ5791 | 6.E-05 | 1.5 | msAD | lnc-TRIM74-1:6 | SEQ4254 | 9.E-03 | 1.6 |
| DLB | lnc-FAM187B-3:1 | SEQ5109 | 6.E-04 | 1.2 | FTD | lnc-TRMT10B-4:1 | SEQ5609 | 3.E-07 | 0.5 |
| FTD | lnc-FAM192A-3:1 | SEQ4170 | 4.E-05 | 0.6 | MCI | lnc-TRMT10B-4:1 | SEQ5609 | 2.E-04 | 0.6 |
| All AD | lnc-FAM192A-3:1 | SEQ4170 | 3.E-03 | 0.6 | All AD | lnc-TRMT10B-4:1 | SEQ5609 | 2.E-02 | 0.8 |
| miAD | lnc-FAM192A-3:1 | SEQ4170 | 4.E-03 | 0.6 | FTD | lnc-TRMT10C-3:1 | SEQ4398 | 1.E-07 | 0.5 |
| msAD | lnc-FAM192A-3:1 | SEQ4170 | 1.E-02 | 0.6 | MCI | lnc-TRMT10C-3:1 | SEQ4398 | 2.E-03 | 0.7 |
| msAD | lnc-FAM192A-4:1 | SEQ4298 | 7.E-03 | 0.7 | All AD | lnc-TRMT10C-3:1 | SEQ4398 | 2.E-02 | 0.7 |
| All AD | lnc-FAM192A-4:1 | SEQ4298 | 2.E-02 | 0.7 | FTD | lnc-TRMT10C-4:1 | SEQ4992 | 8.E-04 | 0.6 |
| msAD | lnc-FAM192A-4:3 | SEQ4603 | 1.E-03 | 0.7 | MCI | lnc-TRMT1-1:1 | SEQ4158 | 7.E-04 | 1.3 |
| All AD | lnc-FAM192A-4:3 | SEQ4603 | 5.E-03 | 0.7 | miAD | lnc-TRMT1-1:1 | SEQ4158 | 1.E-02 | 1.1 |
| msAD | lnc-FAM192A-4:5 | SEQ4150 | 1.E-02 | 0.7 | All AD | lnc-TRMT1-1:1 | SEQ4158 | 2.E-02 | 1.1 |
| All AD | lnc-FAM192A-4:5 | SEQ4150 | 2.E-02 | 0.7 | All AD | lnc-TRMT61B-5:3 | SEQ5853 | 3.E-02 | 0.8 |
| DLB | lnc-FAM193B-2:1 | SEQ5387 | 3.E-04 | 1.7 | All AD | lnc-TRPC5-3:1 | SEQ5854 | 3.E-02 | 1.2 |
| FTD | lnc-FAM200A-1:1 | SEQ5687 | 1.E-04 | 0.6 | FTD | lnc-TRPC5OS-5:1 | SEQ5597 | 2.E-04 | 0.4 |
| FTD | lnc-FAM200B-3:1 | SEQ3664 | 2.E-04 | 0.7 | DLB | lnc-TRPM5-1:1 | SEQ4867 | 9.E-04 | 1.6 |
| miAD | lnc-FAM200B-3:1 | SEQ3664 | 8.E-03 | 0.7 | DLB | lnc-TRPT1-1:2 | SEQ5701 | 1.E-04 | 1.7 |
| All AD | lnc-FAM200B-3:1 | SEQ3664 | 1.E-02 | 0.7 | DLB | lnc-TRRAP-1:1 | SEQ5570 | 2.E-04 | 1.6 |
| msAD | lnc-FAM200B-3:1 | SEQ3664 | 5.E-02 | 0.7 | DLB | lnc-TRRAP-1:4 | SEQ5571 | 2.E-04 | 1.6 |
| DLB | lnc-FAM207A-7:1 | SEQ5711 | 1.E-04 | 1.9 | MCI | lnc-TRRAP-1:5 | SEQ4747 | 1.E-03 | 1.4 |
| MCI | lnc-FAM208B-5:3 | SEQ3973 | 2.E-05 | 1.6 | DLB | lnc-TRRAP-1:6 | SEQ5628 | 2.E-04 | 1.7 |
| FTD | lnc-FAM208B-5:3 | SEQ3973 | 2.E-05 | 1.5 | FTD | lnc-TSPOAP1-1:1 | SEQ5299 | 4.E-04 | 0.7 |
| DLB | lnc-FAM208B-5:3 | SEQ3973 | 8.E-05 | 1.7 | DLB | lnc-TSPOAP1-1:2 | SEQ5674 | 2.E-05 | 1.8 |
| All AD | lnc-FAM208B-5:3 | SEQ3973 | 2.E-02 | 1.2 | MCI | lnc-TSPOAP1-1:2 | SEQ5674 | 1.E-04 | 1.7 |
| msAD | lnc-FAM208B-5:3 | SEQ3973 | 2.E-02 | 1.2 | DLB | lnc-TSPOAP1-1:4 | SEQ4597 | 2.E-03 | 1.7 |
| FTD | lnc-FAM217A-1:7 | SEQ4988 | 4.E-04 | 0.5 | FTD | lnc-TSPYL5-4:1 | SEQ4804 | 1.E-03 | 0.6 |
| DLB | lnc-FAM231C-7:7 | SEQ5203 | 3.E-04 | 1.7 | All AD | lnc-TSPYL5-4:1 | SEQ4804 | 3.E-02 | 0.7 |
| MCI | lnc-FAM231C-7:7 | SEQ5203 | 5.E-04 | 1.7 | DLB | lnc-TSR3-1:2 | SEQ0339 | 1.E-04 | 1.6 |
| All AD | lnc-FAM3B-3:2 | SEQ4659 | 4.E-02 | 0.8 | MCI | lnc-TSR3-1:2 | SEQ0339 | 3.E-04 | 1.5 |
| All AD | lnc-FAM49B-1:1 | SEQ4660 | 4.E-02 | 0.7 | MCI | lnc-TSSK2-1:1 | SEQ5709 | 4.E-05 | 2.0 |
| FTD | lnc-FAM71D-1:2 | SEQ4895 | 9.E-04 | 0.6 | DLB | lnc-TSSK2-1:1 | SEQ5709 | 1.E-04 | 1.8 |
| DLB | lnc-FAM71E1-2:10 | SEQ5752 | 8.E-05 | 1.5 | DLB | lnc-TSSK3-2:2 | SEQ4428 | 2.E-03 | 1.5 |
| All AD | lnc-FAM71E1-2:9 | SEQ3219 | 1.E-02 | 1.3 | DLB | lnc-TSSK4-3:2 | SEQ5308 | 4.E-04 | 1.4 |
| msAD | lnc-FAM71E1-2:9 | SEQ3219 | 2.E-02 | 1.3 | DLB | lnc-TSSK6-1:2 | SEQ5823 | 2.E-05 | 1.6 |
| miAD | lnc-FAM72B-17:1 | SEQ3884 | 4.E-03 | 0.6 | MCI | lnc-TSSK6-1:2 | SEQ5823 | 5.E-05 | 1.9 |
| All AD | lnc-FAM72B-17:1 | SEQ3884 | 5.E-03 | 0.5 | DLB | lnc-TSTA3-2:1 | SEQ4409 | 2.E-03 | 1.4 |
| msAD | lnc-FAM72B-17:1 | SEQ3884 | 3.E-02 | 0.5 | FTD | lnc-TTC27-10:1 | SEQ5976 | 3.E-06 | 0.6 |
| DLB | lnc-FAM72D-8:1 | SEQ2753 | 3.E-04 | 1.4 | DLB | lnc-TTC4-1:1 | SEQ3776 | 4.E-05 | 1.7 |
| miAD | lnc-FAM84B-20:1 | SEQ3995 | 3.E-03 | 1.4 | msAD | lnc-TTC4-1:1 | SEQ3776 | 4.E-02 | 1.2 |
| All AD | lnc-FAM84B-20:1 | SEQ3995 | 4.E-03 | 1.4 | DLB | lnc-TTC9-3:1 | SEQ5917 | 2.E-05 | 1.7 |
| msAD | lnc-FAM84B-20:1 | SEQ3995 | 2.E-02 | 1.4 | FTD | lnc-TTC9-4:1 | SEQ5224 | 5.E-04 | 0.5 |
| MCI | lnc-FAM84B-21:1 | SEQ4956 | 3.E-04 | 1.5 | DLB | lnc-TUBA1C-1:15 | SEQ4456 | 2.E-03 | 1.8 |
| DLB | lnc-FAM84B-21:1 | SEQ4956 | 8.E-04 | 1.5 | DLB | lnc-TUBA1C-1:8 | SEQ5558 | 2.E-04 | 1.4 |
| DLB | lnc-FAM84B-4:3 | SEQ0083 | 9.E-04 | 1.8 | FTD | lnc-TUBA1C-3:2 | SEQ3773 | 9.E-05 | 0.6 |
| DLB | lnc-FAM84B-6:5 | SEQ4529 | 2.E-03 | 1.7 | miAD | lnc-TUBA1C-3:2 | SEQ3773 | 2.E-03 | 0.6 |
| DLB | lnc-FAM8A1-2:5 | SEQ4622 | 2.E-04 | 1.5 | All AD | lnc-TUBA1C-3:2 | SEQ3773 | 5.E-03 | 0.7 |
| MCI | lnc-FAM8A1-2:5 | SEQ4622 | 1.E-03 | 1.4 | msAD | lnc-TUBA1C-3:2 | SEQ3773 | 4.E-02 | 0.7 |
| DLB | lnc-FAM92A-2:1 | SEQ4503 | 2.E-03 | 1.4 | FTD | lnc-TUBA3C-16:1 | SEQ4801 | 1.E-03 | 0.5 |
| DLB | lnc-FAM92B-4:1 | SEQ5535 | 2.E-04 | 1.7 | DLB | lnc-TUBA3D-1:3 | SEQ4712 | 1.E-03 | 1.5 |
| MCI | lnc-FANCA-3:1 | SEQ4011 | 4.E-05 | 1.5 | All AD | lnc-TUBB2A-7:2 | SEQ3767 | 2.E-02 | 0.8 |
| DLB | lnc-FANCA-3:1 | SEQ4011 | 9.E-04 | 1.6 | msAD | lnc-TUBB2A-7:2 | SEQ3767 | 4.E-02 | 0.8 |
| All AD | lnc-FANCA-3:1 | SEQ4011 | 2.E-02 | 1.2 | All AD | lnc-TUBD1-1:1 | SEQ3961 | 7.E-03 | 0.7 |
| msAD | lnc-FANCA-3:1 | SEQ4011 | 2.E-02 | 1.2 | miAD | lnc-TUBD1-1:1 | SEQ3961 | 8.E-03 | 0.7 |
| DLB | lnc-FANCL-4:1 | SEQ2690 | 7.E-04 | 1.5 | msAD | lnc-TUBD1-1:1 | SEQ3961 | 2.E-02 | 0.8 |
| All AD | lnc-FANCL-4:1 | SEQ2690 | 2.E-02 | 1.2 | MCI | lnc-TUBGCP6-5:4 | SEQ5689 | 9.E-06 | 1.7 |
| msAD | lnc-FANCL-4:1 | SEQ2690 | 3.E-02 | 1.2 | DLB | lnc-TUBGCP6-5:4 | SEQ5689 | 9.E-05 | 1.7 |
| All AD | lnc-FAP-3:1 | SEQ0206 | 2.E-02 | 0.7 | FTD | lnc-TUBGCP6-5:4 | SEQ5689 | 1.E-04 | 1.5 |
| msAD | lnc-FAP-3:1 | SEQ0206 | 4.E-02 | 0.7 | MCI | lnc-TUBGCP6-5:6 | SEQ4865 | 7.E-04 | 1.7 |
| All AD | lnc-FAS-1:1 | SEQ4671 | 3.E-02 | 0.8 | DLB | lnc-TUBGCP6-5:6 | SEQ4865 | 9.E-04 | 1.6 |
| FTD | lnc-FAS-2:2 | SEQ5399 | 3.E-04 | 0.7 | MCI | lnc-TULP2-4:1 | SEQ5890 | 1.E-05 | 1.6 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
| --- | --- | --- | --- | --- | --- | --- | --- | --- | --- |
| DLB | lnc-FBXL22-1:1 | SEQ3898 | 9.E−04 | 1.4 | DLB | lnc-TULP2-4:1 | SEQ5890 | 2.E−05 | 1.6 |
| MCI | lnc-FBXL22-1:1 | SEQ3898 | 2.E−03 | 1.4 | DLB | lnc-TUSC5-5:2 | SEQ3875 | 1.E−05 | 1.7 |
| All AD | lnc-FBXL22-1:1 | SEQ3898 | 2.E−02 | 1.2 | MCI | lnc-TUSC5-5:2 | SEQ3875 | 1.E−03 | 1.4 |
| msAD | lnc-FBXL22-1:1 | SEQ3898 | 3.E−02 | 1.2 | msAD | lnc-TUSC5-5:2 | SEQ3875 | 3.E−02 | 1.2 |
| DLB | lnc-FBXO11-1:8 | SEQ5237 | 9.E−06 | 1.9 | All AD | lnc-TUSC5-5:2 | SEQ3875 | 4.E−02 | 1.2 |
| MCI | lnc-FBXO11-1:8 | SEQ5237 | 9.E−05 | 1.6 | DLB | lnc-TVP23A-6:1 | SEQ5530 | 2.E−04 | 1.6 |
| FTD | lnc-FBXO11-1:8 | SEQ5237 | 5.E−04 | 1.6 | FTD | lnc-TWSG1-1:1 | SEQ5776 | 7.E−05 | 0.5 |
| miAD | lnc-FBXO11-4:1 | SEQ3717 | 7.E−03 | 1.4 | All AD | lnc-TWSG1-1:1 | SEQ5776 | 3.E−02 | 0.7 |
| All AD | lnc-FBXO11-4:1 | SEQ3717 | 9.E−03 | 1.3 | FTD | lnc-TWSG1-2:1 | SEQ0047 | 6.E−10 | 0.4 |
| msAD | lnc-FBXO11-4:1 | SEQ3717 | 4.E−02 | 1.2 | MCI | lnc-TWSG1-2:1 | SEQ0047 | 1.E−05 | 0.4 |
| All AD | lnc-FBXO28-1:10 | SEQ4679 | 5.E−02 | 0.8 | miAD | lnc-TWSG1-2:1 | SEQ0047 | 2.E−03 | 0.6 |
| FTD | lnc-FBXO28-1:13 | SEQ5785 | 4.E−06 | 0.3 | All AD | lnc-TWSG1-2:1 | SEQ0047 | 3.E−02 | 0.6 |
| MCI | lnc-FBXO28-1:13 | SEQ5785 | 6.E−05 | 0.4 | FTD | lnc-TXLNB-3:4 | SEQ5914 | 2.E−05 | 0.5 |
| FTD | lnc-FBXO30-2:1 | SEQ5683 | 1.E−04 | 0.5 | FTD | lnc-TXLNB-3:6 | SEQ5988 | 2.E−06 | 0.4 |
| FTD | lnc-FBXO45-4:1 | SEQ4199 | 3.E−07 | 2.1 | DLB | lnc-TXNRD2-2:1 | SEQ5328 | 1.E−04 | 1.7 |
| MCI | lnc-FBXO45-4:1 | SEQ4199 | 1.E−05 | 2.6 | MCI | lnc-TXNRD2-2:1 | SEQ5328 | 4.E−04 | 1.6 |
| DLB | lnc-FBXO45-4:1 | SEQ4199 | 1.E−04 | 2.1 | DLB | lnc-TYW1-7:8 | SEQ5952 | 7.E−06 | 2.0 |
| miAD | lnc-FBXO45-4:1 | SEQ4199 | 2.E−03 | 1.3 | MCI | lnc-U2AF2-1:4 | SEQ5174 | 3.E−04 | 1.3 |
| All AD | lnc-FBXO45-4:1 | SEQ4199 | 2.E−03 | 1.3 | DLB | lnc-U2AF2-1:4 | SEQ5174 | 1.E−04 | 1.4 |
| msAD | lnc-FBXO45-4:1 | SEQ4199 | 1.E−02 | 1.3 | MCI | lnc-UACA-5:1 | SEQ4784 | 2.E−04 | 1.9 |
| DLB | lnc-FBXO47-1:1 | SEQ4419 | 2.E−03 | 1.4 | DLB | lnc-UACA-5:1 | SEQ4784 | 1.E−03 | 1.7 |
| FTD | lnc-FCAR-1:1 | SEQ3850 | 9.E−05 | 0.6 | FTD | lnc-UAP1-4:1 | SEQ4669 | 5.E−06 | 0.6 |
| All AD | lnc-FCAR-1:1 | SEQ3850 | 1.E−02 | 0.7 | MCI | lnc-UAP1-4:1 | SEQ4669 | 1.E−03 | 0.6 |
| miAD | lnc-FCAR-1:1 | SEQ3850 | 1.E−02 | 0.7 | All AD | lnc-UAP1-4:1 | SEQ4669 | 2.E−02 | 0.8 |
| msAD | lnc-FCAR-1:1 | SEQ3850 | 3.E−02 | 0.7 | DLB | lnc-UBAC1-2:2 | SEQ3540 | 1.E−03 | 2.3 |
| All AD | lnc-FCGR2B-5:1 | SEQ4688 | 3.E−02 | 0.7 | DLB | lnc-UBALD1-1:1 | SEQ5739 | 9.E−05 | 1.9 |
| All AD | lnc-FCGR3A-4:1 | SEQ4689 | 3.E−02 | 0.8 | DLB | lnc-UBAP2L-1:1 | SEQ4401 | 2.E−03 | 1.3 |
| FTD | lnc-FEM1B-4:1 | SEQ2624 | 6.E−10 | 0.3 | DLB | lnc-UBE2D2-2:1 | SEQ4832 | 5.E−05 | 1.6 |
| MCI | lnc-FEM1B-4:1 | SEQ2624 | 9.E−06 | 0.4 | MCI | lnc-UBE2D2-2:1 | SEQ4832 | 9.E−04 | 1.4 |
| All AD | lnc-FEM1B-4:1 | SEQ2624 | 1.E−02 | 0.6 | msAD | lnc-UBL5-1:4 | SEQ3948 | 3.E−02 | 1.2 |
| msAD | lnc-FEM1B-4:1 | SEQ2624 | 2.E−02 | 0.6 | All AD | lnc-UBR2-4:2 | SEQ5873 | 4.E−02 | 0.8 |
| FTD | lnc-FFAR2-1:1 | SEQ4692 | 3.E−05 | 0.6 | DLB | lnc-UCK1-3:2 | SEQ5850 | 4.E−05 | 1.6 |
| All AD | lnc-FFAR2-1:1 | SEQ4692 | 3.E−02 | 0.8 | DLB | lnc-UCP3-2:3 | SEQ3728 | 4.E−05 | 2.2 |
| DLB | lnc-FGF23-5:1 | SEQ2474 | 2.E−04 | 1.5 | MCI | lnc-UCP3-2:3 | SEQ3728 | 9.E−05 | 2.4 |
| DLB | lnc-FGF23-5:3 | SEQ2473 | 2.E−04 | 1.6 | FTD | lnc-UCP3-2:3 | SEQ3728 | 1.E−04 | 1.9 |
| DLB | lnc-FGF9-11:1 | SEQ4915 | 5.E−05 | 1.8 | All AD | lnc-UCP3-2:3 | SEQ3728 | 1.E−02 | 1.3 |
| MCI | lnc-FGF9-11:1 | SEQ4915 | 2.E−04 | 1.7 | msAD | lnc-UCP3-2:3 | SEQ3728 | 4.E−02 | 1.2 |
| FTD | lnc-FGF9-11:1 | SEQ4915 | 9.E−04 | 1.5 | All AD | lnc-UGDH-3:3 | SEQ2526 | 2.E−02 | 0.8 |
| All AD | lnc-FGFBP2-1:2 | SEQ3763 | 2.E−02 | 0.7 | FTD | lnc-UGP2-3:2 | SEQ5158 | 5.E−04 | 0.7 |
| msAD | lnc-FGFBP2-1:2 | SEQ3763 | 4.E−02 | 0.7 | All AD | lnc-UGT3A2-3:1 | SEQ0389 | 1.E−02 | 0.8 |
| MCI | lnc-FGL2-3:1 | SEQ3286 | 5.E−05 | 0.4 | DLB | lnc-ULK4-1:2 | SEQ5565 | 2.E−04 | 1.5 |
| FTD | lnc-FGL2-3:1 | SEQ3286 | 2.E−04 | 0.5 | All AD | lnc-UPK3B-5:5 | SEQ5875 | 4.E−02 | 1.3 |
| DLB | lnc-FGL2-3:1 | SEQ3286 | 9.E−04 | 0.6 | All AD | lnc-UQCC3-1:1 | SEQ3979 | 1.E−02 | 1.2 |
| miAD | lnc-FGL2-3:1 | SEQ3286 | 1.E−02 | 0.7 | msAD | lnc-UQCC3-1:1 | SEQ3979 | 2.E−02 | 1.2 |
| All AD | lnc-FGL2-3:1 | SEQ3286 | 1.E−02 | 0.6 | FTD | lnc-UQCC3-2:1 | SEQ4084 | 2.E−09 | 3.3 |
| msAD | lnc-FGL2-3:1 | SEQ3286 | 4.E−02 | 0.6 | MCI | lnc-UQCC3-2:1 | SEQ4084 | 4.E−05 | 2.3 |
| FTD | lnc-FIGNL1-4:1 | SEQ5548 | 2.E−04 | 0.6 | DLB | lnc-UQCC3-2:1 | SEQ4084 | 2.E−04 | 2.0 |
| FTD | lnc-FILIP1-2:2 | SEQ6005 | 4.E−08 | 0.4 | All AD | lnc-UQCC3-2:1 | SEQ4084 | 6.E−03 | 1.5 |
| DLB | lnc-FKBP6-3:1 | SEQ4501 | 2.E−03 | 1.4 | msAD | lnc-UQCC3-2:1 | SEQ4084 | 1.E−02 | 1.5 |
| DLB | lnc-FLII-1:4 | SEQ4273 | 2.E−07 | 1.8 | miAD | lnc-UQCC3-2:1 | SEQ4084 | 1.E−02 | 1.4 |
| FTD | lnc-FLII-1:4 | SEQ4273 | 3.E−07 | 1.5 | FTD | lnc-UQCRHL-1:4 | SEQ4295 | 1.E−04 | 0.5 |
| MCI | lnc-FLII-1:4 | SEQ4273 | 1.E−06 | 1.7 | miAD | lnc-UQCRHL-1:4 | SEQ4295 | 7.E−03 | 0.6 |
| miAD | lnc-FLII-1:4 | SEQ4273 | 2.E−04 | 1.3 | All AD | lnc-UQCRHL-1:4 | SEQ4295 | 9.E−03 | 0.7 |
| All AD | lnc-FLII-1:4 | SEQ4273 | 6.E−04 | 1.2 | DLB | lnc-URGCP-2:11 | SEQ5906 | 2.E−05 | 1.8 |
| msAD | lnc-FLII-1:4 | SEQ4273 | 8.E−03 | 1.2 | MCI | lnc-URGCP-2:8 | SEQ5108 | 6.E−04 | 0.8 |
| FTD | lnc-FLNB-3:1 | SEQ4220 | 3.E−05 | 0.6 | FTD | lnc-URGCP-MRPS24-2:1 | SEQ2667 | 1.E−04 | 0.7 |
| miAD | lnc-FLNB-3:1 | SEQ4220 | 1.E−02 | 0.7 | DLB | lnc-USE1-4:1 | SEQ5041 | 7.E−04 | 1.6 |
| All AD | lnc-FLNB-3:1 | SEQ4220 | 1.E−02 | 0.8 | DLB | lnc-USP10-3:1 | SEQ5320 | 4.E−04 | 1.5 |
| DLB | lnc-FLOT1-1:1 | SEQ4403 | 2.E−05 | 1.5 | msAD | lnc-USP12-9:4 | SEQ4097 | 1.E−02 | 1.3 |
| MCI | lnc-FLOT1-1:1 | SEQ4403 | 1.E−03 | 1.3 | FTD | lnc-USP14-2:3 | SEQ4269 | 6.E−05 | 0.5 |
| DLB | lnc-FLOT1-1:2 | SEQ5889 | 2.E−05 | 1.5 | MCI | lnc-USP14-2:3 | SEQ4269 | 1.E−05 | 0.5 |
| DLB | lnc-FMR1NB-3:1 | SEQ4949 | 8.E−04 | 1.5 | miAD | lnc-USP14-2:3 | SEQ4269 | 8.E−03 | 0.7 |
| DLB | lnc-FNBP1-4:1 | SEQ5121 | 6.E−04 | 1.5 | All AD | lnc-USP14-2:3 | SEQ4269 | 2.E−02 | 0.7 |
| msAD | lnc-FNBP1L-1:12 | SEQ4163 | 2.E−03 | 1.4 | DLB | lnc-USP20-1:1 | SEQ5319 | 4.E−04 | 1.5 |
| All AD | lnc-FNBP1L-1:12 | SEQ4163 | 2.E−03 | 1.4 | FTD | lnc-USP25-1:1 | SEQ4207 | 6.E−05 | 0.6 |
| miAD | lnc-FNBP1L-1:12 | SEQ4163 | 1.E−02 | 1.3 | All AD | lnc-USP25-1:1 | SEQ4207 | 4.E−03 | 0.7 |
| miAD | lnc-FNDC1-9:10 | SEQ3845 | 5.E−03 | 1.4 | msAD | lnc-USP25-1:1 | SEQ4207 | 6.E−03 | 0.7 |
| All AD | lnc-FNDC1-9:10 | SEQ3845 | 6.E−03 | 1.4 | miAD | lnc-USP25-1:1 | SEQ4207 | 1.E−02 | 0.7 |
| msAD | lnc-FNDC1-9:10 | SEQ3845 | 3.E−02 | 1.4 | msAD | lnc-USP3-2:1 | SEQ4010 | 2.E−02 | 0.8 |
| All AD | lnc-FNDC1-9:15 | SEQ4713 | 4.E−02 | 0.8 | All AD | lnc-USP3-2:1 | SEQ4010 | 4.E−02 | 0.8 |
| MCI | lnc-FNDC1-9:22 | SEQ5027 | 2.E−04 | 1.5 | MCI | lnc-USP40-2:1 | SEQ5449 | 4.E−05 | 1.9 |
| DLB | lnc-FNDC1-9:22 | SEQ5027 | 7.E−04 | 1.5 | DLB | lnc-USP40-2:1 | SEQ5449 | 3.E−04 | 1.7 |
| miAD | lnc-FNDC1-9:3 | SEQ3846 | 5.E−03 | 1.4 | DLB | lnc-USP47-2:1 | SEQ3469 | 1.E−05 | 1.6 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| All AD | lnc-FNDC1-9:3 | SEQ3846 | 6.E-03 | 1.4 | msAD | lnc-USP47-2:1 | SEQ3469 | 1.E-02 | 1.2 |
| msAD | lnc-FNDC1-9:3 | SEQ3846 | 3.E-02 | 1.4 | All AD | lnc-USP47-2:1 | SEQ3469 | 3.E-02 | 1.2 |
| FTD | lnc-FNTA-1:4 | SEQ4476 | 8.E-05 | 0.6 | MCI | lnc-USP53-8:1 | SEQ5737 | 9.E-05 | 1.7 |
| MCI | lnc-FNTA-1:4 | SEQ4476 | 2.E-03 | 0.7 | FTD | lnc-USP53-8:20 | SEQ5805 | 6.E-05 | 0.6 |
| All AD | lnc-FNTA-1:4 | SEQ4476 | 5.E-02 | 0.8 | FTD | lnc-USP53-8:32 | SEQ5801 | 6.E-05 | 0.6 |
| MCI | lnc-FOXD4L5-16:1 | SEQ5462 | 1.E-05 | 2.9 | FTD | lnc-USP53-8:5 | SEQ2668 | 4.E-04 | 0.7 |
| FTD | lnc-FOXD4L5-16:1 | SEQ5462 | 2.E-04 | 2.2 | DLB | lnc-USP6-2:20 | SEQ3027 | 2.E-03 | 1.5 |
| DLB | lnc-FOXD4L5-16:1 | SEQ5462 | 3.E-04 | 2.1 | DLB | lnc-USP6-2:22 | SEQ2832 | 2.E-04 | 1.6 |
| All AD | lnc-FOXD4L5-2:2 | SEQ4718 | 3.E-02 | 0.7 | msAD | lnc-USP9Y-17:1 | SEQ3994 | 2.E-02 | 1.3 |
| All AD | lnc-FOXD4L5-26:1 | SEQ4305 | 1.E-03 | 0.5 | FTD | lnc-UTP23-10:3 | SEQ5718 | 1.E-04 | 0.6 |
| miAD | lnc-FOXD4L5-26:1 | SEQ4305 | 1.E-03 | 0.5 | FTD | lnc-UTP23-11:1 | SEQ4260 | 2.E-04 | 0.6 |
| msAD | lnc-FOXD4L5-26:1 | SEQ4305 | 7.E-03 | 0.5 | miAD | lnc-UTP23-11:1 | SEQ4260 | 9.E-03 | 0.7 |
| miAD | lnc-FOXD4L5-28:1 | SEQ4208 | 1.E-02 | 0.7 | All AD | lnc-UTP23-11:1 | SEQ4260 | 1.E-02 | 0.7 |
| All AD | lnc-FOXD4L5-28:1 | SEQ4208 | 3.E-02 | 0.8 | FTD | lnc-UTP23-11:2 | SEQ3766 | 5.E-05 | 0.6 |
| DLB | lnc-FOXL2NB-4:1 | SEQ4512 | 2.E-03 | 1.5 | All AD | lnc-UTP23-11:2 | SEQ3766 | 2.E-02 | 0.7 |
| MCI | lnc-FPGS-1:3 | SEQ5049 | 6.E-04 | 1.8 | msAD | lnc-UTP23-11:2 | SEQ3766 | 4.E-02 | 0.8 |
| DLB | lnc-FPGS-1:3 | SEQ5049 | 7.E-04 | 1.9 | All AD | lnc-UXS1-3:1 | SEQ4239 | 3.E-03 | 1.2 |
| MCI | lnc-FPGS-2:10 | SEQ4725 | 1.E-03 | 1.9 | msAD | lnc-UXS1-3:1 | SEQ4239 | 6.E-03 | 1.2 |
| All AD | lnc-FRAT1-2:1 | SEQ4723 | 2.E-02 | 0.8 | miAD | lnc-UXS1-3:1 | SEQ4239 | 1.E-02 | 1.2 |
| MCI | lnc-FRMD5-1:1 | SEQ5916 | 6.E-07 | 1.6 | FTD | lnc-UXS1-4:9 | SEQ4323 | 4.E-07 | 2.4 |
| DLB | lnc-FRMD5-1:1 | SEQ5916 | 2.E-05 | 1.5 | MCI | lnc-UXS1-4:9 | SEQ4323 | 7.E-06 | 2.3 |
| DLB | lnc-FSCN1-2:1 | SEQ4958 | 5.E-04 | 1.6 | DLB | lnc-UXS1-4:9 | SEQ4323 | 1.E-04 | 2.1 |
| MCI | lnc-FSCN1-2:1 | SEQ4958 | 8.E-04 | 1.6 | All AD | lnc-UXS1-4:9 | SEQ4323 | 2.E-03 | 1.4 |
| DLB | lnc-FSCN2-1:6 | SEQ5192 | 3.E-06 | 1.9 | miAD | lnc-UXS1-4:9 | SEQ4323 | 3.E-03 | 1.4 |
| FTD | lnc-FSCN2-1:6 | SEQ5192 | 3.E-04 | 1.4 | msAD | lnc-UXS1-4:9 | SEQ4323 | 6.E-03 | 1.4 |
| MCI | lnc-FSCN2-1:6 | SEQ5192 | 5.E-04 | 1.5 | DLB | lnc-VAV2-1:1 | SEQ5517 | 2.E-04 | 1.4 |
| DLB | lnc-FSCN2-3:1 | SEQ4608 | 1.E-03 | 1.3 | All AD | lnc-VGLL4-8:1 | SEQ3978 | 1.E-02 | 0.8 |
| FTD | lnc-FUBP1-2:5 | SEQ4729 | 4.E-05 | 0.5 | msAD | lnc-VGLL4-8:1 | SEQ3978 | 2.E-02 | 0.8 |
| All AD | lnc-FUBP1-2:5 | SEQ4729 | 4.E-02 | 0.7 | DLB | lnc-VHLL-1:1 | SEQ4962 | 8.E-04 | 1.6 |
| All AD | lnc-FZD4-1:6 | SEQ2454 | 3.E-02 | 0.7 | DLB | lnc-VIPR1-1:1 | SEQ4485 | 2.E-03 | 1.4 |
| FTD | lnc-FZD5-1:4 | SEQ5296 | 4.E-04 | 0.7 | miAD | lnc-VMP1-8:1 | SEQ3916 | 6.E-03 | 0.7 |
| DLB | lnc-GADD45B-1:2 | SEQ5496 | 2.E-04 | 1.8 | All AD | lnc-VMP1-8:1 | SEQ3916 | 6.E-03 | 0.7 |
| DLB | lnc-GADD45GIP1-1:1 | SEQ4094 | 5.E-05 | 2.0 | msAD | lnc-VMP1-8:1 | SEQ3916 | 3.E-02 | 0.8 |
| MCI | lnc-GADD45GIP1-1:1 | SEQ4094 | 6.E-05 | 2.0 | DLB | lnc-VN1R2-1:1 | SEQ5042 | 7.E-04 | 1.7 |
| FTD | lnc-GADD45GIP1-1:1 | SEQ4094 | 1.E-04 | 1.6 | All AD | lnc-VPREB1-7:15 | SEQ4198 | 3.E-03 | 1.4 |
| msAD | lnc-GADD45GIP1-1:1 | SEQ4094 | 1.E-02 | 1.2 | msAD | lnc-VPREB1-7:15 | SEQ4198 | 4.E-02 | 1.5 |
| All AD | lnc-GADD45GIP1-1:1 | SEQ4094 | 2.E-02 | 1.2 | miAD | lnc-VPREB1-7:15 | SEQ4198 | 1.E-02 | 1.4 |
| All AD | lnc-GALNT15-6:1 | SEQ3879 | 3.E-02 | 1.3 | FTD | lnc-VPS13B-1:2 | SEQ5887 | 1.E-05 | 0.6 |
| msAD | lnc-GALNT15-6:1 | SEQ3879 | 3.E-02 | 1.3 | All AD | lnc-VPS13B-1:2 | SEQ5887 | 3.E-02 | 0.8 |
| DLB | lnc-GALNTL5-2:10 | SEQ4980 | 8.E-04 | 1.9 | All AD | lnc-VRK1-10:3 | SEQ4112 | 9.E-03 | 0.6 |
| DLB | lnc-GAMT-1:2 | SEQ5378 | 3.E-04 | 1.6 | msAD | lnc-VRK1-10:3 | SEQ4112 | 1.E-02 | 0.7 |
| DLB | lnc-GAMT-4:1 | SEQ4704 | 1.E-03 | 1.5 | DLB | lnc-VRK3-2:4 | SEQ4847 | 9.E-04 | 1.5 |
| DLB | lnc-GAN-1:1 | SEQ4410 | 2.E-03 | 1.4 | FTD | lnc-VSIG10-1:1 | SEQ3871 | 2.E-05 | 0.7 |
| FTD | lnc-GAPDH-2:1 | SEQ5305 | 5.E-07 | 9.E-09 | All AD | lnc-VSIG10-1:1 | SEQ3871 | 3.E-02 | 0.8 |
| MCI | lnc-GAPDH-2:1 | SEQ5305 | 2.E-05 | 5.E-09 | msAD | lnc-VSIG10-1:1 | SEQ3871 | 3.E-02 | 0.8 |
| DLB | lnc-GAPDH-2:1 | SEQ5305 | 4.E-04 | 6.E-09 | miAD | lnc-VSNL1-5:1 | SEQ3597 | 2.E-03 | 1.4 |
| DLB | lnc-GAPDH-3:1 | SEQ5118 | 6.E-05 | 1.6 | All AD | lnc-VSNL1-5:1 | SEQ3597 | 5.E-03 | 1.3 |
| MCI | lnc-GAPDH-3:1 | SEQ5118 | 6.E-05 | 1.5 | msAD | lnc-VSNL1-5:1 | SEQ3597 | 4.E-02 | 1.2 |
| DLB | lnc-GAPDH-3:2 | SEQ4569 | 2.E-03 | 1.4 | DLB | lnc-VSTM2B-9:15 | SEQ5569 | 2.E-04 | 1.6 |
| DLB | lnc-GAPDH-6:1 | SEQ4487 | 2.E-03 | 1.4 | FTD | lnc-VSTM5-1:10 | SEQ4904 | 9.E-04 | 0.7 |
| FTD | lnc-GAPVD1-3:2 | SEQ5786 | 3.E-06 | 0.4 | FTD | lnc-VSTM5-1:13 | SEQ2419 | 8.E-04 | 2.2 |
| MCI | lnc-GAPVD1-3:2 | SEQ5786 | 6.E-04 | 0.5 | DLB | lnc-VSX1-4:1 | SEQ5675 | 1.E-04 | 1.9 |
| DLB | lnc-GAST-2:1 | SEQ4494 | 2.E-03 | 1.4 | FTD | lnc-VTI1B-1:1 | SEQ5590 | 2.E-04 | 0.6 |
| MCI | lnc-GATA5-9:1 | SEQ4488 | 9.E-04 | 1.5 | FTD | lnc-WBP4-2:9 | SEQ2356 | 4.E-04 | 0.7 |
| DLB | lnc-GATA5-9:1 | SEQ4488 | 2.E-03 | 1.4 | All AD | lnc-WBP4-2:9 | SEQ2356 | 3.E-02 | 0.8 |
| DLB | lnc-GATS-3:2 | SEQ5487 | 2.E-04 | 1.6 | FTD | lnc-WDR3-1:1 | SEQ5068 | 7.E-04 | 0.7 |
| FTD | lnc-GBP2-1:2 | SEQ2449 | 3.E-06 | 0.6 | DLB | lnc-WDR4-2:5 | SEQ2874 | 2.E-04 | 1.5 |
| MCI | lnc-GBP2-1:2 | SEQ2449 | 2.E-05 | 0.6 | DLB | lnc-WDR45B-1:2 | SEQ3588 | 3.E-05 | 1.8 |
| All AD | lnc-GBP2-1:2 | SEQ2449 | 3.E-02 | 0.8 | DLB | lnc-WDR77-1:2 | SEQ2553 | 5.E-04 | 1.6 |
| msAD | lnc-GBP2-1:2 | SEQ2449 | 3.E-02 | 0.8 | All AD | lnc-WIPF1-1:1 | SEQ5892 | 4.E-02 | 0.8 |
| FTD | lnc-GBP6-1:1 | SEQ5365 | 3.E-06 | 0.4 | All AD | lnc-WNT2-4:1 | SEQ5893 | 5.E-02 | 0.8 |
| MCI | lnc-GBP6-1:1 | SEQ5365 | 3.E-04 | 0.4 | DLB | lnc-WNT4-2:1 | SEQ4565 | 2.E-03 | 1.4 |
| MCI | lnc-GCDH-3:4 | SEQ5537 | 2.E-04 | 1.8 | FTD | lnc-WRNIP1-13:1 | SEQ5955 | 7.E-06 | 0.5 |
| FTD | lnc-GCGR-1:2 | SEQ2373 | 4.E-05 | 1.5 | FTD | lnc-WWP2-2:1 | SEQ4237 | 1.E-08 | 0.5 |
| DLB | lnc-GCGR-1:2 | SEQ2373 | 9.E-05 | 1.7 | MCI | lnc-WWP2-2:1 | SEQ4237 | 8.E-05 | 0.6 |
| miAD | lnc-GCGR-1:2 | SEQ2373 | 5.E-04 | 1.4 | All AD | lnc-WWP2-2:1 | SEQ4237 | 3.E-03 | 0.7 |
| All AD | lnc-GCGR-1:2 | SEQ2373 | 9.E-04 | 1.3 | miAD | lnc-WWP2-2:1 | SEQ4237 | 4.E-03 | 0.6 |
| MCI | lnc-GCGR-1:2 | SEQ2373 | 9.E-04 | 1.4 | msAD | lnc-WWP2-2:1 | SEQ4237 | 1.E-02 | 0.7 |
| msAD | lnc-GCGR-1:2 | SEQ2373 | 3.E-03 | 1.3 | DLB | lnc-XRCC1-2:1 | SEQ5478 | 2.E-04 | 1.4 |
| All AD | lnc-GCH1-2:4 | SEQ4749 | 4.E-02 | 1.2 | FTD | lnc-XRCC2-13:2 | SEQ5151 | 5.E-04 | 0.6 |
| DLB | lnc-GCN1-3:1 | SEQ3301 | 3.E-04 | 1.5 | DLB | lnc-XRCC3-1:1 | SEQ4763 | 1.E-03 | 1.5 |
| MCI | lnc-GCNT1-7:1 | SEQ4751 | 7.E-06 | 3.0 | DLB | lnc-XRCC3-1:2 | SEQ5437 | 3.E-04 | 1.5 |
| DLB | lnc-GCNT1-7:1 | SEQ4751 | 3.E-04 | 2.5 | FTD | lnc-XXYLT1-5:1 | SEQ0221 | 1.E-06 | 0.5 |
| FTD | lnc-GCNT1-7:1 | SEQ4751 | 6.E-04 | 2.1 | miAD | lnc-XXYLT1-5:1 | SEQ0221 | 5.E-04 | 0.6 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| All AD | lnc-GCNT1-7:1 | SEQ4751 | 3.E-02 | 1.4 | All AD | lnc-XXYLT1-5:1 | SEQ0221 | 2.E-03 | 0.7 |
| MCI | lnc-GDE1-1:5 | SEQ4590 | 2.E-03 | 1.6 | msAD | lnc-XXYLT1-5:1 | SEQ0221 | 4.E-02 | 0.7 |
| DLB | lnc-GDI1-1:1 | SEQ4743 | 1.E-03 | 1.4 | DLB | lnc-YIF1A-1:1 | SEQ5935 | 1.E-05 | 1.7 |
| MCI | lnc-GEMIN4-6:1 | SEQ4080 | 6.E-04 | 1.4 | DLB | lnc-YIF1B-1:1 | SEQ5461 | 3.E-04 | 2.1 |
| miAD | lnc-GEMIN4-6:1 | SEQ4080 | 1.E-02 | 1.2 | DLB | lnc-YPEL5-5:1 | SEQ0750 | 1.E-04 | 1.7 |
| All AD | lnc-GEMIN4-6:1 | SEQ4080 | 1.E-02 | 1.2 | MCI | lnc-YPEL5-5:1 | SEQ0750 | 6.E-04 | 1.5 |
| DLB | lnc-GGCT-1:31 | SEQ5630 | 2.E-04 | 1.7 | All AD | lnc-YPEL5-5:1 | SEQ0750 | 4.E-02 | 1.2 |
| DLB | lnc-GGCT-1:4 | SEQ5331 | 4.E-04 | 1.7 | FTD | lnc-YTHDF3-4:1 | SEQ6008 | 8.E-09 | 0.4 |
| FTD | lnc-GGCT-1:64 | SEQ4991 | 8.E-04 | 0.6 | FTD | lnc-YWHAZ-2:1 | SEQ5410 | 3.E-04 | 0.6 |
| FTD | lnc-GGCT-1:81 | SEQ5804 | 6.E-05 | 0.6 | All AD | lnc-YWHAZ-2:1 | SEQ5410 | 4.E-02 | 0.8 |
| FTD | lnc-GGCT-1:82 | SEQ5803 | 6.E-05 | 0.6 | DLB | lnc-YY1-1:2 | SEQ4981 | 8.E-04 | 2.0 |
| DLB | lnc-GHRL-4:2 | SEQ4753 | 2.E-04 | 1.6 | msAD | lnc-YY1AP1-2:1 | SEQ3501 | 8.E-03 | 0.7 |
| MCI | lnc-GHRL-4:2 | SEQ4753 | 1.E-03 | 1.4 | All AD | lnc-YY1AP1-2:1 | SEQ3501 | 2.E-02 | 0.8 |
| miAD | lnc-GHSR-1:1 | SEQ4221 | 1.E-02 | 0.7 | DLB | lnc-YY1AP1-3:1 | SEQ5617 | 2.E-04 | 1.5 |
| All AD | lnc-GHSR-1:1 | SEQ4221 | 2.E-02 | 0.8 | FTD | lnc-ZADH2-3:1 | SEQ5232 | 5.E-04 | 0.7 |
| MCI | lnc-GIMAP5-1:1 | SEQ3302 | 1.E-04 | 1.5 | msAD | lnc-ZBED4-2:1 | SEQ3863 | 3.E-02 | 1.4 |
| DLB | lnc-GIMAP5-1:1 | SEQ3302 | 6.E-04 | 1.4 | msAD | lnc-ZBTB2-7:1 | SEQ3675 | 5.E-02 | 1.4 |
| FTD | lnc-GIMAP7-1:1 | SEQ3984 | 2.E-10 | 0.3 | DLB | lnc-ZBTB46-2:2 | SEQ5242 | 5.E-04 | 1.4 |
| MCI | lnc-GIMAP7-1:1 | SEQ3984 | 6.E-05 | 0.3 | DLB | lnc-ZBTB46-2:3 | SEQ5111 | 6.E-04 | 1.4 |
| All AD | lnc-GIMAP7-1:1 | SEQ3984 | 9.E-03 | 0.6 | FTD | lnc-ZBTB7C-10:1 | SEQ5298 | 4.E-04 | 0.7 |
| miAD | lnc-GIMAP7-1:1 | SEQ3984 | 1.E-02 | 0.6 | MCI | lnc-ZC2HC1C-3:1 | SEQ3856 | 5.E-04 | 1.3 |
| msAD | lnc-GIMAP7-1:1 | SEQ3984 | 2.E-02 | 0.6 | DLB | lnc-ZC2HC1C-3:1 | SEQ3856 | 8.E-04 | 1.3 |
| All AD | lnc-GK5-7:1 | SEQ4767 | 4.E-02 | 0.8 | All AD | lnc-ZC2HC1C-3:1 | SEQ3856 | 2.E-02 | 1.1 |
| DLB | lnc-GLB1-2:1 | SEQ4570 | 1.E-03 | 1.6 | msAD | lnc-ZC2HC1C-3:1 | SEQ3856 | 3.E-02 | 1.1 |
| MCI | lnc-GLB1-2:1 | SEQ4570 | 2.E-03 | 1.5 | DLB | lnc-ZC3H11A-1:3 | SEQ5140 | 6.E-04 | 1.8 |
| DLB | lnc-GLDC-6:1 | SEQ3965 | 2.E-03 | 1.5 | MCI | lnc-ZC3H8-7:2 | SEQ3951 | 4.E-05 | 1.7 |
| msAD | lnc-GLDC-6:1 | SEQ3965 | 2.E-02 | 1.2 | DLB | lnc-ZC3H8-7:2 | SEQ3951 | 8.E-05 | 1.8 |
| All AD | lnc-GLDC-6:1 | SEQ3965 | 3.E-02 | 1.2 | FTD | lnc-ZC3H8-7:2 | SEQ3951 | 2.E-04 | 1.6 |
| DLB | lnc-GLG1-1:1 | SEQ5442 | 3.E-04 | 1.6 | All AD | lnc-ZC3H8-7:2 | SEQ3951 | 8.E-03 | 1.3 |
| DLB | lnc-GLOD4-2:2 | SEQ4773 | 5.E-04 | 1.7 | miAD | lnc-ZC3H8-7:2 | SEQ3951 | 1.E-02 | 1.3 |
| All AD | lnc-GLOD4-2:2 | SEQ4773 | 4.E-02 | 1.2 | msAD | lnc-ZC3H8-7:2 | SEQ3951 | 3.E-02 | 1.3 |
| DLB | lnc-GLOD4-3:1 | SEQ2673 | 8.E-05 | 1.6 | DLB | lnc-ZC3HC1-4:1 | SEQ2731 | 1.E-03 | 1.4 |
| FTD | lnc-GLRX5-7:1 | SEQ5602 | 2.E-04 | 0.6 | FTD | lnc-ZCCHC13-4:1 | SEQ4168 | 3.E-11 | 5.E-03 |
| FTD | lnc-GMNN-5:1 | SEQ5598 | 2.E-04 | 0.6 | MCI | lnc-ZCCHC13-4:1 | SEQ4168 | 9.E-06 | 6.E-03 |
| FTD | lnc-GMNN-5:2 | SEQ5087 | 6.E-04 | 0.6 | DLB | lnc-ZCCHC13-4:1 | SEQ4168 | 7.E-04 | 9.E-03 |
| FTD | lnc-GMPR2-1:1 | SEQ5666 | 3.E-07 | 1.7 | All AD | lnc-ZCCHC13-4:1 | SEQ4168 | 3.E-03 | 1.E-02 |
| MCI | lnc-GMPR2-1:1 | SEQ5666 | 2.E-06 | 1.8 | miAD | lnc-ZCCHC13-4:1 | SEQ4168 | 4.E-03 | 1.E-02 |
| DLB | lnc-GMPR2-1:1 | SEQ5666 | 1.E-04 | 1.6 | msAD | lnc-ZCCHC13-4:1 | SEQ4168 | 1.E-02 | 1.E-02 |
| DLB | lnc-GNA11-3:1 | SEQ2681 | 2.E-04 | 1.6 | DLB | lnc-ZCCHC24-8:1 | SEQ5905 | 2.E-05 | 1.7 |
| miAD | lnc-GNA11-3:1 | SEQ2681 | 3.E-03 | 1.3 | DLB | lnc-ZCCHC7-2:12 | SEQ3490 | 1.E-03 | 2.0 |
| All AD | lnc-GNA11-3:1 | SEQ2681 | 5.E-03 | 1.2 | DLB | lnc-ZCCHC7-2:22 | SEQ3657 | 4.E-05 | 4.6 |
| msAD | lnc-GNA11-3:1 | SEQ2681 | 3.E-02 | 1.2 | MCI | lnc-ZCCHC7-2:22 | SEQ3657 | 1.E-04 | 4.0 |
| DLB | lnc-GNA11-3:2 | SEQ3399 | 2.E-03 | 1.4 | FTD | lnc-ZCCHC7-2:22 | SEQ3657 | 7.E-04 | 2.8 |
| FTD | lnc-GNA14-3:1 | SEQ2572 | 1.E-06 | 0.6 | All AD | lnc-ZCCHC7-2:22 | SEQ3657 | 2.E-02 | 1.5 |
| All AD | lnc-GNA14-3:1 | SEQ2572 | 5.E-02 | 0.7 | msAD | lnc-ZCCHC7-2:22 | SEQ3657 | 5.E-02 | 1.4 |
| DLB | lnc-GNAT2-1:1 | SEQ4948 | 8.E-04 | 1.5 | MCI | lnc-ZCCHC7-2:24 | SEQ2279 | 3.E-04 | 0.5 |
| FTD | lnc-GNB4-1:1 | SEQ4783 | 3.E-05 | 0.5 | FTD | lnc-ZCCHC7-2:24 | SEQ2279 | 4.E-04 | 0.5 |
| MCI | lnc-GNB4-1:1 | SEQ4783 | 3.E-04 | 0.5 | DLB | lnc-ZFP57-11:1 | SEQ4678 | 8.E-04 | 1.4 |
| All AD | lnc-GNB4-1:1 | SEQ4783 | 2.E-02 | 0.7 | MCI | lnc-ZFP57-11:1 | SEQ4678 | 1.E-03 | 1.3 |
| DLB | lnc-GOLGA8J-4:1 | SEQ3857 | 3.E-05 | 1.4 | DLB | lnc-ZFYVE21-2:1 | SEQ5215 | 3.E-04 | 1.9 |
| All AD | lnc-GOLGA8J-4:1 | SEQ3857 | 2.E-02 | 1.1 | MCI | lnc-ZFYVE21-2:1 | SEQ5215 | 5.E-04 | 2.0 |
| msAD | lnc-GOLGA8J-4:1 | SEQ3857 | 3.E-02 | 1.1 | All AD | lnc-ZGLP1-4:1 | SEQ3935 | 9.E-03 | 0.7 |
| FTD | lnc-GOLGA80-1:1 | SEQ4908 | 9.E-04 | 0.7 | miAD | lnc-ZGLP1-4:1 | SEQ3935 | 1.E-02 | 0.7 |
| DLB | lnc-GPAT4-2:2 | SEQ2763 | 1.E-04 | 1.5 | msAD | lnc-ZGLP1-4:1 | SEQ3935 | 3.E-02 | 0.8 |
| FTD | lnc-GPBP1L1-1:8 | SEQ2745 | 1.E-08 | 0.4 | FTD | lnc-ZMAT3-4:1 | SEQ5154 | 5.E-04 | 0.6 |
| MCI | lnc-GPBP1L1-1:8 | SEQ2745 | 2.E-05 | 0.5 | DLB | lnc-ZMYM4-3:2 | SEQ4023 | 2.E-04 | 1.8 |
| All AD | lnc-GPBP1L1-1:8 | SEQ2745 | 3.E-02 | 0.7 | MCI | lnc-ZMYM4-3:2 | SEQ4023 | 1.E-03 | 1.5 |
| All AD | lnc-GPD2-1:3 | SEQ4038 | 1.E-02 | 1.4 | All AD | lnc-ZMYM4-3:2 | SEQ4023 | 1.E-02 | 1.3 |
| msAD | lnc-GPD2-1:3 | SEQ4038 | 2.E-02 | 1.5 | msAD | lnc-ZMYM4-3:2 | SEQ4023 | 2.E-02 | 1.3 |
| MCI | lnc-GPR137C-1:1 | SEQ4790 | 3.E-06 | 0.5 | DLB | lnc-ZMYND19-1:6 | SEQ4936 | 8.E-04 | 1.4 |
| FTD | lnc-GPR137C-1:1 | SEQ4790 | 1.E-05 | 0.5 | DLB | lnc-ZNF100-7:1 | SEQ5333 | 4.E-04 | 1.7 |
| All AD | lnc-GPR137C-1:1 | SEQ4790 | 4.E-02 | 0.8 | MCI | lnc-ZNF131-1:16 | SEQ4589 | 2.E-03 | 1.6 |
| miAD | lnc-GPR141-2:1 | SEQ4049 | 2.E-03 | 0.6 | DLB | lnc-ZNF131-1:24 | SEQ3221 | 4.E-04 | 1.7 |
| All AD | lnc-GPR141-2:1 | SEQ4049 | 3.E-03 | 0.7 | DLB | lnc-ZNF131-2:5 | SEQ5730 | 9.E-05 | 1.5 |
| msAD | lnc-GPR141-2:1 | SEQ4049 | 2.E-02 | 0.7 | DLB | lnc-ZNF132-1:2 | SEQ4976 | 8.E-04 | 1.7 |
| FTD | lnc-GPR141-3:1 | SEQ4382 | 8.E-08 | 0.4 | DLB | lnc-ZNF174-1:13 | SEQ5117 | 6.E-04 | 1.4 |
| MCI | lnc-GPR141-3:1 | SEQ4382 | 4.E-04 | 0.5 | DLB | lnc-ZNF212-2:2 | SEQ5271 | 5.E-04 | 1.7 |
| All AD | lnc-GPR141-3:1 | SEQ4382 | 1.E-03 | 0.5 | DLB | lnc-ZNF217-5:1 | SEQ5907 | 2.E-05 | 1.8 |
| miAD | lnc-GPR141-3:1 | SEQ4382 | 3.E-03 | 0.5 | MCI | lnc-ZNF2-2:1 | SEQ5052 | 7.E-04 | 2.2 |
| msAD | lnc-GPR141-3:1 | SEQ4382 | 3.E-03 | 0.6 | MCI | lnc-ZNF236-6:3 | SEQ5045 | 7.E-04 | 1.8 |
| FTD | lnc-GPR160-1:1 | SEQ5901 | 2.E-05 | 0.6 | DLB | lnc-ZNF236-9:4 | SEQ5268 | 5.E-04 | 1.6 |
| FTD | lnc-GPR161-4:1 | SEQ0070 | 7.E-05 | 0.5 | DLB | lnc-ZNF266-2:1 | SEQ4502 | 3.E-04 | 1.6 |
| All AD | lnc-GPR161-4:1 | SEQ0070 | 5.E-02 | 0.7 | MCI | lnc-ZNF266-2:1 | SEQ4502 | 2.E-03 | 1.4 |
| All AD | lnc-GPR183-5:6 | SEQ4068 | 1.E-02 | 0.6 | All AD | lnc-ZNF273-4:3 | SEQ5909 | 4.E-02 | 0.8 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| msAD | lnc-GPR183-5:6 | SEQ4068 | 1.E-02 | 0.6 | FTD | lnc-ZNF284-1:1 | SEQ4778 | 9.E-04 | 1.6 |
| All AD | lnc-GPR183-5:8 | SEQ4796 | 5.E-02 | 0.7 | DLB | lnc-ZNF284-1:1 | SEQ4778 | 1.E-03 | 1.6 |
| FTD | lnc-GPR27-5:1 | SEQ3959 | 2.E-04 | 0.6 | DLB | lnc-ZNF316-2:1 | SEQ4627 | 1.E-03 | 1.4 |
| miAD | lnc-GPR27-5:1 | SEQ3959 | 2.E-03 | 0.5 | FTD | lnc-ZNF330-4:1 | SEQ5770 | 7.E-05 | 0.4 |
| All AD | lnc-GPR27-5:1 | SEQ3959 | 4.E-03 | 0.6 | DLB | lnc-ZNF335-1:1 | SEQ4628 | 3.E-04 | 1.5 |
| msAD | lnc-GPR27-5:1 | SEQ3959 | 2.E-02 | 0.7 | MCI | lnc-ZNF335-1:1 | SEQ4628 | 1.E-03 | 1.4 |
| FTD | lnc-GPR33-14:1 | SEQ0236 | 8.E-07 | 0.5 | DLB | lnc-ZNF33B-4:4 | SEQ4578 | 2.E-03 | 1.5 |
| MCI | lnc-GPR33-14:1 | SEQ0236 | 2.E-05 | 0.5 | FTD | lnc-ZNF362-1:11 | SEQ4346 | 3.E-06 | 0.5 |
| DLB | lnc-GPR37L1-7:4 | SEQ3402 | 2.E-04 | 1.5 | DLB | lnc-ZNF362-1:11 | SEQ4346 | 3.E-04 | 0.7 |
| FTD | lnc-GPR39-9:1 | SEQ2704 | 5.E-06 | 0.5 | miAD | lnc-ZNF362-1:11 | SEQ4346 | 5.E-03 | 0.6 |
| FTD | lnc-GPR83-1:1 | SEQ5543 | 2.E-04 | 0.6 | All AD | lnc-ZNF362-1:11 | SEQ4346 | 1.E-02 | 0.6 |
| DLB | lnc-GPRC5D-3:1 | SEQ4527 | 5.E-04 | 1.9 | FTD | lnc-ZNF362-1:6 | SEQ3910 | 2.E-05 | 0.6 |
| MCI | lnc-GPRC5D-3:1 | SEQ4527 | 2.E-03 | 1.6 | DLB | lnc-ZNF362-1:6 | SEQ3910 | 8.E-04 | 0.8 |
| MCI | lnc-GPRIN2-2:1 | SEQ2453 | 2.E-03 | 0.7 | All AD | lnc-ZNF362-1:6 | SEQ3910 | 8.E-03 | 0.7 |
| DLB | lnc-GPSM1-2:1 | SEQ4554 | 2.E-05 | 1.5 | miAD | lnc-ZNF362-1:6 | SEQ3910 | 8.E-03 | 0.7 |
| MCI | lnc-GPSM1-2:1 | SEQ4554 | 2.E-04 | 1.3 | msAD | lnc-ZNF362-1:6 | SEQ3910 | 3.E-02 | 0.7 |
| DLB | lnc-GPT2-1:5 | SEQ3923 | 2.E-04 | 1.5 | FTD | lnc-ZNF362-1:7 | SEQ4917 | 9.E-04 | 2.5 |
| MCI | lnc-GPT2-1:5 | SEQ3923 | 2.E-04 | 1.5 | DLB | lnc-ZNF362-3:1 | SEQ5119 | 6.E-04 | 1.5 |
| msAD | lnc-GPT2-1:5 | SEQ3923 | 3.E-02 | 1.2 | DLB | lnc-ZNF385C-4:1 | SEQ5816 | 5.E-05 | 1.6 |
| All AD | lnc-GPT2-1:5 | SEQ3923 | 3.E-02 | 1.2 | DLB | lnc-ZNF397-4:1 | SEQ4775 | 1.E-03 | 1.6 |
| DLB | lnc-GPX3-1:1 | SEQ5729 | 9.E-05 | 1.5 | DLB | lnc-ZNF408-5:2 | SEQ5846 | 4.E-05 | 1.5 |
| MCI | lnc-GPX3-1:2 | SEQ5729 | 9.E-05 | 1.6 | All AD | lnc-ZNF408-5:2 | SEQ5846 | 4.E-02 | 1.2 |
| FTD | lnc-GRAP-1:2 | SEQ5870 | 4.E-05 | 2.8 | DLB | lnc-ZNF420-1:1 | SEQ5699 | 1.E-04 | 1.6 |
| DLB | lnc-GRAP2-2:1 | SEQ2429 | 5.E-04 | 1.6 | DLB | lnc-ZNF438-4:2 | SEQ5275 | 2.E-04 | 1.7 |
| DLB | lnc-GRAP-4:1 | SEQ4649 | 1.E-03 | 1.8 | MCI | lnc-ZNF438-4:2 | SEQ5275 | 5.E-04 | 1.7 |
| FTD | lnc-GRAP-7:2 | SEQ3752 | 2.E-06 | 2.1 | DLB | lnc-ZNF439-1:1 | SEQ4525 | 2.E-03 | 1.6 |
| DLB | lnc-GRAP-7:2 | SEQ3752 | 1.E-03 | 1.7 | DLB | lnc-ZNF460-1:1 | SEQ5610 | 2.E-03 | 1.3 |
| All AD | lnc-GRAP-7:2 | SEQ3752 | 4.E-02 | 1.2 | FTD | lnc-ZNF484-1:1 | SEQ5355 | 4.E-04 | 0.6 |
| msAD | lnc-GRAP-7:2 | SEQ3752 | 4.E-02 | 1.2 | FTD | lnc-ZNF516-14:1 | SEQ4259 | 9.E-10 | 0.3 |
| DLB | lnc-GRAPL-1:1 | SEQ3729 | 2.E-03 | 1.8 | MCI | lnc-ZNF516-14:1 | SEQ4259 | 9.E-06 | 0.4 |
| msAD | lnc-GRAPL-1:1 | SEQ3729 | 4.E-02 | 1.3 | miAD | lnc-ZNF516-14:1 | SEQ4259 | 1.E-04 | 0.5 |
| miAD | lnc-GREM1-2:3 | SEQ4143 | 1.E-02 | 0.4 | DLB | lnc-ZNF516-14:1 | SEQ4259 | 5.E-04 | 0.5 |
| DLB | lnc-GRHPR-1:1 | SEQ4500 | 2.E-03 | 1.4 | All AD | lnc-ZNF516-14:1 | SEQ4259 | 5.E-04 | 0.6 |
| MCI | lnc-GRIK2-7:1 | SEQ5652 | 1.E-04 | 0.5 | msAD | lnc-ZNF516-14:1 | SEQ4259 | 9.E-03 | 0.6 |
| DLB | lnc-GRIN3B-3:1 | SEQ5784 | 3.E-06 | 2.0 | FTD | lnc-ZNF518A-1:14 | SEQ5919 | 1.E-05 | 0.6 |
| MCI | lnc-GRIN3B-3:1 | SEQ5784 | 7.E-06 | 1.8 | All AD | lnc-ZNF518A-1:14 | SEQ5919 | 5.E-02 | 0.8 |
| FTD | lnc-GRIN3B-3:1 | SEQ5784 | 7.E-05 | 1.5 | All AD | lnc-ZNF518A-1:5 | SEQ5920 | 4.E-02 | 0.8 |
| DLB | lnc-GRINA-1:1 | SEQ3118 | 2.E-04 | 1.6 | MCI | lnc-ZNF518B-2:4 | SEQ5239 | 5.E-04 | 0.5 |
| MCI | lnc-GRINA-1:1 | SEQ3118 | 5.E-04 | 1.7 | All AD | lnc-ZNF518B-2:4 | SEQ5239 | 4.E-02 | 0.7 |
| MCI | lnc-GRINA-2:1 | SEQ2969 | 4.E-06 | 1.7 | DLB | lnc-ZNF627-3:6 | SEQ5025 | 7.E-04 | 1.5 |
| DLB | lnc-GRINA-2:1 | SEQ2969 | 1.E-04 | 1.6 | DLB | lnc-ZNF629-1:1 | SEQ4680 | 3.E-05 | 1.4 |
| FTD | lnc-GRINA-2:1 | SEQ2969 | 9.E-04 | 1.4 | MCI | lnc-ZNF629-1:1 | SEQ4680 | 1.E-03 | 1.3 |
| All AD | lnc-GRINA-2:1 | SEQ2969 | 4.E-02 | 1.2 | FTD | lnc-ZNF639-4:1 | SEQ2617 | 8.E-06 | 0.5 |
| DLB | lnc-GRINA-3:1 | SEQ3047 | 6.E-05 | 1.5 | All AD | lnc-ZNF639-4:1 | SEQ2617 | 2.E-02 | 0.7 |
| MCI | lnc-GRINA-3:1 | SEQ3047 | 5.E-04 | 1.4 | DLB | lnc-ZNF646-5:2 | SEQ4789 | 1.E-03 | 1.9 |
| DLB | lnc-GRK3-7:4 | SEQ5037 | 7.E-04 | 1.6 | miAD | lnc-ZNF654-3:1 | SEQ0857 | 6.E-03 | 0.7 |
| DLB | lnc-GRK4-2:7 | SEQ3405 | 9.E-05 | 1.4 | All AD | lnc-ZNF654-3:1 | SEQ0857 | 3.E-02 | 0.8 |
| MCI | lnc-GRK4-2:7 | SEQ3405 | 2.E-03 | 1.3 | msAD | lnc-ZNF683-3:1 | SEQ4253 | 9.E-03 | 1.2 |
| FTD | lnc-GRM1-1:2 | SEQ4887 | 9.E-04 | 0.4 | FTD | lnc-ZNF697-2:1 | SEQ5593 | 2.E-04 | 0.6 |
| DLB | lnc-GRM1-2:1 | SEQ4716 | 1.E-03 | 1.6 | All AD | lnc-ZNF697-2:1 | SEQ5593 | 4.E-02 | 0.8 |
| FTD | lnc-GRM8-2:1 | SEQ4812 | 1.E-03 | 0.7 | FTD | lnc-ZNF704-8:1 | SEQ5717 | 1.E-04 | 0.6 |
| FTD | lnc-GRM8-2:2 | SEQ0430 | 1.E-04 | 0.6 | DLB | lnc-ZNF706-1:1 | SEQ4714 | 1.E-03 | 1.6 |
| FTD | lnc-GRSF1-1:1 | SEQ4817 | 4.E-04 | 0.6 | MCI | lnc-ZNF708-13:1 | SEQ5080 | 2.E-04 | 0.4 |
| All AD | lnc-GRSF1-1:1 | SEQ4817 | 4.E-02 | 0.8 | FTD | lnc-ZNF708-13:1 | SEQ5080 | 6.E-04 | 0.5 |
| MCI | lnc-GSDMD-2:1 | SEQ4522 | 9.E-04 | 1.7 | MCI | lnc-ZNF708-3:1 | SEQ5082 | 2.E-04 | 0.6 |
| DLB | lnc-GSDMD-2:1 | SEQ4522 | 2.E-03 | 1.6 | FTD | lnc-ZNF708-3:1 | SEQ5082 | 6.E-04 | 0.5 |
| All AD | lnc-GSTO2-3:1 | SEQ4818 | 4.E-02 | 0.8 | MCI | lnc-ZNF726-1:3 | SEQ0259 | 9.E-04 | 1.6 |
| FTD | lnc-GSX2-7:1 | SEQ4820 | 1.E-08 | 0.4 | FTD | lnc-ZNF730-11:1 | SEQ4899 | 9.E-04 | 0.6 |
| MCI | lnc-GSX2-7:1 | SEQ4820 | 9.E-05 | 0.6 | All AD | lnc-ZNF740-2:1 | SEQ5924 | 3.E-02 | 0.8 |
| miAD | lnc-GSX2-7:1 | SEQ4820 | 1.E-03 | 0.6 | DLB | lnc-ZNF75D-2:2 | SEQ5659 | 1.E-04 | 1.5 |
| All AD | lnc-GSX2-7:1 | SEQ4820 | 6.E-03 | 0.6 | DLB | lnc-ZNF778-1:4 | SEQ2865 | 8.E-04 | 1.5 |
| All AD | lnc-GTDC1-1:2 | SEQ4821 | 4.E-02 | 0.7 | MCI | lnc-ZNF778-5:1 | SEQ5125 | 6.E-04 | 1.6 |
| FTD | lnc-GTDC1-12:1 | SEQ4822 | 1.E-04 | 0.6 | DLB | lnc-ZNF778-5:1 | SEQ5125 | 6.E-04 | 1.6 |
| All AD | lnc-GTDC1-12:1 | SEQ4822 | 3.E-02 | 0.7 | DLB | lnc-ZNF780B-1:1 | SEQ4526 | 2.E-03 | 1.6 |
| FTD | lnc-GTDC1-17:1 | SEQ5961 | 6.E-06 | 0.3 | FTD | lnc-ZNF792-4:1 | SEQ5866 | 4.E-05 | 0.5 |
| FTD | lnc-GTDC1-21:1 | SEQ5081 | 6.E-04 | 0.5 | DLB | lnc-ZNF8-2:1 | SEQ5379 | 3.E-04 | 1.6 |
| FTD | lnc-GTDC1-22:1 | SEQ5394 | 3.E-04 | 0.5 | DLB | lnc-ZNF835-2:1 | SEQ3790 | 4.E-04 | 1.5 |
| FTD | lnc-GTDC1-28:1 | SEQ5925 | 1.E-05 | 0.6 | msAD | lnc-ZNF835-2:1 | SEQ3790 | 4.E-02 | 1.2 |
| MCI | lnc-GTDC1-3:1 | SEQ3956 | 3.E-06 | 3.2 | All AD | lnc-ZNF835-2:1 | SEQ3790 | 4.E-02 | 1.2 |
| DLB | lnc-GTDC1-3:1 | SEQ3956 | 9.E-06 | 3.1 | DLB | lnc-ZNF836-2:4 | SEQ4699 | 3.E-05 | 1.7 |
| FTD | lnc-GTDC1-3:1 | SEQ3956 | 3.E-05 | 2.5 | MCI | lnc-ZNF836-2:4 | SEQ4699 | 1.E-03 | 1.5 |
| All AD | lnc-GTDC1-3:1 | SEQ3956 | 2.E-02 | 1.3 | DLB | lnc-ZNF837-1:2 | SEQ3783 | 2.E-05 | 2.6 |
| msAD | lnc-GTDC1-3:1 | SEQ3956 | 3.E-02 | 1.3 | MCI | lnc-ZNF837-1:2 | SEQ3783 | 3.E-05 | 2.6 |
| FTD | lnc-GTDC1-3:2 | SEQ5968 | 4.E-06 | 0.5 | FTD | lnc-ZNF837-1:2 | SEQ3783 | 8.E-05 | 2.1 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
| --- | --- | --- | --- | --- | --- | --- | --- | --- | --- |
| FTD | lnc-GTDC1-5:1 | SEQ5395 | 3.E−04 | 0.5 | miAD | lnc-ZNF837-1:2 | SEQ3783 | 3.E−04 | 1.7 |
| DLB | lnc-GTF2IRD2B-3:1 | SEQ5755 | 8.E−05 | 1.7 | All AD | lnc-ZNF837-1:2 | SEQ3783 | 2.E−03 | 1.6 |
| miAD | lnc-GTPBP1-1:1 | SEQ4120 | 1.E−02 | 1.2 | msAD | lnc-ZNF837-1:2 | SEQ3783 | 4.E−02 | 1.4 |
| All AD | lnc-GTPBP1-1:1 | SEQ4120 | 2.E−02 | 1.2 | MCI | lnc-ZNF843-2:1 | SEQ5495 | 3.E−06 | 1.9 |
| DLB | lnc-GTPBP1-1:2 | SEQ3017 | 2.E−04 | 1.4 | DLB | lnc-ZNF843-2:1 | SEQ5495 | 2.E−04 | 1.8 |
| MCI | lnc-GTPBP1-1:2 | SEQ3017 | 2.E−04 | 1.4 | All AD | lnc-ZNF843-2:1 | SEQ5495 | 3.E−02 | 1.2 |
| FTD | lnc-H2AFJ-4:2 | SEQ5975 | 3.E−06 | 0.6 | MCI | lnc-ZNF843-2:4 | SEQ3465 | 2.E−05 | 2.0 |
| FTD | lnc-H2AFV-3:1 | SEQ2433 | 2.E−04 | 0.7 | DLB | lnc-ZNF843-2:4 | SEQ3465 | 1.E−04 | 1.6 |
| All AD | lnc-H3F3A-7:1 | SEQ4831 | 4.E−02 | 0.8 | FTD | lnc-ZNF843-2:4 | SEQ3465 | 5.E−04 | 1.4 |
| DLB | lnc-H6PD-2:1 | SEQ5426 | 3.E−04 | 1.4 | msAD | lnc-ZNF843-2:4 | SEQ3465 | 1.E−02 | 1.2 |
| DLB | lnc-HAGHL-1:1 | SEQ4505 | 2.E−05 | 1.8 | All AD | lnc-ZNF843-2:4 | SEQ3465 | 1.E−02 | 1.2 |
| MCI | lnc-HAGHL-1:1 | SEQ4505 | 2.E−03 | 1.5 | DLB | lnc-ZNF843-2:6 | SEQ4879 | 9.E−04 | 2.1 |
| DLB | lnc-HAND1-3:1 | SEQ5575 | 2.E−04 | 1.7 | MCI | lnc-ZNF843-2:7 | SEQ5631 | 7.E−07 | 2.1 |
| DLB | lnc-HAUS1-1:1 | SEQ4863 | 9.E−04 | 1.6 | DLB | lnc-ZNF843-2:7 | SEQ5631 | 2.E−04 | 1.8 |
| DLB | lnc-HBG2-1:1 | SEQ3409 | 1.E−03 | 1.4 | msAD | lnc-ZNF852-2:3 | SEQ2944 | 2.E−02 | 1.3 |
| DLB | lnc-HCN3-1:1 | SEQ5316 | 4.E−04 | 1.5 | MCI | lnc-ZNHIT2-1:1 | SEQ3818 | 2.E−06 | 1.9 |
| MCI | lnc-HDDC3-3:2 | SEQ4690 | 1.E−03 | 1.4 | DLB | lnc-ZNHIT2-1:1 | SEQ3818 | 3.E−05 | 1.8 |
| DLB | lnc-HDDC3-3:2 | SEQ4690 | 1.E−03 | 1.4 | FTD | lnc-ZNHIT2-1:1 | SEQ3818 | 5.E−04 | 1.4 |
| DLB | lnc-HDGFL2-7:1 | SEQ3180 | 2.E−04 | 1.8 | miAD | lnc-ZNHIT2-1:1 | SEQ3818 | 8.E−03 | 1.2 |
| MCI | lnc-HDGFL2-7:1 | SEQ3180 | 5.E−04 | 1.7 | All AD | lnc-ZNHIT2-1:1 | SEQ3818 | 9.E−03 | 1.2 |
| FTD | lnc-HELZ-4:1 | SEQ5783 | 7.E−05 | 0.7 | msAD | lnc-ZNHIT2-1:1 | SEQ3818 | 4.E−02 | 1.2 |
| FTD | lnc-HEPH-1:1 | SEQ4549 | 2.E−05 | 0.6 | msAD | lnc-ZNRD1-4:2 | SEQ4122 | 1.E−02 | 0.5 |
| MCI | lnc-HEPH-1:1 | SEQ4549 | 2.E−03 | 0.6 | DLB | lnc-ZNRF2-1:1 | SEQ4700 | 5.E−03 | 1.5 |
| DLB | lnc-HIBADH-5:1 | SEQ3962 | 3.E−05 | 1.4 | FTD | lnc-ZNRF2-4:1 | SEQ5551 | 2.E−04 | 0.7 |
| msAD | lnc-HIBADH-5:1 | SEQ3962 | 2.E−02 | 1.1 | FTD | lnc-ZRANB1-4:1 | SEQ5067 | 7.E−04 | 0.7 |
| All AD | lnc-HIBADH-5:1 | SEQ3962 | 4.E−02 | 1.1 | All AD | lnc-ZRANB1-4:1 | SEQ5067 | 4.E−02 | 0.8 |
| DLB | lnc-HIP1-1:2 | SEQ4849 | 9.E−04 | 1.5 | MCI | lnc-ZSCAN10-1:3 | SEQ5651 | 1.E−04 | 0.5 |
| DLB | lnc-HIST1H2BJ-10:5 | SEQ5707 | 1.E−04 | 1.8 | FTD | lnc-ZSCAN10-1:5 | SEQ5093 | 6.E−04 | 0.7 |
| All AD | lnc-HIST1H3A-4:1 | SEQ4172 | 1.E−02 | 0.8 | DLB | lnc-ZSCAN10-1:7 | SEQ5323 | 4.E−04 | 1.5 |
| msAD | lnc-HIST1H3A-4:1 | SEQ4172 | 1.E−02 | 0.8 | DLB | lnc-ZSCAN10-3:32 | SEQ5713 | 1.E−04 | 2.4 |
| All AD | lnc-HIST1H3D-1:1 | SEQ4844 | 3.E−02 | 0.7 | DLB | lnc-ZSCAN10-7:1 | SEQ5370 | 2.E−04 | 1.4 |
| DLB | lnc-HIST1H3F-1:1 | SEQ5878 | 3.E−05 | 1.6 | MCI | lnc-ZSCAN10-7:1 | SEQ5370 | 3.E−04 | 1.4 |
| FTD | lnc-HIST1H4D-3:1 | SEQ4032 | 2.E−05 | 1.5 | DLB | lnc-ZSCAN1-3:3 | SEQ5445 | 3.E−04 | 1.6 |
| DLB | lnc-HIST1H4D-3:1 | SEQ4032 | 2.E−05 | 1.6 | DLB | lnc-ZSCAN21-1:1 | SEQ5240 | 5.E−04 | 1.3 |
| MCI | lnc-HIST1H4D-3:1 | SEQ4032 | 3.E−05 | 1.5 | DLB | lnc-ZSCAN21-2:1 | SEQ5477 | 2.E−04 | 1.4 |
| miAD | lnc-HIST1H4D-3:1 | SEQ4032 | 2.E−03 | 1.2 | DLB | lnc-ZSCAN2-5:1 | SEQ5486 | 2.E−04 | 1.5 |
| All AD | lnc-HIST1H4D-3:1 | SEQ4032 | 3.E−03 | 1.2 | DLB | lnc-ZSCAN2-5:10 | SEQ4859 | 9.E−04 | 1.5 |
| msAD | lnc-HIST1H4D-3:1 | SEQ4032 | 2.E−02 | 1.2 | DLB | lnc-ZSWIM8-2:3 | SEQ4715 | 1.E−03 | 1.6 |
| FTD | lnc-HIST2H2AA3-1:1 | SEQ5069 | 7.E−04 | 0.7 | MCI | LRRC75A-AS1:63 | SEQ5137 | 6.E−04 | 1.8 |
| FTD | lnc-HIST2H2BF-5:1 | SEQ5366 | 3.E−06 | 0.4 | FTD | LUCAT1:1 | SEQ4330 | 3.E−05 | 0.6 |
| MCI | lnc-HIST2H2BF-5:1 | SEQ5366 | 3.E−04 | 0.5 | miAD | LUCAT1:1 | SEQ4330 | 6.E−03 | 0.6 |
| FTD | lnc-HIST2H3A-1:2 | SEQ4852 | 8.E−04 | 0.6 | All AD | LUCAT1:1 | SEQ4330 | 3.E−02 | 0.7 |
| All AD | lnc-HIST2H3A-1:2 | SEQ4852 | 2.E−02 | 0.7 | FTD | LUCAT1:14 | SEQ4151 | 3.E−04 | 0.6 |
| All AD | lnc-HIST2H3D-1:1 | SEQ2368 | 1.E−03 | 0.5 | miAD | LUCAT1:14 | SEQ4151 | 1.E−02 | 0.7 |
| msAD | lnc-HIST2H3D-1:1 | SEQ2368 | 3.E−03 | 0.5 | All AD | LUCAT1:14 | SEQ4151 | 2.E−02 | 0.7 |
| miAD | lnc-HIST2H3D-1:1 | SEQ2368 | 3.E−03 | 0.6 | miAD | LUCAT1:18 | SEQ4351 | 4.E−03 | 0.4 |
| miAD | lnc-HIST2H3PS2-10:1 | SEQ4664 | 1.E−03 | 0.4 | All AD | LUCAT1:18 | SEQ4351 | 1.E−02 | 0.5 |
| All AD | lnc-HIST2H3PS2-10:1 | SEQ4664 | 8.E−03 | 0.4 | All AD | LUCAT1:2 | SEQ5932 | 4.E−02 | 0.8 |
| DLB | lnc-HIST3H2BB-1:4 | SEQ5845 | 4.E−05 | 1.5 | All AD | LUCAT1:20 | SEQ5933 | 3.E−02 | 0.7 |
| FTD | lnc-HIST4H4-1:1 | SEQ5921 | 1.E−05 | 0.2 | All AD | LUCAT1:21 | SEQ5934 | 2.E−02 | 0.7 |
| FTD | lnc-HIST4H4-1:2 | SEQ5750 | 2.E−05 | 0.2 | FTD | LUCAT1:24 | SEQ5510 | 2.E−04 | 0.6 |
| MCI | lnc-HIST4H4-1:2 | SEQ5750 | 8.E−05 | 0.3 | All AD | LUCAT1:24 | SEQ5510 | 2.E−02 | 0.7 |
| All AD | lnc-HIST4H4-4:1 | SEQ4860 | 5.E−02 | 0.8 | FTD | LUCAT1:3 | SEQ5511 | 2.E−04 | 0.6 |
| DLB | lnc-HIST4H4-5:3 | SEQ5897 | 2.E−05 | 2.0 | All AD | LUCAT1:3 | SEQ5511 | 2.E−02 | 0.7 |
| DLB | lnc-HLA-B-2:13 | SEQ4606 | 2.E−04 | 0.2 | FTD | MALAT1:16 | SEQ4201 | 5.E−04 | 0.4 |
| MCI | lnc-HLA-B-2:13 | SEQ4606 | 1.E−03 | 0.2 | msAD | MALAT1:16 | SEQ4201 | 1.E−02 | 0.5 |
| MCI | lnc-HLA-DMA-1:1 | SEQ5942 | 2.E−07 | 1.7 | All AD | MALAT1:16 | SEQ4201 | 2.E−02 | 0.5 |
| DLB | lnc-HLA-DMA-1:1 | SEQ5942 | 4.E−06 | 1.7 | MCI | MALAT1:24 | SEQ4397 | 2.E−04 | 0.5 |
| FTD | lnc-HLA-DMA-1:1 | SEQ5942 | 1.E−05 | 1.4 | DLB | MALAT1:24 | SEQ4397 | 2.E−03 | 0.6 |
| FTD | lnc-HLA-DQA1-7:1 | SEQ5335 | 6.E−05 | 1.7 | miAD | MALAT1:32 | SEQ3633 | 7.E−03 | 0.6 |
| DLB | lnc-HLA-DQA1-7:1 | SEQ5335 | 4.E−05 | 1.7 | All AD | MALAT1:32 | SEQ3633 | 1.E−02 | 0.6 |
| DLB | lnc-HLA-DRB1-5:1 | SEQ4166 | 8.E−04 | 2.7 | msAD | MALAT1:32 | SEQ3633 | 5.E−02 | 0.7 |
| All AD | lnc-HLA-DRB1-5:1 | SEQ4166 | 4.E−03 | 1.6 | FTD | MALAT1:33 | SEQ5927 | 3.E−11 | 4.E−15 |
| msAD | lnc-HLA-DRB1-5:1 | SEQ4166 | 7.E−03 | 1.6 | DLB | MALAT1:33 | SEQ5927 | 1.E−05 | 3.E−15 |
| miAD | lnc-HLA-DRB1-5:1 | SEQ4166 | 1.E−02 | 1.5 | MCI | MALAT1:33 | SEQ5927 | 1.E−05 | 3.E−15 |
| DLB | lnc-HLA-DRB1-5:2 | SEQ5347 | 4.E−04 | 2.4 | MCI | MALAT1:38 | SEQ5650 | 1.E−06 | 0.3 |
| DLB | lnc-HMGA1-2:4 | SEQ3415 | 5.E−04 | 1.3 | FTD | MALAT1:38 | SEQ5650 | 2.E−06 | 0.3 |
| FTD | lnc-HMGB1-4:1 | SEQ5160 | 5.E−04 | 0.7 | DLB | MALAT1:38 | SEQ5650 | 1.E−04 | 0.4 |
| FTD | lnc-HMGB2-5:1 | SEQ3870 | 3.E−05 | 0.6 | DLB | MALAT1:4 | SEQ4834 | 9.E−04 | 1.4 |
| miAD | lnc-HMGB2-5:1 | SEQ3870 | 6.E−03 | 0.8 | MCI | MALAT1:40 | SEQ5556 | 2.E−04 | 0.4 |
| All AD | lnc-HMGB2-5:1 | SEQ3870 | 7.E−03 | 0.8 | DLB | MALAT1:43 | SEQ5018 | 7.E−04 | 1.4 |
| msAD | lnc-HMGB2-5:1 | SEQ3870 | 3.E−02 | 0.8 | DLB | MALAT1:5 | SEQ5019 | 7.E−04 | 1.4 |
| FTD | lnc-HMGB2-8:1 | SEQ5802 | 6.E−05 | 0.6 | DLB | MALAT1:6 | SEQ5016 | 7.E−04 | 1.4 |
| FTD | lnc-HMGN5-3:1 | SEQ3416 | 1.E−09 | 0.4 | DLB | MAP3K14-AS1:27 | SEQ5184 | 5.E−04 | 1.5 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| MCI | lnc-HMGN5-3:1 | SEQ3416 | 2.E-05 | 0.5 | MCI | MAP3K14-AS1:28 | SEQ4862 | 9.E-04 | 1.5 |
| All AD | lnc-HMGN5-3:1 | SEQ3416 | 1.E-03 | 0.6 | DLB | MAP3K14-AS1:28 | SEQ4862 | 9.E-04 | 1.6 |
| miAD | lnc-HMGN5-3:1 | SEQ3416 | 3.E-03 | 0.6 | FTD | MAP3K20-AS1:6 | SEQ5508 | 2.E-04 | 0.5 |
| msAD | lnc-HMGN5-3:1 | SEQ3416 | 4.E-03 | 0.6 | All AD | MATN1-AS1:2 | SEQ5940 | 3.E-02 | 1.2 |
| FTD | lnc-HNRNPA2B1-14:2 | SEQ5828 | 5.E-05 | 0.5 | DLB | MBNL1-AS1:10 | SEQ5456 | 3.E-04 | 1.9 |
| FTD | lnc-HNRNPA2B1-15:1 | SEQ4878 | 6.E-10 | 0.3 | DLB | MBNL1-AS1:5 | SEQ4754 | 1.E-03 | 1.4 |
| MCI | lnc-HNRNPA2B1-15:1 | SEQ4878 | 3.E-06 | 0.3 | miAD | MBNL1-AS1:8 | SEQ4335 | 6.E-04 | 1.5 |
| DLB | lnc-HNRNPA2B1-15:1 | SEQ4878 | 5.E-04 | 0.4 | All AD | MBNL1-AS1:8 | SEQ4335 | 1.E-02 | 1.3 |
| miAD | lnc-HNRNPA2B1-15:1 | SEQ4878 | 6.E-04 | 0.4 | DLB | MCM3AP-AS1:8 | SEQ4507 | 2.E-03 | 1.5 |
| All AD | lnc-HNRNPA2B1-15:1 | SEQ4878 | 3.E-03 | 0.5 | FTD | MIF-AS1:7 | SEQ3858 | 8.E-06 | 1.7 |
| MCI | lnc-HNRNPA2B1-15:3 | SEQ4795 | 1.E-03 | 2.8 | MCI | MIF-AS1:7 | SEQ3858 | 9.E-06 | 1.8 |
| FTD | lnc-HNRNPA2B1-15:4 | SEQ4601 | 1.E-06 | 0.5 | DLB | MIF-AS1:7 | SEQ3858 | 1.E-05 | 1.9 |
| MCI | lnc-HNRNPA2B1-15:4 | SEQ4601 | 2.E-05 | 0.5 | miAD | MIF-AS1:7 | SEQ3858 | 7.E-03 | 1.3 |
| miAD | lnc-HNRNPA2B1-15:4 | SEQ4601 | 1.E-03 | 0.6 | All AD | MIF-AS1:7 | SEQ3858 | 8.E-03 | 1.3 |
| All AD | lnc-HNRNPA2B1-15:4 | SEQ4601 | 6.E-03 | 0.6 | msAD | MIF-AS1:7 | SEQ3858 | 3.E-02 | 1.3 |
| All AD | lnc-HNRNPA2B1-15:5 | SEQ4882 | 4.E-02 | 0.7 | FTD | MIR133A1HG:2 | SEQ5642 | 1.E-04 | 0.6 |
| MCI | lnc-HNRNPA3-2:2 | SEQ5073 | 2.E-04 | 1.8 | FTD | MIR133A1HG:3 | SEQ5855 | 4.E-05 | 0.5 |
| DLB | lnc-HNRNPA3-2:2 | SEQ5073 | 5.E-04 | 1.7 | MCI | MIR17HG:13 | SEQ5996 | 7.E-07 | 3.1 |
| FTD | lnc-HNRNPA3-2:2 | SEQ5073 | 7.E-04 | 1.5 | FTD | MIR17HG:21 | SEQ4799 | 1.E-03 | 0.4 |
| FTD | lnc-HNRNPLL-4:1 | SEQ4287 | 2.E-06 | 0.5 | FTD | MIR181A2HG:1 | SEQ3905 | 9.E-04 | 0.6 |
| msAD | lnc-HNRNPLL-4:1 | SEQ4287 | 7.E-03 | 0.7 | miAD | MIR181A2HG:1 | SEQ3905 | 5.E-03 | 0.6 |
| All AD | lnc-HNRNPLL-4:1 | SEQ4287 | 8.E-03 | 0.7 | All AD | MIR181A2HG:1 | SEQ3905 | 6.E-03 | 0.7 |
| FTD | lnc-HNRNPU-1:3 | SEQ4467 | 4.E-04 | 0.4 | msAD | MIR181A2HG:1 | SEQ3905 | 3.E-02 | 0.8 |
| MCI | lnc-HNRNPU-1:3 | SEQ4467 | 2.E-03 | 0.4 | FTD | MIR222HG:26 | SEQ5396 | 3.E-04 | 0.5 |
| FTD | lnc-HNRNPU-1:6 | SEQ4889 | 7.E-05 | 0.4 | DLB | MIR29B2CHG:14 | SEQ5637 | 2.E-04 | 1.9 |
| All AD | lnc-HNRNPU-1:6 | SEQ4889 | 5.E-02 | 0.6 | DLB | MIR29B2CHG:21 | SEQ4530 | 2.E-03 | 1.8 |
| DLB | lnc-HOMEZ-1:6 | SEQ5032 | 7.E-04 | 1.5 | DLB | MIR29B2CHG:22 | SEQ4655 | 1.E-03 | 1.9 |
| All AD | lnc-HPCA-1:1 | SEQ4891 | 4.E-02 | 0.8 | MCI | MIR29B2CHG:28 | SEQ5457 | 3.E-02 | 1.9 |
| FTD | lnc-HPGD-5:1 | SEQ5827 | 5.E-05 | 0.5 | FTD | MIR29B2CHG:33 | SEQ0583 | 2.E-05 | 0.4 |
| DLB | lnc-HSD11B2-1:1 | SEQ2525 | 1.E-03 | 1.3 | All AD | MIR29B2CHG:33 | SEQ0583 | 2.E-02 | 0.7 |
| DLB | lnc-HSD17B6-3:1 | SEQ3950 | 7.E-07 | 2.0 | All AD | MIR29B2CHG:34 | SEQ5945 | 2.E-02 | 0.7 |
| MCI | lnc-HSD17B6-3:1 | SEQ3950 | 3.E-06 | 1.8 | MCI | MIR29B2CHG:48 | SEQ5099 | 7.E-06 | 0.3 |
| FTD | lnc-HSD17B6-3:1 | SEQ3950 | 6.E-06 | 1.7 | FTD | MIR29B2CHG:48 | SEQ5099 | 1.E-05 | 0.3 |
| All AD | lnc-HSD17B6-3:1 | SEQ3950 | 2.E-02 | 1.2 | DLB | MIR29B2CHG:48 | SEQ5099 | 6.E-04 | 0.3 |
| msAD | lnc-HSD17B6-3:1 | SEQ3950 | 3.E-02 | 1.2 | DLB | MIR29B2CHG:8 | SEQ4457 | 5.E-05 | 2.0 |
| All AD | lnc-HSDL1-2:1 | SEQ3753 | 2.E-02 | 1.1 | MCI | MIR29B2CHG:8 | SEQ4457 | 2.E-03 | 1.9 |
| msAD | lnc-HSDL1-2:1 | SEQ3753 | 4.E-02 | 1.2 | All AD | MIR3936HG:4 | SEQ3771 | 2.E-02 | 0.7 |
| FTD | lnc-HSP90AA1-13:1 | SEQ5591 | 2.E-04 | 0.6 | msAD | MIR3936HG:4 | SEQ3771 | 4.E-02 | 0.7 |
| All AD | lnc-HSP90AA1-15:2 | SEQ4897 | 4.E-02 | 0.8 | DLB | MIR4435-2HG:43 | SEQ4650 | 1.E-03 | 1.8 |
| DLB | lnc-HSP90AA1-2:1 | SEQ5612 | 2.E-04 | 1.4 | FTD | MIR4435-2HG:6 | SEQ5005 | 8.E-04 | 1.7 |
| DLB | lnc-HSPB1-4:4 | SEQ5813 | 5.E-05 | 1.4 | DLB | MIR4453HG:2 | SEQ3568 | 1.E-03 | 1.4 |
| DLB | lnc-HUS1B-2:1 | SEQ4588 | 2.E-03 | 1.6 | DLB | MIR600HG:4 | SEQ3892 | 6.E-04 | 1.9 |
| DLB | lnc-HYAL4-4:6 | SEQ4618 | 2.E-04 | 1.5 | msAD | MIR600HG:4 | SEQ3892 | 3.E-02 | 1.4 |
| MCI | lnc-HYAL4-4:6 | SEQ4618 | 1.E-03 | 1.4 | All AD | MIR600HG:4 | SEQ3892 | 4.E-02 | 1.3 |
| DLB | lnc-ICA1L-7:1 | SEQ4901 | 5.E-04 | 2.1 | DLB | MIR600HG:5 | SEQ3676 | 1.E-03 | 2.0 |
| MCI | lnc-ICA1L-7:1 | SEQ4901 | 5.E-04 | 2.1 | msAD | MIR600HG:5 | SEQ3676 | 5.E-02 | 1.4 |
| All AD | lnc-ICA1L-7:1 | SEQ4901 | 5.E-02 | 1.3 | FTD | MIR646HG:26 | SEQ3222 | 9.E-04 | 0.6 |
| MCI | lnc-ICAM5-1:1 | SEQ4240 | 1.E-05 | 1.7 | FTD | MIR646HG:29 | SEQ3928 | 1.E-05 | 0.5 |
| DLB | lnc-ICAM5-1:1 | SEQ4240 | 1.E-05 | 1.9 | miAD | MIR646HG:29 | SEQ3928 | 1.E-03 | 0.6 |
| FTD | lnc-ICAM5-1:1 | SEQ4240 | 2.E-04 | 1.4 | All AD | MIR646HG:29 | SEQ3928 | 3.E-03 | 0.6 |
| All AD | lnc-ICAM5-1:1 | SEQ4240 | 4.E-03 | 1.3 | msAD | MIR646HG:29 | SEQ3928 | 3.E-02 | 0.7 |
| miAD | lnc-ICAM5-1:1 | SEQ4240 | 8.E-03 | 1.3 | miAD | MIR646HG:35 | SEQ4313 | 7.E-03 | 0.7 |
| msAD | lnc-ICAM5-1:1 | SEQ4240 | 1.E-02 | 1.3 | All AD | MIR646HG:35 | SEQ4313 | 2.E-02 | 0.8 |
| DLB | lnc-ICOSLG-6:12 | SEQ4450 | 8.E-04 | 1.6 | FTD | MME-AS1:2 | SEQ4056 | 2.E-06 | 0.4 |
| MCI | lnc-ICOSLG-6:12 | SEQ4450 | 2.E-03 | 1.6 | miAD | MME-AS1:2 | SEQ4056 | 3.E-03 | 0.6 |
| miAD | lnc-IDE-3:1 | SEQ4211 | 1.E-02 | 0.7 | All AD | MME-AS1:2 | SEQ4056 | 3.E-03 | 0.6 |
| MCI | lnc-IER3-7:16 | SEQ5183 | 5.E-04 | 1.5 | msAD | MME-AS1:2 | SEQ4056 | 2.E-02 | 0.6 |
| MCI | lnc-IER3-7:17 | SEQ4560 | 1.E-04 | 1.6 | MCI | MMP25-AS1:17 | SEQ4787 | 1.E-03 | 1.8 |
| DLB | lnc-IER3-7:17 | SEQ4560 | 2.E-03 | 1.4 | All AD | MMP25-AS1:24 | SEQ5949 | 3.E-02 | 0.8 |
| DLB | lnc-IER5-4:1 | SEQ5876 | 3.E-05 | 1.5 | MCI | MRPL23-AS1:10 | SEQ3942 | 9.E-05 | 1.7 |
| DLB | lnc-IFT140-2:1 | SEQ5623 | 2.E-04 | 1.6 | DLB | MRPL23-AS1:10 | SEQ3942 | 1.E-04 | 1.7 |
| FTD | lnc-IGIP-2:3 | SEQ3421 | 8.E-06 | 0.3 | FTD | MRPL23-AS1:10 | SEQ3942 | 7.E-04 | 1.5 |
| MCI | lnc-IGIP-2:3 | SEQ3421 | 2.E-04 | 0.3 | msAD | MRPL23-AS1:10 | SEQ3942 | 3.E-02 | 1.2 |
| DLB | lnc-IGIP-2:3 | SEQ3421 | 2.E-03 | 0.4 | All AD | MRPL23-AS1:10 | SEQ3942 | 3.E-02 | 1.2 |
| miAD | lnc-IGIP-5:1 | SEQ2977 | 1.E-02 | 0.7 | MCI | MRPS30-DT:11 | SEQ4024 | 2.E-04 | 1.7 |
| All AD | lnc-IGIP-5:1 | SEQ2977 | 2.E-02 | 0.7 | DLB | MRPS30-DT:11 | SEQ4024 | 9.E-04 | 1.6 |
| MCI | lnc-IGLON5-6:10 | SEQ4600 | 8.E-05 | 2.1 | All AD | MRPS30-DT:11 | SEQ4024 | 1.E-02 | 1.3 |
| msAD | lnc-IGLON5-6:10 | SEQ4600 | 1.E-03 | 1.7 | msAD | MRPS30-DT:11 | SEQ4024 | 2.E-02 | 1.3 |
| DLB | lnc-IGLON5-6:10 | SEQ4600 | 2.E-03 | 1.9 | FTD | MRVI1-AS1:16 | SEQ5778 | 7.E-05 | 0.6 |
| All AD | lnc-IGLON5-6:10 | SEQ4600 | 4.E-03 | 1.5 | FTD | MYLK-AS1:13 | SEQ5471 | 3.E-02 | 0.7 |
| FTD | lnc-IGLON5-6:3 | SEQ4129 | 1.E-08 | 4.7 | DLB | MYLK-AS1:16 | SEQ3954 | 1.E-03 | 1.5 |
| MCI | lnc-IGLON5-6:3 | SEQ4129 | 3.E-08 | 7.5 | MCI | MYLK-AS1:16 | SEQ3954 | 2.E-03 | 1.5 |
| DLB | lnc-IGLON5-6:3 | SEQ4129 | 3.E-05 | 3.7 | msAD | MYLK-AS1:16 | SEQ3954 | 3.E-02 | 1.3 |
| All AD | lnc-IGLON5-6:3 | SEQ4129 | 1.E-02 | 1.6 | miAD | MZF1-AS1:11 | SEQ4877 | 6.E-04 | 1.9 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| msAD | lnc-IGLON5-6:3 | SEQ4129 | 1.E-02 | 1.7 | DLB | MZF1-AS1:11 | SEQ4877 | 9.E-04 | 2.1 |
| DLB | lnc-IGLON5-6:5 | SEQ4265 | 2.E-03 | 1.7 | All AD | MZF1-AS1:11 | SEQ4877 | 3.E-03 | 1.6 |
| msAD | lnc-IGLON5-6:5 | SEQ4265 | 9.E-03 | 1.4 | FTD | N4BP2L2-IT2:1 | SEQ5958 | 7.E-06 | 0.6 |
| FTD | lnc-IGSF10-8:1 | SEQ5929 | 1.E-05 | 0.5 | DLB | NAPA-AS1:10 | SEQ5425 | 3.E-04 | 1.4 |
| DLB | lnc-IKBIP-1:1 | SEQ4407 | 2.E-03 | 1.4 | All AD | NCAM1-AS1:1 | SEQ5953 | 4.E-02 | 0.7 |
| DLB | lnc-IL18BP-1:1 | SEQ3303 | 1.E-03 | 1.5 | miAD | NCF4-AS1:4 | SEQ4261 | 9.E-03 | 0.7 |
| DLB | lnc-IL18BP-1:2 | SEQ3422 | 8.E-04 | 1.5 | All AD | NCF4-AS1:4 | SEQ4261 | 3.E-02 | 0.8 |
| MCI | lnc-IL18BP-1:2 | SEQ3422 | 1.E-03 | 1.4 | MCI | NEAT1:11 | SEQ4370 | 1.E-08 | 6.E+04 |
| DLB | lnc-IL18BP-1:3 | SEQ3423 | 2.E-03 | 1.5 | FTD | NEAT1:11 | SEQ4370 | 8.E-07 | 16.4 |
| FTD | lnc-IL18R1-1:1 | SEQ4043 | 5.E-04 | 0.6 | DLB | NEAT1:11 | SEQ4370 | 2.E-04 | 5.6 |
| All AD | lnc-IL18R1-1:1 | SEQ4043 | 1.E-02 | 0.7 | miAD | NEAT1:11 | SEQ4370 | 4.E-03 | 2.4 |
| msAD | lnc-IL18R1-1:1 | SEQ4043 | 2.E-02 | 0.7 | All AD | NEAT1:11 | SEQ4370 | 2.E-02 | 1.9 |
| DLB | lnc-IL1RN-5:1 | SEQ4497 | 2.E-03 | 1.4 | MCI | NEAT1:12 | SEQ4350 | 2.E-06 | 3.E+02 |
| DLB | lnc-IL23A-2:5 | SEQ4425 | 2.E-03 | 1.5 | FTD | NEAT1:12 | SEQ4350 | 1.E-05 | 8.4 |
| msAD | lnc-IL23A-2:6 | SEQ4341 | 5.E-03 | 1.2 | miAD | NEAT1:12 | SEQ4350 | 5.E-03 | 2.4 |
| All AD | lnc-IL23A-2:6 | SEQ4341 | 1.E-02 | 1.2 | All AD | NEAT1:12 | SEQ4350 | 1.E-02 | 2.2 |
| DLB | lnc-IL2RA-5:1 | SEQ4484 | 2.E-03 | 1.4 | FTD | NEAT1:18 | SEQ3809 | 5.E-05 | 0.2 |
| DLB | lnc-IL31RA-1:1 | SEQ2680 | 3.E-04 | 1.6 | miAD | NEAT1:18 | SEQ3809 | 1.E-03 | 0.1 |
| MCI | lnc-IL31RA-1:1 | SEQ2680 | 2.E-03 | 1.5 | DLB | NEAT1:18 | SEQ3809 | 1.E-03 | 0.3 |
| miAD | lnc-IL31RA-1:1 | SEQ2680 | 3.E-03 | 1.4 | All AD | NEAT1:18 | SEQ3809 | 3.E-03 | 0.2 |
| All AD | lnc-IL31RA-1:1 | SEQ2680 | 4.E-03 | 1.3 | msAD | NEAT1:18 | SEQ3809 | 4.E-02 | 0.3 |
| msAD | lnc-IL31RA-1:1 | SEQ2680 | 3.E-02 | 1.3 | FTD | NEAT1:20 | SEQ4469 | 2.E-06 | 0.5 |
| MCI | lnc-IL31RA-6:2 | SEQ4535 | 2.E-03 | 2.2 | DLB | NEAT1:20 | SEQ4469 | 5.E-04 | 0.6 |
| All AD | lnc-IL31RA-6:2 | SEQ4535 | 4.E-02 | 1.4 | MCI | NEAT1:20 | SEQ4469 | 2.E-03 | 0.5 |
| DLB | lnc-IL9R-1:3 | SEQ5657 | 1.E-04 | 1.5 | All AD | NEAT1:20 | SEQ4469 | 3.E-02 | 0.7 |
| DLB | lnc-INO80E-2:2 | SEQ5191 | 5.E-04 | 1.5 | All AD | NEAT1:21 | SEQ5957 | 3.E-02 | 0.8 |
| FTD | lnc-INSL4-4:1 | SEQ5105 | 2.E-05 | 0.6 | miAD | NEAT1:22 | SEQ4986 | 2.E-06 | 0.5 |
| MCI | lnc-INSL4-4:1 | SEQ5105 | 6.E-02 | 0.6 | All AD | NEAT1:22 | SEQ4986 | 2.E-05 | 0.6 |
| FTD | lnc-INSL4-5:1 | SEQ4133 | 4.E-07 | 0.5 | msAD | NEAT1:22 | SEQ4986 | 8.E-04 | 0.6 |
| miAD | lnc-INSL4-5:1 | SEQ4133 | 1.E-02 | 0.7 | MCI | NEAT1:7 | SEQ4362 | 4.E-08 | 8.E+03 |
| All AD | lnc-INSL4-5:1 | SEQ4133 | 3.E-02 | 0.7 | FTD | NEAT1:7 | SEQ4362 | 8.E-06 | 4.8 |
| FTD | lnc-INSL4-6:1 | SEQ5423 | 1.E-07 | 0.4 | miAD | NEAT1:7 | SEQ4362 | 4.E-03 | 2.1 |
| MCI | lnc-INSL4-6:1 | SEQ5423 | 3.E-04 | 0.5 | All AD | NEAT1:7 | SEQ4362 | 1.E-02 | 2.2 |
| FTD | lnc-INSL4-8:1 | SEQ5406 | 3.E-04 | 0.6 | FTD | NEAT1:8 | SEQ4734 | 4.E-07 | 0.4 |
| FTD | lnc-INSL4-9:1 | SEQ4937 | 8.E-07 | 0.5 | MCI | NEAT1:8 | SEQ4734 | 1.E-03 | 0.5 |
| MCI | lnc-INSL4-9:1 | SEQ4937 | 1.E-04 | 0.5 | All AD | NEAT1:8 | SEQ4734 | 2.E-02 | 0.5 |
| All AD | lnc-INSL4-9:1 | SEQ4937 | 3.E-02 | 0.7 | MCI | NIPBL-AS1:1 | SEQ5100 | 6.E-04 | 0.4 |
| FTD | lnc-INSL6-3:1 | SEQ4906 | 9.E-04 | 0.7 | DLB | NIPBL-AS1:2 | SEQ4983 | 8.E-04 | 2.2 |
| FTD | lnc-INTS14-1:2 | SEQ5083 | 6.E-04 | 0.6 | FTD | NIPBL-AS1:6 | SEQ5744 | 9.E-05 | 0.6 |
| FTD | lnc-INTS9-2:1 | SEQ4940 | 8.E-05 | 0.6 | FTD | NORAD:10 | SEQ4733 | 7.E-07 | 2.1 |
| All AD | lnc-INTS9-2:1 | SEQ4940 | 3.E-02 | 0.8 | DLB | NORAD:10 | SEQ4733 | 1.E-05 | 2.0 |
| All AD | lnc-IPCEF1-2:1 | SEQ4941 | 3.E-02 | 1.2 | MCI | NORAD:10 | SEQ4733 | 9.E-05 | 2.1 |
| DLB | lnc-IQCF6-2:2 | SEQ4856 | 9.E-04 | 1.5 | All AD | NORAD:10 | SEQ4733 | 4.E-04 | 1.4 |
| All AD | lnc-IQCG-16:1 | SEQ4943 | 3.E-02 | 0.7 | miAD | NORAD:10 | SEQ4733 | 1.E-03 | 1.4 |
| All AD | lnc-IRF1-2:1 | SEQ4944 | 3.E-02 | 0.8 | msAD | NORAD:10 | SEQ4733 | 1.E-03 | 1.4 |
| All AD | lnc-IRF1-2:6 | SEQ4945 | 3.E-02 | 0.8 | FTD | NORAD:2 | SEQ3125 | 1.E-08 | 4.2 |
| DLB | lnc-IRF1-6:1 | SEQ5756 | 8.E-05 | 1.8 | MCI | NORAD:2 | SEQ3125 | 4.E-06 | 3.6 |
| DLB | lnc-IRF7-1:1 | SEQ5624 | 1.E-05 | 1.8 | DLB | NORAD:2 | SEQ3125 | 2.E-05 | 2.8 |
| MCI | lnc-IRF7-1:1 | SEQ5624 | 2.E-04 | 1.6 | All AD | NORAD:2 | SEQ3125 | 2.E-03 | 1.5 |
| All AD | lnc-IRS2-1:6 | SEQ3812 | 1.E-02 | 0.6 | miAD | NORAD:2 | SEQ3125 | 3.E-03 | 1.5 |
| miAD | lnc-IRS2-1:6 | SEQ3812 | 2.E-02 | 0.5 | msAD | NORAD:2 | SEQ3125 | 1.E-02 | 1.5 |
| msAD | lnc-IRS2-1:6 | SEQ3812 | 4.E-02 | 0.6 | All AD | NORAD:5 | SEQ3646 | 3.E-02 | 1.2 |
| msAD | lnc-IRS2-9:1 | SEQ3896 | 3.E-02 | 0.8 | msAD | NORAD:5 | SEQ3646 | 5.E-02 | 1.2 |
| All AD | lnc-IRS2-9:1 | SEQ3896 | 4.E-02 | 0.8 | FTD | NORAD:8 | SEQ2585 | 8.E-07 | 0.3 |
| MCI | lnc-ITGB1BP2-2:1 | SEQ2701 | 1.E-03 | 0.7 | MCI | NORAD:8 | SEQ2585 | 3.E-06 | 0.3 |
| DLB | lnc-ITGB1BP2-2:3 | SEQ5562 | 2.E-04 | 1.5 | All AD | NORAD:8 | SEQ2585 | 3.E-02 | 0.5 |
| DLB | lnc-ITPA-1:1 | SEQ5904 | 2.E-05 | 1.4 | FTD | NORAD:9 | SEQ2494 | 4.E-04 | 0.4 |
| MCI | lnc-ITPA-2:3 | SEQ4577 | 2.E-03 | 1.5 | MCI | NORAD:9 | SEQ2494 | 6.E-04 | 0.5 |
| DLB | lnc-ITPA-2:3 | SEQ4577 | 2.E-03 | 1.5 | All AD | NORAD:9 | SEQ2494 | 5.E-02 | 0.6 |
| FTD | lnc-JAK1-2:2 | SEQ4953 | 4.E-04 | 0.7 | DLB | NRSN2-AS1:11 | SEQ5450 | 3.E-04 | 1.7 |
| All AD | lnc-JAK1-2:2 | SEQ4953 | 2.E-02 | 0.8 | FTD | NUP50-AS1:22 | SEQ5088 | 6.E-04 | 0.6 |
| FTD | lnc-JCAD-10:1 | SEQ4954 | 1.E-05 | 0.6 | FTD | NUP50-AS1:22 | SEQ4654 | 4.E-04 | 1.7 |
| All AD | lnc-JCAD-10:1 | SEQ4954 | 3.E-02 | 0.8 | DLB | NUP50-AS1:22 | SEQ4654 | 7.E-04 | 1.9 |
| DLB | lnc-JMJD7-PLA2G4B-2:8 | SEQ3428 | 8.E-04 | 1.6 | MCI | NUP50-AS1:22 | SEQ4654 | 1.E-03 | 1.9 |
| DLB | lnc-JSRP1-1:2 | SEQ5710 | 5.E-05 | 1.8 | FTD | NUP50-AS1:27 | SEQ5356 | 4.E-04 | 0.6 |
| MCI | lnc-JSRP1-1:2 | SEQ5710 | 1.E-04 | 1.8 | MCI | NUTM2A-AS1:2 | SEQ5749 | 8.E-05 | 0.3 |
| DLB | lnc-JSRP1-2:1 | SEQ4495 | 2.E-03 | 1.4 | FTD | NUTM2A-AS1:28 | SEQ5222 | 5.E-04 | 0.5 |
| MCI | lnc-JUNB-1:1 | SEQ5422 | 1.E-05 | 1.8 | MCI | NUTM2A-AS1:30 | SEQ5903 | 2.E-05 | 0.3 |
| DLB | lnc-JUNB-1:1 | SEQ5422 | 1.E-05 | 1.6 | FTD | NUTM2A-AS1:34 | SEQ4337 | 3.E-07 | 0.5 |
| FTD | lnc-JUNB-1:1 | SEQ5422 | 3.E-04 | 1.5 | MCI | NUTM2A-AS1:34 | SEQ4337 | 2.E-04 | 0.6 |
| MCI | lnc-KANTR-2:1 | SEQ4836 | 9.E-04 | 1.4 | miAD | NUTM2A-AS1:34 | SEQ4337 | 5.E-03 | 0.7 |
| DLB | lnc-KBTBD4-4:1 | SEQ4614 | 1.E-03 | 1.3 | All AD | NUTM2A-AS1:34 | SEQ4337 | 2.E-02 | 0.7 |
| MCI | lnc-KCNC2-1:1 | SEQ4321 | 9.E-05 | 1.7 | FTD | NUTM2B-AS1:20 | SEQ5596 | 2.E-04 | 0.4 |

TABLE 10-continued 2847 whole blood (Paxgene RNA tube) lncRNAs differentially expressed in MCI group or mild AD group or moderate-to-severe AD group or both of these AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| DLB | lnc-KCNC2-1:1 | SEQ4321 | 2.E−04 | 1.7 | FTD | NUTM2B-AS1:42 | SEQ4813 | 1.E−03 | 0.7 |
| All AD | lnc-KCNC2-1:1 | SEQ4321 | 1.E−03 | 1.3 | FTD | NUTM2B-AS1:53 | SEQ0004 | 8.E−04 | 0.5 |
| miAD | lnc-KCNC2-1:1 | SEQ4321 | 1.E−03 | 1.3 | FTD | OIP5-AS1:15 | SEQ4823 | 3.E−06 | 0.2 |
| msAD | lnc-KCNC2-1:1 | SEQ4321 | 6.E−03 | 1.3 | MCI | OIP5-AS1:15 | SEQ4823 | 6.E−06 | 0.2 |
| DLB | lnc-KCNC3-1:4 | SEQ4083 | 2.E−05 | 2.0 | DLB | OIP5-AS1:15 | SEQ4823 | 9.E−04 | 0.2 |
| msAD | lnc-KCNC3-1:4 | SEQ4083 | 1.E−02 | 1.3 | DLB | OIP5-AS1:18 | SEQ5034 | 7.E−04 | 1.5 |
| All AD | lnc-KCNC3-1:4 | SEQ4083 | 5.E−02 | 1.2 | FTD | OIP5-AS1:25 | SEQ5168 | 4.E−07 | 0.4 |
| FTD | lnc-KCNE1B-10:2 | SEQ5585 | 2.E−04 | 0.2 | MCI | OIP5-AS1:25 | SEQ5168 | 5.E−04 | 0.5 |
| msAD | lnc-KCNE1B-10:3 | SEQ4324 | 6.E−03 | 1.6 | MCI | OIP5-AS1:3 | SEQ4919 | 8.E−04 | 0.5 |
| All AD | lnc-KCNE1B-10:3 | SEQ4324 | 4.E−02 | 1.4 | FTD | OIP5-AS1:36 | SEQ5807 | 6.E−05 | 0.7 |
| miAD | lnc-KCNE1B-2:1 | SEQ4161 | 1.E−02 | 1.3 | miAD | OR2A1-AS1:20 | SEQ4272 | 8.E−03 | 1.5 |
| miAD | lnc-KCNE1B-5:1 | SEQ4162 | 1.E−02 | 1.3 | All AD | OR2A1-AS1:20 | SEQ4272 | 1.E−02 | 1.4 |
| FTD | lnc-KCNE1B-7:1 | SEQ4885 | 2.E−04 | 2.6 | DLB | PAN3-AS1:1 | SEQ4842 | 6.E−04 | 1.5 |
| MCI | lnc-KCNE1B-7:1 | SEQ4885 | 6.E−04 | 2.9 | MCI | PAN3-AS1:1 | SEQ4842 | 9.E−04 | 1.4 |
| DLB | lnc-KCNE1B-7:1 | SEQ4885 | 9.E−04 | 2.9 | DLB | PAN3-AS1:2 | SEQ4843 | 6.E−04 | 1.5 |
| DLB | lnc-KCNE1B-7:2 | SEQ5056 | 7.E−04 | 2.8 | MCI | PAN3-AS1:2 | SEQ4843 | 9.E−04 | 1.4 |
| MCI | lnc-KCNE1B-7:2 | SEQ5056 | 7.E−04 | 2.9 | All AD | PCBP1-AS1:205 | SEQ3681 | 2.E−02 | 0.7 |
| MCI | lnc-KCNE1B-7:5 | SEQ3702 | 3.E−05 | 3.2 | msAD | PCBP1-AS1:205 | SEQ3681 | 5.E−02 | 0.8 |
| miAD | lnc-KCNE1B-7:5 | SEQ3702 | 7.E−05 | 1.7 | All AD | PCBP1-AS1:213 | SEQ5966 | 3.E−02 | 0.7 |
| DLB | lnc-KCNE1B-7:5 | SEQ3702 | 1.E−03 | 2.5 | DLB | PCBP1-AS1:217 | SEQ3458 | 5.E−04 | 1.2 |
| All AD | lnc-KCNE1B-7:5 | SEQ3702 | 1.E−03 | 1.5 | FTD | PCBP1-AS1:302 | SEQ4731 | 3.E−11 | 0.2 |
| msAD | lnc-KCNE1B-7:5 | SEQ3702 | 5.E−02 | 1.3 | MCI | PCBP1-AS1:302 | SEQ4731 | 3.E−08 | 0.3 |
| FTD | lnc-KCNE1B-7:9 | SEQ4884 | 3.E−07 | 11.9 | miAD | PCBP1-AS1:302 | SEQ4731 | 2.E−06 | 0.2 |
| MCI | lnc-KCNE1B-7:9 | SEQ4884 | 9.E−04 | 2.7 | DLB | PCBP1-AS1:302 | SEQ4731 | 1.E−05 | 0.3 |
| MCI | lnc-KCNE4-7:1 | SEQ2466 | 1.E−03 | 0.6 | All AD | PCBP1-AS1:302 | SEQ4731 | 2.E−05 | 0.3 |
| FTD | lnc-KCNE5-3:1 | SEQ5723 | 3.E−06 | 0.5 | msAD | PCBP1-AS1:302 | SEQ4731 | 1.E−03 | 0.3 |
| MCI | lnc-KCNE5-3:1 | SEQ5723 | 9.E−05 | 0.6 | All AD | PCBP1-AS1:304 | SEQ3972 | 2.E−02 | 0.7 |
| FTD | lnc-KCNRG-1:1 | SEQ2856 | 6.E−08 | 0.5 | msAD | PCBP1-AS1:304 | SEQ3972 | 2.E−02 | 0.7 |
| MCI | lnc-KCNRG-1:1 | SEQ2856 | 8.E−04 | 0.6 | DLB | PCED1B-AS1:21 | SEQ5279 | 5.E−04 | 1.8 |
| miAD | lnc-KCNRG-1:1 | SEQ2856 | 6.E−03 | 0.7 | MCI | PCED1B-AS1:21 | SEQ5279 | 5.E−04 | 1.9 |
| All AD | lnc-KCNRG-1:1 | SEQ2856 | 7.E−03 | 0.7 | MCI | PCED1B-AS1:24 | SEQ4320 | 4.E−05 | 3.5 |
| msAD | lnc-KCNRG-1:1 | SEQ2856 | 3.E−02 | 0.7 | DLB | PCED1B-AS1:24 | SEQ4320 | 6.E−05 | 3.0 |
| FTD | lnc-KCNRG-2:2 | SEQ4270 | 1.E−08 | 0.5 | miAD | PCED1B-AS1:24 | SEQ4320 | 6.E−03 | 1.6 |
| MCI | lnc-KCNRG-2:2 | SEQ4270 | 1.E−05 | 0.5 | All AD | PCED1B-AS1:24 | SEQ4320 | 2.E−02 | 1.4 |
| miAD | lnc-KCNRG-2:2 | SEQ4270 | 2.E−04 | 0.6 | MCI | PCED1B-AS1:4 | SEQ5455 | 2.E−04 | 1.9 |
| All AD | lnc-KCNRG-2:2 | SEQ4270 | 5.E−04 | 0.7 | DLB | PCED1B-AS1:4 | SEQ5455 | 5.E−04 | 1.9 |
| msAD | lnc-KCNRG-2:2 | SEQ4270 | 8.E−03 | 0.7 | MCI | PCED1B-AS1:7 | SEQ5348 | 4.E−04 | 3.1 |
| FTD | lnc-KCNRG-5:2 | SEQ4075 | 1.E−08 | 0.5 | All AD | PCED1B-AS1:7 | SEQ5348 | 3.E−02 | 1.4 |
| MCI | lnc-KCNRG-5:2 | SEQ4075 | 9.E−05 | 0.6 | MCI | PCF11-AS1:12 | SEQ5841 | 4.E−05 | 0.5 |
| miAD | lnc-KCNRG-5:2 | SEQ4075 | 1.E−03 | 0.6 | FTD | PDCD4-AS1:5 | SEQ5721 | 1.E−04 | 0.6 |
| All AD | lnc-KCNRG-5:2 | SEQ4075 | 2.E−03 | 0.7 | DLB | PDCD4-AS1:6 | SEQ5401 | 1.E−05 | 1.9 |
| msAD | lnc-KCNRG-5:2 | SEQ4075 | 1.E−02 | 0.7 | MCI | PDCD4-AS1:6 | SEQ5401 | 6.E−05 | 1.7 |
| DLB | lnc-KCNT1-1:7 | SEQ5577 | 2.E−04 | 1.7 | FTD | PDCD4-AS1:6 | SEQ5401 | 3.E−04 | 1.5 |
| DLB | lnc-KCNT1-6:1 | SEQ2699 | 1.E−03 | 1.4 | DLB | PIK3CD-AS1:1 | SEQ5793 | 6.E−05 | 1.6 |
| DLB | lnc-KDM3A-1:4 | SEQ0104 | 2.E−03 | 1.4 | DLB | PIK3CD-AS2:10 | SEQ5127 | 6.E−04 | 1.6 |
| DLB | lnc-KDM4C-18:1 | SEQ5474 | 2.E−04 | 0.5 | MCI | PIK3CD-AS2:8 | SEQ5460 | 2.E−04 | 2.0 |
| MCI | lnc-KIAA0319L-1:4 | SEQ4874 | 9.E−04 | 1.8 | DLB | PIK3CD-AS2:8 | SEQ5460 | 3.E−04 | 2.0 |
| All AD | lnc-KIAA0355-1:1 | SEQ4993 | 3.E−02 | 0.8 | DLB | PIK3IP1-AS1:12 | SEQ5029 | 7.E−04 | 1.5 |
| FTD | lnc-KIAA0391-1:1 | SEQ3817 | 3.E−04 | 0.7 | All AD | PIK3IP1-AS1:12 | SEQ5029 | 4.E−02 | 1.2 |
| All AD | lnc-KIAA0391-1:1 | SEQ3817 | 3.E−02 | 0.8 | All AD | PIK3IP1-AS1:3 | SEQ5973 | 2.E−02 | 1.3 |
| msAD | lnc-KIAA0391-1:1 | SEQ3817 | 4.E−02 | 0.8 | MCI | PINK1-AS:2 | SEQ5500 | 2.E−04 | 2.3 |
| FTD | lnc-KIAA0825-1:2 | SEQ4996 | 5.E−08 | 0.5 | All AD | PLBD1-AS1:6 | SEQ3960 | 8.E−03 | 0.7 |
| MCI | lnc-KIAA0825-1:2 | SEQ4996 | 5.E−04 | 0.7 | miAD | PLBD1-AS1:6 | SEQ3960 | 1.E−02 | 0.8 |
| All AD | lnc-KIAA0825-1:2 | SEQ4996 | 2.E−02 | 0.7 | msAD | PLBD1-AS1:6 | SEQ3960 | 2.E−02 | 0.7 |
| MCI | lnc-KIAA1109-1:1 | SEQ5381 | 2.E−04 | 1.6 | miAD | PLBD1-AS1:7 | SEQ4173 | 2.E−04 | 0.8 |
| DLB | lnc-KIAA1109-1:1 | SEQ5381 | 3.E−04 | 1.6 | All AD | PLBD1-AS1:7 | SEQ4173 | 7.E−04 | 0.8 |
| DLB | lnc-KIAA1549L-1:1 | SEQ5427 | 2.E−04 | 1.3 | msAD | PLBD1-AS1:7 | SEQ4173 | 1.E−02 | 0.8 |
| MCI | lnc-KIAA1549L-1:1 | SEQ5427 | 3.E−04 | 1.4 | FTD | POC1B-AS1:8 | SEQ5156 | 5.E−04 | 0.6 |
| All AD | lnc-KIAA1551-13:1 | SEQ3715 | 3.E−02 | 0.8 | FTD | PPP3CB-AS1:4 | SEQ5981 | 2.E−06 | 0.4 |
| msAD | lnc-KIAA1551-13:1 | SEQ3715 | 4.E−02 | 0.8 | DLB | PRKAG2-AS1:1 | SEQ5488 | 1.E−04 | 1.7 |
| All AD | lnc-KIAA1551-2:1 | SEQ4066 | 9.E−03 | 0.7 | MCI | PRKAG2-AS1:1 | SEQ5488 | 2.E−04 | 1.6 |
| msAD | lnc-KIAA1551-2:1 | SEQ4066 | 2.E−02 | 0.7 | FTD | PRKCQ-AS1:11 | SEQ4800 | 1.E−03 | 0.5 |
| FTD | lnc-KIAA1551-4:1 | SEQ4359 | 3.E−06 | 0.5 | MCI | PRKCQ-AS1:3 | SEQ4536 | 3.E−06 | 4.4 |
| All AD | lnc-KIAA1551-4:1 | SEQ4359 | 9.E−04 | 0.6 | FTD | PRKCQ-AS1:3 | SEQ4536 | 1.E−03 | 2.1 |
| msAD | lnc-KIAA1551-4:1 | SEQ4359 | 1.E−03 | 0.7 | DLB | PRKCQ-AS1:3 | SEQ4536 | 2.E−03 | 2.2 |
| miAD | lnc-KIAA1551-4:1 | SEQ4359 | 4.E−03 | 0.6 | MCI | PRKCQ-AS1:36 | SEQ4537 | 3.E−06 | 4.4 |
| msAD | lnc-KIAA1551-6:1 | SEQ3988 | 2.E−02 | 0.8 | FTD | PRKCQ-AS1:36 | SEQ4537 | 1.E−03 | 2.1 |
| All AD | lnc-KIAA1551-6:1 | SEQ3988 | 3.E−02 | 0.8 | DLB | PRKCQ-AS1:36 | SEQ4537 | 2.E−03 | 2.2 |
| FTD | lnc-KIF14-1:2 | SEQ3885 | 1.E−06 | 0.5 | MCI | PRKCQ-AS1:38 | SEQ4661 | 1.E−03 | 2.1 |
| miAD | lnc-KIF14-1:2 | SEQ3885 | 4.E−04 | 0.6 | All AD | PRKCQ-AS1:45 | SEQ5977 | 3.E−02 | 1.4 |
| All AD | lnc-KIF14-1:2 | SEQ3885 | 2.E−03 | 0.6 | MCI | PRKCQ-AS1:53 | SEQ5501 | 2.E−04 | 2.3 |
| msAD | lnc-KIF14-1:2 | SEQ3885 | 3.E−02 | 0.6 | MCI | PRR7-AS1:7 | SEQ5332 | 2.E−04 | 1.7 |
| DLB | lnc-KIRREL1-1:3 | SEQ4531 | 2.E−03 | 1.8 | DLB | PRR7-AS1:7 | SEQ5332 | 4.E−04 | 1.7 |
| msAD | lnc-KLF11-1:4 | SEQ4039 | 2.E−02 | 1.5 | DLB | PRR7-AS1:8 | SEQ4420 | 1.E−03 | 1.4 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| FTD | lnc-KLF12-4:1 | SEQ0938 | 2.E−05 | 0.5 | MCI | PRR7-AS1:8 | SEQ4420 | 2.E−03 | 1.4 |
| FTD | lnc-KLF12-5:1 | SEQ5149 | 5.E−04 | 0.6 | All AD | PSMA3-AS1:12 | SEQ5979 | 4.E−02 | 0.8 |
| FTD | lnc-KLF5-12:1 | SEQ5008 | 5.E−07 | 0.4 | DLB | PSMA3-AS1:16 | SEQ4675 | 1.E−03 | 1.3 |
| All AD | lnc-KLF5-12:1 | SEQ5008 | 4.E−02 | 0.7 | DLB | PSMA3-AS1:27 | SEQ3498 | 1.E−03 | 1.6 |
| DLB | lnc-KLHDC9-5:1 | SEQ4478 | 2.E−03 | 1.3 | DLB | PSMA3-AS1:28 | SEQ5075 | 2.E−04 | 2.5 |
| DLB | lnc-KLHDC9-5:3 | SEQ4458 | 2.E−03 | 2.2 | FTD | PSMA3-AS1:28 | SEQ5075 | 7.E−04 | 2.2 |
| DLB | lnc-KLHDC9-5:4 | SEQ3431 | 5.E−05 | 1.5 | DLB | PSMA3-AS1:36 | SEQ5190 | 5.E−04 | 1.5 |
| MCI | lnc-KLHDC9-5:4 | SEQ3431 | 2.E−03 | 1.3 | FTD | PSMA3-AS1:40 | SEQ3628 | 6.E−06 | 0.5 |
| DLB | lnc-KLHL10-2:1 | SEQ2459 | 2.E−04 | 1.4 | FTD | PSMA3-AS1:41 | SEQ5915 | 2.E−05 | 0.6 |
| DLB | lnc-KLHL25-1:4 | SEQ4938 | 7.E−04 | 1.4 | msAD | PSMB8-AS1:11 | SEQ3937 | 3.E−02 | 0.8 |
| MCI | lnc-KLHL25-1:4 | SEQ4938 | 8.E−04 | 1.4 | MCI | PSMB8-AS1:14 | SEQ5844 | 1.E−05 | 1.6 |
| DLB | lnc-KLHL28-3:5 | SEQ2642 | 5.E−04 | 1.5 | FTD | PSMB8-AS1:14 | SEQ5844 | 1.E−05 | 1.5 |
| DLB | lnc-KLHL36-4:1 | SEQ5382 | 3.E−06 | 1.8 | DLB | PSMB8-AS1:14 | SEQ5844 | 4.E−05 | 1.5 |
| FTD | lnc-KLHL36-4:1 | SEQ5382 | 2.E−04 | 1.5 | MCI | PSMB8-AS1:15 | SEQ5888 | 2.E−05 | 0.2 |
| MCI | lnc-KLHL36-4:1 | SEQ5382 | 3.E−04 | 1.6 | MCI | PSMB8-AS1:16 | SEQ5453 | 3.E−04 | 1.8 |
| FTD | lnc-KLHL8-2:1 | SEQ4998 | 8.E−04 | 0.7 | DLB | PTOV1-AS1:8 | SEQ5212 | 5.E−04 | 1.9 |
| All AD | lnc-KLHL8-2:1 | SEQ4998 | 2.E−02 | 0.8 | DLB | PTOV1-AS2:1 | SEQ4744 | 1.E−03 | 1.4 |
| DLB | lnc-KLHL9-1:1 | SEQ5014 | 4.E−06 | 1.9 | MCI | PVT1:31 | SEQ4534 | 2.E−03 | 2.0 |
| MCI | lnc-KLHL9-1:1 | SEQ5014 | 2.E−04 | 1.6 | DLB | PXN-AS1:15 | SEQ3573 | 9.E−04 | 1.5 |
| miAD | lnc-KLHL9-1:1 | SEQ5014 | 7.E−04 | 1.4 | MCI | PXN-AS1:22 | SEQ4576 | 1.E−03 | 1.7 |
| All AD | lnc-KLHL9-1:1 | SEQ5014 | 4.E−03 | 1.3 | DLB | PXN-AS1:22 | SEQ4576 | 2.E−03 | 1.5 |
| All AD | lnc-KLLN-1:1 | SEQ5017 | 5.E−02 | 0.8 | MCI | PYCARD-AS1:1 | SEQ5028 | 1.E−04 | 1.6 |
| msAD | lnc-KLRD1-1:1 | SEQ3801 | 4.E−02 | 0.7 | FTD | PYCARD-AS1:1 | SEQ5028 | 1.E−04 | 1.5 |
| All AD | lnc-KLRD1-1:1 | SEQ3801 | 4.E−02 | 0.7 | DLB | PYCARD-AS1:1 | SEQ5028 | 7.E−04 | 1.5 |
| FTD | lnc-KMT2E-6:1 | SEQ3952 | 3.E−06 | 0.5 | DLB | RAB11B-AS1:7 | SEQ5538 | 2.E−04 | 1.8 |
| All AD | lnc-KMT2E-6:1 | SEQ3952 | 1.E−02 | 0.6 | DLB | RAD51-AS1:1 | SEQ5132 | 6.E−04 | 1.6 |
| msAD | lnc-KMT2E-6:1 | SEQ3952 | 2.E−02 | 0.7 | DLB | RALY-AS1:13 | SEQ5553 | 2.E−05 | 1.7 |
| All AD | lnc-KPNA2-6:1 | SEQ5021 | 4.E−02 | 1.2 | MCI | RALY-AS1:13 | SEQ5553 | 6.E−05 | 1.6 |
| DLB | lnc-KPNA2-6:13 | SEQ4978 | 9.E−05 | 2.2 | FTD | RALY-AS1:13 | SEQ5553 | 2.E−04 | 1.4 |
| MCI | lnc-KPNA2-6:13 | SEQ4978 | 8.E−04 | 1.8 | All AD | RALY-AS1:13 | SEQ5553 | 4.E−02 | 1.2 |
| FTD | lnc-KPNA2-6:16 | SEQ5883 | 3.E−05 | 0.5 | miAD | RARA-AS1:3 | SEQ4223 | 1.E−02 | 0.8 |
| DLB | lnc-KPNA2-6:25 | SEQ5284 | 5.E−04 | 2.4 | All AD | RARA-AS1:3 | SEQ4223 | 3.E−02 | 0.8 |
| DLB | lnc-KRT80-3:1 | SEQ3433 | 3.E−04 | 1.5 | DLB | RASSF1-AS1:2 | SEQ4746 | 6.E−04 | 1.6 |
| DLB | lnc-KRTAP5-6-3:1 | SEQ4942 | 8.E−04 | 1.5 | FTD | RASSF1-AS1:2 | SEQ4746 | 1.E−03 | 1.3 |
| miAD | lnc-KRTDAP-1:2 | SEQ4276 | 8.E−03 | 0.7 | MCI | RASSF1-AS1:2 | SEQ4746 | 1.E−03 | 1.4 |
| All AD | lnc-KRTDAP-1:2 | SEQ4276 | 1.E−02 | 0.7 | MCI | RBM26-AS1:1 | SEQ4319 | 4.E−06 | 2.0 |
| All AD | lnc-KRTDAP-1:6 | SEQ3868 | 1.E−02 | 0.7 | DLB | RBM26-AS1:1 | SEQ4319 | 1.E−05 | 2.1 |
| msAD | lnc-KRTDAP-1:6 | SEQ3868 | 3.E−02 | 0.7 | FTD | RBM26-AS1:1 | SEQ4319 | 4.E−05 | 1.7 |
| miAD | lnc-KY-4:1 | SEQ0123 | 1.E−02 | 0.6 | All AD | RBM26-AS1:1 | SEQ4319 | 2.E−03 | 1.3 |
| All AD | lnc-KY-4:1 | SEQ0123 | 2.E−02 | 0.7 | msAD | RBM26-AS1:1 | SEQ4319 | 5.E−03 | 1.3 |
| DLB | lnc-LAMA5-1:4 | SEQ3434 | 1.E−04 | 1.5 | miAD | RBM26-AS1:1 | SEQ4319 | 6.E−03 | 1.3 |
| MCI | lnc-LAMA5-1:4 | SEQ3434 | 2.E−03 | 1.3 | DLB | RBM5-AS1:1 | SEQ4691 | 1.E−03 | 1.4 |
| DLB | lnc-LAMA5-4:1 | SEQ3435 | 1.E−03 | 1.4 | DLB | RBM5-AS1:2 | SEQ4489 | 2.E−03 | 1.4 |
| All AD | lnc-LASP1-5:1 | SEQ2438 | 2.E−03 | 0.7 | All AD | RC3H1-IT1:1 | SEQ5983 | 2.E−02 | 0.7 |
| msAD | lnc-LASP1-5:1 | SEQ2438 | 3.E−03 | 0.7 | MCI | RNF219-AS1:16 | SEQ4990 | 3.E−04 | 0.6 |
| miAD | lnc-LASP1-5:1 | SEQ2438 | 8.E−03 | 0.7 | FTD | RNF219-AS1:16 | SEQ4990 | 8.E−04 | 0.6 |
| DLB | lnc-LCMT2-1:1 | SEQ4769 | 1.E−03 | 1.5 | MCI | RPARP-AS1:29 | SEQ4873 | 4.E−05 | 1.8 |
| miAD | lnc-LCOR-4:3 | SEQ3289 | 1.E−02 | 0.8 | DLB | RPARP-AS1:29 | SEQ4873 | 9.E−04 | 1.8 |
| All AD | lnc-LCOR-4:3 | SEQ3289 | 1.E−02 | 0.8 | DLB | RPARP-AS1:31 | SEQ5023 | 7.E−04 | 1.5 |
| All AD | lnc-LCOR-4:4 | SEQ5033 | 4.E−02 | 0.8 | All AD | RPS6KB2-AS1:2 | SEQ5986 | 4.E−02 | 1.2 |
| FTD | lnc-LCP2-3:1 | SEQ5766 | 8.E−05 | 0.7 | DLB | RUSC1-AS1:8 | SEQ5658 | 1.E−04 | 1.5 |
| DLB | lnc-LDAH-4:1 | SEQ4557 | 2.E−03 | 1.3 | DLB | SATB1-AS1:2 | SEQ3794 | 2.E−03 | 1.9 |
| MCI | lnc-LDHAL6A-1:2 | SEQ4830 | 9.E−04 | 1.3 | miAD | SATB1-AS1:2 | SEQ3794 | 7.E−03 | 1.5 |
| DLB | lnc-LEAP2-2:1 | SEQ2749 | 2.E−03 | 1.3 | All AD | SATB1-AS1:2 | SEQ3794 | 8.E−03 | 1.4 |
| FTD | lnc-LEKR1-7:1 | SEQ3831 | 3.E−04 | 0.6 | msAD | SATB1-AS1:2 | SEQ3794 | 4.E−02 | 1.4 |
| msAD | lnc-LEKR1-7:1 | SEQ3831 | 3.E−02 | 0.8 | All AD | SATB1-AS1:90 | SEQ5987 | 4.E−02 | 1.5 |
| All AD | lnc-LEKR1-7:1 | SEQ3831 | 4.E−02 | 0.8 | miAD | SBF2-AS1:7 | SEQ4385 | 3.E−03 | 0.7 |
| FTD | lnc-LEO1-2:1 | SEQ6013 | 1.E−10 | 0.3 | FTD | SDCBP2-AS1:4 | SEQ3711 | 3.E−04 | 2.2 |
| All AD | lnc-LEPROTL1-5:1 | SEQ4388 | 5.E−04 | 1.8 | MCI | SDCBP2-AS1:4 | SEQ3711 | 3.E−04 | 2.4 |
| msAD | lnc-LEPROTL1-5:1 | SEQ4388 | 1.E−03 | 1.8 | DLB | SDCBP2-AS1:4 | SEQ3711 | 5.E−04 | 2.3 |
| miAD | lnc-LEPROTL1-5:1 | SEQ4388 | 2.E−03 | 1.7 | msAD | SDCBP2-AS1:4 | SEQ3711 | 1.E−02 | 1.3 |
| DLB | lnc-LEPROTL1-5:2 | SEQ4449 | 2.E−03 | 1.6 | MCI | SGMS1-AS1:10 | SEQ5536 | 2.E−04 | 1.8 |
| DLB | lnc-LGALS2-1:3 | SEQ5164 | 5.E−05 | 1.6 | All AD | SGMS1-AS1:10 | SEQ5536 | 2.E−02 | 1.3 |
| FTD | lnc-LGALS2-1:3 | SEQ5164 | 5.E−04 | 1.4 | MCI | SLC25A25-AS1:1 | SEQ5910 | 2.E−05 | 2.8 |
| DLB | lnc-LGALS2-5:1 | SEQ4413 | 1.E−03 | 1.4 | DLB | SLC25A25-AS1:14 | SEQ4871 | 6.E−04 | 1.6 |
| MCI | lnc-LGALS2-5:1 | SEQ4413 | 2.E−03 | 1.4 | MCI | SLC25A25-AS1:14 | SEQ4871 | 9.E−04 | 1.7 |
| DLB | lnc-LGALS7B-1:5 | SEQ5114 | 6.E−04 | 1.4 | DLB | SLC25A25-AS1:8 | SEQ5861 | 4.E−05 | 1.8 |
| DLB | lnc-LGALSL-2:9 | SEQ4391 | 2.E−03 | 2.E−02 | DLB | SLC2A1-AS1:4 | SEQ3874 | 1.E−03 | 1.3 |
| MCI | lnc-LHFPL3-4:1 | SEQ5301 | 5.E−05 | 1.7 | miAD | SLC2A1-AS1:4 | SEQ3874 | 5.E−03 | 1.2 |
| DLB | lnc-LHFPL3-4:1 | SEQ5301 | 5.E−05 | 1.6 | All AD | SLC2A1-AS1:4 | SEQ3874 | 6.E−03 | 1.2 |
| FTD | lnc-LHFPL3-4:1 | SEQ5301 | 4.E−04 | 1.3 | msAD | SLC2A1-AS1:4 | SEQ3874 | 3.E−02 | 1.1 |
| DLB | lnc-LHPP-6:5 | SEQ5439 | 3.E−04 | 1.5 | msAD | SLC2A1-AS1:5 | SEQ3691 | 5.E−02 | 1.4 |
| DLB | lnc-LHPP-6:6 | SEQ3436 | 2.E−04 | 1.6 | FTD | SLC8A1-AS1:30 | SEQ4131 | 6.E−05 | 0.5 |
| All AD | lnc-LHPP-8:1 | SEQ3637 | 3.E−02 | 0.8 | miAD | SLC8A1-AS1:30 | SEQ4131 | 1.E−02 | 0.6 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| msAD | lnc-LHPP-8:1 | SEQ3637 | 5.E-02 | 0.8 | All AD | SLC8A1-AS1:30 | SEQ4131 | 3.E-02 | 0.6 |
| All AD | lnc-LIN7A-3:1 | SEQ3437 | 4.E-02 | 0.7 | FTD | SMARCA5-AS1:2 | SEQ5505 | 7.E-06 | 2.6 |
| DLB | lnc-LINC00094-2:1 | SEQ5204 | 8.E-05 | 1.9 | MCI | SMARCA5-AS1:2 | SEQ5505 | 2.E-05 | 2.6 |
| MCI | lnc-LINC00094-2:1 | SEQ5204 | 5.E-04 | 1.7 | DLB | SMARCA5-AS1:2 | SEQ5505 | 9.E-05 | 2.2 |
| DLB | lnc-LINC00672-1:1 | SEQ5376 | 3.E-04 | 1.5 | msAD | SMARCA5-AS1:2 | SEQ5505 | 2.E-04 | 1.7 |
| DLB | lnc-LINC00694-4:1 | SEQ5521 | 2.E-04 | 1.4 | All AD | SMARCA5-AS1:2 | SEQ5505 | 9.E-04 | 1.5 |
| FTD | lnc-LINC02210-CRHR1-2:4 | SEQ5641 | 1.E-04 | 0.5 | DLB | SMCR5:1 | SEQ3037 | 2.E-04 | 2.0 |
| FTD | lnc-LINC02210-CRHR1-3:1 | SEQ5938 | 1.E-05 | 0.4 | DLB | SNAI3-AS1:12 | SEQ5634 | 9.E-05 | 1.9 |
| All AD | lnc-LINS1-3:1 | SEQ5047 | 2.E-02 | 1.2 | MCI | SNAI3-AS1:12 | SEQ5634 | 2.E-04 | 1.9 |
| FTD | lnc-LIPC-2:1 | SEQ4921 | 5.E-05 | 0.4 | FTD | SND1-IT1:4 | SEQ3933 | 1.E-04 | 0.5 |
| MCI | lnc-LIPC-2:1 | SEQ4921 | 8.E-04 | 0.7 | miAD | SND1-IT1:4 | SEQ3933 | 3.E-03 | 0.6 |
| All AD | lnc-LIPC-2:1 | SEQ4921 | 2.E-02 | 0.7 | All AD | SND1-IT1:4 | SEQ3933 | 4.E-03 | 0.6 |
| FTD | lnc-LIPC-3:1 | SEQ4070 | 3.E-05 | 0.4 | msAD | SND1-IT1:4 | SEQ3933 | 2.E-02 | 0.7 |
| MCI | lnc-LIPC-3:1 | SEQ4070 | 6.E-04 | 0.6 | DLB | SND1-IT1:5 | SEQ5050 | 7.E-04 | 1.9 |
| miAD | lnc-LIPC-3:1 | SEQ4070 | 1.E-02 | 0.6 | MCI | SNHG1:1 | SEQ5463 | 3.E-04 | 2.7 |
| All AD | lnc-LIPC-3:1 | SEQ4070 | 3.E-02 | 0.7 | FTD | SNHG1:54 | SEQ5502 | 6.E-10 | 9.7 |
| FTD | lnc-LIPC-4:1 | SEQ5054 | 3.E-06 | 0.4 | MCI | SNHG1:54 | SEQ5502 | 2.E-04 | 2.6 |
| MCI | lnc-LIPC-4:1 | SEQ5054 | 9.E-05 | 0.5 | DLB | SNHG12:16 | SEQ4759 | 1.E-03 | 1.5 |
| All AD | lnc-LIPC-4:1 | SEQ5054 | 2.E-02 | 0.6 | MCI | SNHG12:17 | SEQ5303 | 4.E-05 | 1.8 |
| FTD | lnc-LIPC-5:1 | SEQ4920 | 3.E-05 | 0.4 | DLB | SNHG12:17 | SEQ5303 | 4.E-04 | 1.8 |
| MCI | lnc-LIPC-5:1 | SEQ4920 | 8.E-04 | 0.5 | FTD | SNHG12:17 | SEQ5303 | 4.E-04 | 1.7 |
| All AD | lnc-LIPC-5:1 | SEQ4920 | 4.E-02 | 0.8 | All AD | SNHG12:17 | SEQ5303 | 4.E-02 | 1.2 |
| FTD | lnc-LIPC-6:1 | SEQ3678 | 1.E-07 | 0.3 | All AD | SNHG16:31 | SEQ5992 | 4.E-02 | 0.8 |
| MCI | lnc-LIPC-6:1 | SEQ3678 | 1.E-05 | 0.3 | DLB | SNHG16:4 | SEQ4727 | 1.E-03 | 2.3 |
| DLB | lnc-LIPC-6:1 | SEQ3678 | 6.E-04 | 0.3 | All AD | SNHG16:42 | SEQ5994 | 4.E-02 | 0.8 |
| miAD | lnc-LIPC-6:1 | SEQ3678 | 1.E-02 | 0.6 | DLB | SNHG17:23 | SEQ5489 | 2.E-04 | 1.6 |
| All AD | lnc-LIPC-6:1 | SEQ3678 | 1.E-02 | 0.6 | DLB | SNHG21:11 | SEQ4768 | 1.E-03 | 1.5 |
| msAD | lnc-LIPC-6:1 | SEQ3678 | 5.E-02 | 0.6 | MCI | SNHG22:3 | SEQ5497 | 1.E-04 | 1.8 |
| FTD | lnc-LIX1-1:1 | SEQ5413 | 3.E-04 | 0.6 | DLB | SNHG22:3 | SEQ5497 | 2.E-04 | 1.9 |
| MCI | lnc-LKAAEAR1-2:1 | SEQ5026 | 5.E-04 | 1.5 | DLB | SNHG25:1 | SEQ4827 | 9.E-04 | 1.2 |
| DLB | lnc-LKAAEAR1-2:1 | SEQ5026 | 7.E-04 | 1.5 | MCI | SNHG5:12 | SEQ5542 | 1.E-04 | 0.3 |
| miAD | lnc-LMLN-4:1 | SEQ3734 | 7.E-03 | 0.5 | FTD | SNHG5:12 | SEQ5542 | 2.E-04 | 0.3 |
| All AD | lnc-LMLN-4:1 | SEQ3734 | 9.E-03 | 0.6 | All AD | SNHG6:12 | SEQ5995 | 5.E-02 | 0.8 |
| msAD | lnc-LMLN-4:1 | SEQ3734 | 4.E-02 | 0.7 | DLB | SNHG7:12 | SEQ4121 | 1.E-05 | 1.8 |
| FTD | lnc-LONP2-8:1 | SEQ4310 | 8.E-06 | 0.5 | MCI | SNHG7:12 | SEQ4121 | 2.E-04 | 1.6 |
| miAD | lnc-LONP2-8:1 | SEQ4310 | 7.E-03 | 0.6 | FTD | SNHG7:12 | SEQ4121 | 7.E-04 | 1.4 |
| All AD | lnc-LONP2-8:1 | SEQ4310 | 1.E-02 | 0.7 | All AD | SNHG7:12 | SEQ4121 | 8.E-03 | 1.2 |
| DLB | lnc-LPAR6-4:1 | SEQ5491 | 4.E-04 | 1.6 | msAD | SNHG7:12 | SEQ4121 | 1.E-02 | 1.3 |
| FTD | lnc-LPCAT3-1:1 | SEQ2652 | 5.E-06 | 1.8 | FTD | SNRK-AS1:1 | SEQ5965 | 1.E-08 | 0.5 |
| MCI | lnc-LPCAT3-1:1 | SEQ2652 | 5.E-04 | 1.9 | MCI | SNRK-AS1:1 | SEQ5965 | 4.E-06 | 0.5 |
| DLB | lnc-LPCAT3-1:1 | SEQ2652 | 2.E-03 | 1.8 | FTD | SNRK-AS1:4 | SEQ4006 | 4.E-07 | 2.3 |
| All AD | lnc-LPCAT3-1:1 | SEQ2652 | 2.E-02 | 1.2 | MCI | SNRK-AS1:4 | SEQ4006 | 1.E-06 | 2.7 |
| FTD | lnc-LPIN1-5:1 | SEQ5066 | 1.E-05 | 1.6 | DLB | SNRK-AS1:4 | SEQ4006 | 2.E-05 | 2.3 |
| MCI | lnc-LPIN1-5:1 | SEQ5066 | 2.E-04 | 1.5 | All AD | SNRK-AS1:4 | SEQ4006 | 7.E-03 | 1.3 |
| All AD | lnc-LPIN1-5:1 | SEQ5066 | 4.E-02 | 1.2 | miAD | SNRK-AS1:4 | SEQ4006 | 9.E-03 | 1.3 |
| MCI | lnc-LPIN1-7:2 | SEQ5581 | 4.E-05 | 2.2 | msAD | SNRK-AS1:4 | SEQ4006 | 2.E-02 | 1.3 |
| DLB | lnc-LPIN1-7:2 | SEQ5581 | 2.E-04 | 2.0 | FTD | SOS1-IT1:2 | SEQ4034 | 2.E-07 | 0.4 |
| DLB | lnc-LPIN3-1:1 | SEQ3438 | 3.E-04 | 1.5 | MCI | SOS1-IT1:2 | SEQ4034 | 8.E-05 | 0.5 |
| FTD | lnc-LPP-2:1 | SEQ5070 | 7.E-06 | 0.7 | All AD | SOS1-IT1:2 | SEQ4034 | 1.E-02 | 0.7 |
| All AD | lnc-LPP-2:1 | SEQ5070 | 4.E-02 | 0.8 | msAD | SOS1-IT1:2 | SEQ4034 | 2.E-02 | 0.7 |
| FTD | lnc-LPP-2:2 | SEQ5072 | 3.E-05 | 0.7 | DLB | SPAG5-AS1:8 | SEQ5843 | 4.E-05 | 1.4 |
| All AD | lnc-LPP-2:2 | SEQ5072 | 5.E-02 | 0.8 | DLB | SPAG5-AS1:9 | SEQ4632 | 1.E-03 | 1.5 |
| miAD | lnc-LRFN5-10:1 | SEQ4213 | 1.E-02 | 1.2 | DLB | SSBP3-AS1:2 | SEQ5270 | 5.E-04 | 1.6 |
| All AD | lnc-LRFN5-10:1 | SEQ4213 | 1.E-02 | 1.2 | MCI | STARD7-AS1:5 | SEQ4797 | 1.E-06 | 2.2 |
| DLB | lnc-LRP1-1:1 | SEQ4508 | 2.E-03 | 1.5 | DLB | STARD7-AS1:5 | SEQ4797 | 6.E-06 | 2.2 |
| DLB | lnc-LRP5L-14:1 | SEQ5248 | 5.E-04 | 1.5 | FTD | STARD7-AS1:5 | SEQ4797 | 3.E-05 | 2.0 |
| miAD | lnc-LRRC10-1:1 | SEQ3290 | 2.E-03 | 0.7 | All AD | STARD7-AS1:5 | SEQ4797 | 1.E-04 | 1.5 |
| All AD | lnc-LRRC10-1:1 | SEQ3290 | 5.E-03 | 0.7 | miAD | STARD7-AS1:5 | SEQ4797 | 1.E-04 | 1.5 |
| msAD | lnc-LRRC10-1:1 | SEQ3290 | 4.E-02 | 0.7 | msAD | STARD7-AS1:5 | SEQ4797 | 1.E-03 | 1.4 |
| FTD | lnc-LRRC10-1:2 | SEQ3441 | 3.E-04 | 0.5 | MCI | STXBP5-AS1:16 | SEQ5579 | 2.E-04 | 1.9 |
| miAD | lnc-LRRC10-1:2 | SEQ3441 | 1.E-02 | 0.7 | FTD | SVIL-AS1:37 | SEQ5868 | 4.E-05 | 0.6 |
| All AD | lnc-LRRC10-1:2 | SEQ3441 | 1.E-02 | 0.7 | DLB | TBC1D22A-AS1:1 | SEQ4592 | 2.E-03 | 1.7 |
| msAD | lnc-LRRC10-1:2 | SEQ3441 | 4.E-02 | 0.7 | DLB | TBX2-AS1:17 | SEQ4493 | 2.E-03 | 1.4 |
| FTD | lnc-LRRC31-2:1 | SEQ5058 | 7.E-04 | 0.5 | MCI | TCONS_00000224 | SEQ1048 | 2.E-05 | 0.5 |
| FTD | lnc-LRRC37A3-5:15 | SEQ5603 | 2.E-04 | 0.6 | DLB | TCONS_00000224 | SEQ1048 | 9.E-04 | 0.6 |
| DLB | lnc-LRRC3C-2:1 | SEQ5388 | 1.E-04 | 1.8 | FTD | TCONS_00000416 | SEQ1091 | 6.E-04 | 0.6 |
| MCI | lnc-LRRC3C-2:1 | SEQ5388 | 3.E-04 | 1.7 | FTD | TCONS_00000556 | SEQ1026 | 1.E-04 | 0.6 |
| FTD | lnc-LRRC57-1:1 | SEQ2537 | 5.E-07 | 0.5 | All AD | TCONS_00000556 | SEQ1026 | 3.E-02 | 0.8 |
| MCI | lnc-LRRC57-1:1 | SEQ2537 | 2.E-04 | 0.6 | All AD | TCONS_00000655 | SEQ1050 | 4.E-02 | 0.7 |
| All AD | lnc-LRRC57-1:1 | SEQ2537 | 5.E-02 | 0.7 | miAD | TCONS_00000773 | SEQ1086 | 1.E-02 | 0.6 |
| FTD | lnc-LRRC72-10:2 | SEQ4806 | 1.E-03 | 0.6 | All AD | TCONS_00000773 | SEQ1086 | 3.E-02 | 0.7 |
| All AD | lnc-LRRC72-10:2 | SEQ4806 | 4.E-02 | 0.7 | FTD | TCONS_00005037 | SEQ1136 | 1.E-04 | 0.6 |

TABLE 10-continued 2847 whole blood (Paxgene RNA tube) lncRNAs differentially expressed in MCI group or mild AD group or moderate-to-severe AD group or both of these AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| miAD | lnc-LRRC72-10:4 | SEQ4336 | 5.E-03 | 0.5 | msAD | TCONS_00005060 | SEQ1140 | 5.E-02 | 1.2 |
| FTD | lnc-LRRC7-5:3 | SEQ4376 | 4.E-07 | 0.4 | FTD | TCONS_00005264 | SEQ1123 | 3.E-08 | 0.5 |
| MCI | lnc-LRRC7-5:3 | SEQ4376 | 1.E-03 | 0.6 | FTD | TCONS_00008856 | SEQ1166 | 3.E-04 | 0.5 |
| miAD | lnc-LRRC7-5:3 | SEQ4376 | 3.E-03 | 0.6 | miAD | TCONS_00008879 | SEQ1170 | 1.E-02 | 0.5 |
| All AD | lnc-LRRC7-5:3 | SEQ4376 | 8.E-03 | 0.6 | All AD | TCONS_00008879 | SEQ1170 | 2.E-02 | 0.5 |
| DLB | lnc-LRRC75A-2:1 | SEQ5568 | 2.E-04 | 1.6 | All AD | TCONS_00008889 | SEQ1172 | 2.E-02 | 0.6 |
| MCI | lnc-LRRK1-3:4 | SEQ0242 | 9.E-05 | 2.0 | msAD | TCONS_00008889 | SEQ1172 | 3.E-02 | 0.7 |
| DLB | lnc-LRRK1-3:4 | SEQ0242 | 8.E-04 | 1.7 | DLB | TCONS_00011972 | SEQ1217 | 5.E-04 | 1.3 |
| msAD | lnc-LRRK1-3:4 | SEQ0242 | 2.E-02 | 1.3 | DLB | TCONS_00011994 | SEQ1222 | 6.E-06 | 1.7 |
| All AD | lnc-LRRK1-3:4 | SEQ0242 | 4.E-02 | 1.2 | FTD | TCONS_00012062 | SEQ1202 | 4.E-05 | 0.6 |
| DLB | lnc-LSM11-1:1 | SEQ5011 | 7.E-04 | 1.3 | MCI | TCONS_00012062 | SEQ1202 | 2.E-03 | 0.6 |
| FTD | lnc-LSM14A-2:5 | SEQ5293 | 4.E-04 | 0.6 | FTD | TCONS_00012063 | SEQ1203 | 2.E-07 | 0.3 |
| DLB | lnc-LTBP2-2:1 | SEQ5625 | 2.E-04 | 1.7 | MCI | TCONS_00012063 | SEQ1203 | 2.E-04 | 0.4 |
| DLB | lnc-LTBP3-2:14 | SEQ4404 | 2.E-03 | 1.3 | All AD | TCONS_00012063 | SEQ1203 | 5.E-02 | 0.6 |
| MCI | lnc-LTBP3-2:5 | SEQ4364 | 6.E-06 | 0.2 | FTD | TCONS_00014141 | SEQ1224 | 5.E-08 | 0.4 |
| FTD | lnc-LTBP3-2:5 | SEQ4364 | 6.E-06 | 0.2 | MCI | TCONS_00014141 | SEQ1224 | 2.E-04 | 0.5 |
| miAD | lnc-LTBP3-2:5 | SEQ4364 | 4.E-03 | 0.3 | miAD | TCONS_00014141 | SEQ1224 | 3.E-03 | 0.5 |
| All AD | lnc-LTBP3-2:5 | SEQ4364 | 2.E-02 | 0.4 | FTD | TCONS_00014165 | SEQ1227 | 3.E-04 | 0.7 |
| MCI | lnc-LTC4S-1:1 | SEQ2941 | 2.E-04 | 1.6 | MCI | TCONS_00014211 | SEQ1239 | 1.E-03 | 1.8 |
| FTD | lnc-LUC7L3-6:1 | SEQ4810 | 1.E-03 | 0.7 | DLB | TCONS_00014211 | SEQ1239 | 2.E-03 | 1.8 |
| FTD | lnc-LXN-1:6 | SEQ5400 | 3.E-04 | 0.7 | All AD | TCONS_00014453 | SEQ1256 | 4.E-02 | 0.7 |
| All AD | lnc-LY86-4:8 | SEQ5094 | 4.E-02 | 0.7 | FTD | TCONS_00017372 | SEQ1273 | 6.E-09 | 4.4 |
| All AD | lnc-LYN-2:1 | SEQ5095 | 4.E-02 | 0.8 | MCI | TCONS_00017372 | SEQ1273 | 4.E-05 | 4.2 |
| DLB | lnc-LYPD6-2:1 | SEQ4429 | 8.E-05 | 1.8 | FTD | TCONS_00017375 | SEQ1276 | 2.E-04 | 3.E-08 |
| MCI | lnc-LYPD6-2:1 | SEQ4429 | 2.E-03 | 1.5 | DLB | TCONS_00017375 | SEQ1276 | 2.E-04 | 2.E-08 |
| FTD | lnc-LYPD8-4:1 | SEQ4365 | 1.E-05 | 0.4 | MCI | TCONS_00017375 | SEQ1276 | 7.E-04 | 2.E-08 |
| miAD | lnc-LYPD8-4:1 | SEQ4365 | 4.E-03 | 0.6 | DLB | TCONS_00017376 | SEQ1277 | 2.E-04 | 0.9 |
| All AD | lnc-LYPD8-4:1 | SEQ4365 | 9.E-03 | 0.6 | MCI | TCONS_00017376 | SEQ1277 | 5.E-02 | 0.9 |
| MCI | lnc-LYZL2-5:1 | SEQ4185 | 2.E-03 | 0.7 | msAD | TCONS_00017376 | SEQ1277 | 4.E-02 | 0.9 |
| miAD | lnc-LYZL2-5:1 | SEQ4185 | 1.E-02 | 0.7 | All AD | TCONS_00017376 | SEQ1277 | 5.E-02 | 0.9 |
| All AD | lnc-LYZL2-5:1 | SEQ4185 | 2.E-02 | 0.6 | FTD | TCONS_00019772 | SEQ1301 | 4.E-04 | 0.6 |
| DLB | lnc-M1AP-1:1 | SEQ4974 | 8.E-04 | 1.7 | DLB | TCONS_00019840 | SEQ1292 | 2.E-03 | 1.3 |
| DLB | lnc-M1AP-6:2 | SEQ5390 | 8.E-05 | 1.8 | FTD | TCONS_00019918 | SEQ1308 | 3.E-05 | 0.6 |
| MCI | lnc-M1AP-6:2 | SEQ5390 | 3.E-04 | 1.8 | DLB | TCONS_00021481 | SEQ1342 | 4.E-04 | 1.7 |
| DLB | lnc-M6PR-4:1 | SEQ3969 | 2.E-04 | 1.6 | MCI | TCONS_00021481 | SEQ1342 | 5.E-04 | 1.6 |
| MCI | lnc-M6PR-4:1 | SEQ3969 | 2.E-04 | 1.4 | MCI | TCONS_00023115 | SEQ1352 | 2.E-03 | 0.4 |
| All AD | lnc-M6PR-4:1 | SEQ3969 | 1.E-02 | 1.2 | FTD | TCONS_00023190 | SEQ1369 | 5.E-04 | 0.6 |
| msAD | lnc-M6PR-4:1 | SEQ3969 | 2.E-02 | 1.2 | miAD | TCONS_00023190 | SEQ1369 | 3.E-03 | 0.6 |
| MCI | lnc-MAD2L2-4:1 | SEQ5633 | 2.E-04 | 1.9 | All AD | TCONS_00023190 | SEQ1369 | 9.E-03 | 0.7 |
| MCI | lnc-MAFF-10:1 | SEQ4924 | 8.E-04 | 1.3 | FTD | TCONS_00023372 | SEQ1374 | 9.E-04 | 0.6 |
| DLB | lnc-MAFF-2:1 | SEQ3013 | 9.E-04 | 1.6 | DLB | TCONS_00026558 | SEQ1414 | 9.E-04 | 1.4 |
| MCI | lnc-MAFF-2:1 | SEQ3013 | 2.E-03 | 1.7 | DLB | TCONS_00033649 | SEQ1546 | 1.E-05 | 2.3 |
| MCI | lnc-MAFK-4:3 | SEQ3644 | 2.E-06 | 1.7 | FTD | TCONS_00033649 | SEQ1546 | 4.E-04 | 1.6 |
| DLB | lnc-MAFK-4:3 | SEQ3644 | 6.E-06 | 1.7 | DLB | TCONS_00035022 | SEQ1567 | 2.E-03 | 16.3 |
| FTD | lnc-MAFK-4:3 | SEQ3644 | 3.E-04 | 1.3 | DLB | TCONS_00035023 | SEQ1568 | 2.E-03 | 16.3 |
| msAD | lnc-MAFK-4:3 | SEQ3644 | 5.E-02 | 1.1 | MCI | TCONS_00035024 | SEQ1571 | 4.E-07 | 2.5 |
| All AD | lnc-MAGEB1-2:1 | SEQ3902 | 1.E-02 | 0.7 | DLB | TCONS_00035024 | SEQ1571 | 3.E-06 | 2.4 |
| msAD | lnc-MAGEB1-2:1 | SEQ3902 | 3.E-02 | 0.7 | FTD | TCONS_00035024 | SEQ1571 | 5.E-05 | 1.9 |
| FTD | lnc-MAGEE2-2:1 | SEQ3291 | 4.E-07 | 0.4 | All AD | TCONS_00035024 | SEQ1571 | 4.E-02 | 1.2 |
| MCI | lnc-MAGEE2-2:1 | SEQ3291 | 2.E-03 | 0.5 | All AD | TCONS_00035025 | SEQ1572 | 3.E-02 | 1.2 |
| FTD | lnc-MALRD1-11:1 | SEQ3815 | 4.E-06 | 0.6 | msAD | TCONS_00035027 | SEQ1575 | 2.E-02 | 1.4 |
| All AD | lnc-MALRD1-11:1 | SEQ3815 | 1.E-02 | 0.7 | FTD | TCONS_00035036 | SEQ1586 | 7.E-04 | 0.6 |
| miAD | lnc-MALRD1-11:1 | SEQ3815 | 1.E-02 | 0.7 | MCI | TCONS_00035091 | SEQ1565 | 2.E-02 | 1.8 |
| msAD | lnc-MALRD1-11:1 | SEQ3815 | 4.E-02 | 0.8 | DLB | TCONS_00035091 | SEQ1565 | 6.E-05 | 1.7 |
| msAD | lnc-MAN2B1-1:1 | SEQ3906 | 3.E-02 | 1.3 | FTD | TCONS_00035091 | SEQ1565 | 2.E-04 | 1.5 |
| All AD | lnc-MAN2B1-1:1 | SEQ3906 | 4.E-02 | 1.3 | DLB | TCONS_00035092 | SEQ1569 | 7.E-06 | 2.6 |
| All AD | lnc-MAN2C1-2:3 | SEQ5106 | 3.E-02 | 0.8 | MCI | TCONS_00035092 | SEQ1569 | 9.E-06 | 2.6 |
| FTD | lnc-MANBA-2:9 | SEQ3443 | 3.E-10 | 0.4 | FTD | TCONS_00035092 | SEQ1569 | 1.E-05 | 2.3 |
| MCI | lnc-MANBA-2:9 | SEQ3443 | 8.E-05 | 0.6 | All AD | TCONS_00035092 | SEQ1569 | 1.E-02 | 1.4 |
| miAD | lnc-MANBA-2:9 | SEQ3443 | 6.E-03 | 0.6 | miAD | TCONS_00035092 | SEQ1569 | 1.E-02 | 1.5 |
| All AD | lnc-MANBA-2:9 | SEQ3443 | 7.E-03 | 0.6 | msAD | TCONS_00035092 | SEQ1569 | 3.E-02 | 1.4 |
| msAD | lnc-MANBA-2:9 | SEQ3443 | 4.E-02 | 0.7 | MCI | TCONS_00035093 | SEQ1570 | 6.E-10 | 1.7 |
| FTD | lnc-MANSC4-2:2 | SEQ5685 | 1.E-04 | 0.6 | FTD | TCONS_00035093 | SEQ1570 | 6.E-06 | 1.4 |
| MCI | lnc-MAP1LC3B-1:10 | SEQ5574 | 2.E-04 | 1.6 | DLB | TCONS_00035093 | SEQ1570 | 3.E-05 | 1.5 |
| DLB | lnc-MAP1LC3B-1:9 | SEQ4514 | 2.E-03 | 1.5 | miAD | TCONS_00035093 | SEQ1570 | 1.E-02 | 1.1 |
| All AD | lnc-MAP1LC3B2-14:13 | SEQ5112 | 4.E-02 | 0.7 | All AD | TCONS_00035093 | SEQ1570 | 4.E-02 | 1.1 |
| All AD | lnc-MAP1LC3B2-14:16 | SEQ4227 | 3.E-03 | 0.6 | MCI | TCONS_00035094 | SEQ1573 | 2.E-07 | 2.6 |
| miAD | lnc-MAP1LC3B2-14:16 | SEQ4227 | 6.E-03 | 0.5 | FTD | TCONS_00035094 | SEQ1573 | 5.E-07 | 2.4 |
| msAD | lnc-MAP1LC3B2-14:16 | SEQ4227 | 1.E-02 | 0.6 | DLB | TCONS_00035094 | SEQ1573 | 9.E-06 | 2.3 |
| DLB | lnc-MAP1LC3B2-15:1 | SEQ5337 | 4.E-04 | 1.8 | All AD | TCONS_00035094 | SEQ1573 | 1.E-02 | 1.3 |
| DLB | lnc-MAP2K2-2:3 | SEQ5736 | 9.E-05 | 1.7 | msAD | TCONS_00035094 | SEQ1573 | 4.E-02 | 1.3 |
| MCI | lnc-MAP3K3-2:1 | SEQ3807 | 6.E-07 | 2.5 | FTD | TCONS_00037031 | SEQ1676 | 3.E-04 | 0.5 |
| DLB | lnc-MAP3K3-2:1 | SEQ3807 | 7.E-07 | 2.4 | DLB | TCONS_00037110 | SEQ1641 | 7.E-06 | 1.6 |
| FTD | lnc-MAP3K3-2:1 | SEQ3807 | 2.E-06 | 2.3 | DLB | TCONS_00037198 | SEQ1659 | 6.E-05 | 2.6 |

TABLE 10-continued 2847 whole blood (Paxgene RNA tube) lncRNAs differentially expressed in
MCI group or mild AD group or moderate-to-severe AD group or both of these
AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| All AD | lnc-MAP3K3-2:1 | SEQ3807 | 1.E-02 | 1.3 | msAD | TCONS_00037198 | SEQ1659 | 4.E-02 | 1.4 |
| msAD | lnc-MAP3K3-2:1 | SEQ3807 | 4.E-02 | 1.3 | MCI | TCONS_00037216 | SEQ1662 | 6.E-05 | 0.4 |
| DLB | lnc-MAP3K3-2:5 | SEQ5175 | 5.E-04 | 1.4 | All AD | TCONS_00040803 | SEQ1719 | 4.E-02 | 0.7 |
| DLB | lnc-MAP3K6-1:1 | SEQ4742 | 3.E-04 | 1.5 | DLB | TCONS_00040994 | SEQ1713 | 2.E-05 | 1.8 |
| MCI | lnc-MAP3K6-1:1 | SEQ4742 | 1.E-03 | 1.4 | All AD | TCONS_00040994 | SEQ1713 | 4.E-02 | 1.1 |
| All AD | lnc-MAP3K7-3:3 | SEQ4255 | 8.E-03 | 1.6 | msAD | TCONS_00040994 | SEQ1713 | 5.E-02 | 1.1 |
| msAD | lnc-MAP3K7-3:3 | SEQ4255 | 9.E-03 | 1.7 | DLB | TCONS_00044932 | SEQ1735 | 1.E-06 | 2.0 |
| FTD | lnc-MAP3K8-20:1 | SEQ5064 | 7.E-04 | 0.7 | FTD | TCONS_00045041 | SEQ1769 | 5.E-05 | 0.5 |
| FTD | lnc-MAP3K9-10:2 | SEQ5122 | 7.E-06 | 0.6 | MCI | TCONS_00045041 | SEQ1769 | 9.E-04 | 0.6 |
| All AD | lnc-MAP3K9-10:2 | SEQ5122 | 5.E-02 | 0.8 | FTD | TCONS_00045125 | SEQ1790 | 2.E-07 | 0.6 |
| FTD | lnc-MAP3K9-13:1 | SEQ4811 | 1.E-04 | 0.7 | MCI | TCONS_00045125 | SEQ1790 | 1.E-04 | 0.6 |
| All AD | lnc-MAP3K9-13:1 | SEQ4811 | 3.E-02 | 0.8 | All AD | TCONS_00045125 | SEQ1790 | 3.E-02 | 0.7 |
| All AD | lnc-MAP6-4:10 | SEQ4008 | 8.E-03 | 0.7 | msAD | TCONS_00045125 | SEQ1790 | 4.E-02 | 0.7 |
| miAD | lnc-MAP6-4:10 | SEQ4008 | 1.E-02 | 0.7 | All AD | TCONS_00050017 | SEQ1804 | 3.E-02 | 1.2 |
| msAD | lnc-MAP6-4:10 | SEQ4008 | 2.E-02 | 0.7 | FTD | TCONS_00050224 | SEQ1854 | 8.E-05 | 0.6 |
| miAD | lnc-MAPK13-1:1 | SEQ4156 | 1.E-02 | 0.7 | miAD | TCONS_00050224 | SEQ1854 | 9.E-03 | 0.7 |
| All AD | lnc-MAPK13-1:1 | SEQ4156 | 2.E-02 | 0.8 | All AD | TCONS_00050224 | SEQ1854 | 1.E-02 | 0.7 |
| DLB | lnc-MAPK6-8:3 | SEQ4947 | 8.E-04 | 1.5 | MCI | TCONS_00055681 | SEQ1887 | 3.E-06 | 0.5 |
| All AD | lnc-MARC2-2:1 | SEQ3917 | 8.E-03 | 0.9 | FTD | TCONS_00059297 | SEQ1957 | 1.E-03 | 0.6 |
| miAD | lnc-MARC2-2:1 | SEQ3917 | 9.E-03 | 0.9 | MCI | TCONS_00059378 | SEQ1928 | 4.E-05 | 1.5 |
| msAD | lnc-MARC2-2:1 | SEQ3917 | 3.E-02 | 0.9 | DLB | TCONS_00059378 | SEQ1928 | 2.E-03 | 1.5 |
| DLB | lnc-MARCH10-8:2 | SEQ5669 | 1.E-04 | 1.7 | FTD | TCONS_00059405 | SEQ1944 | 2.E-06 | 0.5 |
| FTD | lnc-MARCH7-1:6 | SEQ4074 | 5.E-05 | 0.7 | FTD | TCONS_00059425 | SEQ1949 | 5.E-05 | 0.5 |
| miAD | lnc-MARCH7-1:6 | SEQ4074 | 1.E-02 | 0.7 | DLB | TCONS_00059492 | SEQ1962 | 3.E-04 | 1.6 |
| All AD | lnc-MARCH7-1:6 | SEQ4074 | 2.E-02 | 0.8 | MCI | TCONS_00059492 | SEQ1962 | 2.E-03 | 1.5 |
| FTD | lnc-MARCH7-3:1 | SEQ3444 | 2.E-07 | 0.5 | MCI | TCONS_00062313 | SEQ1998 | 2.E-04 | 0.5 |
| MCI | lnc-MARCH7-3:1 | SEQ3444 | 2.E-04 | 0.6 | miAD | TCONS_00062327 | SEQ2005 | 7.E-03 | 0.6 |
| All AD | lnc-MARCH7-3:1 | SEQ3444 | 3.E-02 | 0.7 | All AD | TCONS_00062327 | SEQ2005 | 2.E-02 | 0.7 |
| FTD | lnc-MARCH7-4:1 | SEQ3895 | 6.E-05 | 0.6 | All AD | TCONS_00062345 | SEQ2020 | 2.E-02 | 0.7 |
| miAD | lnc-MARCH7-4:1 | SEQ3895 | 7.E-03 | 0.7 | MCI | TCONS_00062359 | SEQ2028 | 3.E-05 | 1.9 |
| All AD | lnc-MARCH7-4:1 | SEQ3895 | 7.E-03 | 0.7 | miAD | TCONS_00062359 | SEQ2028 | 8.E-03 | 1.4 |
| msAD | lnc-MARCH7-4:1 | SEQ3895 | 3.E-02 | 0.7 | All AD | TCONS_00062359 | SEQ2028 | 8.E-03 | 1.3 |
| MCI | lnc-MASTL-6:1 | SEQ2430 | 2.E-04 | 0.6 | msAD | TCONS_00062359 | SEQ2028 | 3.E-02 | 1.3 |
| FTD | lnc-MASTL-7:1 | SEQ4246 | 4.E-06 | 0.6 | msAD | TCONS_00062426 | SEQ2041 | 2.E-03 | 0.5 |
| miAD | lnc-MASTL-7:1 | SEQ4246 | 9.E-03 | 0.7 | All AD | TCONS_00062426 | SEQ2041 | 4.E-03 | 0.6 |
| All AD | lnc-MASTL-7:1 | SEQ4246 | 2.E-02 | 0.7 | FTD | TCONS_00062427 | SEQ2042 | 3.E-07 | 0.2 |
| FTD | lnc-MAVS-3:1 | SEQ2534 | 3.E-08 | 0.5 | DLB | TCONS_00062427 | SEQ2042 | 1.E-05 | 0.2 |
| MCI | lnc-MAVS-3:1 | SEQ2534 | 7.E-06 | 0.5 | FTD | TCONS_00062454 | SEQ2047 | 1.E-04 | 0.6 |
| All AD | lnc-MAVS-3:1 | SEQ2534 | 4.E-03 | 0.7 | All AD | TCONS_00062454 | SEQ2047 | 5.E-02 | 0.7 |
| msAD | lnc-MAVS-3:1 | SEQ2534 | 9.E-03 | 0.7 | DLB | TCONS_00062559 | SEQ1995 | 1.E-03 | 1.4 |
| miAD | lnc-MAVS-3:1 | SEQ2534 | 1.E-02 | 0.7 | DLB | TCONS_00062700 | SEQ2045 | 4.E-04 | 1.3 |
| DLB | lnc-MB-9:1 | SEQ5524 | 2.E-04 | 1.5 | MCI | TCONS_00066312 | SEQ2053 | 2.E-03 | 0.8 |
| msAD | lnc-MBD3L2B-3:1 | SEQ4042 | 2.E-02 | 2.1 | DLB | TCONS_00066327 | SEQ2060 | 1.E-03 | 1.4 |
| All AD | lnc-MBD3L2B-3:1 | SEQ4042 | 4.E-02 | 1.8 | FTD | TCONS_00066357 | SEQ2067 | 1.E-05 | 0.5 |
| FTD | lnc-MBNL1-3:1 | SEQ5764 | 8.E-05 | 0.6 | FTD | TCONS_00066544 | SEQ2098 | 1.E-03 | 0.7 |
| FTD | lnc-MBOAT1-11:1 | SEQ5280 | 7.E-05 | 1.8 | All AD | TCONS_00066544 | SEQ2098 | 3.E-02 | 0.8 |
| MCI | lnc-MBOAT1-11:1 | SEQ5280 | 5.E-04 | 1.8 | FTD | TET2-AS1:5 | SEQ4311 | 2.E-04 | 0.6 |
| All AD | lnc-MBOAT2-2:1 | SEQ4338 | 2.E-03 | 0.7 | miAD | TET2-AS1:5 | SEQ4311 | 1.E-02 | 0.7 |
| miAD | lnc-MBOAT2-2:1 | SEQ4338 | 3.E-03 | 0.6 | All AD | TET2-AS1:5 | SEQ4311 | 2.E-02 | 0.7 |
| msAD | lnc-MBOAT2-2:1 | SEQ4338 | 5.E-03 | 0.7 | miAD | THAP9-AS1:27 | SEQ2178 | 1.E-02 | 0.6 |
| FTD | lnc-MCF2L-2:1 | SEQ5231 | 5.E-04 | 0.7 | All AD | THAP9-AS1:27 | SEQ2178 | 2.E-02 | 0.6 |
| DLB | lnc-MCHR1-1:1 | SEQ5182 | 9.E-05 | 1.5 | msAD | THRIL:2 | SEQ3970 | 2.E-02 | 1.4 |
| MCI | lnc-MCHR1-1:1 | SEQ5182 | 5.E-04 | 1.5 | All AD | THRIL:2 | SEQ3970 | 3.E-02 | 1.3 |
| All AD | lnc-MCL1-1:1 | SEQ3947 | 1.E-02 | 0.8 | FTD | THUMPD3-AS1:16 | SEQ5771 | 7.E-05 | 0.4 |
| msAD | lnc-MCL1-1:1 | SEQ3947 | 3.E-02 | 0.8 | DLB | THUMPD3-AS1:51 | SEQ5758 | 8.E-05 | 2.2 |
| All AD | lnc-MCL1-2:1 | SEQ5138 | 3.E-02 | 0.8 | MCI | TMEM161B-AS1:51 | SEQ4098 | 6.E-06 | 2.5 |
| All AD | lnc-MCL1-3:1 | SEQ5139 | 4.E-02 | 0.7 | FTD | TMEM161B-AS1:51 | SEQ4098 | 6.E-06 | 2.6 |
| FTD | lnc-MCTP2-1:1 | SEQ5748 | 9.E-05 | 0.7 | DLB | TMEM161B-AS1:51 | SEQ4098 | 2.E-05 | 2.5 |
| MCI | lnc-MCTP2-7:4 | SEQ3446 | 3.E-04 | 1.7 | miAD | TMEM161B-AS1:51 | SEQ4098 | 2.E-03 | 1.6 |
| DLB | lnc-MCTP2-7:4 | SEQ3446 | 5.E-04 | 1.8 | All AD | TMEM161B-AS1:51 | SEQ4098 | 2.E-03 | 1.5 |
| msAD | lnc-MCTP2-7:4 | SEQ3446 | 2.E-02 | 1.3 | msAD | TMEM161B-AS1:51 | SEQ4098 | 2.E-02 | 1.4 |
| All AD | lnc-MCTP2-7:4 | SEQ3446 | 2.E-02 | 1.3 | FTD | TMEM161B-AS1:52 | SEQ4308 | 1.E-09 | 0.3 |
| DLB | lnc-MCTS1-2:1 | SEQ2602 | 9.E-04 | 1.3 | MCI | TMEM161B-AS1:52 | SEQ4308 | 4.E-04 | 0.5 |
| All AD | lnc-MDM1-5:1 | SEQ3748 | 1.E-02 | 0.6 | DLB | TMEM161B-AS1:52 | SEQ4308 | 2.E-03 | 0.5 |
| msAD | lnc-MDM1-5:1 | SEQ3748 | 4.E-02 | 0.6 | miAD | TMEM161B-AS1:52 | SEQ4308 | 7.E-03 | 0.5 |
| FTD | lnc-MDM4-8:1 | SEQ0816 | 2.E-04 | 0.7 | All AD | TMEM161B-AS1:52 | SEQ4308 | 2.E-02 | 0.6 |
| All AD | lnc-MED1-4:1 | SEQ5145 | 5.E-02 | 1.1 | MCI | TMEM202-AS1:3 | SEQ4015 | 1.E-05 | 1.7 |
| DLB | lnc-MED26-1:2 | SEQ4633 | 5.E-05 | 1.8 | DLB | TMEM202-AS1:3 | SEQ4015 | 2.E-05 | 1.7 |
| MCI | lnc-MED26-1:2 | SEQ4633 | 1.E-03 | 1.5 | FTD | TMEM202-AS1:3 | SEQ4015 | 9.E-05 | 1.5 |
| DLB | lnc-MED26-1:3 | SEQ4970 | 8.E-04 | 1.6 | All AD | TMEM202-AS1:3 | SEQ4015 | 7.E-03 | 1.3 |
| DLB | lnc-MED9-1:2 | SEQ2833 | 2.E-04 | 1.9 | miAD | TMEM202-AS1:3 | SEQ4015 | 1.E-02 | 1.3 |
| FTD | lnc-MEMO1-4:1 | SEQ4312 | 3.E-08 | 0.5 | msAD | TMEM202-AS1:3 | SEQ4015 | 2.E-02 | 1.3 |
| MCI | lnc-MEMO1-4:1 | SEQ4312 | 2.E-04 | 0.6 | DLB | TMEM9B-AS1:10 | SEQ4722 | 4.E-05 | 2.2 |
| miAD | lnc-MEMO1-4:1 | SEQ4312 | 7.E-03 | 0.7 | MCI | TMEM9B-AS1:10 | SEQ4722 | 1.E-03 | 1.9 |

TABLE 10-continued 2847 whole blood (Paxgene RNA tube) lncRNAs differentially expressed in MCI group or mild AD group or moderate-to-severe AD group or both of these AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| All AD | lnc-MEMO1-4:1 | SEQ4312 | 1.E-02 | 0.7 | DLB | TMEM9B-AS1:7 | SEQ5539 | 2.E-04 | 2.0 |
| DLB | lnc-MEP1B-2:1 | SEQ3447 | 1.E-04 | 2.1 | All AD | TMLHE-AS1:2 | SEQ6006 | 3.E-02 | 0.8 |
| MCI | lnc-MEP1B-2:1 | SEQ3447 | 5.E-04 | 1.8 | DLB | TMPO-AS1:5 | SEQ4339 | 3.E-06 | 1.8 |
| DLB | lnc-MEPCE-1:2 | SEQ5812 | 5.E-05 | 1.4 | MCI | TMPO-AS1:5 | SEQ4339 | 6.E-06 | 1.6 |
| DLB | lnc-MEPE-1:1 | SEQ4345 | 9.E-05 | 1.5 | FTD | TMPO-AS1:5 | SEQ4339 | 7.E-06 | 1.6 |
| All AD | lnc-MEPE-1:1 | SEQ4345 | 2.E-03 | 1.3 | All AD | TMPO-AS1:5 | SEQ4339 | 1.E-03 | 1.3 |
| MCI | lnc-MEPE-1:1 | SEQ4345 | 2.E-03 | 1.3 | miAD | TMPO-AS1:5 | SEQ4339 | 2.E-03 | 1.3 |
| msAD | lnc-MEPE-1:1 | SEQ4345 | 3.E-03 | 1.3 | msAD | TMPO-AS1:5 | SEQ4339 | 5.E-03 | 1.3 |
| miAD | lnc-MEPE-1:1 | SEQ4345 | 5.E-03 | 1.3 | DLB | TNK2-AS1:1 | SEQ5728 | 9.E-05 | 1.5 |
| FTD | lnc-MEST-6:1 | SEQ0124 | 1.E-07 | 0.5 | MCI | TNRC6C-AS1:1 | SEQ3072 | 6.E-06 | 1.8 |
| MCI | lnc-MEST-6:1 | SEQ0124 | 2.E-04 | 0.6 | DLB | TNRC6C-AS1:1 | SEQ3072 | 8.E-05 | 1.8 |
| miAD | lnc-MEST-6:1 | SEQ0124 | 2.E-03 | 0.6 | MCI | TNRC6C-AS1:2 | SEQ3143 | 2.E-05 | 1.6 |
| All AD | lnc-MEST-6:1 | SEQ0124 | 3.E-03 | 0.7 | DLB | TNRC6C-AS1:2 | SEQ3143 | 5.E-04 | 1.6 |
| msAD | lnc-MEST-6:1 | SEQ0124 | 2.E-02 | 0.7 | MCI | TNRC6C-AS1:5 | SEQ3142 | 2.E-05 | 1.7 |
| All AD | lnc-METTL14-3:13 | SEQ5152 | 3.E-02 | 0.8 | DLB | TNRC6C-AS1:5 | SEQ3142 | 2.E-04 | 1.6 |
| DLB | lnc-METTL26-1:2 | SEQ5891 | 2.E-05 | 1.6 | DLB | TPT1-AS1:54 | SEQ2870 | 3.E-05 | 1.8 |
| FTD | lnc-METTL2B-3:1 | SEQ3710 | 9.E-04 | 1.7 | All AD | TRAF3IP2-AS1:35 | SEQ3829 | 4.E-02 | 1.3 |
| MCI | lnc-METTL2B-3:1 | SEQ3710 | 9.E-04 | 1.7 | msAD | TRAF3IP2-AS1:35 | SEQ3829 | 4.E-02 | 1.3 |
| All AD | lnc-METTL2B-3:1 | SEQ3710 | 4.E-02 | 1.3 | FTD | TRG-AS1:1 | SEQ3894 | 7.E-04 | 0.6 |
| msAD | lnc-METTL2B-3:1 | SEQ3710 | 5.E-02 | 1.3 | All AD | TRG-AS1:1 | SEQ3894 | 8.E-03 | 0.6 |
| DLB | lnc-METTL6-5:1 | SEQ5436 | 3.E-04 | 1.5 | miAD | TRG-AS1:1 | SEQ3894 | 9.E-03 | 0.6 |
| All AD | lnc-METTL8-3:1 | SEQ5157 | 3.E-02 | 1.2 | msAD | TRG-AS1:1 | SEQ3894 | 3.E-02 | 0.7 |
| FTD | lnc-MFN1-1:2 | SEQ4058 | 3.E-07 | 0.5 | All AD | TRPM2-AS:7 | SEQ6007 | 3.E-02 | 0.7 |
| MCI | lnc-MFN1-1:2 | SEQ4058 | 2.E-05 | 0.6 | DLB | TSPOAP1-AS1:2 | SEQ5852 | 3.E-05 | 23.4 |
| miAD | lnc-MFN1-1:2 | SEQ4058 | 2.E-04 | 0.6 | MCI | TSPOAP1-AS1:2 | SEQ5852 | 4.E-05 | 13.9 |
| All AD | lnc-MFN1-1:2 | SEQ4058 | 8.E-04 | 0.7 | msAD | TSPOAP1-AS1:9 | SEQ3939 | 3.E-02 | 1.1 |
| msAD | lnc-MFN1-1:2 | SEQ4058 | 2.E-02 | 0.7 | All AD | TSPOAP1-AS1:9 | SEQ3939 | 3.E-02 | 1.1 |
| DLB | lnc-MFNG-1:2 | SEQ5035 | 7.E-04 | 1.5 | FTD | TTC21B-AS1:1 | SEQ4910 | 9.E-04 | 0.7 |
| DLB | lnc-MFSD11-1:2 | SEQ5483 | 2.E-04 | 1.5 | FTD | TTC21B-AS1:2 | SEQ4735 | 8.E-05 | 0.6 |
| DLB | lnc-MFSD13A-2:1 | SEQ3448 | 2.E-04 | 1.3 | All AD | TTC21B-AS1:2 | SEQ4735 | 1.E-04 | 0.6 |
| DLB | lnc-MFSD3-2:1 | SEQ5576 | 2.E-04 | 1.7 | miAD | TTC21B-AS1:2 | SEQ4735 | 3.E-04 | 0.6 |
| FTD | lnc-MFSD4A-1:1 | SEQ2625 | 3.E-04 | 0.6 | msAD | TTC21B-AS1:2 | SEQ4735 | 6.E-04 | 0.6 |
| FTD | lnc-MGARP-3:1 | SEQ5165 | 2.E-04 | 0.7 | MCI | TTC21B-AS1:2 | SEQ4735 | 1.E-03 | 0.6 |
| All AD | lnc-MGARP-3:1 | SEQ5165 | 3.E-02 | 0.8 | All AD | TTC21B-AS1:33 | SEQ4252 | 3.E-03 | 0.7 |
| msAD | lnc-MGAT1-4:4 | SEQ3705 | 5.E-02 | 1.2 | miAD | TTC21B-AS1:33 | SEQ4252 | 6.E-03 | 0.6 |
| DLB | lnc-MGAT5-3:1 | SEQ5166 | 5.E-04 | 1.5 | msAD | TTC21B-AS1:33 | SEQ4252 | 9.E-03 | 0.7 |
| All AD | lnc-MGAT5-3:1 | SEQ5166 | 4.E-02 | 1.2 | All AD | TTN-AS1:4 | SEQ3692 | 4.E-02 | 1.4 |
| DLB | lnc-MGLL-5:1 | SEQ4517 | 2.E-05 | 1.6 | msAD | TTN-AS1:4 | SEQ3692 | 5.E-02 | 1.4 |
| MCI | lnc-MGLL-5:1 | SEQ4517 | 2.E-03 | 1.5 | FTD | TTN-AS1:58 | SEQ5991 | 1.E-06 | 0.5 |
| MCI | lnc-MICA-9:2 | SEQ4955 | 6.E-04 | 1.5 | All AD | TTN-AS1:6 | SEQ4123 | 1.E-02 | 0.6 |
| DLB | lnc-MICA-9:2 | SEQ4955 | 8.E-04 | 1.5 | msAD | TTN-AS1:6 | SEQ4123 | 1.E-02 | 0.6 |
| DLB | lnc-MIEF2-2:1 | SEQ5243 | 5.E-04 | 1.4 | MCI | TUG1:33 | SEQ4063 | 6.E-04 | 1.5 |
| DLB | lnc-MIER3-2:1 | SEQ4681 | 1.E-03 | 1.4 | All AD | TUG1:33 | SEQ4063 | 6.E-03 | 1.3 |
| All AD | lnc-MIER3-2:1 | SEQ4681 | 5.E-02 | 1.1 | miAD | TUG1:33 | SEQ4063 | 1.E-02 | 1.3 |
| FTD | lnc-MIOS-5:2 | SEQ3764 | 8.E-06 | 0.6 | msAD | TUG1:33 | SEQ4063 | 2.E-02 | 1.3 |
| All AD | lnc-MIOS-5:2 | SEQ3764 | 1.E-02 | 0.7 | DLB | TUG1:39 | SEQ5735 | 9.E-05 | 1.6 |
| msAD | lnc-MIOS-5:2 | SEQ3764 | 4.E-02 | 0.7 | DLB | TUG1:40 | SEQ5895 | 2.E-05 | 1.8 |
| DLB | lnc-MIS12-4:1 | SEQ4840 | 9.E-04 | 1.4 | FTD | TUG1:45 | SEQ5840 | 2.E-06 | 0.5 |
| DLB | lnc-MISP3-1:7 | SEQ4619 | 1.E-03 | 1.4 | MCI | TUG1:45 | SEQ5840 | 4.E-05 | 0.5 |
| All AD | lnc-MIXL1-7:1 | SEQ5170 | 5.E-02 | 0.8 | FTD | TUG1:7 | SEQ4607 | 1.E-06 | 0.3 |
| All AD | lnc-MKI67-4:1 | SEQ5171 | 5.E-02 | 0.8 | MCI | TUG1:7 | SEQ4607 | 1.E-06 | 0.3 |
| All AD | lnc-MKI67-8:2 | SEQ5172 | 4.E-02 | 0.7 | DLB | TUG1:7 | SEQ4607 | 1.E-03 | 0.4 |
| MCI | lnc-MKLN1-1:12 | SEQ5004 | 9.E-06 | 2.0 | FTD | UBR5-AS1:10 | SEQ5412 | 3.E-04 | 0.6 |
| DLB | lnc-MKLN1-1:12 | SEQ5004 | 2.E-05 | 1.9 | MCI | UBR5-AS1:4 | SEQ5078 | 9.E-05 | 0.3 |
| FTD | lnc-MKLN1-1:12 | SEQ5004 | 8.E-04 | 1.5 | DLB | UBR5-AS1:4 | SEQ5078 | 1.E-04 | 0.3 |
| FTD | lnc-MLH1-1:1 | SEQ2597 | 8.E-06 | 0.7 | FTD | UBR5-AS1:4 | SEQ5078 | 6.E-04 | 0.3 |
| MCI | lnc-MLH1-1:1 | SEQ2597 | 2.E-04 | 0.8 | All AD | USP3-AS1:11 | SEQ6010 | 3.E-02 | 0.8 |
| All AD | lnc-MLH1-1:1 | SEQ2597 | 7.E-03 | 0.8 | FTD | USP3-AS1:9 | SEQ4289 | 9.E-10 | 0.1 |
| msAD | lnc-MLH1-1:1 | SEQ2597 | 9.E-03 | 0.8 | MCI | USP3-AS1:9 | SEQ4289 | 4.E-04 | 0.2 |
| MCI | lnc-MLLT1-2:1 | SEQ3450 | 5.E-04 | 1.4 | miAD | USP3-AS1:9 | SEQ4289 | 7.E-03 | 0.2 |
| DLB | lnc-MLLT1-2:1 | SEQ3450 | 8.E-04 | 1.4 | DLB | VAC14-AS1:3 | SEQ5572 | 2.E-04 | 1.6 |
| DLB | lnc-MLX-3:1 | SEQ3451 | 4.E-05 | 1.6 | DLB | VASH1-AS1:7 | SEQ4786 | 1.E-03 | 1.7 |
| MCI | lnc-MLX-3:1 | SEQ3451 | 2.E-03 | 1.5 | DLB | VIM-AS1:1 | SEQ3832 | 5.E-05 | 1.5 |
| All AD | lnc-MLX-3:1 | SEQ3451 | 4.E-02 | 1.1 | MCI | VIM-AS1:1 | SEQ3832 | 8.E-05 | 1.5 |
| MCI | lnc-MMP23B-1:1 | SEQ4520 | 2.E-03 | 1.5 | FTD | VIM-AS1:1 | SEQ3832 | 2.E-04 | 1.3 |
| DLB | lnc-MMP23B-4:1 | SEQ4774 | 1.E-03 | 1.5 | All AD | VIM-AS1:1 | SEQ3832 | 2.E-02 | 1.2 |
| FTD | lnc-MOCS2-9:1 | SEQ5832 | 5.E-05 | 0.6 | msAD | VIM-AS1:1 | SEQ3832 | 3.E-02 | 1.2 |
| FTD | lnc-MOV10-2:1 | SEQ2519 | 4.E-04 | 0.5 | FTD | VIM-AS1:11 | SEQ3989 | 1.E-03 | 0.7 |
| All AD | lnc-MOV10-2:1 | SEQ2519 | 3.E-02 | 0.6 | All AD | VIM-AS1:11 | SEQ3989 | 1.E-02 | 0.8 |
| MCI | lnc-MPC1-3:1 | SEQ4672 | 1.E-03 | 0.8 | msAD | VIM-AS1:11 | SEQ3989 | 2.E-02 | 0.9 |
| MCI | lnc-MPLKIP-1:1 | SEQ5848 | 1.E-05 | 1.5 | All AD | VIM-AS1:7 | SEQ3576 | 7.E-03 | 1.2 |
| DLB | lnc-MPLKIP-1:1 | SEQ5848 | 4.E-05 | 1.5 | miAD | VIM-AS1:7 | SEQ3576 | 1.E-02 | 1.2 |
| DLB | lnc-MRNIP-4:1 | SEQ4511 | 2.E-05 | 1.8 | msAD | VIM-AS1:7 | SEQ3576 | 2.E-02 | 1.2 |
| MCI | lnc-MRNIP-4:1 | SEQ4511 | 2.E-03 | 1.5 | DLB | WAC-AS1:1 | SEQ5662 | 1.E-04 | 1.5 |

TABLE 10-continued 2847 whole blood (Paxgene RNA tube) lncRNAs differentially expressed in MCI group or mild AD group or moderate-to-severe AD group or both of these AD groups or FTD group or DLB group as compared to healthy control group.

| Group | lncRNA | SEQ | p-value | FC | Group | lncRNA | SEQ | p-value | FC |
|---|---|---|---|---|---|---|---|---|---|
| DLB | lnc-MRPL11-1:11 | SEQ5481 | 2.E-04 | 1.4 | DLB | WAC-AS1:11 | SEQ4770 | 1.E-03 | 1.5 |
| FTD | lnc-MRPL16-1:1 | SEQ5189 | 4.E-04 | 0.7 | FTD | WAC-AS1:14 | SEQ4892 | 9.E-04 | 0.5 |
| All AD | lnc-MRPL16-1:1 | SEQ5189 | 5.E-02 | 0.8 | DLB | ZBED5-AS1:1 | SEQ4959 | 8.E-04 | 1.6 |
| DLB | lnc-MRPL41-1:1 | SEQ5528 | 2.E-04 | 1.6 | MCI | ZBTB11-AS1:2 | SEQ5006 | 1.E-04 | 2.4 |
| MCI | lnc-MRPL43-2:3 | SEQ3791 | 9.E-06 | 1.6 | DLB | ZBTB11-AS1:2 | SEQ5006 | 1.E-04 | 2.2 |
| DLB | lnc-MRPL43-2:3 | SEQ3791 | 2.E-05 | 1.7 | FTD | ZBTB11-AS1:2 | SEQ5006 | 8.E-04 | 2.1 |
| FTD | lnc-MRPL43-2:3 | SEQ3791 | 4.E-04 | 1.4 | All AD | ZBTB11-AS1:2 | SEQ5006 | 2.E-02 | 1.4 |
| msAD | lnc-MRPL43-2:3 | SEQ3791 | 4.E-02 | 1.2 | FTD | ZFAS1:30 | SEQ4911 | 9.E-04 | 0.7 |
| FTD | lnc-MRPL44-6:2 | SEQ5773 | 7.E-05 | 0.4 | DLB | ZFHX2-AS1:10 | SEQ4957 | 8.E-04 | 1.6 |
| MCI | lnc-MRPL48-1:2 | SEQ5193 | 2.E-07 | 2.1 | FTD | ZMIZ1-AS1:33 | SEQ4236 | 2.E-04 | 0.5 |
| FTD | lnc-MRPL48-1:2 | SEQ5193 | 3.E-04 | 1.6 | miAD | ZMIZ1-AS1:33 | SEQ4236 | 1.E-02 | 0.7 |
| DLB | lnc-MRPL48-1:2 | SEQ5193 | 4.E-04 | 1.7 | All AD | ZMIZ1-AS1:33 | SEQ4236 | 3.E-02 | 0.7 |
| All AD | lnc-MRPL48-1:2 | SEQ5193 | 4.E-02 | 1.1 | miAD | ZNF436-AS1:9 | SEQ4235 | 1.E-02 | 0.6 |
| DLB | lnc-MRPL48-1:3 | SEQ4932 | 8.E-04 | 1.4 | All AD | ZNF436-AS1:9 | SEQ4235 | 3.E-02 | 0.7 |
| DLB | lnc-MRPL58-2:2 | SEQ5615 | 2.E-04 | 1.4 | DLB | ZNF460-AS1:2 | SEQ3955 | 7.E-04 | 1.7 |
| FTD | lnc-MRPS14-1:6 | SEQ2452 | 2.E-04 | 0.7 | msAD | ZNF460-AS1:2 | SEQ3955 | 3.E-02 | 1.3 |
| DLB | lnc-MRPS25-5:2 | SEQ5123 | 6.E-04 | 1.5 | All AD | ZNF460-AS1:2 | SEQ3955 | 4.E-02 | 1.2 |
| MCI | lnc-MRPS5-2:2 | SEQ4304 | 9.E-05 | 2.1 | FTD | ZSCAN16-AS1:12 | SEQ4808 | 1.E-03 | 0.7 |

To further identify lncRNAs differentially expressed in AD patients, whole blood (Paxgene RNA tube) expression in AD patients were compared with non-AD subject groups. 136 lncRNAs were differentially expressed in whole blood (Paxgene RNA tube) of AD patient groups (mild AD+moderate-to-severe AD groups) when compared to non-AD subject groups (either DLB+ FTD groups or DLB+FTD+HC groups), with statistical significance (p value <0.05, Wilcoxon test) and a fold change FC≤0.80 or ≥1.20. The 136 lncRNAs are shown in Table 11.

TABLE 11

136 whole blood (Paxgene RNA tube) lncRNAs differentially expressed in AD patient groups (mild AD + moderate-to-severe AD groups) when compared to non-AD subject groups (either DLB + FTD groups or DLB + FTD + HC groups).

| Group compared to AD | lncRNA | SEQ | p-value | FC | Group compared to AD | lncRNA | SEQ | p-value | FC |
|---|---|---|---|---|---|---|---|---|---|
| NAD | ARRDC3-AS1:3 | SEQ 6042 | 8E-04 | 0.8 | NAD + HC | lnc-LRRC37A3-5:8 | SEQ 3442 | 4E-03 | 0.8 |
| NAD + HC | ARRDC3-AS1:3 | SEQ 6042 | 3E-03 | 0.8 | NAD | lnc-LRRC47-4:4 | SEQ 6118 | 4E-04 | 0.7 |
| NAD + HC | CARS-AS1:1 | SEQ 6047 | 4E-03 | 0.8 | NAD | lnc-MARS-1:1 | SEQ 6068 | 3E-04 | 0.8 |
| NAD | CELF2-AS1:2 | SEQ 6134 | 2E-05 | 0.5 | NAD + HC | lnc-MARS-1:1 | SEQ 6068 | 3E-04 | 0.8 |
| NAD + HC | CFLAR-AS1:21 | SEQ 6090 | 2E-03 | 0.8 | NAD + HC | lnc-NDUFB3-2:1 | SEQ 6043 | 2E-03 | 0.8 |
| NAD + HC | CFLAR-AS1:8 | SEQ 6080 | 2E-03 | 0.8 | NAD | lnc-NPTX1-2:4 | SEQ 6117 | 1E-04 | 0.6 |
| NAD + HC | CSNK1G2-AS1:2 | SEQ 6094 | 2E-03 | 0.8 | NAD + HC | lnc-NPTX1-2:4 | SEQ 6117 | 5E-04 | 0.7 |
| NAD | DLEU2:21 | SEQ 6064 | 7E-05 | 0.7 | NAD | lnc-OR4F29-7:1 | SEQ 6119 | 6E-04 | 0.6 |
| NAD + HC | DLEU2:21 | SEQ 6064 | 1E-03 | 0.8 | NAD + HC | lnc-OR4F29-7:1 | SEQ 6119 | 3E-03 | 0.7 |
| NAD | FAM157C:5 | SEQ 6125 | 2E-04 | 0.6 | NAD | lnc-OTOL 1-5:1 | SEQ 6019 | 8E-05 | 2.3 |
| NAD + HC | FAM157C:5 | SEQ 6125 | 3E-04 | 0.7 | NAD + HC | lnc-OTOL1-5:1 | SEQ 6019 | 2E-04 | 1.9 |
| NAD | FAM198B-AS1:2 | SEQ 6051 | 3E-05 | 0.7 | NAD | lnc-PBX2-1:1 | SEQ 6081 | 3E-04 | 0.7 |
| NAD + HC | FAM198B-AS1:2 | SEQ 6051 | 1E-03 | 0.8 | NAD + HC | lnc-PBX2-1:1 | SEQ 6081 | 3E-04 | 0.8 |
| NAD + HC | ITGB2-AS1:6 | SEQ 6097 | 4E-03 | 0.7 | NAD | lnc-PBX2-1:2 | SEQ 6077 | 3E-04 | 0.7 |
| NAD | JPX:34 | SEQ 6017 | 3E-04 | 2.7 | NAD + HC | lnc-PBX2-1:2 | SEQ 6077 | 4E-04 | 0.8 |
| NAD + HC | LCMT1-AS1:9 | SEQ 2883 | 4E-03 | 0.7 | NAD + HC | lnc-PGAM1-4:1 | SEQ 6066 | 3E-03 | 0.8 |
| NAD | LINC00324:3 | SEQ 6113 | 3E-04 | 0.7 | NAD + HC | lnc-PLCD3-4:8 | SEQ 6112 | 3E-03 | 0.7 |
| NAD | LINC00861:2 | SEQ 6132 | 7E-04 | 0.6 | NAD | lnc-PLCG2-6:1 | SEQ 6095 | 7E-04 | 0.7 |
| NAD + HC | LINC01000:3 | SEQ 6093 | 1E-03 | 0.8 | NAD + HC | lnc-PLEKHG3-1:1 | SEQ 6056 | 3E-03 | 0.8 |
| NAD + HC | LINC01001:1 | SEQ 6128 | 2E-03 | 0.6 | NAD | lnc-RMDN2-11:1 | SEQ 6067 | 2E-04 | 0.7 |
| NAD + HC | LINC01814:2 | SEQ 6071 | 2E-03 | 0.8 | NAD + HC | lnc-RMDN2-11:1 | SEQ 6067 | 2E-03 | 0.8 |
| NAD | lnc-ALDH1A2-9:1 | SEQ 6031 | 4E-04 | 1.5 | NAD | lnc-RNF19A-8:2 | SEQ 6085 | 7E-04 | 0.8 |
| NAD | lnc-ANXA2R-1:25 | SEQ 6121 | 3E-06 | 0.6 | NAD | lnc-ROM1-7:2 | SEQ 6015 | 9E-06 | 3.8 |
| NAD + HC | lnc-ANXA2R-1:25 | SEQ 6121 | 2E-05 | 0.7 | NAD + HC | lnc-ROM1-7:2 | SEQ 6015 | 3E-04 | 2.9 |
| NAD | lnc-ARFGEF2-6:1 | SEQ 6083 | 4E-04 | 0.7 | NAD | lnc-RPEL1-2:1 | SEQ 6102 | 5E-04 | 0.7 |
| NAD + HC | lnc-ARFGEF2-6:1 | SEQ 6083 | 2E-03 | 0.8 | NAD + HC | lnc-RPEL 1-2:1 | SEQ 6102 | 6E-04 | 0.7 |
| NAD | lnc-ATG2A-2:1 | SEQ 6087 | 5E-04 | 0.8 | NAD + HC | lnc-RPLP0-4:4 | SEQ 6060 | 2E-03 | 0.8 |
| NAD | lnc-ATP6V1G3-6:1 | SEQ 6079 | 6E-04 | 0.8 | NAD | lnc-SAG-4:1 | SEQ 6114 | 6E-04 | 0.7 |
| NAD + HC | lnc-B3GNTL1-2:2 | SEQ 6040 | 4E-03 | 0.8 | NAD | lnc-SAMD11-12:2 | SEQ 6021 | 2E-04 | 2.0 |
| NAD | lnc-BCL2L11-6:5 | SEQ 6101 | 2E-04 | 0.7 | NAD + HC | lnc-SAMD11-12:2 | SEQ 6021 | 1E-03 | 1.7 |
| NAD + HC | lnc-BCL2L11-6:5 | SEQ 6101 | 2E-03 | 0.7 | NAD | lnc-SAMD11-15:1 | SEQ 6030 | 4E-04 | 1.5 |
| NAD | lnc-BRD3-7:1 | SEQ 6108 | 4E-05 | 0.6 | NAD + HC | lnc-SAMD11-15:1 | SEQ 6030 | 9E-04 | 1.4 |
| NAD + HC | lnc-BRD3-7:1 | SEQ 6108 | 2E-04 | 0.7 | NAD + HC | lnc-SBDS-19:2 | SEQ 2509 | 3E-03 | 1.5 |
| NAD | lnc-C1QTNF3-AMACR-2:5 | SEQ 6027 | 4E-04 | 1.6 | NAD + HC | lnc-SETD9-6:1 | SEQ 6091 | 1E-03 | 0.8 |
| NAD | lnc-C5orf56-4:1 | SEQ 6082 | 1E-04 | 0.7 | NAD | lnc-SETDB1-1:1 | SEQ 6115 | 4E-04 | 0.7 |
| NAD + HC | lnc-C5orf56-4:1 | SEQ 6082 | 3E-04 | 0.8 | NAD + HC | lnc-SETDB1-1:1 | SEQ 6115 | 6E-04 | 0.7 |

TABLE 11-continued 136 whole blood (Paxgene RNA tube) lncRNAs differentially expressed in AD patient groups (mild AD + moderate-to-severe AD groups) when compared to non-AD subject groups (either DLB + FTD groups or DLB + FTD + HC groups).

| Group compared to AD | lncRNA | SEQ | p-value | FC | Group compared to AD | lncRNA | SEQ | p-value | FC |
|---|---|---|---|---|---|---|---|---|---|
| NAD | lnc-CACNA1B-1:2 | SEQ 6120 | 3E−04 | 0.6 | NAD | lnc-SHC3-5:3 | SEQ 3102 | 6E−04 | 1.9 |
| NAD + HC | lnc-CACNA1B-1:2 | SEQ 6120 | 1E−03 | 0.7 | NAD | lnc-SLC29A4-1:2 | SEQ 6052 | 5E−04 | 0.8 |
| NAD | lnc-CACNA1B-1:4 | SEQ 6122 | 3E−04 | 0.6 | NAD + HC | lnc-SLC29A4-1:2 | SEQ 6052 | 2E−03 | 0.8 |
| NAD + HC | lnc-CACNA1B-1:4 | SEQ 6122 | 1E−03 | 0.7 | NAD | lnc-SLC35F5-3:9 | SEQ 6022 | 7E−04 | 1.9 |
| NAD + HC | lnc-CAND2-2:5 | SEQ 3083 | 2E−03 | 0.8 | NAD + HC | lnc-SLC35F5-3:9 | SEQ 6022 | 1E−03 | 1.7 |
| NAD + HC | lnc-CAND2-2:6 | SEQ 3084 | 2E−03 | 0.8 | NAD | lnc-SLC5A10-3:2 | SEQ 6133 | 3E−04 | 0.5 |
| NAD | lnc-CATSPER3-2:10 | SEQ 6104 | 5E−04 | 0.7 | NAD | lnc-SNX11-10:2 | SEQ 6024 | 5E−04 | 1.8 |
| NAD | lnc-CDC42BPB-4:1 | SEQ 3357 | 3E−04 | 0.8 | NAD + HC | lnc-SNX11-10:2 | SEQ 6024 | 8E−04 | 1.7 |
| NAD | lnc-CDC42BPB-4:4 | SEQ 6050 | 3E−04 | 0.8 | NAD | lnc-SPATA32-2:12 | SEQ 6109 | 1E−04 | 0.7 |
| NAD + HC | lnc-CDC42BPB-4:4 | SEQ 6050 | 2E−03 | 0.8 | NAD + HC | lnc-SPATA32-2:12 | SEQ 6109 | 1E−04 | 0.7 |
| NAD | lnc-CDHR4-5:2 | SEQ 6089 | 5E−04 | 0.8 | NAD + HC | lnc-STX4-1:4 | SEQ 6075 | 3E−03 | 0.8 |
| NAD | lnc-CDIPT-1:1 | SEQ 6048 | 5E−04 | 0.7 | NAD | lnc-SYNPO-6:1 | SEQ 6123 | 1E−04 | 0.7 |
| NAD + HC | lnc-CDIPT-1:1 | SEQ 6048 | 4E−03 | 0.8 | NAD | lnc-SYT2-4:1 | SEQ 6107 | 2E−04 | 0.7 |
| NAD + HC | lnc-CDIPT-1:5 | SEQ 6028 | 5E−04 | 1.5 | NAD | lnc-TARDBP-5:3 | SEQ 6131 | 5E−04 | 0.6 |
| NAD | lnc-CDIPT-1:5 | SEQ 6028 | 7E−04 | 1.6 | NAD | lnc-TCF19-1:103 | SEQ 6130 | 6E−04 | 0.6 |
| NAD + HC | lnc-CEBPB-13:13 | SEQ 6070 | 3E−03 | 0.8 | NAD | lnc-THTPA-2:29 | SEQ 6016 | 8E−05 | 2.7 |
| NAD + HC | lnc-CEBPG-4:1 | SEQ 6069 | 2E−03 | 0.8 | NAD + HC | lnc-THTPA-2:29 | SEQ 6016 | 2E−04 | 2.2 |
| NAD | lnc-CEL-4:1 | SEQ 6032 | 7E−04 | 1.5 | NAD + HC | lnc-TLE3-6:8 | SEQ 6035 | 3E−03 | 1.3 |
| NAD + HC | lnc-CHIC1-2:1 | SEQ 6026 | 1E−03 | 1.7 | NAD + HC | lnc-TMEM150A-4:2 | SEQ 6046 | 4E−03 | 0.8 |
| NAD + HC | lnc-CLLU1-2:6 | SEQ 3284 | 1E−04 | 12 | NAD + HC | lnc-TMEM181-1:1 | SEQ 6084 | 2E−03 | 0.8 |
| NAD | lnc-CLLU1-2:6 | SEQ 3284 | 2E−04 | 18 | NAD | lnc-TREM2-1:1 | SEQ 6029 | 1E−04 | 1.5 |
| NAD + HC | lnc-CNTRL-6:31 | SEQ 6023 | 3E−03 | 1.8 | NAD | lnc-TRMT61B-5:6 | SEQ 6103 | 9E−05 | 0.7 |
| NAD + HC | lnc-CTXN1-6:1 | SEQ 3096 | 3E−03 | 0.8 | NAD + HC | lnc-TRMT61B-5:6 | SEQ 6103 | 2E−04 | 0.7 |
| NAD | lnc-DDX39A-4:1 | SEQ 6045 | 3E−04 | 0.8 | NAD | lnc-UGT2B28-1:2 | SEQ 1001 | 4E−04 | 1.8 |
| NAD + HC | lnc-DDX39A-4:1 | SEQ 6045 | 3E−03 | 0.8 | NAD + HC | lnc-UGT2B28-1:2 | SEQ 1001 | 2E−03 | 1.7 |
| NAD | lnc-DDX49-1:1 | SEQ 2759 | 3E−04 | 0.8 | NAD | lnc-UNC93B1-1:8 | SEQ 6092 | 6E−05 | 0.8 |
| NAD + HC | lnc-DDX49-1:1 | SEQ 2759 | 3E−03 | 0.9 | NAD + HC | lnc-WASHC3-2:3 | SEQ 6073 | 3E−03 | 0.8 |
| NAD | lnc-DEPTOR-2:1 | SEQ 6037 | 4E−04 | 1.3 | NAD | lnc-WDR81-6:1 | SEQ 6055 | 8E−04 | 0.7 |
| NAD | lnc-DGKE-7:1 | SEQ 6062 | 3E−04 | 0.7 | NAD + HC | lnc-WDR81-6:1 | SEQ 6055 | 3E−03 | 0.8 |
| NAD + HC | lnc-DGKE-7:1 | SEQ 6062 | 4E−03 | 0.8 | NAD + HC | lnc-WSB1-1:1 | SEQ 6054 | 2E−03 | 0.8 |
| NAD + HC | lnc-DHRS7B-1:10 | SEQ 6041 | 1E−03 | 0.8 | NAD + HC | lnc-ZFP57-21:6 | SEQ 6099 | 3E−03 | 0.7 |
| NAD | lnc-EIF4H-1:1 | SEQ 6053 | 1E−04 | 0.7 | NAD | lnc-ZNF705B-1:6 | SEQ 6086 | 7E−04 | 0.7 |
| NAD + HC | lnc-EIF4H-1:1 | SEQ 6053 | 8E−04 | 0.8 | NAD + HC | lnc-ZNF705B-1:6 | SEQ 6086 | 3E−03 | 0.8 |
| NAD | lnc-EPHB1-1:1 | SEQ 6129 | 1E−04 | 0.6 | NAD | lnc-ZRANB1-7:1 | SEQ 6039 | 6E−04 | 0.8 |
| NAD + HC | lnc-FANCI-5:3 | SEQ 6044 | 3E−03 | 0.8 | NAD + HC | lnc-ZRANB1-7:1 | SEQ 6039 | 2E−03 | 0.8 |
| NAD | lnc-FKBP6-4:1 | SEQ 3394 | 8E−04 | 0.8 | NAD + HC | MALAT1:17 | SEQ 6076 | 2E−03 | 0.8 |
| NAD + HC | lnc-FKBP6-4:1 | SEQ 3394 | 3E−03 | 0.8 | NAD + HC | MIR22HG:36 | SEQ 6038 | 2E−03 | 0.9 |
| NAD + HC | lnc-GABBR1-1:1 | SEQ 6036 | 2E−03 | 1.3 | NAD + HC | MIR4435-2HG:29 | SEQ 6074 | 4E−03 | 0.8 |
| NAD | lnc-GINS2-2:6 | SEQ 6096 | 2E−04 | 0.7 | NAD | MME-AS1:1 | SEQ 6106 | 1E−04 | 0.6 |
| NAD + HC | lnc-GINS2-2:6 | SEQ 6096 | 4E−03 | 0.7 | NAD + HC | MME-AS1:1 | SEQ 6106 | 2E−03 | 0.7 |
| NAD + HC | lnc-GPR20-3:6 | SEQ 6105 | 3E−03 | 0.7 | NAD | NALT1:14 | SEQ 6127 | 7E−04 | 0.7 |
| NAD + HC | lnc-GPR68-1:1 | SEQ 6088 | 2E−03 | 0.8 | NAD | NUTM2A-AS1:16 | SEQ 6110 | 2E−04 | 0.6 |
| NAD | lnc-GTPBP1-4:1 | SEQ 6072 | 3E−04 | 0.7 | NAD + HC | NUTM2A-AS1:16 | SEQ 6110 | 1E−03 | 0.7 |
| NAD + HC | lnc-GTPBP1-4:1 | SEQ 6072 | 6E−04 | 0.8 | NAD + HC | PCBP1-AS1:170 | SEQ 6098 | 4E−03 | 0.7 |
| NAD | lnc-HLA-B-2:12 | SEQ 6116 | 4E−06 | 0.6 | NAD + HC | PCBP1-AS1:27 | SEQ 6100 | 3E−03 | 0.7 |
| NAD + HC | lnc-HLA-B-2:12 | SEQ 6116 | 9E−05 | 0.7 | NAD + HC | RARA-AS1:2 | SEQ 6049 | 2E−03 | 0.8 |
| NAD + HC | lnc-HYAL3-1:1 | SEQ 6065 | 8E−04 | 0.8 | NAD | SNHG10:11 | SEQ 6078 | 3E−04 | 0.8 |
| NAD | lnc-IL10-1:1 | SEQ 6126 | 3E−04 | 0.7 | NAD | SNHG22:6 | SEQ 6034 | 7E−04 | 1.4 |
| NAD | lnc-IL31RA-2:1 | SEQ 2557 | 8E−04 | 0.7 | NAD + HC | SNHG7:16 | SEQ 6124 | 4E−04 | 0.7 |
| NAD | lnc-INSM2-8:1 | SEQ 6033 | 4E−04 | 1.4 | NAD | SNHG7:16 | SEQ 6124 | 4E−04 | 0.6 |
| NAD + HC | lnc-IRF1-2:5 | SEQ 6058 | 4E−03 | 0.8 | NAD + HC | TCONS_00011974 | SEQ 1218 | 3E−03 | 0.8 |
| NAD | lnc-ISYNA1-2:1 | SEQ 6063 | 3E−04 | 0.8 | NAD | TCONS_00017370 | SEQ 1271 | 4E−05 | 103 |
| NAD + HC | lnc-ISYNA1-2:1 | SEQ 6063 | 2E−03 | 0.8 | NAD + HC | TCONS_00017370 | SEQ 1271 | 3E−03 | 66 |
| NAD + HC | lnc-KIAA1551-3:1 | SEQ 6061 | 2E−03 | 0.8 | NAD + HC | TCONS_00017373 | SEQ 1274 | 2E−03 | 1.5 |
| NAD | lnc-KLHDC7B-5:2 | SEQ 6111 | 7E−04 | 0.7 | NAD | XIST:27 | SEQ 6020 | 4E−04 | 2.1 |
| NAD + HC | lnc-LAX1-4:1 | SEQ 6059 | 4E−03 | 0.8 | NAD + HC | XIST:27 | SEQ 6020 | 1E−03 | 1.8 |
| NAD | lnc-LGALS2-1:2 | SEQ 6057 | 3E−04 | 0.8 | NAD + HC | XIST:47 | SEQ 6025 | 3E−03 | 1.7 |
| NAD + HC | lnc-LGALS2-1:2 | SEQ 6057 | 2E−03 | 0.8 | NAD | ZNF529-AS1:19 | SEQ 6018 | 3E−05 | 2.4 |

Brain-enriched lncRNAs: Out of the 10122 lncRNAs sequenced by the invention in the AD and control brains and having an expression level >5 CPM (median), 860 lncRNAs showed an expression level 2-fold higher in the brain as compared to peripheral organs lung, ovary, colon, prostate, breast, liver, bladder, kidney, skin, heart, muscle. The 860 lncRNAs are shown in Table 12.

TABLE 12

860 brain-enriched lncRNAs with an expression level in the brain at least 2-fold higher than that in 12 peripheral organs.

| lncRNA | SEQ | Ratio Br/org |
|---|---|---|
| TCONS_00005325 | SEQ1141 | 7.7E+01 |
| TCONS_00035021 | SEQ1566 | 4.0E+00 |
| TCONS_00035024 | SEQ1571 | 1.9E+01 |
| TCONS_00035022 | SEQ1567 | 4.6E+32 |
| TCONS_00012059 | SEQ1200 | 1.2E+03 |
| TCONS_00045364 | SEQ1785 | 3.7E+00 |
| TCONS_00050012 | SEQ1801 | 6.7E+02 |
| TCONS_00035023 | SEQ1568 | 6.9E+04 |
| TCONS_00012060 | SEQ1201 | 5.6E+02 |
| TCONS_00035090 | SEQ1564 | 4.8E+00 |
| TCONS_00035091 | SEQ1565 | 1.3E+01 |
| TCONS_00050014 | SEQ1803 | 1.2E+03 |
| TCONS_00035094 | SEQ1573 | 2.7E+01 |
| TCONS_00035092 | SEQ1569 | 3.4E+02 |
| TCONS_00035093 | SEQ1570 | 4.5E+00 |
| TCONS_00012009 | SEQ1185 | 3.2E+01 |
| TCONS_00045125 | SEQ1790 | 1.1E+01 |
| TCONS_00024864 | SEQ1388 | 5.0E+01 |
| lnc-SP110-8:2 | SEQ6135 | 9.6E+02 |
| MEG3:21 | SEQ6136 | 2.0E+02 |
| lnc-CCDC150-6:1 | SEQ6137 | 1.8E+02 |
| lnc-ZNF45-2:1 | SEQ6138 | 1.7E+02 |
| NUTM2B-AS1:31 | SEQ6139 | 1.5E+02 |
| lnc-HMBS-1:1 | SEQ6140 | 1.2E+02 |
| TMEM5-AS1:2 | SEQ6141 | 9.4E+01 |
| lnc-ZNF583-4:2 | SEQ6142 | 9.2E+01 |
| lnc-LYRM2-2:1 | SEQ6143 | 6.5E+01 |
| lnc-TBX2-4:2 | SEQ6144 | 6.5E+01 |
| lnc-NAA50-3:1 | SEQ2266 | 6.1E+01 |
| lnc-HINFP-1:1 | SEQ6145 | 5.9E+01 |
| MIR4458HG:7 | SEQ6146 | 4.8E+01 |
| lnc-SLC25A44-1:2 | SEQ6147 | 4.4E+01 |
| lnc-SEPT5-1:4 | SEQ6148 | 4.2E+01 |
| lnc-UBE4A-1:1 | SEQ6149 | 4.1E+01 |
| lnc-RP11-334E6.3.1-2:1 | SEQ6150 | 4.0E+01 |
| lnc-GBP5-2:6 | SEQ6151 | 4.0E+01 |
| lnc-FAM49B-5:1 | SEQ6152 | 4.0E+01 |
| STXBP5-AS1:2 | SEQ6153 | 4.0E+01 |
| lnc-ROBO3-2:2 | SEQ6154 | 3.9E+01 |
| lnc-ZNF91-4:4 | SEQ6155 | 3.9E+01 |
| lnc-ATRNL1-1:1 | SEQ6156 | 3.7E+01 |
| lnc-MAPK8IP1-3:1 | SEQ6157 | 3.5E+01 |
| LINC01024:12 | SEQ6158 | 3.4E+01 |
| lnc-CSNK2A2-2:2 | SEQ6159 | 3.2E+01 |
| lnc-LPL-4:2 | SEQ6160 | 3.1E+01 |
| lnc-TBL1XR1-17:1 | SEQ2374 | 3.1E+01 |
| lnc-POM121L2-2:1 | SEQ2133 | 2.8E+01 |
| lnc-MBOAT2-5:1 | SEQ6161 | 2.8E+01 |
| lnc-CDC27-7:1 | SEQ6162 | 2.7E+01 |
| lnc-RP11-345P4.5.1-1:1 | SEQ6163 | 2.7E+01 |
| lnc-PNPLA8-2:8 | SEQ6164 | 2.5E+01 |
| lnc-CYP20A1-1:3 | SEQ6165 | 2.5E+01 |
| lnc-CTD-2117L12.1.1-4:4 | SEQ6166 | 2.5E+01 |
| lnc-KNG1-2:3 | SEQ6167 | 2.4E+01 |
| lnc-SNAP25-3:1 | SEQ6168 | 2.4E+01 |
| UBA6-AS1:10 | SEQ6169 | 2.3E+01 |
| EIF3J-AS1:2 | SEQ6170 | 2.3E+01 |
| SLC25A25-AS1:16 | SEQ6171 | 2.2E+01 |
| lnc-UQCRH-1:3 | SEQ6172 | 2.1E+01 |
| lnc-DLX1-2:5 | SEQ6173 | 2.0E+01 |
| SUCLG2-AS1:5 | SEQ6174 | 2.0E+01 |
| lnc-ARSG-1:1 | SEQ6175 | 1.8E+01 |
| lnc-COX17-2:2 | SEQ6176 | 1.8E+01 |
| lnc-TRIM26-2:8 | SEQ6177 | 1.8E+01 |
| lnc-RAB27A-1:4 | SEQ6178 | 1.8E+01 |
| TP73-AS1:23 | SEQ6179 | 1.8E+01 |
| lnc-VPREB1-7:6 | SEQ6180 | 1.7E+01 |
| RNF219-AS1:4 | SEQ6181 | 1.7E+01 |
| lnc-BRAF-2:1 | SEQ6182 | 1.7E+01 |
| lnc-TPTE2-4:1 | SEQ2431 | 1.5E+01 |
| MYLK-AS1:1 | SEQ6183 | 1.5E+01 |
| lnc-UQCRH-1:1 | SEQ6184 | 1.5E+01 |
| lnc-GPR39-9:1 | SEQ2704 | 1.4E+01 |
| lnc-TRIM26-2:24 | SEQ6185 | 1.4E+01 |
| lnc-EPHA4-4:1 | SEQ6186 | 1.4E+01 |
| lnc-LSM5-2:1 | SEQ6187 | 1.4E+01 |
| lnc-MLST8-2:6 | SEQ6188 | 1.4E+01 |
| NCBP2-AS2:1 | SEQ6189 | 1.3E+01 |
| LIMD1-AS1:3 | SEQ6190 | 1.3E+01 |
| PINK1-AS:1 | SEQ2712 | 1.3E+01 |
| lnc-BRWD1-2:2 | SEQ6191 | 1.3E+01 |
| lnc-FAM200B-1:5 | SEQ6192 | 1.3E+01 |
| lnc-ARL6IP4-1:10 | SEQ6193 | 1.3E+01 |
| lnc-TMEM189-UBE2V1-4:5 | SEQ6194 | 1.3E+01 |
| lnc-ARL16-2:2 | SEQ6195 | 1.3E+01 |
| lnc-NAGA-2:1 | SEQ6196 | 1.3E+01 |
| lnc-LPCAT1-3:23 | SEQ6197 | 1.3E+01 |
| lnc-NEDD8-MDP1-1:1 | SEQ6198 | 1.2E+01 |
| LIFR-AS1:3 | SEQ6199 | 1.2E+01 |
| lnc-NEK3-1:8 | SEQ6200 | 1.2E+01 |
| lnc-KCNE4-7:1 | SEQ2466 | 1.2E+01 |
| lnc-FAM200B-1:11 | SEQ6201 | 1.2E+01 |
| lnc-CDC42SE2-1:10 | SEQ2613 | 1.2E+01 |
| lnc-TM9SF2-8:1 | SEQ6202 | 1.2E+01 |
| MIR4458HG:6 | SEQ6203 | 1.2E+01 |
| lnc-DCTN3-1:3 | SEQ6204 | 1.1E+01 |
| lnc-PAPLN-3:1 | SEQ6205 | 1.1E+01 |
| lnc-RP11-1035H13.3.1-1:3 | SEQ6206 | 1.1E+01 |
| lnc-NDUFS1-2:2 | SEQ6207 | 1.1E+01 |
| LINC00630:8 | SEQ6208 | 1.1E+01 |
| lnc-ZNF449-3:5 | SEQ2420 | 1.1E+01 |
| lnc-ZNF449-3:4 | SEQ2421 | 1.1E+01 |
| PEG3-AS1:1 | SEQ2398 | 1.1E+01 |
| lnc-XRRA1-1:3 | SEQ6209 | 1.0E+01 |
| lnc-USP13-5:1 | SEQ6210 | 1.0E+01 |
| lnc-FAM104A-2:1 | SEQ2542 | 1.0E+01 |
| lnc-CPO-2:1 | SEQ6211 | 1.0E+01 |
| lnc-KBTBD6-2:1 | SEQ2349 | 1.0E+01 |
| lnc-GPC2-2:7 | SEQ6212 | 9.7E+00 |
| lnc-POLK-3:1 | SEQ6213 | 9.6E+00 |
| lnc-INO80B-1:2 | SEQ6214 | 9.6E+00 |
| lnc-ZSCAN10-3:1 | SEQ6215 | 9.4E+00 |
| lnc-RASA1-13:5 | SEQ6216 | 9.4E+00 |
| lnc-PRMT5-1:2 | SEQ6217 | 9.4E+00 |
| lnc-CPOX-1:1 | SEQ6218 | 9.4E+00 |
| lnc-VEPH1-2:1 | SEQ6219 | 9.3E+00 |
| lnc-RPAIN-2:1 | SEQ6220 | 9.3E+00 |
| lnc-SNX20-5:3 | SEQ2643 | 9.3E+00 |
| RNF219-AS1:16 | SEQ4990 | 9.2E+00 |
| lnc-C9orf123-8:2 | SEQ6221 | 9.1E+00 |
| lnc-SLC5A2-1:4 | SEQ2622 | 9.1E+00 |
| lnc-GDPD4-7:1 | SEQ6223 | 9.0E+00 |
| lnc-PRKD2-2:1 | SEQ6224 | 9.0E+00 |
| lnc-C18orf54-3:4 | SEQ6225 | 9.0E+00 |
| lnc-AGPHD1-1:6 | SEQ6226 | 9.0E+00 |
| lnc-NPR3-3:5 | SEQ6227 | 8.9E+00 |
| lnc-CBWD5-2:8 | SEQ6228 | 8.9E+00 |
| lnc-NUDT3-1:2 | SEQ6229 | 8.8E+00 |
| lnc-VSTM5-1:13 | SEQ2419 | 8.7E+00 |
| LINC00630:12 | SEQ6230 | 8.7E+00 |
| lnc-SLMO2-3:1 | SEQ6231 | 8.7E+00 |
| lnc-DPH5-2:7 | SEQ6232 | 8.6E+00 |
| lnc-SCN4B-2:3 | SEQ6233 | 8.5E+00 |
| lnc-NDUFA6-1:1 | SEQ6234 | 8.5E+00 |
| RAB11B-AS1:1 | SEQ6235 | 8.5E+00 |
| lnc-LRRC37A2-2:3 | SEQ6236 | 8.4E+00 |
| lnc-PAQR7-1:1 | SEQ6237 | 8.3E+00 |
| lnc-POLR2I-1:2 | SEQ6238 | 8.3E+00 |

TABLE 12-continued 860 brain-enriched lncRNAs with an expression level in the brain at least 2-fold higher than that in 12 peripheral organs.

| lncRNA | SEQ | Ratio Br/org |
|---|---|---|
| lnc-H2AFZ-1:4 | SEQ6239 | 8.2E+00 |
| SVIL-AS1:4 | SEQ6240 | 8.1E+00 |
| lnc-DCUN1D3-1:5 | SEQ6241 | 8.1E+00 |
| lnc-PRR4-1:2 | SEQ6242 | 8.0E+00 |
| MAGI2-AS3:13 | SEQ6243 | 8.0E+00 |
| lnc-FANCM-8:3 | SEQ2291 | 7.9E+00 |
| lnc-CRLF1-2:1 | SEQ6244 | 7.8E+00 |
| lnc-PPP4C-1:1 | SEQ6245 | 7.7E+00 |
| lnc-RNF187-2:2 | SEQ6246 | 7.6E+00 |
| lnc-ATAT1-4:1 | SEQ6247 | 7.5E+00 |
| lnc-AP2M1-2:1 | SEQ6248 | 7.5E+00 |
| lnc-MARCH7-1:3 | SEQ6249 | 7.5E+00 |
| lnc-ZNF518B-2:4 | SEQ5239 | 7.5E+00 |
| lnc-OTP-4:1 | SEQ6250 | 7.4E+00 |
| EPB41L4A-AS1:4 | SEQ6251 | 7.4E+00 |
| lnc-ATAD5-3:22 | SEQ6252 | 7.4E+00 |
| NDUFA6-AS1:4 | SEQ6253 | 7.4E+00 |
| lnc-RGPD1-6:1 | SEQ6254 | 7.4E+00 |
| lnc-DLG2-3:2 | SEQ6255 | 7.3E+00 |
| lnc-PSMA3-1:5 | SEQ6256 | 7.3E+00 |
| lnc-GRIN2A-1:2 | SEQ6257 | 7.0E+00 |
| lnc-KNG1-2:6 | SEQ6258 | 7.0E+00 |
| lnc-AMN1-1:2 | SEQ6259 | 7.0E+00 |
| lnc-MTMR4-2:1 | SEQ6260 | 7.0E+00 |
| lnc-PRTFDC1-3:1 | SEQ6261 | 6.9E+00 |
| lnc-PRKAR1A-2:1 | SEQ6262 | 6.9E+00 |
| lnc-ANKRD56-5:1 | SEQ6263 | 6.9E+00 |
| lnc-GJC2-2:2 | SEQ6264 | 6.9E+00 |
| lnc-CDKL3-3:1 | SEQ6265 | 6.9E+00 |
| MYCBP2-AS1:10 | SEQ6266 | 6.8E+00 |
| lnc-POM121L2-2:8 | SEQ6267 | 6.8E+00 |
| lnc-IQUB-2:6 | SEQ6268 | 6.7E+00 |
| lnc-ARMC9-2:2 | SEQ6269 | 6.7E+00 |
| lnc-DBF4-3:1 | SEQ6270 | 6.7E+00 |
| lnc-SOCS6-10:1 | SEQ2214 | 6.6E+00 |
| lnc-AF131216.6.1-2:2 | SEQ6271 | 6.5E+00 |
| lnc-CLEC2D-8:7 | SEQ3369 | 6.5E+00 |
| lnc-UROS-2:4 | SEQ6272 | 6.5E+00 |
| lnc-EDC4-1:2 | SEQ6273 | 6.5E+00 |
| lnc-ESCO2-1:2 | SEQ6274 | 6.5E+00 |
| OTUD6B-AS1:3 | SEQ6275 | 6.4E+00 |
| lnc-SREBF1-1:1 | SEQ6276 | 6.4E+00 |
| lnc-DLG5-4:1 | SEQ6277 | 6.4E+00 |
| lnc-GNGT1-4:1 | SEQ6278 | 6.4E+00 |
| lnc-PRDX2-1:1 | SEQ6279 | 6.4E+00 |
| lnc-MBOAT4-5:1 | SEQ6280 | 6.3E+00 |
| lnc-RBM25-5:2 | SEQ6281 | 6.2E+00 |
| LINC-PINT:9 | SEQ6282 | 6.2E+00 |
| lnc-RP11-478C19.2.1-2:7 | SEQ6283 | 6.2E+00 |
| lnc-APOPT1-1:1 | SEQ6284 | 6.1E+00 |
| lnc-ZBTB17-4:1 | SEQ6285 | 6.1E+00 |
| lnc-PRKAB2-5:1 | SEQ6286 | 6.1E+00 |
| lnc-TMEM154-4:2 | SEQ6287 | 6.1E+00 |
| GLIDR:2 | SEQ6288 | 6.1E+00 |
| lnc-ZNF664-2:16 | SEQ6289 | 6.0E+00 |
| lnc-MLL3-1:2 | SEQ6290 | 6.0E+00 |
| lnc-MRPL48-4:1 | SEQ6291 | 6.0E+00 |
| lnc-TMEM232-7:1 | SEQ6292 | 6.0E+00 |
| lnc-BRCC3-4:1 | SEQ6293 | 6.0E+00 |
| lnc-PKD2L1-6:1 | SEQ6294 | 5.9E+00 |
| UBA6-AS1:2 | SEQ6295 | 5.9E+00 |
| lnc-SESN3-2:2 | SEQ6296 | 5.9E+00 |
| lnc-SGIP1-3:1 | SEQ6297 | 5.9E+00 |
| SNHG3:2 | SEQ6298 | 5.8E+00 |
| lnc-GABBR1-1:1 | SEQ6036 | 5.7E+00 |
| lnc-EXD1-1:1 | SEQ6299 | 5.7E+00 |
| lnc-VPREB1-7:1 | SEQ6300 | 5.7E+00 |
| lnc-PPFIA4-1:1 | SEQ2325 | 5.7E+00 |
| lnc-C2orf63-3:1 | SEQ6301 | 5.7E+00 |
| TP73-AS1:21 | SEQ6302 | 5.7E+00 |
| lnc-FAM200B-1:3 | SEQ6303 | 5.6E+00 |
| lnc-FAM210A-1:1 | SEQ6304 | 5.6E+00 |
| lnc-FAM153A-3:4 | SEQ6305 | 5.6E+00 |
| lnc-PCGF5-5:4 | SEQ6306 | 5.6E+00 |
| BCDIN3D-AS1:1 | SEQ6307 | 5.5E+00 |
| lnc-KIAA1704-3:1 | SEQ6308 | 5.5E+00 |
| lnc-C5orf13-1:3 | SEQ6309 | 5.5E+00 |
| lnc-RGR-3:4 | SEQ6310 | 5.5E+00 |
| lnc-RPGRIP1L-1:2 | SEQ6311 | 5.5E+00 |
| lnc-FAM120AOS-3:6 | SEQ6312 | 5.5E+00 |
| lnc-DYNC1LI2-2:2 | SEQ6313 | 5.5E+00 |
| lnc-GPS2-1:1 | SEQ6314 | 5.5E+00 |
| PRKCQ-AS1:11 | SEQ4800 | 5.4E+00 |
| lnc-ZAR1L-2:1 | SEQ6315 | 5.4E+00 |
| lnc-TRIOBP-1:3 | SEQ6316 | 5.4E+00 |
| lnc-RNPEP-3:1 | SEQ6317 | 5.4E+00 |
| lnc-FOXD4L6-2:6 | SEQ6318 | 5.4E+00 |
| lnc-FAM150B-5:3 | SEQ6319 | 5.4E+00 |
| LINC00662:21 | SEQ6320 | 5.4E+00 |
| lnc-PNLIPRP1-1:2 | SEQ2540 | 5.3E+00 |
| CARS-AS1:2 | SEQ6321 | 5.3E+00 |
| lnc-FBXO3-3:2 | SEQ6322 | 5.2E+00 |
| lnc-XRCC5-3:1 | SEQ2326 | 5.2E+00 |
| lnc-AIPL1-6:1 | SEQ6323 | 5.2E+00 |
| lnc-AF131215.2.1-1:3 | SEQ6324 | 5.1E+00 |
| lnc-MC5R-6:1 | SEQ6325 | 5.1E+00 |
| lnc-DNAJC17-1:1 | SEQ6326 | 5.1E+00 |
| HEIH: 11 | SEQ6327 | 5.1E+00 |
| MIR100HG:17 | SEQ6328 | 5.1E+00 |
| lnc-TMEM232-4:6 | SEQ6329 | 5.1E+00 |
| lnc-TMEM99-5:3 | SEQ6330 | 5.0E+00 |
| lnc-AC005609.1-3:7 | SEQ6331 | 5.0E+00 |
| lnc-SPAG16-5:1 | SEQ6332 | 5.0E+00 |
| lnc-CYP19A1-2:1 | SEQ6333 | 4.9E+00 |
| lnc-TYSND1-1:6 | SEQ6334 | 4.9E+00 |
| lnc-CDT1-1:1 | SEQ2708 | 4.9E+00 |
| lnc-C16orf61-3:7 | SEQ6335 | 4.9E+00 |
| lnc-IFI27L2-3:2 | SEQ6336 | 4.9E+00 |
| lnc-CLDN25-5:1 | SEQ6337 | 4.9E+00 |
| lnc-UNC80-1:1 | SEQ2219 | 4.9E+00 |
| lnc-PRKAA1-2:1 | SEQ6338 | 4.8E+00 |
| lnc-RPRML-3:24 | SEQ6339 | 4.8E+00 |
| SNHG16:11 | SEQ6340 | 4.8E+00 |
| lnc-MRFAP1-2:1 | SEQ6341 | 4.8E+00 |
| lnc-CERK-2:1 | SEQ6342 | 4.8E+00 |
| lnc-RAB11A-2:1 | SEQ6343 | 4.8E+00 |
| lnc-NETO2-1:1 | SEQ6344 | 4.8E+00 |
| lnc-LYN-9:4 | SEQ6345 | 4.8E+00 |
| lnc-GATC.1-2:1 | SEQ6346 | 4.8E+00 |
| lnc-PTMS-1:3 | SEQ6347 | 4.7E+00 |
| lnc-SOD1-4:4 | SEQ6348 | 4.7E+00 |
| lnc-HMGA1-2:9 | SEQ6349 | 4.7E+00 |
| lnc-ZNF518B-2:3 | SEQ6350 | 4.7E+00 |
| lnc-RAP1GAP2-5:1 | SEQ6351 | 4.7E+00 |
| lnc-CCNB2-2:1 | SEQ6352 | 4.6E+00 |
| lnc-LIN7A-3:1 | SEQ3437 | 4.6E+00 |
| lnc-UBE2B-2:1 | SEQ2253 | 4.6E+00 |
| lnc-MBP-13:10 | SEQ6353 | 4.6E+00 |
| lnc-RAP1GAP2-6:2 | SEQ6354 | 4.6E+00 |
| lnc-NEDD8-MDP1-1:3 | SEQ6355 | 4.6E+00 |
| lnc-MFSD4-3:3 | SEQ6356 | 4.6E+00 |
| lnc-PKIA-4:1 | SEQ6357 | 4.5E+00 |
| lnc-NRBP2-2:1 | SEQ6358 | 4.5E+00 |
| TP53TG1:8 | SEQ6359 | 4.5E+00 |
| BCDIN3D-AS1:6 | SEQ6360 | 4.5E+00 |
| BCDIN3D-AS1:2 | SEQ6361 | 4.5E+00 |
| lnc-MMADHC-11:1 | SEQ6362 | 4.5E+00 |
| lnc-RNF123-1:1 | SEQ4013 | 4.5E+00 |
| lnc-PRPF18-1:1 | SEQ6363 | 4.5E+00 |
| lnc-ZNF91-4:19 | SEQ6364 | 4.5E+00 |
| lnc-SATB1-8:6 | SEQ6365 | 4.4E+00 |
| lnc-FGD4-4:1 | SEQ6366 | 4.4E+00 |
| lnc-PALLD-7:1 | SEQ6367 | 4.4E+00 |
| lnc-KIAA1841-3:1 | SEQ6368 | 4.4E+00 |
| lnc-AARSD1-2:6 | SEQ6369 | 4.4E+00 |
| lnc-TRIM26-2:6 | SEQ6370 | 4.4E+00 |
| OTUD6B-AS1:8 | SEQ6371 | 4.4E+00 |
| lnc-TRIM26-2:13 | SEQ6372 | 4.4E+00 |

TABLE 12-continued 860 brain-enriched lncRNAs with an expression level in the brain at least 2-fold higher than that in 12 peripheral organs.

| lncRNA | SEQ | Ratio Br/org |
|---|---|---|
| lnc-RGPD3-5:2 | SEQ6373 | 4.4E+00 |
| lnc-ENSA-1:2 | SEQ6374 | 4.4E+00 |
| LINC01278:3 | SEQ6375 | 4.4E+00 |
| lnc-SUGP1-1:1 | SEQ6376 | 4.3E+00 |
| lnc-ORMDL2-1:17 | SEQ6377 | 4.3E+00 |
| lnc-ZNF397-7:1 | SEQ6378 | 4.3E+00 |
| lnc-TUBA1C-1:3 | SEQ6379 | 4.3E+00 |
| lnc-RERE-4:2 | SEQ6380 | 4.3E+00 |
| lnc-PDE7A-3:1 | SEQ6381 | 4.3E+00 |
| lnc-UROS-2:3 | SEQ6382 | 4.2E+00 |
| lnc-SRP19-1:4 | SEQ6383 | 4.2E+00 |
| ZNF571-AS1:12 | SEQ6384 | 4.2E+00 |
| ZNF571-AS1:13 | SEQ6385 | 4.2E+00 |
| lnc-MOB4-1:1 | SEQ6386 | 4.2E+00 |
| lnc-FMR1NB-4:3 | SEQ6387 | 4.2E+00 |
| lnc-NOL11-3:1 | SEQ6388 | 4.2E+00 |
| lnc-SMN1-1:2 | SEQ6389 | 4.2E+00 |
| lnc-POLR3GL-3:2 | SEQ6390 | 4.2E+00 |
| lnc-PRPF39-2:1 | SEQ6391 | 4.2E+00 |
| PAXIP1-AS1:7 | SEQ6392 | 4.2E+00 |
| lnc-ACOT12-8:2 | SEQ6393 | 4.1E+00 |
| lnc-ZNF582-3:2 | SEQ6394 | 4.1E+00 |
| lnc-CPVL-2:1 | SEQ6395 | 4.1E+00 |
| lnc-TARSL2-2:1 | SEQ6396 | 4.1E+00 |
| lnc-THRAP3-1:1 | SEQ6397 | 4.1E+00 |
| lnc-CCNB1-1:2 | SEQ6398 | 4.1E+00 |
| lnc-TIRAP-2:3 | SEQ6399 | 4.1E+00 |
| lnc-ZNF583-4:3 | SEQ6400 | 4.1E+00 |
| lnc-FAM200B-1:9 | SEQ6401 | 4.0E+00 |
| lnc-ANKUB1-2:2 | SEQ6402 | 4.0E+00 |
| lnc-NKAIN3-3:4 | SEQ6403 | 4.0E+00 |
| lnc-SNURF-1:10 | SEQ6404 | 4.0E+00 |
| MEG3:11 | SEQ6405 | 4.0E+00 |
| lnc-GSPT2-4:1 | SEQ6406 | 4.0E+00 |
| PTOV1-AS1:4 | SEQ6407 | 3.9E+00 |
| lnc-ZZZ3-1:1 | SEQ6408 | 3.9E+00 |
| lnc-CHRNA5-4:2 | SEQ6409 | 3.9E+00 |
| LINC01024:6 | SEQ6410 | 3.9E+00 |
| PAXIP1-AS1:1 | SEQ6411 | 3.9E+00 |
| lnc-CTDSP2-2:11 | SEQ6412 | 3.9E+00 |
| lnc-ITGAL-2:2 | SEQ6413 | 3.9E+00 |
| lnc-MACROD2-2:1 | SEQ6414 | 3.9E+00 |
| lnc-RABGAP1L-1:1 | SEQ6415 | 3.9E+00 |
| lnc-CEP192-2:3 | SEQ6416 | 3.9E+00 |
| lnc-PRR18-1:1 | SEQ6417 | 3.9E+00 |
| lnc-CTD-2228K2.5.1-1:2 | SEQ6418 | 3.9E+00 |
| lnc-ARSG-1:2 | SEQ6419 | 3.8E+00 |
| SNHG8:11 | SEQ6420 | 3.8E+00 |
| lnc-AL592284.1-1:19 | SEQ6421 | 3.8E+00 |
| lnc-C1QL3-1:1 | SEQ6422 | 3.8E+00 |
| lnc-HELLS-2:1 | SEQ6423 | 3.8E+00 |
| lnc-STXBP4-1:1 | SEQ6424 | 3.8E+00 |
| lnc-DOM3Z-3:6 | SEQ6425 | 3.8E+00 |
| lnc-EML6-5:3 | SEQ6426 | 3.8E+00 |
| lnc-CLK4-2:2 | SEQ6427 | 3.8E+00 |
| lnc-AC084851.1-9:1 | SEQ6428 | 3.8E+00 |
| lnc-POM121L2-2:2 | SEQ2341 | 3.8E+00 |
| PAXBP1-AS1:4 | SEQ6429 | 3.8E+00 |
| PAXBP1-AS1:3 | SEQ6430 | 3.8E+00 |
| TRAF3IP2-AS1:4 | SEQ6431 | 3.8E+00 |
| lnc-KAZALD1-2:3 | SEQ6432 | 3.8E+00 |
| lnc-AL669831.1-3:33 | SEQ6433 | 3.8E+00 |
| lnc-SLC6A18-2:2 | SEQ6434 | 3.8E+00 |
| lnc-VPS72-2:2 | SEQ6435 | 3.8E+00 |
| LINC01278:1 | SEQ6436 | 3.7E+00 |
| lnc-BDH1-5:3 | SEQ6437 | 3.7E+00 |
| NPTN-IT1:2 | SEQ6438 | 3.7E+00 |
| lnc-DAXX-2:1 | SEQ6439 | 3.7E+00 |
| lnc-UBE2E3-2:12 | SEQ6440 | 3.7E+00 |
| lnc-MINOS1-2:2 | SEQ6441 | 3.7E+00 |
| lnc-POM121C-1:3 | SEQ6442 | 3.7E+00 |
| WAC-AS1:2 | SEQ6443 | 3.7E+00 |
| lnc-RGPD8-1:1 | SEQ6444 | 3.7E+00 |
| lnc-SLC4A5-5:4 | SEQ6445 | 3.7E+00 |
| lnc-GABBR1-1:2 | SEQ2290 | 3.7E+00 |
| lnc-AC006465.3.1-1:13 | SEQ6446 | 3.7E+00 |
| lnc-TRAPPC11-4:1 | SEQ6447 | 3.7E+00 |
| lnc-UROS-2:1 | SEQ6448 | 3.7E+00 |
| CD27-AS1:5 | SEQ6449 | 3.7E+00 |
| lnc-LXN-1:3 | SEQ6450 | 3.7E+00 |
| lnc-RASL11B-10:1 | SEQ6451 | 3.6E+00 |
| lnc-DLG2-3:1 | SEQ6452 | 3.6E+00 |
| lnc-NECAP1-1:2 | SEQ6453 | 3.6E+00 |
| lnc-EDEM1-1:1 | SEQ6454 | 3.6E+00 |
| lnc-STX2-8:1 | SEQ6455 | 3.6E+00 |
| lnc-SLC35F5-14:11 | SEQ6456 | 3.6E+00 |
| lnc-EPB41L5-1:1 | SEQ6457 | 3.6E+00 |
| lnc-LAMTOR1-1:1 | SEQ6458 | 3.6E+00 |
| lnc-KBTBD2-2:2 | SEQ6459 | 3.5E+00 |
| lnc-ARC-1:5 | SEQ6460 | 3.5E+00 |
| lnc-SON-3:2 | SEQ6461 | 3.5E+00 |
| lnc-CCNL2-3:2 | SEQ6462 | 3.5E+00 |
| lnc-RP11-1035H13.3.1-1:2 | SEQ6463 | 3.5E+00 |
| lnc-LPCAT1-3:13 | SEQ6464 | 3.5E+00 |
| lnc-RP11-96020.4.1-1:1 | SEQ6465 | 3.5E+00 |
| lnc-THAP4-3:2 | SEQ6466 | 3.5E+00 |
| lnc-SFXN5-1:4 | SEQ6467 | 3.5E+00 |
| lnc-GOLT1B-1:3 | SEQ6468 | 3.5E+00 |
| lnc-SUGT1-3:1 | SEQ0131 | 3.5E+00 |
| ATP6VOE2-AS1:5 | SEQ6469 | 3.5E+00 |
| lnc-FAM71E1-1:1 | SEQ6470 | 3.4E+00 |
| lnc-ZNF8-4:3 | SEQ6471 | 3.4E+00 |
| LINC00936:2 | SEQ6472 | 3.4E+00 |
| DANCR:2 | SEQ6473 | 3.4E+00 |
| lnc-DDX31-3:1 | SEQ6474 | 3.4E+00 |
| lnc-TKT-1:9 | SEQ6475 | 3.4E+00 |
| lnc-EFCAB8-1:2 | SEQ6476 | 3.4E+00 |
| lnc-RSPH10B2-1:3 | SEQ2580 | 3.4E+00 |
| lnc-NTRK1-4:1 | SEQ6477 | 3.4E+00 |
| lnc-RPL3-2:3 | SEQ6478 | 3.4E+00 |
| lnc-CCL28-2:1 | SEQ6479 | 3.4E+00 |
| lnc-ARHGEF35-2:1 | SEQ6480 | 3.4E+00 |
| lnc-IL12RB2-3:1 | SEQ6481 | 3.4E+00 |
| lnc-BDH1-5:2 | SEQ6482 | 3.4E+00 |
| lnc-TRIM38-1:1 | SEQ6483 | 3.4E+00 |
| lnc-ATPAF2-2:5 | SEQ6484 | 3.4E+00 |
| lnc-HIGD1C-1:5 | SEQ6485 | 3.4E+00 |
| lnc-RP11-645C24.1.1-3:8 | SEQ6486 | 3.3E+00 |
| lnc-TCTA-1:1 | SEQ4966 | 3.3E+00 |
| MAPKAPK5-AS1:8 | SEQ6487 | 3.3E+00 |
| lnc-TMSB10-1:1 | SEQ6488 | 3.3E+00 |
| lnc-AES-1:3 | SEQ6489 | 3.3E+00 |
| lnc-GNAI2-1:12 | SEQ6490 | 3.3E+00 |
| lnc-ATP6V1C1-9:4 | SEQ3802 | 3.3E+00 |
| lnc-GLTSCR2-2:6 | SEQ6491 | 3.3E+00 |
| lnc-IL9R-1:6 | SEQ6492 | 3.3E+00 |
| lnc-ZEB2-1:9 | SEQ6493 | 3.3E+00 |
| lnc-AL669831.1-3:10 | SEQ6494 | 3.3E+00 |
| lnc-GRIK2-5:1 | SEQ6495 | 3.3E+00 |
| lnc-OTP-5:1 | SEQ6496 | 3.3E+00 |
| lnc-ST6GALNAC6-1:4 | SEQ6497 | 3.3E+00 |
| lnc-BLZF1-2:4 | SEQ6498 | 3.3E+00 |
| lnc-AL669831.1-3:4 | SEQ6499 | 3.2E+00 |
| lnc-CNR2-1:7 | SEQ6500 | 3.2E+00 |
| lnc-SRPRB-1:1 | SEQ2427 | 3.2E+00 |
| lnc-NETO2-4:1 | SEQ6501 | 3.2E+00 |
| lnc-RP11-796G6.2.1-4:7 | SEQ6502 | 3.2E+00 |
| lnc-SLC25A16-1:1 | SEQ6503 | 3.2E+00 |
| lnc-FAM165B-1:2 | SEQ6504 | 3.2E+00 |
| lnc-NUTF2-1:1 | SEQ6505 | 3.2E+00 |
| lnc-CTDSP2-2:9 | SEQ6506 | 3.2E+00 |
| lnc-HNRNPA1L2-2:4 | SEQ6507 | 3.2E+00 |
| lnc-NDUFA7-1:2 | SEQ6508 | 3.2E+00 |
| lnc-TRAPPC6B-3:1 | SEQ6509 | 3.2E+00 |
| TCONS_00062327 | SEQ2005 | 7.4E+23 |
| TCONS_00062311 | SEQ1996 | 1.9E+05 |
| TCONS_00033704 | SEQ1562 | 2.8E+03 |
| TCONS_00036143 | SEQ1611 | 9.6E+01 |

TABLE 12-continued 860 brain-enriched lncRNAs with an expression level in the brain at least 2-fold higher than that in 12 peripheral organs.

| lncRNA | SEQ | Ratio Br/org |
|---|---|---|
| TCONS_00045398 | SEQ1789 | 7.7E+01 |
| TCONS_00033666 | SEQ1553 | 3.9E+01 |
| TCONS_00021559 | SEQ1333 | 3.3E+01 |
| TCONS_00026547 | SEQ1410 | 2.6E+01 |
| TCONS_00055516 | SEQ1902 | 2.4E+01 |
| TCONS_00062422 | SEQ2040 | 2.4E+01 |
| TCONS_00024800 | SEQ1391 | 2.0E+01 |
| TCONS_00021416 | SEQ1328 | 1.9E+01 |
| TCONS_00014326 | SEQ1225 | 1.3E+01 |
| TCONS_00045346 | SEQ1781 | 9.0E+00 |
| TCONS_00021544 | SEQ1320 | 9.0E+00 |
| TCONS_00023115 | SEQ1352 | 7.6E+00 |
| TCONS_00014261 | SEQ1249 | 6.3E+00 |
| lnc-NKX1-2-2:1 | SEQ6510 | 3.2E+00 |
| lnc-HSDL1-1:1 | SEQ6511 | 3.2E+00 |
| lnc-FAM115C-1:1 | SEQ6512 | 3.2E+00 |
| lnc-AARSD1-2:7 | SEQ6513 | 3.2E+00 |
| LINC00969:38 | SEQ6514 | 3.2E+00 |
| lnc-VPREB1-7:13 | SEQ6515 | 3.2E+00 |
| lnc-MYO15A-1:1 | SEQ6516 | 3.2E+00 |
| lnc-SNURF-1:22 | SEQ6517 | 3.2E+00 |
| lnc-ZNF415-2:9 | SEQ6518 | 3.2E+00 |
| lnc-KNG1-2:5 | SEQ6519 | 3.2E+00 |
| LINC00641:4 | SEQ6520 | 3.1E+00 |
| lnc-KCND3-3:1 | SEQ6521 | 3.1E+00 |
| lnc-XPOT-2:1 | SEQ6522 | 3.1E+00 |
| lnc-ARIH2-2:6 | SEQ6523 | 3.1E+00 |
| lnc-GNGT1-1:3 | SEQ6524 | 3.1E+00 |
| lnc-CEPT1-1:6 | SEQ6525 | 3.1E+00 |
| lnc-SLC25A4-1:1 | SEQ6526 | 3.1E+00 |
| lnc-AGAP9-2:2 | SEQ6527 | 3.1E+00 |
| lnc-DLG5-4:2 | SEQ6528 | 3.1E+00 |
| lnc-PPHLN1-1:2 | SEQ6529 | 3.1E+00 |
| lnc-RBM25-2:1 | SEQ6530 | 3.1E+00 |
| lnc-USH2A-4:1 | SEQ6531 | 3.1E+00 |
| lnc-ENC1-5:1 | SEQ2244 | 3.1E+00 |
| lnc-FAM106A-2:18 | SEQ6532 | 3.1E+00 |
| lnc-METTL17-1:2 | SEQ6533 | 3.1E+00 |
| lnc-TMEM178-1:19 | SEQ6534 | 3.1E+00 |
| lnc-CHRNA5-4:7 | SEQ6535 | 3.1E+00 |
| lnc-C1orf200-9:1 | SEQ6536 | 3.1E+00 |
| lnc-HEXA-3:1 | SEQ6537 | 3.1E+00 |
| lnc-PKHD1L1-2:7 | SEQ6538 | 3.1E+00 |
| lnc-GALNT5-4:1 | SEQ6539 | 3.0E+00 |
| lnc-TOB1-4:1 | SEQ5647 | 3.0E+00 |
| lnc-ZNF238-7:1 | SEQ6540 | 3.0E+00 |
| lnc-KCNMB4-4:3 | SEQ6541 | 3.0E+00 |
| lnc-BRWD1-1:1 | SEQ6542 | 3.0E+00 |
| lnc-DYNLL1-1:1 | SEQ6543 | 3.0E+00 |
| lnc-TMF1-2:1 | SEQ6544 | 3.0E+00 |
| lnc-HSPBP1-1:1 | SEQ6545 | 3.0E+00 |
| TTC28-AS1:33 | SEQ6546 | 3.0E+00 |
| lnc-SLC8A1-1:1 | SEQ6547 | 3.0E+00 |
| lnc-HMGA1-2:4 | SEQ3415 | 3.0E+00 |
| lnc-TH1L-5:6 | SEQ6548 | 3.0E+00 |
| lnc-RGS9-1:5 | SEQ6549 | 3.0E+00 |
| lnc-SERINC1-3:1 | SEQ5720 | 3.0E+00 |
| lnc-SMARCA5-6:4 | SEQ6550 | 3.0E+00 |
| lnc-RGS9-1:1 | SEQ6551 | 3.0E+00 |
| LINC01420:2 | SEQ6552 | 3.0E+00 |
| lnc-AC007401.2.1-2:1 | SEQ6553 | 3.0E+00 |
| lnc-BX255923.1-8:3 | SEQ6554 | 3.0E+00 |
| NR2F1-AS1:15 | SEQ6555 | 3.0E+00 |
| lnc-AC138969.4.1-1:1 | SEQ6556 | 3.0E+00 |
| lnc-CYP26C1-1:1 | SEQ6557 | 3.0E+00 |
| lnc-TCEA1-3:1 | SEQ6558 | 3.0E+00 |
| lnc-CSNK1D-2:6 | SEQ6559 | 2.9E+00 |
| lnc-DNAL1-1:1 | SEQ2480 | 2.9E+00 |
| lnc-MLNR-2:2 | SEQ6560 | 2.9E+00 |
| lnc-THEMIS-6:1 | SEQ6561 | 2.9E+00 |
| lnc-DAPL1-3:1 | SEQ6562 | 2.9E+00 |
| lnc-ARL15-7:1 | SEQ6563 | 2.9E+00 |
| lnc-CDKL2-2:1 | SEQ6564 | 2.9E+00 |
| lnc-UBLCP1-3:3 | SEQ6565 | 2.9E+00 |
| lnc-VEZF1-1:6 | SEQ6566 | 2.9E+00 |
| SNHG4:19 | SEQ6567 | 2.9E+00 |
| lnc-TANK-3:1 | SEQ6568 | 2.9E+00 |
| ATP6VOE2-AS1:1 | SEQ4643 | 2.9E+00 |
| lnc-SP3-10:1 | SEQ6569 | 2.9E+00 |
| lnc-SNURF-1:8 | SEQ6570 | 2.9E+00 |
| lnc-AZIN1-1:5 | SEQ6571 | 2.9E+00 |
| lnc-CHMP1A-4:6 | SEQ6572 | 2.9E+00 |
| GAS5:40 | SEQ6573 | 2.9E+00 |
| lnc-BCO2-2:3 | SEQ6574 | 2.9E+00 |
| lnc-POC1B-GALNT4-3:1 | SEQ6575 | 2.9E+00 |
| lnc-TPD52-3:12 | SEQ6576 | 2.9E+00 |
| lnc-FAM27B-12:3 | SEQ6577 | 2.9E+00 |
| lnc-STARD9-1:1 | SEQ6578 | 2.9E+00 |
| lnc-IKBIP-1:1 | SEQ4407 | 2.9E+00 |
| lnc-MBOAT4-2:1 | SEQ2592 | 2.9E+00 |
| lnc-ATP6V1E1-2:2 | SEQ6579 | 2.9E+00 |
| lnc-SPINK9-2:2 | SEQ6580 | 2.9E+00 |
| lnc-SHC4-3:1 | SEQ6581 | 2.9E+00 |
| lnc-GATSL1-4:4 | SEQ6582 | 2.9E+00 |
| lnc-DNAJC16-1:2 | SEQ4625 | 2.8E+00 |
| lnc-SLC39A6-3:1 | SEQ6583 | 2.8E+00 |
| lnc-POU5F1-10:2 | SEQ6584 | 2.8E+00 |
| lnc-NMD3-1:1 | SEQ2364 | 2.8E+00 |
| lnc-FGD4-5:1 | SEQ6585 | 2.8E+00 |
| lnc-RAD54B-2:3 | SEQ6586 | 2.8E+00 |
| LINC01355:4 | SEQ6587 | 2.8E+00 |
| lnc-IMPDH1-3:3 | SEQ6588 | 2.8E+00 |
| lnc-TMEM88B-3:8 | SEQ6589 | 2.8E+00 |
| EIF3J-AS1:4 | SEQ6590 | 2.8E+00 |
| lnc-PRR11-3:1 | SEQ6591 | 2.8E+00 |
| lnc-ZNF880-1:1 | SEQ6592 | 2.8E+00 |
| lnc-SLC4A5-3:1 | SEQ6593 | 2.8E+00 |
| NR2F1-AS1:27 | SEQ6594 | 2.8E+00 |
| lnc-STARD4-4:2 | SEQ6595 | 2.8E+00 |
| lnc-GUSB-15:1 | SEQ6596 | 2.8E+00 |
| SNHG21:15 | SEQ6597 | 2.8E+00 |
| lnc-CSNK2A2-2:1 | SEQ6598 | 2.8E+00 |
| lnc-PON3-2:1 | SEQ6599 | 2.8E+00 |
| lnc-C14orf132-1:5 | SEQ6600 | 2.8E+00 |
| lnc-RNASEK-1:4 | SEQ6601 | 2.7E+00 |
| lnc-NR2C2-1:1 | SEQ2751 | 2.7E+00 |
| lnc-PNP-1:1 | SEQ6602 | 2.7E+00 |
| lnc-CWH43-3:4 | SEQ6603 | 2.7E+00 |
| lnc-CLSTN2-1:1 | SEQ6604 | 2.7E+00 |
| lnc-SLC9A5-2:1 | SEQ6605 | 2.7E+00 |
| lnc-C1orf185-5:1 | SEQ6606 | 2.7E+00 |
| lnc-TMEM167A-4:5 | SEQ6607 | 2.7E+00 |
| lnc-TSC22D2-1:2 | SEQ6608 | 2.7E+00 |
| lnc-TULP4-1:1 | SEQ6609 | 2.7E+00 |
| lnc-SYNE2-4:1 | SEQ2308 | 2.7E+00 |
| lnc-RPRML-3:20 | SEQ6610 | 2.7E+00 |
| PSMD5-AS1:5 | SEQ6611 | 2.7E+00 |
| lnc-R3HDM1-1:2 | SEQ6612 | 2.7E+00 |
| PCBP1-AS1:183 | SEQ6613 | 2.7E+00 |
| lnc-PHLDB2-2:3 | SEQ6614 | 2.7E+00 |
| LINC00339:21 | SEQ6615 | 2.7E+00 |
| lnc-POLR1B-2:1 | SEQ6616 | 2.7E+00 |
| lnc-MOCOS-3:10 | SEQ6617 | 2.7E+00 |
| lnc-CSTF3-2:1 | SEQ6618 | 2.7E+00 |
| lnc-SEPT5-1:2 | SEQ6619 | 2.7E+00 |
| NFYC-AS1:2 | SEQ6620 | 2.7E+00 |
| lnc-PABPC1L-2:1 | SEQ6621 | 2.7E+00 |
| lnc-DUS4L-2:4 | SEQ6622 | 2.7E+00 |
| CKMT2-AS1:6 | SEQ6623 | 2.7E+00 |
| MIF-AS1:7 | SEQ3858 | 2.7E+00 |
| lnc-TBR1-1:1 | SEQ6624 | 2.7E+00 |
| lnc-NFAT5-2:1 | SEQ6625 | 2.7E+00 |
| lnc-NLRP3-1:5 | SEQ6626 | 2.7E+00 |
| lnc-SLC25A39-2:1 | SEQ5393 | 2.7E+00 |
| lnc-PPHLN1-1:1 | SEQ6627 | 2.7E+00 |
| lnc-CTC-554D6.1.1-2:1 | SEQ6628 | 2.7E+00 |
| lnc-DDIT3-2:1 | SEQ6629 | 2.7E+00 |
| lnc-ABCD2-4:1 | SEQ2216 | 2.6E+00 |

TABLE 12-continued 860 brain-enriched lncRNAs with an expression level in the brain at least 2-fold higher than that in 12 peripheral organs.

| lncRNA | SEQ | Ratio Br/org |
|---|---|---|
| lnc-BMF-3:4 | SEQ6630 | 2.6E+00 |
| lnc-CXXC11-8:6 | SEQ6631 | 2.6E+00 |
| lnc-PSMC1-2:2 | SEQ6632 | 2.6E+00 |
| lnc-AC008394.1-7:1 | SEQ6633 | 2.6E+00 |
| lnc-TNFRSF14-5:3 | SEQ6634 | 2.6E+00 |
| lnc-FER-8:1 | SEQ6635 | 2.6E+00 |
| lnc-ELN-2:2 | SEQ6636 | 2.6E+00 |
| lnc-PSMA7-1:1 | SEQ5951 | 2.6E+00 |
| lnc-TTYH2-1:4 | SEQ6637 | 2.6E+00 |
| lnc-RPL36A-1:4 | SEQ6638 | 2.6E+00 |
| lnc-WSB1-5:1 | SEQ6639 | 2.6E+00 |
| lnc-SLC25A38-2:1 | SEQ6640 | 2.6E+00 |
| lnc-LEPREL4-1:3 | SEQ6641 | 2.6E+00 |
| lnc-B4GALT2-1:2 | SEQ6642 | 2.6E+00 |
| lnc-AL049840.1-3:1 | SEQ6643 | 2.6E+00 |
| lnc-SUMF2-10:1 | SEQ6644 | 2.6E+00 |
| lnc-EIF1AD-1:1 | SEQ2653 | 2.6E+00 |
| lnc-NUDT16L1-2:1 | SEQ6645 | 2.6E+00 |
| lnc-TMEM180-2:1 | SEQ6646 | 2.6E+00 |
| lnc-PPIL2-1:2 | SEQ6647 | 2.6E+00 |
| lnc-ERAS-4:1 | SEQ6648 | 2.6E+00 |
| lnc-USP34-1:10 | SEQ3127 | 2.6E+00 |
| lnc-EIF4G1-1:1 | SEQ6649 | 2.6E+00 |
| lnc-GPRIN2-2:1 | SEQ2453 | 2.6E+00 |
| DICER1-AS1:9 | SEQ6650 | 2.6E+00 |
| lnc-C10orf40-5:1 | SEQ6651 | 2.6E+00 |
| lnc-BCAT1-2:1 | SEQ6652 | 2.6E+00 |
| lnc-RP11-96020.4.1-1:4 | SEQ6653 | 2.5E+00 |
| lnc-RP11-1012A1.4.1-1:5 | SEQ6654 | 2.5E+00 |
| lnc-RP11-632K20.1.1-1:1 | SEQ6655 | 2.5E+00 |
| lnc-BDH2-2:1 | SEQ6656 | 2.5E+00 |
| lnc-CDO1-1:7 | SEQ6657 | 2.5E+00 |
| lnc-GDI1-1:1 | SEQ4743 | 2.5E+00 |
| lnc-SSBP2-5:9 | SEQ6658 | 2.5E+00 |
| CERS6-AS1:3 | SEQ6659 | 2.5E+00 |
| lnc-ABCA3-2:1 | SEQ6660 | 2.5E+00 |
| SNHG1:25 | SEQ6661 | 2.5E+00 |
| lnc-MLLT6-1:1 | SEQ6662 | 2.5E+00 |
| lnc-OTOA-2:1 | SEQ6663 | 2.5E+00 |
| lnc-CDK2AP1-1:1 | SEQ6664 | 2.5E+00 |
| lnc-CDK2AP1-1:7 | SEQ6665 | 2.5E+00 |
| LINC00963:8 | SEQ6666 | 2.5E+00 |
| lnc-C3orf25-2:7 | SEQ6667 | 2.5E+00 |
| LINC00894:9 | SEQ6668 | 2.5E+00 |
| lnc-CCDC68-4:1 | SEQ6669 | 2.5E+00 |
| lnc-S100A13-2:7 | SEQ6670 | 2.5E+00 |
| lnc-EFHB-5:1 | SEQ6671 | 2.5E+00 |
| lnc-AC073263.1-3:1 | SEQ6672 | 2.5E+00 |
| LINC00623:8 | SEQ6673 | 2.5E+00 |
| lnc-ZNF33B-4:11 | SEQ6674 | 2.5E+00 |
| LINC01278:2 | SEQ6675 | 2.5E+00 |
| lnc-PLAT-4:1 | SEQ6676 | 2.5E+00 |
| lnc-STXBP3-1:2 | SEQ6677 | 2.5E+00 |
| CERS6-AS1:4 | SEQ6678 | 2.5E+00 |
| CERS6-AS1:5 | SEQ6679 | 2.5E+00 |
| TMEM254-AS1:1 | SEQ6680 | 2.5E+00 |
| lnc-EPB41L3-3:1 | SEQ6681 | 2.5E+00 |
| lnc-XRCC5-1:3 | SEQ6682 | 2.5E+00 |
| lnc-CCAR1-4:1 | SEQ6683 | 2.5E+00 |
| lnc-SNX2-1:2 | SEQ4824 | 2.5E+00 |
| lnc-GALNTL1-5:5 | SEQ6684 | 2.5E+00 |
| lnc-FAM200B-1:16 | SEQ6685 | 2.4E+00 |
| EAF1-AS1:14 | SEQ6686 | 2.4E+00 |
| lnc-SLC16A9-6:2 | SEQ6687 | 2.4E+00 |
| lnc-GNA13-2:9 | SEQ6688 | 2.4E+00 |
| lnc-GALT-1:9 | SEQ6689 | 2.4E+00 |
| lnc-ATP6V0A1-1:2 | SEQ6690 | 2.4E+00 |
| lnc-CCNB1IP1-1:1 | SEQ6691 | 2.4E+00 |
| lnc-C11orf58-2:3 | SEQ6692 | 2.4E+00 |
| lnc-ST7L-3:10 | SEQ6693 | 2.4E+00 |
| lnc-DHX33-2:1 | SEQ6694 | 2.4E+00 |
| lnc-AC011551.1-1:1 | SEQ6695 | 2.4E+00 |
| lnc-SP9-4:2 | SEQ6696 | 2.4E+00 |
| lnc-C11orf31-1:1 | SEQ6697 | 2.4E+00 |
| lnc-AL669831.1-11:3 | SEQ6698 | 2.4E+00 |
| lnc-NINL-2:1 | SEQ6699 | 2.4E+00 |
| OIP5-AS1:25 | SEQ5168 | 2.4E+00 |
| lnc-KIAA1383-7:2 | SEQ6700 | 2.4E+00 |
| lnc-APBA1-1:2 | SEQ6701 | 2.4E+00 |
| NIPBL-AS1:3 | SEQ6702 | 2.4E+00 |
| lnc-MRPL30-2:4 | SEQ6703 | 2.4E+00 |
| lnc-RWDD2B-4:2 | SEQ6704 | 2.4E+00 |
| lnc-RASL11B-9:1 | SEQ6705 | 2.4E+00 |
| lnc-TBC1D5-2:1 | SEQ6706 | 2.4E+00 |
| lnc-CEP152-1:1 | SEQ6707 | 2.4E+00 |
| lnc-CCDC144NL-7:1 | SEQ6708 | 2.4E+00 |
| lnc-PLCE1-3:1 | SEQ6709 | 2.4E+00 |
| lnc-CENPV-2:1 | SEQ2516 | 2.4E+00 |
| lnc-ZNF397-4:1 | SEQ4775 | 2.4E+00 |
| lnc-WDR41-1:1 | SEQ6710 | 2.4E+00 |
| lnc-AC112715.2.1-7:1 | SEQ6711 | 2.4E+00 |
| lnc-PHAX-2:1 | SEQ6712 | 2.4E+00 |
| lnc-BMI1-3:3 | SEQ6713 | 2.4E+00 |
| lnc-NAV3-5:5 | SEQ6714 | 2.4E+00 |
| lnc-FAM156A-2:1 | SEQ3387 | 2.4E+00 |
| lnc-CAND1-3:2 | SEQ6715 | 2.4E+00 |
| lnc-DAPL1-6:2 | SEQ6716 | 2.4E+00 |
| lnc-ENAH-2:3 | SEQ6717 | 2.4E+00 |
| lnc-PLSCR3-1:1 | SEQ6718 | 2.4E+00 |
| lnc-HMBS-1:4 | SEQ6719 | 2.4E+00 |
| lnc-RAPSN-1:1 | SEQ6720 | 2.4E+00 |
| lnc-MATR3-3:2 | SEQ6721 | 2.4E+00 |
| lnc-GLB1L-1:1 | SEQ6722 | 2.4E+00 |
| lnc-CLEC18B-7:5 | SEQ2353 | 2.4E+00 |
| LINC-PINT:2 | SEQ6723 | 2.4E+00 |
| lnc-MRPS36-2:1 | SEQ6724 | 2.4E+00 |
| lnc-RNF187-2:1 | SEQ6725 | 2.3E+00 |
| lnc-PEX19-4:1 | SEQ6726 | 2.3E+00 |
| lnc-SNURF-1:44 | SEQ6727 | 2.3E+00 |
| lnc-RNF43-2:2 | SEQ6728 | 2.3E+00 |
| lnc-AF131216.6.1-2:1 | SEQ6729 | 2.3E+00 |
| lnc-SCFD2-4:1 | SEQ6730 | 2.3E+00 |
| CD27-AS1:4 | SEQ6731 | 2.3E+00 |
| lnc-ENSA-1:1 | SEQ6732 | 2.3E+00 |
| lnc-RP11-439E19.8.1-2:1 | SEQ6733 | 2.3E+00 |
| lnc-OGFRL1-4:1 | SEQ6734 | 2.3E+00 |
| lnc-C12orf10-1:3 | SEQ6735 | 2.3E+00 |
| lnc-HIBADH-5:1 | SEQ3962 | 2.3E+00 |
| CRHR1-IT1:8 | SEQ6736 | 2.3E+00 |
| lnc-BRAF-3:2 | SEQ6737 | 2.3E+00 |
| lnc-SIRT2-1:2 | SEQ6738 | 2.3E+00 |
| lnc-RAB27A-1:2 | SEQ6739 | 2.3E+00 |
| lnc-SNRNP35-1:2 | SEQ6740 | 2.3E+00 |
| MSC-AS1:2 | SEQ6741 | 2.3E+00 |
| lnc-WSB2-1:1 | SEQ6742 | 2.3E+00 |
| lnc-ISCU-2:1 | SEQ6743 | 2.3E+00 |
| lnc-KIAA0564-2:1 | SEQ6744 | 2.3E+00 |
| CRHR1-IT1:9 | SEQ6745 | 2.3E+00 |
| lnc-DRD5-23:2 | SEQ5314 | 2.3E+00 |
| lnc-CHST10-2:1 | SEQ6746 | 2.3E+00 |
| lnc-GJC2-2:9 | SEQ6747 | 2.3E+00 |
| LINC01578:14 | SEQ6748 | 2.3E+00 |
| lnc-ERN1-3:1 | SEQ6749 | 2.3E+00 |
| lnc-GRIA4-2:1 | SEQ6750 | 2.3E+00 |
| lnc-GMNN-3:1 | SEQ6751 | 2.3E+00 |
| PRKCQ-AS1:9 | SEQ6752 | 2.3E+00 |
| lnc-VOPP1-5:1 | SEQ6753 | 2.3E+00 |
| lnc-FAM53B-1:1 | SEQ6754 | 2.3E+00 |
| lnc-C12orf10-1:2 | SEQ6755 | 2.3E+00 |
| lnc-ERICH1-19:8 | SEQ6756 | 2.3E+00 |
| lnc-PALLD-8:1 | SEQ2633 | 2.3E+00 |
| lnc-POLD3-1:1 | SEQ6757 | 2.3E+00 |
| lnc-ELAC1-1:1 | SEQ6758 | 2.3E+00 |
| lnc-RAB4A-2:2 | SEQ6759 | 2.3E+00 |
| lnc-VEZT-2:2 | SEQ6760 | 2.3E+00 |
| lnc-C6orf228-4:1 | SEQ6761 | 2.3E+00 |
| LINC00294:2 | SEQ6762 | 2.3E+00 |
| lnc-LRRC8E-2:1 | SEQ6763 | 2.3E+00 |

TABLE 12-continued 860 brain-enriched lncRNAs with an expression level in the brain at least 2-fold higher than that in 12 peripheral organs.

| lncRNA | SEQ | Ratio Br/org |
|---|---|---|
| RNF139-AS1:1 | SEQ6764 | 2.2E+00 |
| lnc-PRSS1-6:3 | SEQ6765 | 2.2E+00 |
| lnc-SLC9A7-1:2 | SEQ6766 | 2.2E+00 |
| lnc-UBXN6-1:3 | SEQ6767 | 2.2E+00 |
| lnc-ALG1-2:1 | SEQ6768 | 2.2E+00 |
| lnc-AES-1:1 | SEQ6769 | 2.2E+00 |
| lnc-PLAGL2-4:1 | SEQ6770 | 2.2E+00 |
| GMDS-AS1:44 | SEQ6771 | 2.2E+00 |
| lnc-PABPC4-1:3 | SEQ6772 | 2.2E+00 |
| LINC00294:1 | SEQ6773 | 2.2E+00 |
| USP46-AS1:4 | SEQ6774 | 2.2E+00 |
| lnc-GLTPD1-1:1 | SEQ6775 | 2.2E+00 |
| lnc-HEBP2-1:1 | SEQ6776 | 2.2E+00 |
| lnc-VSTM5-1:12 | SEQ6777 | 2.2E+00 |
| lnc-ZNF595-1:1 | SEQ6778 | 2.2E+00 |
| lnc-URGCP-2:8 | SEQ5108 | 2.2E+00 |
| lnc-SERGEF-3:2 | SEQ6779 | 2.2E+00 |
| lnc-APBB2-2:4 | SEQ6780 | 2.2E+00 |
| lnc-C19orf71-1:1 | SEQ6781 | 2.2E+00 |
| lnc-VEZF1-1:3 | SEQ6782 | 2.2E+00 |
| lnc-COMMD1-1:1 | SEQ2294 | 2.2E+00 |
| lnc-SECISBP2L-3:1 | SEQ6783 | 2.2E+00 |
| lnc-TAOK3-1:5 | SEQ6784 | 2.2E+00 |
| lnc-RWDD1-1:1 | SEQ6785 | 2.2E+00 |
| lnc-TDRKH-1:1 | SEQ6786 | 2.2E+00 |
| lnc-SNAPIN-2:2 | SEQ6787 | 2.2E+00 |
| lnc-C1orf132-1:7 | SEQ6788 | 2.2E+00 |
| lnc-ARVCF-4:8 | SEQ6789 | 2.2E+00 |
| lnc-COLEC10-1:4 | SEQ6790 | 2.2E+00 |
| lnc-CCNL2-3:1 | SEQ6791 | 2.2E+00 |
| lnc-BCL7B-1:5 | SEQ6792 | 2.2E+00 |
| lnc-METTL2B-3:16 | SEQ6793 | 2.2E+00 |
| lnc-FAM72B-12:1 | SEQ6794 | 2.2E+00 |
| lnc-SLC39A3-2:1 | SEQ6795 | 2.2E+00 |
| lnc-MSH3-2:1 | SEQ6796 | 2.2E+00 |
| lnc-OTP-4:2 | SEQ6797 | 2.2E+00 |
| lnc-SNURF-9:1 | SEQ6798 | 2.2E+00 |
| lnc-DCHS2-1:1 | SEQ6799 | 2.1E+00 |
| EIF3J-AS1:3 | SEQ6800 | 2.1E+00 |
| lnc-VPREB1-7:14 | SEQ6801 | 2.1E+00 |
| lnc-CLASP2-3:1 | SEQ6802 | 2.1E+00 |
| lnc-BICD1-1:1 | SEQ2413 | 2.1E+00 |
| lnc-NIPA1-1:3 | SEQ6803 | 2.1E+00 |
| lnc-MBTPS1-1:1 | SEQ6804 | 2.1E+00 |
| lnc-SLC35G3-1:4 | SEQ6805 | 2.1E+00 |
| lnc-STK16-4:1 | SEQ6806 | 2.1E+00 |
| TTC28-AS1:2 | SEQ6807 | 2.1E+00 |
| lnc-ECE1-2:2 | SEQ6808 | 2.1E+00 |
| lnc-DNA2-1:1 | SEQ6809 | 2.1E+00 |
| lnc-TCF3-2:2 | SEQ6810 | 2.1E+00 |
| lnc-POLR21-1:1 | SEQ6811 | 2.1E+00 |
| lnc-GRM1-1:4 | SEQ6812 | 2.1E+00 |
| lnc-ADAMTS18-1:1 | SEQ6813 | 2.1E+00 |
| lnc-CCDC56-2:1 | SEQ6814 | 2.1E+00 |
| lnc-SLC30A10-7:1 | SEQ6815 | 2.1E+00 |
| lnc-AL627171.1-1:1 | SEQ6816 | 2.1E+00 |
| lnc-ARL6IP4-1:6 | SEQ6817 | 2.1E+00 |
| lnc-DNAJC5-1:3 | SEQ5372 | 2.1E+00 |
| lnc-SMYD5-1:4 | SEQ6818 | 2.1E+00 |
| lnc-NAP1L5-3:1 | SEQ6819 | 2.1E+00 |
| lnc-APBA2-1:8 | SEQ6820 | 2.1E+00 |
| lnc-WTAP-2:2 | SEQ6821 | 2.1E+00 |
| MIF-AS1:8 | SEQ2383 | 2.1E+00 |
| lnc-NCAPD3-2:1 | SEQ6822 | 2.1E+00 |
| lnc-ZBTB8OS-3:1 | SEQ6823 | 2.1E+00 |
| lnc-EXTL3-6:7 | SEQ6824 | 2.1E+00 |
| lnc-MKKS-4:1 | SEQ6825 | 2.1E+00 |
| lnc-CWH43-3:1 | SEQ6826 | 2.1E+00 |
| lnc-FAM75A4-3:3 | SEQ6827 | 2.1E+00 |
| lnc-PKHD1L1-2:11 | SEQ6828 | 2.1E+00 |
| lnc-TUBB3-3:1 | SEQ6829 | 2.1E+00 |
| lnc-ARHGAP15-2:3 | SEQ2483 | 2.1E+00 |
| lnc-NAB1-2:2 | SEQ6830 | 2.1E+00 |
| lnc-KCNT1-6:1 | SEQ2699 | 2.1E+00 |
| lnc-GRSF1-1:1 | SEQ4817 | 2.1E+00 |
| lnc-LYRM7-3:1 | SEQ6831 | 2.1E+00 |
| lnc-RNF111-2:1 | SEQ6832 | 2.1E+00 |
| lnc-DCTN5-1:2 | SEQ6833 | 2.1E+00 |
| lnc-C3orf38-3:3 | SEQ6834 | 2.1E+00 |
| lnc-PXDC1-12:3 | SEQ4641 | 2.1E+00 |
| lnc-EGLN2-1:1 | SEQ6835 | 2.1E+00 |
| lnc-GRID2IP-1:2 | SEQ6836 | 2.1E+00 |
| lnc-RP11-977G19.10.1-1:3 | SEQ6837 | 2.1E+00 |
| lnc-THAP4-4:1 | SEQ6838 | 2.1E+00 |
| lnc-AL139333.1-1:1 | SEQ6839 | 2.1E+00 |
| lnc-UXS1-4:7 | SEQ6840 | 2.1E+00 |
| lnc-ZNF746-3:4 | SEQ6841 | 2.1E+00 |
| lnc-FAM213A-1:1 | SEQ6842 | 2.1E+00 |
| lnc-RP11-219B4.5.1-2:1 | SEQ6843 | 2.1E+00 |
| lnc-PRR3-1:2 | SEQ6844 | 2.1E+00 |
| lnc-IL17RC-3:3 | SEQ6845 | 2.1E+00 |
| lnc-C11orf48-1:2 | SEQ6846 | 2.1E+00 |
| lnc-FRG1B-2:3 | SEQ6847 | 2.1E+00 |
| lnc-SNAP47-2:1 | SEQ5143 | 2.1E+00 |
| lnc-AKT3-6:1 | SEQ6848 | 2.1E+00 |
| lnc-ITGB3BP-5:5 | SEQ6849 | 2.1E+00 |
| lnc-AL049840.1-2:1 | SEQ6850 | 2.1E+00 |
| lnc-HIGD1C-1:7 | SEQ6851 | 2.0E+00 |
| lnc-CNP-1:1 | SEQ3058 | 2.0E+00 |
| lnc-PRPF31-2:1 | SEQ6852 | 2.0E+00 |
| lnc-BX255923.1-5:1 | SEQ6853 | 2.0E+00 |
| lnc-GUCY1A2-1:1 | SEQ6854 | 2.0E+00 |
| LINC00674:12 | SEQ6855 | 2.0E+00 |
| lnc-ARMCX6-3:1 | SEQ6856 | 2.0E+00 |
| lnc-ODF4-4:1 | SEQ6857 | 2.0E+00 |
| lnc-DDX19B-2:1 | SEQ6858 | 2.0E+00 |
| lnc-CLNS1A-3:1 | SEQ6859 | 2.0E+00 |
| lnc-PPIL1-2:2 | SEQ6860 | 2.0E+00 |
| lnc-PSMA3-1:1 | SEQ6861 | 2.0E+00 |
| lnc-TCEANC2-2:2 | SEQ6862 | 2.0E+00 |
| LINCO1123:5 | SEQ6863 | 2.0E+00 |
| lnc-CLPB-1:1 | SEQ6864 | 2.0E+00 |
| lnc-RNMT-1:1 | SEQ6865 | 2.0E+00 |
| lnc-CUEDC1-2:1 | SEQ6866 | 2.0E+00 |
| lnc-NAB1-2:3 | SEQ6867 | 2.0E+00 |
| lnc-MUC5B-1:1 | SEQ5724 | 2.0E+00 |
| lnc-BDH1-5:9 | SEQ6868 | 2.0E+00 |
| lnc-CTDSP2-2:6 | SEQ6869 | 2.0E+00 |
| lnc-LRRC40-3:1 | SEQ6870 | 2.0E+00 |
| lnc-C5orf32-3:1 | SEQ6871 | 2.0E+00 |
| lnc-RPP38-5:1 | SEQ5046 | 2.0E+00 |
| lnc-JAG1-6:1 | SEQ2547 | 2.0E+00 |
| lnc-FGF14-1:1 | SEQ6872 | 2.0E+00 |
| lnc-ZNF8-4:1 | SEQ6873 | 2.0E+00 |
| lnc-CPLX1-2:11 | SEQ6874 | 2.0E+00 |
| lnc-KRT80-3:1 | SEQ3433 | 2.0E+00 |
| lnc-CPSF3-2:1 | SEQ6875 | 2.0E+00 |
| lnc-PROKR2-1:1 | SEQ6876 | 2.0E+00 |
| lnc-POLD1-2:1 | SEQ6877 | 2.0E+00 |
| lnc-C16orf52-1:1 | SEQ6878 | 2.0E+00 |

The correlation between 31 lncRNAs identified in the invention and neurocognitive MMSE (Mini-Mental State Examination) test or cerebrospinal fluid CSF biomarkers Abeta and Tau or phosphorylated tau or age were examined. The result is shown in Table 13.

TABLE 13

Correlation between blood lncRNAs and neurocognitive MMSE test or cerebrospinal fluid CSF biomarkers Abeta and Tau or phosphorylated tau or age.

|  |  | ab42 n=70 | tau 70 | ptau 70 | MMSE 84 | age 137 |
|---|---|---|---|---|---|---|
| ab42 | r | 1.000 | −0.207 | −.322* | 0.067 | 0.044 |
| tau | r | −0.207 | 1.000 | .853* | 0.028 | 0.117 |
| FTX_19 | r | .266* | 0.000 | −0.076 | −0.032 | −0.093 |
| LEF1_AS1_1 | r | −0.121 | 0.013 | −0.016 | 0.089 | −.364** |
| lnc_ADAD1_3_1 | r | .302* | 0.031 | −0.050 | −0.089 | −0.124 |
| lnc_ANKRD36_1_4 | r | −0.053 | −0.191 | −0.138 | 0.035 | −.222** |
| lnc_ATP6AP2_13_1 | r | −0.218 | 0.113 | 0.196 | −.216* | 0.151 |
| lnc_CA6_8_1 | r | 0.003 | −0.067 | −0.030 | .220* | −0.133 |
| lnc_CA6_8_2 | r | 0.080 | 0.035 | 0.047 | .351** | −0.082 |
| lnc_CDIPT_2_1 | r | −0.058 | −0.086 | 0.051 | .255* | −0.073 |
| lnc_CGREF1_2_1 | r | .494** | −0.089 | −0.177 | −0.099 | −0.156 |
| lnc_EVX1_15_1 | r | .255* | 0.005 | −0.027 | 0.193 | −0.078 |
| lnc_IL31RA_1_1 | r | 0.231 | −0.053 | −0.077 | 0.164 | −.360* |
| lnc_KIF14_1_2 | r | 259* | 0.075 | −0.021 | 0.035 | −0.015 |
| lnc_NEMF_1_4 | r | −.325* | 0.089 | 0.168 | 0.096 | .213* |
| lnc_NID1_4_4 | r | .305* | 0.118 | 0.053 | 0.038 | −0.130 |
| lnc_OCM_3_4 | r | 0.088 | −0.087 | −0.128 | 0.206 | −.308** |
| lnc_PCP4L1_3_2 | r | .342* | 0.072 | −0.035 | −0.015 | −0.167 |
| lnc_PDGFA_6_2 | r | −.290* | 0.130 | 0.204 | 0.103 | .179* |
| lnc_SLC35E3_8_2 | r | .386** | 0.002 | −0.069 | −0.084 | −0.106 |
| lnc_SOCS6_10_1 | r | .321** | −0.135 | −0.209 | −0.160 | −0.069 |
| lnc_STX10_2_1 | r | −.276** | 0.141 | 0.218 | 0.079 | −0.002 |
| lnc_UQCC3_2_1 | r | −.356** | −0.003 | 0.086 | 0.161 | 0.114 |
| lnc_USP47_2_1 | r | .2377** | −0.047 | −0.042 | 0.210 | −0.080 |
| lnc_ZCCHC13_4_1 | r | 329** | 0.081 | −0.019 | −0.043 | −0.120 |
| lnc_ZNF516_14_1 | r | .270** | 0.025 | −0.060 | −0.003 | −0.097 |
| MYLK_AS1_13 | r | .419** | −0.031 | −0.183 | 0.031 | −.247** |
| OIP5_AS1_36 | r | .316** | −0.075 | −0.110 | 0.079 | −.227** |
| PCBP1_AS1_302 | r | .251* | 0.048 | −0.058 | −0.152 | 0.026 |
| TCONS_00017372 | r | −.306* | 0.083 | 0.118 | 0.038 | .182* |
| TTC21B_AS1_2 | r | 0.193 | 0.005 | 0.027 | −0.001 | .194* |
| lnc-FOXD4L5-16:1 | r | −.341* | 0.120 | 0.174 | 0.100 | 0.059 |
| lnc-ZC3H12B-11:1 | r | .302* | −0.094 | −0.227 | −0.045 | −.235** |

In all lncRNAs examined, except ANKRD36-1-4, the correlation with age still remained significant for subject groups after adjusting with age by generalized linear model, indicating that the differential expression of selected lncRNAs when comparing subject groups is not due simply to an age effect but to the disease effect, highlighting their relevance for diagnosis and/or therapeutic applications for the respective dementia types.

To further select the best candidates of lncRNAs, fold change (FC) and AUC were calculated for each lncRNA and for each tested condition. lncRNA candidates were selected when differential expression was determined based on an appropriate fold-change (FC) such as a FC >1.2 (or <0.8) and/or an appropriate AUC such as AUC >0.65 (or <0.35) when comparing two groups. Random Forest algorithm (Breimann 2001, Breiman and Cutler 2001) was used to build the model and also to select the top ranked lncRNAs. A predictive model based on the combination of the list of top ranked candidates comprising at least 2 lncRNAs enables to predict the disease with an accuracy of ≥65% and up to 100%.

The predictive modelling based on the random forest algorithm to discriminate between mild cognitive impairment (MCI) patient and healthy control populations when using the total of the 844 lncRNAs measurable in whole blood samples and having an AUC ≥0.8 (or ≤0.2) described in the Table 11 enabled to show that the AUC in function of the number of lncRNAs reached a plateau with the following 2 lncRNAs. These 2 lncRNAs were used to construct the model. The results show that this lncRNA signature enabled a discrimination between the 2 populations (Mild cognitive impairment patient and healthy control populations) with an AUC value=1, an accuracy=100%, sensitivity=100% and specificity=100%.

| lncRNA | Rank |
|---|---|
| TCONS_00035093 | 1 |
| lnc-OCM-3:4 | 2 |

The predictive modelling based on the random forest algorithm to discriminate between mild AD patient and healthy control populations when using the total of the 500 lncRNAs measurable in whole blood and having an AUC ≥0.7 (or ≤0.3) described in the Table 11, enabled to show that the AUC in function of the number of lncRNAs reached a plateau with the following 7 lncRNAs. These 7 lncRNAs were used to construct the model. The results show that this lncRNA signature enabled a discrimination between the 2 populations (mild AD patient and healthy control populations) with an AUC value=0.954, an accuracy=91%, sensitivity=90% and specificity=91%.

| lncRNA | Rank |
|---|---|
| lnc-KIF14-1:2 | 1 |
| PCBP1-AS1:302 | 2 |
| lnc-CA6-8:1 | 3 |
| NEAT1:22 | 4 |

| lncRNA | Rank |
|---|---|
| lnc-CA6-8:2 | 5 |
| STARD7-AS1:5 | 6 |
| lnc-IL31RA-1:1 | 7 |

The predictive modelling based on the random forest algorithm to discriminate between moderate-to-severe AD patient and healthy control populations when using the total of the 605 lncRNAs measurable in whole blood and having an AUC ≥0.65 (or ≤0.35) described in the Table 11, enabled to show that the AUC in function of the number of lncRNAs reached a plateau with the following 6 lncRNAs. These 6 lncRNAs were used to construct the model. The results show that this lncRNA signature enabled a discrimination between the 2 populations (moderate to severe AD patient and healthy control populations) with an AUC value=0.922, an accuracy=83%, sensitivity=70% and specificity=91%.

| lncRNA | Rank |
|---|---|
| lnc-CA6-8:2 | 1 |
| lnc-ANKRD36-1:4 | 2 |
| lnc-ATP6AP2-13:1 | 3 |
| lnc-SOCS6-10:1 | 4 |
| lnc-CDIPT-2:1 | 5 |
| lnc-USP47-2:1 | 6 |

The predictive modelling based on the random forest algorithm to discriminate between all AD patient (mild+ moderate-to-severe) and healthy control populations when using the total of the 1124 lncRNAs measurable in whole blood and having an AUC ≥0.65 (or ≤0.35) described in the Table 11, enabled to show that the AUC in function of the number of lncRNAs reached a plateau with the following 7 lncRNAs. These 7 lncRNAs were used to construct the model. The results show that this lncRNA signature enabled a discrimination between the 2 populations (AD patient and healthy control populations) with an AUC value=0.954, an accuracy=91%, sensitivity=88% and specificity=92%.

| lncRNA | Rank |
|---|---|
| lnc-CA6-8:2 | 1 |
| lnc-CA6-8:1 | 2 |
| RBM26-AS1:1 | 3 |
| PCBP1-AS1:302 | 4 |
| MIR181A2HG:1 | 5 |
| TTC21B-AS1:2 | 6 |
| lnc-SOCS6-10:1 | 7 |

The predictive modelling based on the random forest algorithm to discriminate between dementia with Levy bodies patient and healthy control populations when using the total of the 1352 lncRNAs measurable in whole blood and having an AUC ≥0.8 (or ≤0.2) described in the Table 11, enabled to show that the AUC in function of the number of lncRNA reached a plateau with the following 2 lncRNAs. These 2 lncRNAs were used to construct the model. The results show that this lncRNA signature enabled a discrimination between the 2 populations (Dementia with Levy bodies patient and healthy control populations) with an AUC value=1, an accuracy=100%, sensitivity=100% and specificity=100%.

| lncRNA | Rank |
|---|---|
| lnc-OCM-3:4 | 1 |
| lnc-SLC35E3-8:1 | 2 |

The predictive modelling based on the random forest algorithm to discriminate between frontotemporal dementia patient and healthy control populations when using the total of the 1041 lncRNAs measurable in whole blood and having an AUC ≥0.8 (or ≤0.2) described in the Table 4, enabled to show that the AUC in function of the number of lncRNA reached a plateau with the following 3 lncRNAs. These 3 lncRNAs were used to construct the model. The results show that this lncRNA signature enabled a discrimination between the 2 populations (Frontotemporal dementia patient and healthy control populations) with an AUC value=1, an accuracy=100%, sensitivity=100% and specificity=100%.

| lncRNA | Rank |
|---|---|
| lnc-ZCCHC13-4:1 | 1 |
| PCBP1-AS1:302 | 2 |
| lnc-NEMF-1:4 | 3 |

The predictive modelling based on the random forest algorithm to discriminate between All AD patients' population and NAD (FTD+DLB) patients populations when using the total of the 6 lncRNAs measurable in whole blood and having an AUC ≥0.65 (or ≤0.35) described in the Tables 11, 12, enabled to show that the AUC in function of the number of lncRNA reached a plateau with the following 6 lncRNAs. These X6 lncRNAs were used to construct the model. The results show that this lncRNA signature enabled a discrimination between the 2 populations (AD populations and population suffering other dementia types) with an AUC value=0,804, an accuracy=79%, sensitivity=56% and specificity=91%.

| lncRNA | rank |
|---|---|
| lnc-STAT3-1:2 | 1 |
| lnc-NEMF-1:4 | 2 |
| lnc-EPN2-3:2 | 3 |
| lnc-SLC25A39-2:1 | 4 |
| lnc-ARF6-1:1 | 5 |
| lnc-CCNYL1-2:1 | 6 |

The predictive modelling based on the random forest algorithm to discriminate between All AD patients' population and DLB, FTD patients+healthy control populations when using the total of the 5 lncRNAs measurable in whole blood and having an AUC ≥0.65 (or ≤0.35) described in the Table 4, enabled to show that the AUC in function of the number of lncRNAs reached a plateau with the following 5 lncRNAs. These 5 lncRNAs were used to construct the model. The results show that this lncRNA signature enabled a discrimination between the 2 populations (AD population and population either suffering other dementia type or having normal cognitive status) with an AUC value=0,811, an accuracy=72%, sensitivity=61% and specificity=81%.

| lncRNA | rank |
| --- | --- |
| ANKRD44-IT1:1 | 1 |
| APOBEC3B-AS1:2 | 2 |
| ADAMTSL4-AS1:2 | 3 |
| AGAP2-AS1:2 | 4 |
| A1BG-AS1:14 | 5 |

As for diagnosis, for differential diagnosis, several other lncRNAs panels were identified such as those listed below comprising at least 3 lncRNAs from Tables 11, 12 and enabling to detect each dementia type specifically:

| Panel Example 1 | Panel Example 2 | Panel Example 3 | Panel Example 4 |
| --- | --- | --- | --- |
| LEF1-AS1:1 | lnc-CGREF1-2:1 | TCONS_00011994 | OIP5-AS1:36 |
| PCBP1-AS1:302 | PSMB8-AS1:14 | lnc-EVX1-15:1 | MYLK-AS1:13 |
| lnc-CA6-8:2 | lnc-STX10-2:1 | lnc-REC8-2:1 | lnc-PCP4L1-3:2 |
| | lnc-TCFL5-6:1 | | |
| | ZC3H12B-11:1 | | |

The signature of the following 11 top ranked lncRNAs expressed in whole blood (Paxgene RNA samples) enabled an excellent discrimination between HC group and all other groups (MCI, all AD, DLB, FTD) with AUC=0.963, accuracy=93.4%, sensitivity=65% and specificity=98.3%.

| lncRNA | Rank |
| --- | --- |
| PCBP1-AS1:302 | 1 |
| STARD7-AS1:5 | 2 |
| lnc-NID1-4:4 | 3 |
| RBM26-AS1:1 | 4 |
| LEF1-AS1:1 | 5 |
| lnc-CA6-8:1 | 6 |
| lnc-CA6-8:2 | 7 |
| lnc-OCM-3:4 | 8 |
| lnc-AFG1L-7:1 | 9 |
| lnc-LASP1-5:1 | 10 |
| lnc-GCGR-1:2 | 11 |

The signature of the following 7 top ranked lncRNAs expressed in whole blood (Paxgene RNA samples) enabled an excellent discrimination between HC group and patients with mild AD, with with accuracy=90.7%, sensitivity=90% and specificity=91.2%.

| lncRNA | Rank |
| --- | --- |
| lnc-KIF14-1:2 | 1 |
| PCBP1-AS1:302 | 2 |
| lnc-CA6-8:1 | 3 |
| NEAT1:22 | 4 |
| lnc-CA6-8:2 | 5 |
| STARD7-AS1:5 | 6 |
| lnc-IL31RA-1:1 | 7 |

The signature of the following 7 top ranked lncRNAs expressed in whole blood (Paxgene RNA samples) enabled an excellent discrimination between HC group and patients with moderate to severe AD with accuracy=83.3%, sensitivity=70% and specificity=91.2%.

| | |
| --- | --- |
| lnc-CA6-8:2 | 1 |
| lnc-ANKRD36-1:4 | 2 |
| lnc-ATP6AP2-13:1 | 3 |
| lnc-SOCS6-10:1 | 4 |
| lnc-CDIPT-2:1 | 5 |
| lnc-USP47-2:1 | 6 |
| lnc-UXS1-3:1 | 7 |

The signature of the following 3 top ranked lncRNAs expressed in whole blood (Paxgene RNA samples) enabled an excellent discrimination between HC group and patients with dementia with Lewy bodies with accuracy=100%, sensitivity=100% and specificity=100%.

| | |
| --- | --- |
| lnc-OCM-3:4 | 1 |
| lnc-SLC35E3-8:1 | 2 |
| LINC-PINT:11 | 3 |

The signature of the following 2 top ranked lncRNAs expressed in whole blood (Paxgene RNA samples) enabled an excellent discrimination between HC group and patients with frontotemporal dementia with accuracy=100%, sensitivity=100% and specificity=100%.

| | |
| --- | --- |
| lnc-ZCCHC13-4:1 | 1 |
| PCBP1-AS1:302 | 2 |

The signature of the following 5 top ranked lncRNAs expressed in whole blood (Paxgene RNA samples) enabled an excellent discrimination between AD patients (with mild AD patients and moderate-to severe AD) and non-AD dementia group (FTD+DLB) with accuracy=76.5%, sensitivity=55.9% and specificity=86.8%.

| lncRNA | rank |
| --- | --- |
| lnc-JUNB-1:1 | 1 |
| lnc-RARB-4:1 | 2 |
| lnc-ZNF284-1:1 | 3 |
| TCONS_00035093 | 4 |
| lnc-TELO2-3:3 | 5 |

The signature of the following 5 top ranked lncRNAs expressed in whole blood (Paxgene RNA samples) enabled an excellent discrimination between AD patients (with mild AD patients and moderate-to severe AD) and non-AD dementia group (FTD+DLB) with accuracy=82.4%, sensitivity=61.8% and specificity=92.6%.

| lncRNA | Rank |
| --- | --- |
| lnc-CGREF1-2:1 | 1 |
| PSMB8-AS1:14 | 2 |
| lnc-STX10-2:1 | 3 |
| lnc-TCFL5-6:1 | 4 |
| lnc-ZC3H12B-11:1 | 5 |

Material and Methods

To identify lncRNAs in brain, serum, plasma, whole blood or other samples of human subjects, total RNA was first extracted and sequencing libraries were prepared by removal of ribosomic RNA (RiboZero TruSeq library preparation kit, Illumina Inc. San Diego, USA) and sequenced on Illumina NextSeq500 with 2×75 bp read length.

lncRNAs were also measured by qPCR using specific primers. For this, total RNA was first extracted, reverse transcription and real time PCR using specific primers were performed. Using FiMAP (also called Quantamatrix QMAP platform and also a new fully automatized version QMX), a proprietary platform based on hybridization of PCR products on coated microdiscs with complementary oligonucleotide coupled to detection probes. Total RNA was extracted followed by reverse transcription and PCR step allowing multiplexing of several targets using specific primers to the lncRNAs.

To show the efficacy of FiMAP as a multiplexed platform capable to quantify lncRNAs, plasma samples have been tested using NGS, qPCR, Celemics and FiMAP. Most of the lncRNAs showed that they are well quantified since the dilutions of the input RNAs are concentration dependent manner measured on QMAP, and that for lncRNA 20321 very equivalent results were obtained when using the reference qPCR method. Quantification was therefore performed on the FiMAP platform using coded microdiscs specific of each lncRNA.

Patient Population and Samples

Brain tissue biopsies: postmortem brain medio-temporal cortex tissue samples and the blood samples other than from the below-mentioned prospective studies, as well peripheral organ biopsies: lung, ovary, colon, prostate, breast, liver, bladder, kidney, skin, heart, muscle) were from diverse European hospitals and Firalis biobanks.

Body fluid samples: Body fluid samples were from healthy volunteers (HV), donors at the "Etablissement Français du Sang" (EFS) of Mulhouse, France, and from cognitively intact healthy control subjects and from patients with mild cognitive impairment or with different stages of Alzheimer's disease (AD) or with other dementia types recruited, according to the protocols of European hospitals accepted by country ethic committees, and in the Amoneta Diagnostics sponsored prospective studies registered to the Agence Nationale de Sécurité du Médicament et des Produits de Santé (ANSM) such as under the ID RCB: 2015-A00118-41 on Jan. 22, 2015, the ID RCB: 2016-A200227-44 on Feb. 4, 2016. Whole blood samples were collected in Paxgene RNA tubes. Serum or plasma samples were prepared from blood samples collected in lithium-heparin tubes or EDTA tubes and CSF, urine, saliva and tears were collected using polypropylene tubes.

Results shown in tables and drawings from the invention are those obtained in 10 postmortem brain samples (5AD, 5 HC), 24 serum samples (12 AD and 12 HC), 12 plasma samples (6 AD and 6 HC) and 139 samples from the following subject groups:

| Subject Group | Gender | | |
|---|---|---|---|
| | Male | Female | Total |
| HC | 6 | 14 | 20 |
| MCI | 8 | 7 | 15 |
| Mild AD | 15 | 19 | 34 |
| Mod-SevAD | 11 | 23 | 34 |
| DLB | 5 | 10 | 15 |
| FTD | 2 | 17 | 19 |
| Other diseases | 2 | 0 | 2 |
| Total | 49 | 90 | 139 |

Method for lncRNAs
Samples Sequencing

Ribonucleic acid (RNA) extraction is performed starting from 1.5 ml of serum, using Norgen Serum/plasma extraction and RNA Clean-Up and Concentration Micro-Elute Kits according to the manufacturer's instructions. Sequencing libraries are prepared from the total amount of extracted RNA, using the Illumina TruSeq stranded total RNA library preparation kit combined with the human/mouse/rat RiboZero rRNA removal kit (Illumina Inc. San Diego, USA, C). All steps are performed with the low-throughput protocol and according to the manufacturer's instructions, with no fragmentation step. Briefly, cytoplasmic ribosomal RNA (rRNA) are hybridized to biotinylated target-specific oligos and removed using streptavidin coated magnetic beads. rRNA depleted RNA samples are then reverse transcribed into complementary deoxyribonucleic acid (cDNA). To ensure strand specificity, single stranded cDNA is first synthetized using Super-Script II reverse transcriptase (Invitrogen) and random primers in the presence of Actinomycin D, and then converted to double stranded cDNA with the second strand marking mix that incorporates dUTP in place of dTTP. Resulting blunt ended cDNA are purified using AMPure XP magnetic beads. After a 3'end adenylation step, Illumina's adapters ligation is performed. So, obtained singled indexed libraries are washed twice using AMPure XP beads to remove excess adapters and enriched by PCR (15 cycles). PCR products are purified with a final AMPure XP beads wash and sequencing ready libraries are eluted in 30 µl of resuspension buffer.

For quality control, 1 µl of each library is run on the Agilent Technologies 2100 Bioanalyzer using a DNA 1000 chip according to the manufacturer's recommendations. Absence of adapter dimers is checked and the average library size is determined by a region table. Libraries are quantified on Qubit 2.0 using Qubit dsDNA High Sensitivity assay kit (Invitrogen). Library size previously determined on the Bioanalyzer is used to calculate molar concentrations from mass concentrations. All libraries are sequenced with the Illumina NextSeq500 (2×75 bp).

Bioinformatic Analysis
lncRNA Based on the *Homo sapiens* hg38 Genome

RNA-seq data analysis is performed using Partek Flow (Partek Inc., St Louis, MO, USA build 6). The pre-alignment QA/QC module of Partek Flow is used to visualize the read quality of the FASTQ files. All reads are examined. The raw FASTQ files are trimmed at the 3' end in function of their quality score (Phred score). The parameters used are an end minimum quality level of 30 and a minimum trimmed read length of 50. Unaligned reads are mapped using the *Homo sapiens* hg38 genome. This mapping is done using the software STAR version 2.5.3 (Dobin A. et al., 2013). STAR: ultrafast universal RNA-seq aligner. Bioinforma. Oxf. Engl. 29, 15-21). The default parameters are used. The post-alignment QC module of Partek Flow was used to visualize the average base quality score per position as well as the mapping quality per alignment. The mapped reads were quantified using the GTF file with the patented lncRNA annotation for quantification using the Partek Expectation/Maximization (E/M) algorithm (Xing Y. et al, 2006). An expectation-maximization algorithm for probabilistic reconstructions of full-length isoforms from splice graphs. Nucleic Acids Res. 34, 3150-3160). The default parameters are used. The transcripts where their medians are under the median read density in intergenic regions are discarded for the next steps of the analysis. The transcript counts were normalized by CPM (counts per million). Only transcripts showing high expression (CPM ≥5) in at least half the samples of one group are considered.

Novel lncRNAs Discovery

The novel discovery was performed by using UCIncR pipeline version 1.1.1 (Sun Z. et al., Scientific Reports, 7 (1): 14196, 2017). In this pipeline, StringTie version 1.3.4d (Pertea M. et al., Nat Biotechnol, 33 (3): 290-295, 2015) was used for the reconstruction.

The "cuffcompare" program version 2.2.1 (C. Trapnell et al., 'Nat Protoc, 7 (3): 562-578, 2012) was used to compare the assembled transcripts to the reference annotated GTF file (Gencode 27 and LNCipedia 5) and to generate a new GTF file with all transcripts from 9 samples for further analysis.

Filtering was done on Transfrag class codes generated by cuffcompare, transcript length, number of exons and protein coding potential. Firstly, the transcripts with code 'i', 'j', 'o', 'u', 'x' and '.' were extracted, all of which could potentially include novel lncRNAs. The 'i' category, for example, could contain the lncRNAs entirely within the intron of known genes. Similarly, the 'j' category could be long non-coding isoforms of known genes. The 'o' category could include novel lncRNAs having generic exonic overlap with known transcripts. The 'u' category could be long intergenic non-coding RNAs (lincRNAs). The 'x' category could contain novel lncRNAs on the opposite strand of reference genes. The '.' category may be sequences with multiple classifications. Following this, only the transcripts with a length of ≥200 nt and with at least 2 exons were kept for the next step. CPAT (Coding-Potential Assessment Tool, L. Wang L., et al., Nucleic Acids Res, 41 (6): e74,2013.) is used for the evaluation the non-coding potential. The transcripts with CPAT score <0.3 were considered as non-coding. A new GTF file was generated with the final list of selected novel lncRNAs.

Fastq files of GSE45326 were downloaded from ArrayExpress [9]. The dataset includes RNA-seq data of 12 normal human tissues. The paired-end sequencing was performed on ribominus total RNA library. Reads alignment was performed as described before. The quantification was done with the novel lncRNA annotation using the Partek E/M algorithm.

Statistical Analysis and Predictive Modelling

To determine differentially expressed lncRNA, a statistical analysis is performed using Wilcoxon Mann-Whitney parametric test to compare 2 groups of subjects. A lncRNA with a p value≤0.05 is considered as differentially expressed. Anova test is used for comparison of more than 2 subject groups.

In order to build classification models for the 2 classifications, the Classification for MicroArrays (CMA) package of R (Slawski M, Daumer M, Boulesteix A L. CMA: a comprehensive Bioconductor package for supervised classification with high dimensional data. BMC Bioinformatics 2008, 9:439) with a leave-one-out cross-validation has been used.

The algorithms used for this predictive modelling are (a) random forest, (b) linear discriminant analysis and (c) naïve Bayes (Breiman L. Random forests. Machine Learning, 45 (1): 5-32, 2001).

The rank of the RNA candidate in a model was calculated by the mean rank of 10 candidates' selections (per CV-fold). Per model (and RNA selection method) the AUC was plotted as a function of the number of RNAs in the model. The optimal number of RNAs per model was determined graphically. ROC curves and confusion matrices were generated to assess the predictive performance of our models. The values of AUC, accuracy, sensitivity, specificity, positive and negative predictive values are reported.

Additional Method for Quantification of lncRNA

Total RNA Extraction

Total RNA was extracted using Paxgene Blood RNA kit (Qiagen, France) and Serum/Plasma mini kit (Norgen Biotek, Canada) respectively, according to manufacturer's instructions. RNA quality was examined on an Agilent 2100 Bioanalyzer with the RNA 6000 Nano Kits (Agilent, France). RNA quantity was measured on Qubit 3.0 fluorometer using RNA High sensitivity kit (Fisher Scientific, France).

cDNA Synthesis

Reverse transcription was performed using high capacity cDNA reverse transcription kit (Fisher scientific, France) according to the manufacturer instructions.

qPCR Quantification lncRNA were preamplified before qPCR. Preamplification reactions were prepared using Applied Biosystems preamplification master mix with 0.1× (100 nM) of each of the primers pairs corresponding to the lncRNAs. 16 preamplification cycles were performed as preconized by the furnisher (50° C. 2 minutes, 96° C. 10 minutes, 40 cycles at 95° C. for 15 seconds and 60° C. for 1 minute). Quantitative PCR of biological samples was done in 10 µl total volume with 1 µl of preamplification product diluted 1/20 in TE buffer, 5 µl of 2× Soadvanced SYBR green PCR master mix (Biorad, USA) and 250 nM of each primer. Cycling conditions were 95° C. for 5-10 min followed by 40 cycles of 95° C. for 10-30 sec and 60° C. 30-60 sec. A melting curve analysis (60° C. to 99° C.) was performed after the thermal profile to ensure specificity in the amplification. Relative expression level was determined against a standard curve realized on a 5 log scale using CFX maestro Software (Biorad, USA).

QUANTAMATRIX FIMAP Quantification lncRNAs of interest were also quantified using the FIMAP/QMAP platform developed by Quantamatrix (South Korea). Briefly, lncRNAs were amplified by PCR using primers with the same sequences as for qPCR that were chemically modified. Forward primers were phosphorylated in 5' and Reverse primers biotinylated in 5'. Multiplexed PCR reactions were performed on Biorad T100 thermocycler in 20 µl reactions containing 2 µl of lncRNA cDNA, 250 nM of each primers and 10 µl of 2× One Taq Hot Start 2× master Mix (New England Biolabs, USA) with the following conditions: 30 seconds at 94° C., 25 cycles of 30s at 94° C., 1 min at 60° C. and 1 min at 68° C., followed by a final extension at 68° C. for 5 minutes. PCR products were then digested with 25 U of lambda exonuclease for 30 minutes at 37° C. to eliminate the phosphorylated strand and keep only the biotinylated ones. So digested products were quantified on QMAP using coded silica microdisks coated with oligos complementary to the RNAs of interest (one code per target oligo). Briefly, biotinylated PCR products were incubated with the coated microdisks in a 96 well plate, and hybridized products revealed by addition of a fluorescent streptavidin conjugate, SAPE (Prozyme, Denmark) after washing steps. Plates were imaged on QMAP that takes 2 images per spot: one dark image to quantify the fluorescence and 1 white light image to read the microdisks codes. Each target relative expression is then calculated by QMAP software by assigning fluorescence signal to each target according to the associated microdisk code.

lncRNAs were also measured by qPCR using specific primers. For this, total RNA was first extracted, reverse transcription and real time PCR using specific primers were performed. Using FiMAP (also called Quantamatrix QMAP platform and also a new fully automatized version QMX), a proprietary platform based on hybridization of PCR products on coated microdiscs with complementary oligonucleotide coupled to detection probes. Total RNA was extracted followed by reverse transcription and PCR step allowing multiplexing of several targets using specific primers to the lncRNAs.

To show the efficacy of FiMAP as a multiplexed platform capable to quantify lncRNAs, plasma samples have been tested using NGS, qPCR, Celemics and FiMAP. Most of the lncRNAs showed that they are well quantified on the QMAP and quantitative with dilutions linearity in function of the input RNAs concentration on a dose dependent manner measured on QMAP with very equivalent results obtained when using the reference qPCR method as for the known reference lncRNA 20321.

Quantification performed on the FiMAP platform using coded microdiscs specific of each lncRNA was appropriate for multiplexing testing platform.

Celemics Description

Celemics is based on a targeted sequencing approach using capture probes of 120 nucleotides that hybridize with the selected lncRNAs with magnetics beads. The capture step is performed following library preparation describe above. Briefly, 100 ng of library DNA is used in a volume of 3.4 µl mixed with 5.6 µl of Block Mix. Then, 7 µL of the Capture Library and 13 µL of the Hybridization Buffer is mixed with 9 µl of the DNA library preparation and incubated 24 h at 65° C. After the incubation, 50 µl of Dynabeads Myone Steptavidin T1 are mixed with 200 µl of wash buffer #1 and added to the hybridization mixture. After removal of supernatant under magnetic condition, 500 µl of wash buffer #2 is added and removed using separator and wash 3 to 6 time with wash buffer #3 and then add 30 µl of nuclease free water for elution. Library is then amplified using PCR mixing on beads Captured DNA (15 µl), PCR post capture primer (5 µl), KAPA Library Amplification Mix (25 µl) and nuclease free water (5 µl) for 16 cycles and sample are purified of using AMPure XP beads prior sequencing. All libraries are sequenced with the Illumina NextSeq500 (2×75 bp).

Results

Profiling 127,802 transcripts based on LNCipedia v5.2 was performed on serum samples from patients suffering of Alzheimer disease and cognitively intact healthy subjects using total-RNAseq technology. Above 127,802 transcripts, 19867 lncRNAs were identified with expression level of over 10 CPM in at least half the samples of one group.

Out of 19867 serum lncRNAs, a list of 1008 lncRNAs useful for diagnosis of Alzheimer disease was selected based on the statistical significance (p value <0.05, Wilcoxon test). Random Forest algorithm was used for the classification model. From this, several sets of 2-20 lncRNAs with high predictive value were identified. The sets of selected 2-20 lncRNAs provide an AUC ranged from 0.7 and up to 1 with an accuracy, sensitivity and specificity ranged from 0.7 to 1.

A total of 1091 novel lncRNAs were further identified using transcript reconstruction in the human postmortem mediotemporal brain tissue of 5 AD cases and 10 HC cases from deep-sequencing experiments. Profiling these novel 1091 novel lncRNAs was performed on same brain area, the mediotemporal cortex from the group of human AD brains and the group of healthy control brains using total-RNAseq technology. Out of these 1091 novel brain transcripts, 26 showed deficient expression and 16 showed overexpression level in AD brains as compared to HC brains (P<0.05).

Profiling of a total of 128 893 comprising the 1091 novel lncRNAs and 127,802 transcripts based on LNCipedia v5.2 was performed using total-RNAseq technology on brain cortex (mediotemporal) from 5 AD cases and 5 healthy controls, and on plasma samples from 12 subjects, 6 patients suffering Alzheimer and 6 healthy controls as well as on whole blood (Paxgene RNA tubes) samples from 137 subjects included in 5 groups: patients suffering of MCI, mild AD, moderate-to-severe AD, DLB or, FTD and cognitively intact healthy control subjects.

Out of the 128 893 transcripts sequenced in each biological sample type from all patient and HC groups, lncRNAs were identified based on their threshold expression level (median over 5 count per million (CPM) in at least half the samples of at least one subject group studied). 10122 brain lncRNAs, 3774 plasma lncRNAs and 9367 whole blood lncRNAs were retained for statistical analysis. The results show:

1—Brain lncRNAs panels: Out of the 10122 brain lncRNAs sequenced in the brains and having an expression level >5 CPM:

We confirmed on all brains tested, the expression in the brain of the 1091 novel lncRNAs (Table 7) never described before, which represent novel therapeutic and diagnostic targets for brain disorders including cognitive disorders.

We identified 860 brain-enriched lncRNAs (Table 12) that exhibit at least 2-fold higher expression level in the brain as compared to all other peripheral organs studied (lung, ovary, colon, prostate, breast, liver, bladder, kidney, skin, heart, muscle). These 860 lncRNAs represent novel therapeutic and/or diagnosis targets for brain disorders including cognitive disorders.

We identified 1202 lncRNAs (Table 8) comprising 42 novel lncRNAs, showing a statistically significant differential expression when comparing AD brains to HC brains: These 1202 lncRNAs represent therapeutic and/or diagnosis candidates specifically for cognitive disorders in particular Alzheimer 2—Plasma lncRNAs panels: Out of the retained 3714 plasma lncRNAs, we identified 410 plasma lncRNAs (Table 9) that showed a statistically significant differential expression (p<0.05, Wilcoxon test) when comparing AD plasma samples to HC plasma samples: These 410 lncRNAs represent novel panel of biomarkers useful for diagnosis and for therapeutic response monitoring applications of cognitive disorders in particular MCI and Alzheimer.

3—Blood lncRNA panels: Out of the retained blood 9367 lncRNAs, we identified 2982 blood lncRNAs (Tables 10, 11) that showed statistically significant differential expression in at least one of the subject groups studied (HC, MCI, mild AD, Moderate-to-severe AD, all AD, DLB, FTD) (p value<0.05 using Anova test comparing all groups and a p value <0.05 when using the Wilcoxon test to compare the HC group and one of the patient population groups studied). Further, we applied additional criteria such as fold change <0.8 or >1.2 and AUC >0.65 or <0.35 to select the 2847 lncRNAs and 136 lncRNAs listed in Tables 10 and 11. These 2982 blood lncRNAs represent novel biomarker(s) and biomarker signature(s) useful for diagnosis, differential diagnosis and for therapeutic response monitoring applications of cognitive disorders in particular MCI and Alzheimer as MCI, mild AD, moderate-to-severe AD, DLB and FTD and other cognitive disorders.

'-Circulating lncRNAs panels (common-to brain and present in peripheral body fluids): Out of the 10122 lncRNAs sequenced in the brains, the following numbers were identified as circulating lncRNAs in body fluids:

2096 circulating lncRNAs in plasma: Out of these 2096 lncRNAs, a panel of 46 lncRNAs showed a differential expression in plasma samples of AD patients group as compared to HC subject group with statistical significance (p<0.05, Wilcoxon test) and having all an AUC value >0.8 or <0.2. Out of these 46 differentially expressed circulating lncRNAs, 17 have an AUC value >0.9, 4 candidates have AUC value=1 thus fully discriminating AD patients from healthy control subjects.

4902 lncRNAs detected in blood samples (Pax RNA tube) and thus identified as a novel panel of lncRNAs measurable in the peripheral body fluid. Out of these 4902 lncRNAs, a panel of 310 lncRNAs showed a differential expression in blood samples of at least one of the 5 patients groups studies (MCI, mild AD, moderate-to-severe AD, DLB or FTD patients) as compared to HC subject group with statistical significance (p<0.05, Wilcoxon test) and represent good candidates for diagnosis and therapeutic applications for cognitive disorders.-5054 lncRNAs circulating lncRNAs in serum. Out of these 5054 lncRNAs, 43 lncRNAs are differentially expressed in serum of AD group as compared to healthy group with statistical significance (p<0.05, Wilcoxon test). Thus, the invention also relates to any common brain/plasma and/or common brain/blood and/or brain/serum lncRNAs and/or brain-enriched lncRNA circulating in plasma, blood, serum or in any other non-invasive peripheral body fluid detected using the methods of the invention for use for therapeutic and diagnosis applications of any brain disorders where such circulating lncRNAs are altered.

In particular the invention relates to the panels of lncRNAs listed in tables 1-12 for use for therapeutic and diagnosis applications of brain disorders in particular cognitive disorders.

The sequences of lncRNAs disclosed in this disclosure are shown in the sequence listing included in this application.

SEQUENCE LISTING (6878 sequences)

SEQ ID NO: 1 - DNA, 30872 bp, Homo Sapiens
agagagccaccggggcccgctcgcgcgcctctgagaggctgtccgcgcgcgcgcgtgtgtgcgtgagtgtggatttgccgggactggagctggaaagttcaaactaaacgtgttgctctcgccgagtgccgaggccgcggcggaggctgcccaacttccccgggccaagtgagtggcgttgcccagcgcctttggcgaggcggcggccgctcggccctgcgcccggccgcggcggcggcggctccgctcgccccgggagggagcccgcggccagggctggactctcgccccgccacctccaccgactctctcctcagcctccgcgcctggcaccgcagcaagacttgaatgaagtgatcatgtaaactagagaaaggagattaaaaataacctctggatattcctctcatgtgatctttattctggatgaagcattaggacagctaatagccgtgtgtcacttaaaaatccaacttgagaactgtcaccaaagatgtctaggaactttgaagaaacatgaagtaatatgcatgcaaagtaaagtaaaatttcctgagcaaaggacatcagaatcagtttcatgaagatgaacctgtggccagaaaatgaagacctttcctgaattcagagaaccaactttgcacccacaagagagaaaaaggcaaataaataatattatattttggaagagtcttacaaaatgattcataattaatttgcagtatactattctaaaattcttttgtaagagattaaagaaatatgtacacattagaaaactataattagtactcctaatggaaatcaattttcatttacaaaatagctttaaaaatttacaaatacaatgttaattcactcctgcttgcccaacaaggggagttcttgatggagtgaaaaagagcctaaatcttgagcacttactgggtacagggcactgtcatgtgtgtttcacgtgtattgccgaatgtgatacttacaaaaaccatatcaggtgggtgtggtaattatcatgatgcccattttgcaaatgaagaagctgagccactgaaatgttcaacaaatgtgcctccaggatacacaggttgattttccgtttcaggatttggactcatatactggccccaatgtctgctatgttctcttttggtaaacatgcaggaaatggaatgaaatatgttgtctttagtataacagaatctttaatttgtagctctatttgaactttcttagctgaagtgtcctcaacaaagtcatatatgtagtcactaatcactatgaaaatgacaatataagaagtaaaattatatgtataccattcaaagagatctgaaaattgaattaactgagcatttttgtagcatgaatctttgattagaaaatattggagcccatttgcaacattttaggttgctacatataatgttttatatgaaataatataatcaacttatttatagaagtgtagatgattttagttcttttcctatcattattcagacagagtttgatagcttagcagactcgtgttgtatgtgtatatgttagggaggacaggtttgcaattgaagctgattgtttgcccaaacaccatctggcctacccatttataatatgtcaaatgagactgcccaaggtatgagaaaaatcttaatttcacatttattcaggtcatattggccacagctcaaactgcactattatattgtttgcattttcatcaccacccggttttttttttaatttttttctgaattctcttgaatgctttactgattttcactaccttccttttaattatttcagaaacctactattaaagattttcactcactgttgatcataacgttaatcatcttgttacaatatagactattataagctttagtaaaataacttaaatattttaaaacccaaatatctttggatggactttgtgtatattaaattcttgtctattatagcaaagtttcaatatgcataaacatatacatataagtaaatattttataatgtatcactggctcttgtaaagatagttattcatgctcaatatcaacattttgaaaaatgtagctattaataaatatttatgcacaaacttagatttttaactgaaagttaatggctaggatttttaagtaactgtccaaataattaaatagaaggaataaaataaacatttcactttgcattagacacttctgctagaacatgttttataagaattaaatgttgaggaattttaaaaactacattagattttaaatcaccttaatagtcctacactgatttctactgttttagttggaagaatgatcagaaatagtatccaggggaaatgtattttgtaaaaatactgtagtttaataatatgataagaaggcaacttctgagtatatcctctgattaattcaatgccaaaatatatggggaagatagttttcaatgtaaatactgattcctgtttagaaaataaaaacagcatattattaatttagattaacataattaatataacacttatttcccaaaatgttatatttctttgggtagccccttaattattagtcaaacaagaaacctccaacagaagtatttcagaaaatatcatggcatttaaaaatatgaatgttcataatttccttaatagtttacatttttaacccctttaaaatgctaatttcatgatctttattgctgatttatgaaaatatcactattcattagtaaaatatgtatttttaaattaaaatttgaatctgaaagagcaaggaagacttaattggaagatgcatagaatttgtgaggtcttttcagaatatcttactgtatgtatgttacagaacataagcactgagtcaaagctcagcggaggaagttcacgttaatagtgtgctctaggccgggcgcagtggctcacacctgtaatcccagcactttgggaggctgaggcaggaggacaacctgaggtgaagagttcgagaccaggctggccaacatggtgaaaccctgtctctactaaaaatacaaaaaaattagccgggcacggtggtgggtgcctgtaatcccagctgctagggaggctgaggcacgagaattgcttgaacctgggaggcagaggttgcagtgagccgagatcacgccagtacactccagcctggacaacagagtgagactgtgtctcaaaaaaaaacaaaaacaaaagcaaaacaaaaaacaacaacagtgtgttctccaggctgagggccttcagtgctgcagcttattactttaatggtgagtagaaagtaaggtatggggtcaggcacggtggcttactcctgtaatcccagaactttgggaggctgaggcgggtggatcacctgagatcaggagttcgagaccagcctgaccaacgtggtgaaaccctgtctctactaaaaacacaaaaccaaacacctcatgttctcactcataagtgggagatgaacaatgacaacacatggacacagggaggggaacatcacacaccaaggcctgttgaggggtgggaggctaggggagggatagcattaggagaaatacctaatgtagatgatgggttgatgagtgcagcaaatcacaatggcaagtgtatatgtatgtaacaaacctgcacattctgcacatgtattctgaaacttaaagtataataataataaatgaataaaaaataaatatacgaagcaaaagaaaaaaatacaaaaattagctgggcatggtggtgcatacctgtagtcccaggtattgggagggtgaggcaggagaatctcttgaacccagaaggcagaggttgcagtgagccaagatcacgccactgcactccagcctgggcaacaagagcaaaactccatctcaaaaaaaaaaaaaaaagaaaaaagaaaaagaaaaagaaaaaaagacagccaggtatgggaggaaggcaaattatttacatttgtggtgcataaaatataccagaacaggaccataccctggattcatctcctgtatgaagtgttaaaactacataattcataaagtagtctaaactgtgtatttatatgacaagtattgcatatttcagacaacctaagcaacatcagtttaacacatagtatttctcagttaatcattttgagtatatggaaactgctgattatattactactatatatacaaaaactatgcatgctttgaagtcctaaaatgaagcaatcaatttttttctaaattaattcaagaagagtagtgaaatgaagtgcataatttatttcagtccttaaaagaaaatcatttaattgctcattttgtttttaagcacttttccccataactgcatagaaatgattcttcaaggcttgttagataagtagtcctatcctattttaagggaactctaataacgtggtaaaggtaagtgatagctgatttttctaaatcttcacatatatgtaaaatcctaaatattagatgttgaaactttttaaattgcatcatgaagatgtttatgaggattttacagagttatttatcgagtttccgaattacataatcagatatcctatttttgttacactagaattaatttcattgtcatgtctcaagtcatcaatttacatacagataactattagatacttatgaaagatctattgacttaaatatcaaaaaaagaaaagaaagaaaaaagaaaaccttatcttttacttcttccataaatttcagtcattagttttgaatgaggttttgatatacaaacctgtgctcttatgaaactgagcaaaatataatttttagtatggtgcactatgcataaatgaacttattacagcaaaaatgcagttaattatttaattacctatgtagtcattttcattttgctagatttaactttgaggcgtatttgtcatgttcaagtacttatttgatttttaaattatatatcttttgtagtaatcatgtattattctttacctgtgcaactaactgttcttttgaaaagcagcaaaaatataaactgcttataataataatgaacctgatgtggttaaaaatgaagctttcatgaatgctaatcaaaaataaaaagaatgaatccacaatgaaaacctaattctcttttgttgattttgaagatgtgttttgaacaaattgctttttcaatggaattcaagtttcctttttttcttcaacctatgtttatgacagttcggtctgctatcactgacatgattgtgaggtttgaaatagtgttaaaatttcactgcaggatcaatttttacagggattgcatgctatgaggtggacattttcttaaatatgcttaatgttggtgttctttgagcagtagaataaaaattactaaaatttatagaataattggacataattatatttgtagcttttgtttattgatttaaaagcctttttcttaaaatctgcttatagaatataccactctcacttgacttgcttatagagaatatttttaaatggaaatttttaaaatttaatctggaatttcagcttactttcttccttcacacaataaggctagagtttagtgacagtataatagtaaaaaaatcagaggaaaattaatgtgtagcaattgagaaaatattgcagtatggtatatgataactagtttctcatgtttggagtacctataatttatatgtaataagtttttacataattttatgtatttattggtagtgcaagttttgggaaaactgatagattgaaaattccttgctaaatcgccctcagctgctttcactaactgcttgagttgctctttagtggttcatatcacaacagcagaaactcttgagtaggacccttccatagagccaggcaaggtcatttgtaagtgtaagtgctggaggtatctatgggtaatggatgcttaaagtgtgtacgaatgaacttaatgtgattacactaataatggaaaaaagcatattggtaaactattatttcagaaaatcaatttgtacttccatagtttaaaatcttttcattattcttactacattcaccattttcaatactactaaacttgtatttttctctaggaattttatctcaatttactcttgctgacattttaaaactcattaattttgagatcaatcacattttactcttcaaacctatgtattttacatacttttaatttatatatgctattttatattaaaattttaatgcaatttatgtaatataaaaagtagatttatacaatttaaatgtatatcacatttccttatccttataaaattataaatgacatcttacacactaggttaaaaattttgtgaagaaccaaagaaagtataccggttagaaacatttgggaaaatattttgcatattttttaggctaaaacggaatcatttaattatagatatttaaaagtgcaataaaatattagcttccatatttatataaattccagaaaaaatagttcctggaataaagatttaattaaagtattttacaaattttgaactttgtcatttagaatctccttaagaaaataatttgtctaaaaataatgagatcatttcatatacttgcttatttcacatacaagtaacatatttcctaataaccatgtttaaaaaaatagttggccatgtgtaattccagcactttcagaggcaaggtgggcagatggcttgagctcagtagttaaagaccaccctgggcaacatagtgagaccctgtctcaaaaaagaaaaaaaaaattagccgtgcatagtggtacagtcctggaattccagctacttgggaggctgaggtgagaggattcaacctaggaggtggaggagaaggtgcaggttgcagtcagccagtcagccagtcagccagtcagccagtcagccgtaatcgcaccactgcactccagcctgggtcacagagcaagaccttgtctcgaaaaaaaaaaaataataataattgatgattaccaatgtatatctgctgtaaaatgaaaaggaaacatactactgccctctactaacaatggaggatccatgctttgcttacagtaacatgttaacaccaagagtgagggagagtattatactgaaaattgctgagtaaggaagtagaggtcatagaaacatttgacattaattgttacatgttatgacagagataaagaaaggtatatttataaaaagactaccatttttataaagatgcttgcattatacatttattcatcatatctaaattgagtactcacatagtatccagcttgtttttctccctgaaaatgtatttttagttatgatcatgttgccattgtttcaaatcttgcatgactcttctttcctagcaagttaaatgcacagtccttactctgccatacccaaccttccgcacggtatgactccagcctccgttctctgccagttcactctctcgctctcagtcacatctctcgtaactcttgcaaacctgattgcttactgttctccaaacatgtataagcagggttggcttcattgagtcaggcggtcttgtgtctttattagatatgcaacattgggaaaactactcaacttctctgaatcacatttattcattgataaaatgttggaagtattgaatatgtctagtgcattctctgaccatgagattatactccatctccatcccatgtcttagtccttttctttaacagacaaattactatgaagttatcattaactagattgaattatcatgttaaaattctactcataggaagaatactattttaaaaaataagttgtgtgaaaatatatagattcactgaaagaaagaaattcttcacctgcttctattttctaaaatggggcaagtgatatacatggagattaaaaaagattataaggaagcatctgtccctgtacatttttctacagttttttttgtatcttatgtaggtttgtgaatttcacttaaaattgcttaaattttaaaaatgcaaaaatattgtatgaattttgtgttattccttctaaaatatttttatcttttttatcagatgtttttccttttgaaagcttcttctaatgtaggttttcaaataatatctgaatataattataaattgtattatttgatattatttaaaattatgatatcgtatgattaagatatttaagtgatactaagattatatttggagtacctataatttatatgtaataatttgttaaataaacttatagaatatagaatataagtttatatatatgatgcttctaaagaatatagaatatattggatatagaatatagaggcatctaaagcaagttgtatggattaatatgtatgaatgaaaccccaatatgctctgtgcagtagttcagtctctcctgcgtctcctgccttcccgcccctgactcctcatctctgcctctcattgttcttgttgtccagcagcagtactgaaaactacaatgtaagataaaaaaagatgggagaagaagaaaaagagcaggattagactggagagaaggctgtttccaccataaagacatttacccagccagccctatgaaaacaggagcctatttcactacttggttattgactgaacagagtagccaagaggtgggcctttcagcccttagggcctgccagacagcattaaaactaagtcttctgtgaagaagctccctgtgcttgggagtatgcagctttaatgtttgaaagagtgagggagggaagaagggagataaccctcccagaaaacagaaacgcagaccgtgctttagaaaagatctttccatatgtaacaaacctgcacgttgtggacatgtaccctaaaacttaaagtataataataataataataaaagaaaagttctttctcacaatcctatcagatggaatgagtcacccacctcccttgtgagggaaggagtaaggcccccaggataatgcttgttggggcagccttggcttactcccctgagaaagcacacagctgagcagaagctgcctctttggaaccagtggtggaatagttactggttttacgaatacaatggacacagcagattttgtttgtttgtttgttttgagacagggtctagttccgtcacccaggctggagtgcagtggtaggatcttgggtcactccagcctcaatcccctgggctgaagcgatcctcccacctcagcctcccaagtagatgagattatgcctggataattttttaaatttttaaaaaattttaaaaaattttgcccaggctgctcttgatctcctgggttcaagcgatcccgtcgcctctgcctcccaaaatgcaaggcttcacagcagatgttttcagtagaaattgtcttatatttgttttgtgttgttattgaaatgaatataatgctagatatttcttggtatttcggaagtttatatcttataggatagattttatggtaactttttacatcttgaaaattatgttaaaattattttagtttaactttgttgattatctgcttgtatgaattggctttaatgacaagaaaatactttaaaaccccagggttacctccagctggcttgtcctttacccctgaaaattttggtttcctaatataggcaatgacaaaaagaatatttaaattccacactctccaaagttgcaaagtaaaaataaataaaatattcataaacgtatctgaaatgggtccaaaatcaaagattcaggtaaatattaaaatacatgtccttttttctctgttgtagatggacagagagagaaaaaaaatcactgagtagagagagaaattatattgtaaataaaacatatggcgaaagaaaacttttcaggcaaattaatttttaaaaagccacatcatacacgatattaattaaaaatgtgtatatatataatttaaataaaaatattttcctttttgttatcttcttcatcttccaaattttggcattaaaaatattaggaaggcatttctatggcttttaaaaaagctttccaagcagctctcaatttattgtttcacataatgctactcttttctctaagtctgccttgtcagctaacgtgttttgggaagaaaaaagaaaacaaaacaaaaccaagactctgttcttctcatctctttgattgagttatcctttgctaggtgaagtgttgtgagctttcatacccttccctgggcttccagcagctctccccacggagtgctgccacagcaccaccaggagccccagatccctgcaaggaggagatcaaacctccacagcagggattcctcaagacaggtcaagctccagtgcttggaaaactcagcctacatcacacaaaaatgttatcatttatttggaattctttttcaatggattgtctccacttctaaaacatttctaagtctagttcaaatccagctgcagattcctggcacttgcttccttcccattctttttcatatatcttcttttatgttgcatatacttacttcagattaagtatataagttaaactttcagtctattctgccattagaagagtttatttccatacacaataaaaaaggatcgtttgtattatcctcaagattagtgtatgttatgaatgcaatatctttgcattcaagtgaatttaaatattataggaaggggtagagaaggaaatgcaagttatcactgactgacttgccaaagttaagcaatttttaagcattttggcatgcatgattgattgtgtacttttaaatttaatattgtatggtaattattttctcacgtcattaaaaagtatttttttcaatggccagataatagtttatcatgccatgtactgtatttaacttcaaattgatagtcttgaacacatatattaatttcaattccacagatacaaaaaataattgacattaaacttctttgagaataaaaccttgtccaaatttgatatatccttaggatgtattcctagacatggtttatttcatatcttatgaactctttatttgaaggtatttggtatgagttgagaaattacattacagaaaaaaattttgagtgtgtatttcattcaatctttgcattgtttgtaagtgcctatattaagaacttttttgttaaagtttgactatgaaatctgatgagtgaaaatttaatctttttcttattttaattttaatttcttcagttaatagttaaactgaacgctttccatgtgtttattagccacttctcaatttttatatatttatttagataaaattgtgcttaccaactccagtctcaatactctctgttaaggtctacggtgtattcatctgttgaggtttttgtgcttagagtatcaatttttgtgaatgggatatttattataactaacaattctaggttttatttattaaaaattgaacaatctgctatctataaaatccgtaatatttcctttgcaattttcttccaaacaattgtaagttttacaccaaaattattccaagaacaaagcacgtgagactattttattgacaaaactttgttggctgaaagtttatcttccgtatacttcaattttttttcccataggaggtttaaagagcacacacacacacacaccacacacacacacacacacacacacacacacacacacacacacacacacacagtgtttctgaagcccaggccatttttggtaccaactatatcaagttagaatttttacatgtgtctcttctgtacgaatctataccaaaatacatggacagaaaatacagtgatacattcttttaaatgaatgctgattgcactttacagtttaagaaacaaggcttcgatgtagggatttcagagtgaacacttactatatatctttggaaactagactgctaacctgttactgaaatgtttgcatcaaattgtttatcaggttattttctctcggtatataaatataacaaacttggacaaagtggatgtattttcaaaggataataaaaactaagaatggagtgggtcaatatacaaggagaaataaggcaatagactggaatgtagagaagagagagagactggcacagagggacagtggggatgataggtattttaaaaaataatgggaaatgaaaagattttctctatcacagaaaaccaaggttctgtggagacagaccctaaactagactcctgcagagtctaatgctcgttcatcacaaggcatgctagacactgcaagacccattggcccatctttttgatcctcactctcaatcatctaaacaaggctgagagatgactctctgtacagcctctgcattgtgtaataataactctgaaatagtttctgatcttttctcttaggggttgcataaaattttgcttctagcaagagaaataaacaacccataactaaatctagaaacttagcaggcaaagctctgtagtcagaatggctactttaatttgagcaattctgaacacaatttgaacctctccacactatgaaaatagcataaaatgaaagaaataatagctaatacaccaacaagaagtacagtatatatgatgtacttacaaaaaaatatagaattatggataatatgacacattcattgagcaaagagaacatggcatacatttatcttatataaaataatgctttataatatatatttaattgaacatggattcttaatacagaaacaaaaaatattttagattgattatcattgtacaattccttagagacaaaaaatgtaagtaaaatgtctgtggattttccaatacaacctactcttcctatctaagtgataataatagcctttaagtaattttctaaggatttttattttaaaaagtttaatttaccaatgaaaaaacataaatctttgacattaaatgaaagctctaacagatgacgcagatatttctaataaaaacaactcaaaaaatggaggaactaagctcgtatatttcattagagatattggatatagcaaattagcctttattttaaaatgaggtctctcaatctaattttaaaaataaatataagcggacttttacttacagcaaggtggaggaaatatattttttttctctatatttccttctaacaaggaatgaaaaccctagacatcatataagaaaaaacaataagaagattttgaaagatagagagaaatcagaccagccagtggctttggaaccctaggaagaactcagtggtgagtttcctggatcttcctttaatctcacatatctgagccttattgctgaagaattcaacaacctggagataccaagagcacagagaaaaccacaccccgacaaaagtctgctctttctagccaaagggtgaggaacgggcctgcctagaaagacatcatacttctagacaacaacccatcaactccagcaaatgccacagaaaaaaactgtggccccgctctcactcccacaatacgtatcaattggggggcacaaagtttcttcctctcgaggccataacgatgtgctccccaaaccctgctggggtggttggtgtgagagagagccagataggaaacttgatgttcatcttctctcgctgtaagaaatccccatgccccttcccctcactcccggccatagtgtcagtttatgtgatgtgaggatcctagtgctgcatcctcaccacacaagaacaagcccccctccaccaccctgcccattatgatggagtcagcagagcccggtggagagtcccatagactggtcacatagactggccgcgtagactggccacaggggatctgggcttctcactccgccaggcagcaatgaagtggcaccctcccattctgtcagagtggagtcagatcatgccagctaaaatgcacggtttaaatacaggcttcatcacatgattggaaatgtccacttttaaattgaaaatcacttatcataccaagatccaggaagacctaaaaccaaatgcaccaggcatggtaggtaacacctgtaactctagcactttgggaggccaagacgggaggatcacttgagctcaggagttcaagaccagcctgggcaacatagcaagacctcatctgtacttaaaatttttaaaaagctagccaggtgtggcagcgcatgcctgtagttccagctgctctggaggctgaggcaggagaatcacttgagtctgggaggtcaaggctgcagtgagccatgattgtgccaccacactccagcctgggtgacagagtgagactctgtgtcaaaataaacaaacatataagctgaatgaaaaggacagtcagcaattataaatatgtgataacagatatagaattacctacaaacgttgtgaggcagccattgtaaaatgtttcaaggagcacttacaaatagaaagtgccagcaaagagatataaagaacaaaggggaaatttgaatatttaaaaattaataatcaatgcgaaagtttagtgtttggactcaacagcttaatggaggagatagagtaaaagatcaggaaactggaagatagaataagaaaagttacccggtctgagcaacagagaaaagatagctggaaaacaataacaaaaatgacagagcatcagagatctaagggactataacaaaagatattagaaaaaggccaggtgtgatggctcaagcctgtaattgcctgtaatactagcaatttgggaggcccaggagggcaaatcactaggtcaggagtttgagatcagcctggccaacatggtgagacccccgtctctactaaaaatacaaaaaaaaaaaaaaaattagctgggcatagtgttgggcacctgtaatcccagctacttgggagactgaggcaggagaattgcttgaacctgggaggcagaggttgcagtgagccaagatcacaccactgcactccaaccccgggcgacagagtgtaactcagtctcaaagaaaaaaaagatattagagaaaaaaaaatcatgcaaccagagtccctaaaggagaggaggaagggtgcaaaggtgaaaaagttacttgaaaaataatgacttaaaaaataatgatgtttggccagatacaggacactacagaatcaagaagctgagcaaaccttcaacaaaataatccaaagaaatccacatcaaacaattaacttctgaaatctaaaaacaaagaaaaatcttgaaagtagccaaagaaaaaatgacaccttagttacaggagaaattcataatcacagtaggtttctgatctggaacaatggaagccaaattaataggacacaatatttttcaagtgctggaggaaaggaaccgtcaacaccaaatcctatagccttgaaaatgtcattcagaaattaagggaagatcaagacattctcagatgatatataattaagaatatttattaccagcagacataccctaaaataatgactgaaggaagttctctaaacagaaaggaaaaaatagaaaaaggaatcttggaacatcaggaaggaagaaatcatatgattaaaacaaatatgggtaaatattataggctttccatctcctcttgactttaagagagtgggtttgatgtttgaagccagaattataacactgcctcaagtggttctatatgaatgcagatgaaatatttatgacaaatatattataaatggggaagaatagaggagcataaaagaagtaagttttccctacttcatttgaactgatgaaataaggacactactggagtgttatgagttatgtataaataatgtaattctgagaaccacaggaaaatcacccaacacattgaaactaagcaacaatcttttaagtaatctcactatcaaaggggaaggatcaaggaaaataaatagaaaataatgcatattaaaagttatgtgacacagataaagcagtgttaaaggaatttttgcactaaatgcgtaattagaaaagaaaaataatctcaaatcagctatcatagtttgcatcccaagaatctagaaaagtaattttaaaacatcagaaagaaaaaaatgataaagttatgagacagttaagagcagaaacaaatgaaattggaaacagcaaaacaatataaaaaatcaatgaacaaaaaagctagttctttgaaagatcaacaaaattgacatgaatgatgaaaaataagagaaagacatgaattaccagcatgtagaatggcactaaagatgcttcactatatcctgcaatcatcaaaaggatgatgagagattacaatgaacaactctagacacataaatttgataccttacatgaaatggaccactttctttaaaaaaaaaaagaaaagctaccacaattgactcaacataaattgctaattgggatagtcttttaagtagtaaagaaactgaattcataattagacattgtcaaaatgaaatctctgagcccagatggtttcaccggagaaattatttaaagaagaattaacatcaattctaaagaatccagattattgagggggagggaacactttttgatagactttagaaagctagtattactctggttttgattcatatcaaaaccagaataaaattgttaaaaataaaatataaggaaataaagagaaagcaacatatcaataaccctcataaatatgacagaaaatatttaagaaaatattagtaaattgaaataaaattcagcagtatatcaaaaggattatatattataaccatgtatcttctattctaaggaaacaaggcaattcagtattcaaaaatcaaatagtgtaggcccccatattaacagaattaacaaaactcttctaattttccaattagaggaaaaatcacatggtcatacaattgatgcagaaaaggcattttaaatattcagaaaccatttataataaaactctcagaaaactagaaatagagagggatatttctcaacctgataaagaacatctacaaaacctgtgggtattttcataatgatgacagagagaatgctttttctctaaggtcaggaacaaggaaaaaatgctctcaccacacttatctaacagtgattgaaattctaatcagtgcagtagggcaaataataataataacaacaaacacaaagcagaaaggaagaaacaaatgtccctgcctacagatgacttggttgttcgcatggaaaatctcaaggaatctacaaaaatattcctaaaaacagtaagtaagttcagcaagtttacagaatacaagatgtatattaaaaagttatattcctatatattcacagtgaatacatgggaaatgaaccaaagaatgtgatatcatttataatcactaaaaatgaaatgaaatatttaggtataaattgaaactacacaccactgctaaaagaaatcaaataagatccaactaacagagagtaaacttagtttcttgaattgaaagagtaaacttagtaagtagtcaattctttctaaatttatactggaggtttaatgcaattctgatcaaaatctcagcaaaatgtttcgtaggtatagaaaagattgttataaaatttatctggaaaggcataggtcctaggatagctacagtaatttttacagagaataataaagtaggtggaatctgaatacccagtatcaaaacttactttacatctgtgttcattaagaatgtttggtgttggtggagagatagaaatattggccaatggacagaacagagagcccagaaatagacacacacaaatacactcacctaatctcttaagaaggggcaaaagcatttcaacaaatggtactggagccatcgaactccacagaccaaaaaacagtatcttaatgtaaggcttacatcttattaaaaaattaactcaagaaaggccacacagagacataaatgtaaaacaactgtaaaacttttagaataaatataggagaaaatttccagtgtctagggctaaacgaagagttccttgtcgtggtatcaaaatcatggtctctcaaagaaaaaatagttaattggatttcatcaaaatgtttactttgcaaaaaaaaaaacacctctgtaaagagggtaacagatcagttactgggcagctaaaatatttgaaatctacatataggtaaaaggactaacatctaggtctattttttcaactctcaaaactcagtagtagctagttgcagtggctcatgcctgtaatcccagcactttgggaggctgaagcaggcagatcacgtgaggtcaggagttcaagaccagcctggccaacatggtgaaaccctgtctctactaaaaatacaaaaactagcaggacatggttaattaattaattgattatttaaattaatacttgggaggcagacgcagtagaatcgcttgaacccgggaggcgaaggttgcagtgagttgagatcgcgccattgtactccagcctggccgacagagagagattctgtctcaaaaaacagaactcaacggtaacaaaaacaaagagagaataggcaaaagatatgaagaaatttcacagaaaatgaaaaacatatggcaaaaaaacacatgaaaagatactcaaaattatttgccatttggataattaatattaaaaccgtaatgagatatcactgcatatctttcataaaaactaaaatcaaagacagtaaaaacactaaatcctggtgaggctgcaaaggaactggatcactcacacaatgctgatggaaagataaaacggtagatacattctggaaaatagttttgcagtttctttaaaaaaagtaaacttgcattaaaacccaaaaattgacctcctagccttttatttcagagaaatacagacttatgttgacacaaaaacgagtaaacaaatgtttataataggttgattcataatatccacaaactaaaaactatccagacagacatcctttaccagatggagggttaaacacactgcggtacctctatacgatggaatactattcagtgatcaaagggaaagaattattgatatgtgcaacaacctggataattctccagaaaatgatgcctgctgacagaaatcaataccaaaaagctacacgattccactgaagtcacattattgaaacgacaaaattaccaaatggaaaagatattagtgatttccaggaattaaggaggggatgaggtgaaggaagtgggtatggctataaaagggtaaaatgagtgggttcaactgtattccccgcccacactaataaagcatatgaatatatgctaatgcctgaagcctatgaatatgaccctatgtggaaaaaggggttttgcagatgtcattaaagatctcaagatgacattatcctggattatctgggtggaccctaaatccagtataagtgcccatgtaataagccgaagagatgagagaaggccatgtgaagacagaggcagagattgaagttttacaaccacaggtccaggaacacctgaagccagcaaaataggcaaggcaatagctggactaggccaggaaggattcacttctaaaccttggaagggaatgcagcactgctgctaccttgattttaggcttctggcctccagaacggtgagagaataaatatcagttgttttaagctgtccagcttgtggtcattggttaggggttaggacagctctagaaaacgaatatgggggatcctcatggtgatgaaaatgttctgtatctctggtttaacaatgtcaatgtcctgggtatcatattgtaccagagttttgaaagatgttgtcactagggaaaactaggtaaagcagggcgatgtttttgttttattttgcataactgcatgcaaatctatcattatcccaaaataaaatgttgataaaaataaataaataaaattgaattataatttgatctctgggttacacaatcagaatgagttgatggcacctgaagggcatctattttatagtacaccttcatccaaatatttacttttaatgattaacaaaccgacttagcatgtttgcattaatatcttaagtgagtctctggaattattcatcttttagcaaaatactatgaaagcctctcacacaggctaagcagagaatattaatgactaactatgatttatcgttttgtgtttgcttcaagaaactggtacataaatatgtaattcttataaaaaatttgtggcagcttataaaatatacatgtaatataaggtgaaaaacaaaataaaataggagagaaataaggataggaaaagtaaaggaaggcaaagttaaaattagaatacaaaacatcagagagtgatctacacttcacaagtttgggcttctaatttttccagagaagaaatatataattccataaagatatttaagcaagtataaattagtcaatattctcatgtcaaaaaactaaaacataaaaataagtatctcaattagagatgtcaaatttagtcagagtttagaatattctatttaaaatatatccagtacgatttcagaaataattatctcagttcaagaagggaaaacctgctaaatatttaaatgtcaaatatatcagtgatagtttctgttcatatttttagtcttttgtcctggtataactgaaaaatttgcatgacttaaaatgtcatattttatttcagccttaatattggttagttgaaaggcataattatgaccagaaaatgtactttaaaattacccaatgagaaaagctatgctagttttaactgaaaatgctttacttaaatgccaaaaattgaaatagtctactttattaagatatttaaaataaaattatgaaaacgatgtcatatcctttgcaaagttggcacccgaagttcgagttctgtctttcaaaatgtaaagtgatttttttctgtggaagtagaattgtcacctgtaatggttttcagtaaattactctgaagcatcttgtcaagaacattcataaacttaaaaataaaacaaagattttcatgtctatcaagactaaaataacaaaaagttattcccaccatttaatatcatataaagacaaaaataaatagatatataataaaaaataaaatatatatatttaaagatacatacttttttcaatagtaaggatcacatttgcatgtatatgaaatacaacataaaaatcagcataaaaatcatccactatctcatttttacataaaatgatatctaacacgaggactgcttggaaaatagcatcttaatctttgcttaacttcttaggttattttggaactctcttgatctcagattcttcttctataaaattgagacaatctttctccaggagaataggttcaggttttataaagtgatagatataaaagtaatataacagatatgattattaataatattattatttgaaatggacaagcagtaatgggaggatagaatgataaggatgtgtatcattgccaaatccttgagggaggtgctggtatttggaaaaaaaaaaaaaaacaacgaatacctaaacgtgaataaatttgaggaaactctattgaaagtcttccccacctgttcatgaaacagatgcccttttctcctctgttattgcataagtaaggtatatgtcttagtccctttcaattccagtctggccatgtgcctgagctctatctagccaatagaatgccagcagaaattatatgtatcacttccaggtcttcccttttagaaccctaacacccaccctctttcatgctcattcttcaccaactgattgcacacacccgtcaaggaacttggagctgtcagatggcagaaggttgctgccctgaatggcagaatggaaataaacgcacaccggaattacccgcaattaaccactgcaactaaatgagacatcaactttacttatgttaagccactgagattgtaagttttgaatgtagacccaatatactacgccggttaatttacaagcctagaatagtacgaagaactatcatatataataagtaatgccaatatcaaaattatggtaatgtttcttgatacaaaaacataaactggaaaaggaaacaattactactaacaaaattcactataagatgtgtctaatatgtcaagcattgaccctagactacggtcaaatgtcagttggaaggttaagttgtgtactctaagacaagcacgtgaaataattcctgtggattcctgtcagtgcagcagtttctcagctagtgttagtctaggagattctgaccagcagcacttcttgttcagctccttttccttaacgtgtaattttcagcagaataaaactgcattctctatattctagcacaaatgaacattttgtgactaacagtattcactgatagtataatgtatcggccttattgctgtcaataattattatttgtatttatattacaatattacatttcagttattttggttcaaggttttagagtcatcaacttctgtgaacatttctaagaattttccatcccttatcttcctacccccttcatcaggaacccttagtctaagtaaccccatatacttttgcctatgtaacccctctcatatcaaaaactagaacacagacatattgagatggactcagtcataaagggatataaatttgttttgtagattcatatgttaattttataataatagattacttttaattgacacaaaatattacccagctcagataatattttattttgcaatctttcaacaattagctgttaggaaagactgtttaagtgaaggatctaccataaagaatccaaaataatataccactttttgcccagtggcttttgcgtatcaggcactatgttacagattttatatgcctaactactatgtttttataaagtattattttctaaatttacagatgagatagcctcacctcactgagattacatgatttgctaaagaccacaaggatagaatcaagatttgaactcttttctttctccaaatctagagctctttttccttacttctgttctatggaattgattgttctgcttcttttctataattaacctttacaatcacttaataacaaatttgtgatatatacggtagacaccaatataagtgctgaagctacaaagataaatgggaacccctggccaggtgtggtggtgcgcgcctgtggtcccagctactcaggagattgaagcgggaagatcacttgaactcaggaatttgagatcagcctgctccaaaaagcaagtccccaactctataaaaatatatttttaaaaaattagccagacatggtggcaggcatctacggtagcagctatgtgggaggctgaggtgggaggattacttgtgcctggaagttcaaggttgcagtgagctatgattgcaccactgtgctctagcctgggtgaccacaaagccctgtcttaaaaacaaaacataaaagtaaaaatatggaaccatcagtctagttggagaaaaattcatgaaaataaatgattacattgtggtgggatatgcgagtagaggtgaaagagaagacacagaagccctgccgtgaaggcagtgaataacttgctatgggactttcaaggactgtttggaggtgaaggcagtaccagagcaggaattagaggtacattggaaacttagtaggccaacagaggagatgagggtgtgaggtgtggaagagaagatacctgagtggggtctactcatggcaaacctatatacaatgctaagaaatttgagctgttgtcctgtgcatgagaggaaacaatgacaaattttactgaaaataataattttaagagatttttgatgtaagaaattactatcagcaacagcaaatatgggtcagggatggagaaactaactgggttgtgatggcagattagagatcatgtttccatttatccaatctatcaatccatttatccttccactttattagaaaaagcctggtctagctactcaggaggatgaggcaggagaatcgcttgaaccaatggaggttgcagtgagccgagatcacaccactgcactccagcctgggcaacagagcaagactccttctcaaaaaaaagaaaaaagaaaagaaagaaaagaaaagaaaagaaaagaaaagaaagaaaagaaaagaaaagaaaaagactggtctaacaaataatagttgggacattgggaatatgataggtttttgacatatttaggaactgaaattcaggcattttagagatttatgggacatccaggtagagttctatgataggcaactgaatagttagatttcacaggaaagcagatcaatcaataaatgtgggacttatgtatttacatgtggttattaaaaccaaggacaaagatttcattaccttagagtatagtaaaaaagagaggattgaatagaatcacaaagagggacacagggacagagaagaaggaggaaggagactgggaaagaacatttaggaagaggacagagacctagagaggatcatgtaaggaaaccaagtaaggcatgttctcaagactataaattgctgataggaacagaagccacaggaagtttaagaacagtgtacattggtctcacaaaataggagaccatttgttaaaacactgtccaaggcactacttatggcagcagaagtgagattaaaggggattaagtagttggtgaaaattagacagtgaaaatataaaagtaaattactattttcataaatgtatataggcacacctcattttattgaaccttgctttacaaattttaaccttgtggttaaaacaaccacagatactacattttttacaaattaaaggttttggcaactgtgtggagcaagtttattggcagcatttttttccaacagcacgttctttctctcttttggcctctgttacattttggtaattcttgcaataactaaaacttgttcattattatcacacctgttacggtaacctgtgatcagagatcgttgatgttactgttgtaattgttttggggtgccatgaaccagaaccatgtaaaacggcaaactcacttgttaagtgttgtgtgtgttctgaatgccccactgacctgttgttctgccatctctgtccttctccttgggcatccctattctctgagacacaacaatattgaaattaggccagttaagcctacaatggcttctaagtattcaggtgaaaggaatagttacatgtctcttactttaaatccaaagctagaaatgacgaagctcagtgaggaaggcatgtcaaaagccaatatgggacaaaagctagacctcttgcaccaaaactagccaaattatgaatgcaaaggaaaagttctggaaggaaattaaaagtgctactttaatgaacgcacaaatgagaagaaagcaaaaccttattgttgacatggagaaagttttagtggcctgagtagaagatcaaaccagccacactattcccttaagccaacgtctaatctaggggaaggccctaactcacttcaattctatgaaggctgagagaggtgaggcagctgcggaagaaaagtaggagactaggagaggctggctcacgaagttaaggaaagatgccatctgcataacatagaaatgtaaggtgaagcagcaactgctgatggagaagctgcagcaagttatccagaagacctagctaaaataattggtgaaagggcctacactaaaacaacaaatttttagtgaaaaacgcagctttgtattgggagaagatctcctctggactttcatagctaagaaggagaagttgatgcctggcttcaaatctttaaagaataggttgactcttctattaggggctaatgcagctggtgaccttaagttgaagccaatatgaatttaccattctgaaaattttaaaacaagaattatgctaaatctacgtagcctgtggtaagtggaacaaaacctggattacagcacatctgtttatagcatgatttactgaatatttttagctttcttttgagacctagtgcacagaaaataatattcctttcaaagtagtactgctcattgacaatgcacctggccatccaaaagctctgatagagatgtacagggagattaatgttgttttcaggcctgccaatggaacatctattctgccacccatggatcaaggagtaattttgactttcaagcactatgattcaagaaatacatttcatggggatatagattccatagatagtgattcctctgattgatctgggtatagtcaattgaaaaccttctggaggctgggcatggtggctcatacctgtaatcccagcaatttgggaggctgagaagggcagatcttctgaggtcaggagtttaagactagcctggccaacatggtgaaaccctgtctctactaaaaatacaaaaactagcctggcaaggtggtgcacccctgtaatcccagctactcaggaggctgagtgaggcaaggcaggagaattgctggaacgtggaggcagaggttgcagtgagccgagatcccgccactcactccagcctggataaaagagcaagactccatcgcaaaaaaaaagagaaaaccttctggaaatgtttcattactctaaattgcattaagaacaaggaggtcaaaatatcaacattaatagtactttgaaagaagttgattccaactctcatggatgactttgaggggttcaagacttcagtggaggaagtaactgaagatggtctggaaatagcaagataactagaattagaagcagagcctgaaaacgtgactgaattgctgctacctcataataaatccttaagggatgagaggctgcttgttatggacgagcaaataaagtggtttcttgagacagcctctacttccggtgaagatgcgatgaactttgttgaaatgacaacaaagggtttagaatactctgtaaacttagttcgtaaagcagccacagggtatgagaagattgactccagttttgaaagaacttctaatttgggtacattgttatcaaacggcaacgcatgctacaaagaaatcttttctgaaaggaagagtcaattgatgaggcaaacttcattgtcttattttaagaaatcatcggccaggcatggttgctcacacctgtaatcccagcactttgggagaccgaggcgggcagattgcctgagctcaggaattcacaactagcctgggaaacccaggtgaaaccccatctctactaaaatgcaaaaaattagccgggcgtggctgcgtgctcctgtagtcccacctactcgggaagctgaggcaatagaattgcttgaacctgggaggcagagggtgcagtaagctgagattgtgccactgcactccagcctgggccacagagtgagattccatctacaaaaaagaaaaaaaaaaaaaagaaagaaaaagaaaagaaattgtcacagccaccccaggatttaaccaccatcgttgtcatcatcagcagccatcaatatggaggtaagaccttccaccagcagaaatgttataactggctgaaggctcagatgactgttagcagttttagcattaaaatatttttaattacggtattttcattggttttttagacatgatgttattatacattttatagactacagtgtagtgtaaatgtaactgggccgaaaaaattgtgactttattgggacagttgcttaattgcagtgatctcgaccctcacttgcagtatctctcaggtgtgcctgtataacgtgaatggaatttattaacagggagtgaaacgaaagagtggcaactagagagaagcatggagtaaggagagggattttctcttgatttcatttgttgacataggaatcatttatagatttgtttttcatttatttcaatgataagaaagaatgataagaggtggcagagaaagagaagttgaaaatagaataaagctaagttacttattattgaggaaaacctaaatgaaaaatagggaaataggatgaagtctattaaagagattatccatgaggagggagacctcatcttctgagacaagaataaaagatacaatggtggactcagaggtaaagtaattataagtcttggtgaatgtgtgtggtggatagggaggtatgactattctttctcaaagtaagtggtaatttaactattggggaaagggagatgcttgatattttgaggacattgataaagtctaagccaagccacctttttttttttgaataattactgaaccattccttttctttagcaagtaccattacttgaatataattgactctactaaaagtcttcatatatttataataatcattgttaaatcaaaattattttctaaaaatatctaggctaccataacataaataacatatcacaatattttcaaagacagttatcatttagcttattcatataataattatcccgttaacttttttattttctgaggtgataaatctacctattttcattaagattttatgcaagcataatttatactacatataacaagtttttttcaactcacaatgaccttttaaaattgttaataagagtatataaggggttttagaaaactccttggcttgtaggtgtgagagaaagtcacatttattattactagaagcagtgttctgttggcatattacaatgtggcagacaatccttcaacaattaattaccagtaaagtaattatagaatatcctttgatgtttataatgttttaattgaagtaaaaatgtgagaatatgcttcaggggaatataatattttaattatttatgggccaagatatctatatactttgactagagtgcatttctctattctgtggcatctctgttataatagaacatttgtagactaaaaaaatagggtgttttccccccacagcgtattacagtgaatgtagtctactttataatcctcagggttcttttaacttgacgtgaatcaaacaccttaaggaaacagaaactaagactgaaagttttgacaaattagttttgaaaccttcacaaactaaacctgtttttgatattggtttcaaaaagtatgcatagaaacttgacatgaagtagctaaatttatgcactcaattgatatttatatgtgtgcaggtctatcaacgttattgaaaagttaatccaaaggatttattgattactctcaatttctcagatactgtcagttcacttttgaaaattattctcttatgtaatattgcactcttttcagtaaaaaggagagtttgtggctgttaaatatgcatgaggcacaatagtttcacaacaaatcaaatttaattaaatgatgcatttcctccacttacaaaaggtttattaaaggtttatttgctcatgcaaattaaagtgttagagtaaaaatccacatgaaacttggcactaacaattaaaaaaatattgaaagatttctcgcctcgctgcaataccttgctatgtttaaactgctcagcttgtcatttagaatctttaatgaaaccagggaggaggctatttatttgcataataggacataatttgctgtggtgaggttttaattatttataggctgtctgaaatatttaaaatggcatcactaaggagcatgaagtgttggataatgccttcatttcaggtttcctgccgtttcttttatgggtcaagcgatttatttctaattagcataccaggctagtggctttaaaaacataaggaaaacaaattggtttcagtctgtttgcagcttgagtagttggagacggccaagggtcactgacggagactgagcagagttaagagatgaagccagaagccatcccagcacatggaaatcactgactcaacagagccatactttcatttgtgcacactgattactgtatgtagtagcttctctttggtaggtagtgggttagagttaatggatttcatgttaattgtcccttaaatattttctaccattaacacatttcttattggaaatgatgtgtaagcaacagaaaatattccatttccttggataaaagatacagtaattactgtgtgcatagggaaaaattcggcagtttcagggtgagatttaacatttaagtatatgcaatcttatttatatacaagaacaagagcctgtggttaaaacacaatagggttcttttttaataaaccatatggaaactcatatatcttgtgagaggttgtgaattagcagagtacactaaaatatgttcgaatttctaaagcattcttattgtgcattgtctgtgttctaggtaaaaggaaaaaaaaaactcaggaatcatctataaggtctcttatgttatgataaatggattttcatgttctttactatctattttaaatatgataattttcttgaaagtagtttaaaagtggtcatgttgtaaacatcattgtatagccaggagaaatgtgtttactgcaagagtttattatatttccgtgatgctctagatatccccatcatcatgcacatagattgaaagcaggggtagcacactgttgtcagacattctctcatttgtcaccttctggcctcaaaacatgaatagagaaattgctgccagatgtcaagaaacagccttagggcattacagaggatattatccatgcccttttaagtagtagacagatgctgtattcagagagaggatttttatgattatcgttcacacagcccaggtgattggtcaaggccataaaggagtctgcaatccttggagaacttttggagtcactttaaccataacgtaatgtattgcaacagttacaataaattatgttatggttcctgaatgtaaccgtcaattatcattatttttttaagtatccactggatacagatagtgg

SEQ ID NO: 2 - DNA, 2661 bp, Homo Sapiens
ttacaagtgagtggataaatggtgagaatttatcacccctttgaatatcaggaagaagacaacgatgcccactctgttaccacctctaatcagcactgcactaggggttccgaccagtgtagaaaagcaaaaaacaaaacaaaaataaaaacataaagtaaaaatccagaacaacaggaatgggaaagaaaacccattactcatagaaaacatgactgtgtgcctaaaaatgaggaaacagctacaggcaaatgattaaaattactagactgccggatacaaattaatacacaaaaatgaatttccatgaaatggcaacacataattaggaaaatgaaatccaagcacatttttaaaaacagcatcgcaaaataacaaggacctaggattaaatgtaacaaaagacatacaagaccactgtgaaaagtatcaggctgtatgaacacccgctgaaggagccctaacatttggagagacagataccatgttcagagcttgtaaaacccagtactgcaagtacgtcaatgattcccaagttgatctacaggttcaacacaatcccaaacaaaatcccaactcgaccggctagttctaaaatgtatgaaacacaaagggtcaaaaacagccaagacatcctaacataagatggaggtacgcgccccagagtgtgtggtattggcagagacagacaaggagatgcagaaacggacacagagatcatcctgacaaaggaatcttcagcagccgggactgggaaaactgggcttatgtctgcaacacaatgaaactggatccttaagcttcacaacaggcgcaaaaatcaattctgggtagaatctatatctaaaatccaaaatatacaaaactataaaatcctttggaaggtaacagagtatctttatgatcaaggcaaagtaaagattattaaaaattaggatccaaaatgctttaatcataaaagaaaatattgatacattgggccatattaaagtttaaaatttctcttaaaagacaccattgaagtaaaaagacaagaaaagctatttgcaaatgtaattcacaaagcactactacccagaatcataaataacacctgcaaataaatgagacagaccatccaatagaaaagtagggaaaatacttgaataggtactttacaaacaggaaatcccaatgagccgcagacacatgagaaggtgctgaacaaggagaagccaatgaaaccagaaagaggtctaccccacacgttccaccaccccgcgccctccgccaccccgcgccctccaccaccccactccctccactaccccacacccaccggagtgaaggtgctaacacttcaggcaatgggtgctgaaaacatggaccggcagacgtggtcatacacaactagcagtcgggcctgcgggtaccaccactttggaacagttgggaatttctagtaaacctgttaaaaacatggttaagcagttaatggaaacgtgaacataatgggatataaaactaatgaaaaaaatcaaatggagtttttttgttttttttttgagacggagtcttgctctgtcgtctaggctggagtgcagtgctgcaatcttggctcactgcaacctccgcctcccaggttcaaacgattctcctgcctcagccccccaagaagctgggactacaggtgcccaccaccatgcccagctaattttcatttttagcagagatggagtttcgccatgttggccaggctggtctcaaactcctggcctcaagtgatcctcctgcctcagcctcccaaagtgctgggattacggtgtgagccaccccgcctagcctcaaatggaattttagaacaaaaatatacctaatttctgatataaaaaattcactatacaagcttaacatcaaattaggcaagtggaagaaaagattagtaagcctcgcaacaggacaataaaaccacctaaaggaaaggatgagagaacaaggatgaaaaagcatcacgtttagtgacctgagagacagtatcacagtctaacagaaagctaactagagtcccagatggggacagggaggaagaagtgagagacggggtcagacaagaaatatgagtagtggctgcaactttgccaaatctggtgaaaaatatgaactcacaggtccaagaagctcaatgaaacccaaacgaggtaagcatctataagcttaaagtggattaatattaacatcttctaatactcttacatacataaattacgtgatgacaaattaaccccatcccaaccctacagaaaataaatttggtatgacacattttcctgttaggaccacaactggacagagaggtgacacaagagggcagcctgaagcctagcaagtcctcttcggggaagagacagcagagtcccacctctgatttccccagggatacaatccacacgcacacacacacacacacagaagcacacacacacacagctagcagacacacacagctagcacacaagcacacacacagcaagcatgcacacacagctagcacacacacagcaagcgcacacacagctagcacacacactaggcgcacacacagcacacacacacagctagcacacacacacagcaagcgcacactagcgcacacacagcacacacacacagcaagggcacaca

SEQ ID NO: 3 - DNA, 3258 bp, Homo Sapiens
gagattcagacacacagaaagattgttatgtggtggcagaggcagatattgtagtgatgcatttccatgccgggaaatgctaaggatggctgttaataaccagaagctgggagacaggcatggagcagattcccactctggatgcccaagaaggaatcaaccctgctatcctcctgactttagacttctagactcctgaactgtgaaagaacatctttgtattgccttaaatcacccagtttgtggtagtttgttatggtaacaataggaaataatatagtaactaatatagatgcttagtaaccattttcccatcccaaaattgactaaggaagctaataagaaggggtagaaaagtggatttcgaaatagcctttaatgttcaataggtgttccacttcagcacaaatggaaatttccttcctggttcttgtgactgctctagtatttatttacaaattgatatgagaacttttgcttttgatggatggaaggatccaatcaaggcaaagatatgcagggagaaaggagaggtggacaatagaagggaatgacatggaaattctcctcatctcctggtctgctggattgtcctttaaaagcagaactcaagttattgtttaataagcaatttcatgaaacactcgtgctttaaggaccagtaaagcaaaaatcaaggtggaggaaaatttcttctttcacaatttgctctgtagatcttgtcctatagttgttgtgaggacaatagtgaattaatgtaagccaggcatggtggttcatgcctgtaatcccagaactttgggaggctgaggcaggcagcacttgaggtcaagagttcaagaccttcctggccaacatggtgaaaccctgtctctactaaaaattcaaaaattagctgggcattttggcgggcacctgtaatcccagctacttaggagtctgagggaggagaatcacttgatcccaggaggtagaggttgaagtgggccgagatcacgccactgcattccagcctgggccatagaaggagactctgtctcaaaaaaaaaaaaaagtgaattaatatatgttaagtgcttagaacacgtctgacatatagtaagtatagtgttttctataattataaaaagggaagaacataaacagatctatttctaagcacaaaagacttccttggggacaccccaaaacaactgggagaattgctgctcatatatctgtaactacagacaagcctaaggaatttgtcttactaattcatattcattaatttaatgaatatgtgttgaataccttctaaatggataaactcaatgaagggagaaatcatttaggcactgctaccccggtgacagagcagacagtaagtggtgactgactgagtgttccttgtacagcactgagtgccaagaatactcgggggaacaagacatcattgtctcacaatcagcagagccaagaggtgcaggttagaatgatgaacttgatctacatggaatgttcttaacaaagttttaattttttcccaatgtcgccaaaataaatagttttgactaattacctggaaaactaactggtgtggaatagtttatttcttccaaactttcagataaattatatgagaatgaaattaggaggaagaacagaaaaatcagtcatttcaagcaactgcatggaaaagaatgtatttcctttgaaaactctgggaatgtaaattcttaaccatttatggggattttagtaaatgcaggcaaggcatttcattcttacagctttctttgaagacagaaatacataatagcctactccgtaacaacatttcagtagtctttgagatttattttttctataacttgtagaagaaataggatcatttccgaagcagtatgactaggaatattactttgaaaaagtccaataaccatttctgatctttttcaaacagaaaaagtagaaaacgtcacctagtgtactatcctttaggcttttggttgaactcaagctattctggaaaagtcttgcttatcccccaaccttgtaaatatttagtgtttccagtttcccataatgtaaatgcagcattacaaacagcatgacaactgtgtatacaacaaattttgacaggactgctgaagatagaagtacaattctttgaagacaaatgaagtcccttatagagttttaatgataaatagaagggtacttagtcttccaactcccatgtcaatcagtgataaattttcctccaagcttaccataaaacggccaggttctgaggtctgggaagggcgtactcagtgccaaaccttatcttaaagaagggaagtccaatgtcatagtgcagagtgtgattcaaactgatttctctgtctgtttcataatggagatataatcttaggcctggtgcagtggctcacccctgtaatctcagtacttcgggaggccaaagtgggcagatcgcttgagctcaggagttcaagaccagcctaggcaacatgacgaaaccctgtctctactaaaaatacaaaaataagctggtgatggtggcaggtgcctgtagtctcagctatttgggaggttgtggcaggagcattgcttgagactgggaggcagagggtgcagtgaaccaagactgcgttactgcatttcagcctgggcaacacagccacaccctgtctcaataataataataattataataataataatagatatataatcttgttaagaatatatgttactatactgaagcaatgcagtgcaatgtacctcaacattgctcagaattcagagggtcatcatatagttccaaatgaaaaaccttaattgcaacagagagaaaaaagatgttaagcgtctagcattgttgcctaactaaagtacttggtatatattgttccttttcttctttttctcttttgtctaacttacaaaacatgaatatttatttccaagcttttttaaaaaaaactttttaattctgttttgtatctgagaagtaaagagatggtgaagtgagcacaattgtaagtaatactggataattactttggaggagattgctaggtagtgagacaagtggataatatcataagtgctagggctgagtatgaagttccgtgggaacacaaaggaggaaatagctatgaatcttaagaatagattgttatttaaactaaattctttcatggaaaaaaatagccttttaacacattatctcttacagaaaaccaattaataaaaacaaaacaaaatgaa

SEQ ID NO: 4 - DNA, 3846 bp, Homo Sapiens
tgtagacatatatagatgtatacatatatagatagataggtctatatagaaaaccatctatctatatctagatagagatatgtattgatagatatctctccctgtctatctctagatagattatctaatctatctgtaaaactatcttaaaaccatactaatttaaaaatcaagattcatcttaatttaaaaatcttaatttaaaagttaagaaccatctttattttgtggttcatatacaccatggaatgttaggcagccataaaagagagtgagatcaagtcctttgcaggaacatggatggagctggatggaggtctttatccttaacaaactaatgcaggaacagaaaaccaaatactgcatgttctcatttacaaatgggagctaaattatgagaacacatgaacacatagagggaaacaacagacactggggcctctgggagggtggatggtgggaggaagcagaagatcaggaaaaacaattaatgggtactaggcttaatagctgggtggtgaaataatctgcacaacaaatccctgtgacactagtttacctacataacaaacctacgcatgtgccattgacctgaaaataaaagttaaaaaaattattaaaaatatgtcagtaaaagtctttaaccaacacaagatggttcatcccaagagtcatcttaatttaaaaatcttcacatcttaagaagctacacgggaggctgcggcaggagaatggcttgaacccagcaggcaggggttgcagtgaagcgagatggcaacattgtactccagcccgggcgacagtgtgagtctctgtctcaaaaaaaaaaaaaaaaaaaaaagcaactttgctgcttaaattgagtataatacccatttacatttaatgtggtgaatgaaaaatttggttttcatttaccaccctacaactgaatttttaattcctccacatattctatttgcctttctcaactattattttatagataaaaggacttacagaaagcaaatatatgattcaatattccaataaaagtgctttttaaatttatattgagcattttatccttctttcttaaaaatcttaagctacacacattacatagctaggcactgataagaatctagtactagataaccatttcaaaggcatggatagaatgctttccaggtatggattgtttccataactccccttccatacattttaaagccattgcataaaaaataaggaattttgtagagaggagtgagtttatatcctttaatattttctcactttagaagtgcagtcttggaatgatataaactctgtaaacagactatcatgctgcatttacagagaatgatatcatggtgtctatttttaagacaagaataaaaattatgtttttttctaataatagaaatggataagcagaattctggcttctaataatgagaacatactatcccctagtttgaaataagttagataatttaactttctcatgttatcttgaagttaatacatcatttgtattgaatgtatcagtgcactacatgaagtcttacattgggtaccatcccttttatcttccacataaagtgatttagtgttttaatacacttctttccatatcttgcagttttgcatagcaaaagaagcatgcactttgaggaaaatgcaccttttaattttctgtattttaaatattatgggtacaaaatatttgtatataattatggagtacatgtgatgtttcaatacctcctttttgatcccagatctttcctgaattttttgtccaatttgtattgcgttatttatgtttgaaaaggagtaatgatgtttagtatatactgttataaaataactgattcaaaggatgtaaagtatctgatactaactatgtccaaatatgatttttaagcaaatgttcctaacaatacataaataataacatggaataaaataaattcatgtagctttatgataataattttacctaaattaaaaagtgttatgtgcaaatagatggtatacgacacttggcatgtaataatgcaattaagtccaattgaatatattgtttgatttatttccacaatctttgatacatgtattgtagatccaaacatcaaaaaccataagtagcctgtataatgctttttttattctctgtaaagtttttaatataaatatataaaagagcatcttaaattatttaagtcaattattttatatgtggatttggtattagaacatatatcttctttagcacaataaacttttttaagtgtcagaaattatataattatatagtgacttttgttcacaaggtagttagttgtacgtacctacaagatacttgaaaaatatttttgtcaagattggatgcatttttctcttatagactcttaaaaatgttaacaagccaacacgtgaacgtactgaagtattttttaatcatcttttctagtgttgataatgagttggctgatataaagtcattagagtggcaattcaacaaatattttctatggcataacaaatgtcattaacttgctagtctgtcacgatgttgcaaagctaaagtcacattcattagtgttttttgttgttgttgctgtagtggtggtttgttttgttacatgaagtggcccacttcttgtattaaattatttattctttctgaaaatgttcaatcagaatgtaataacacctttaaaaatgatttaaaaatgtattcccataggtgggaattgagcaatgagaacacttggacacagggtggggaaaatcacaccccagggcctgtcgggggtgggggcagggggagggatagcattaggagaaatacctaatgtaaatgatgagttaatgggtgcagcaaaccaacatggcacgtgtataccaatgtaacaaaactgcatgttgtgcacatgtatcctagaacttaaagcataataaaaaatatatatatttatttctactgaacacaatgtctatatattagatgacctagaactggtagggggttctaatccaggggattgttgataaactcagacaacttctgtatttttacattgttactcttaaagtcttgtcattgattgtctcaatattggaaaataacatgtcaatattcagtgtaataaactggaagaaaaaatgggccaatatcccattcaattaaagacatgaaaaagagtgtgtatgtattacttctgctcacatcttaatgttcaacatgtcgtcaccaagccagatagaaccatatactggggaatgtaatgtttatctgagaaaccaaatgcctaaatacaaattttagtagtacgaagtaagaggaaataaatatgggggattttctagtcttctctattatatataaattgcaagatttggctactttaaaaaatattaacatttactaatttttcatcaattcaaataccatattgtagagtgcaatttaaccaaattagataacagtcccaaatataacatttaactgtacatcttccagaagccaaaaaatgagaaattatttgtggcttttggctagacaaagatttcttagatgtggcccaaaagaacaacctagagaacaaacaaaaaaaccagttacaacaacaatagatatgacttcataaaaacaaaaaattctgtatttctaccctatatgcctcaaactaggaatagacatttccaaattatatctgataaagaatgtgtatccaaaatatgtaaactcaattataaggaaaattacagaccaataataaacaataaggaaaagaatatacttgaacacatactttgccagaggaaattcagagacagcaaataatcacatca

SEQ ID NO: 5 - DNA, 3376 bp, Homo Sapiens
gctctggtcaagtttgctgtttcatgtgtcttgggttggcttcgctgataagcagacctaggagctgacatatgttagcagagacatatttggacccaacctatatactttttctctataaagcattcaaagaacaatgtgacgattacagttgtgtgggatttcacccttccttaactataaaaagaagacttcttgggccaggccggtggctcacgcctgtagtcccagcactttgggaagccgaggcggatggatcacgaggtcaggagatcgagaccagactggccaacatggtgaaaccccgtctctaacaaaaatagaaaaatcagctgggcatggtggtgcatgcctgtagtcccagctacttgggaagctgaggcaggagaattgcttgaacctgggaggtggaggttgcagtaaaccgagatcgtgccactgcactccagcctggtgacagagcaagagtccgtctgaaaaaaaaaaaagacttcttaataaaaaacaggcatacctcattttactgcacttcactttttttgtgcttcacagatattgcttttttttttttttttttttttttttacaaatggaaggtttgtgtggtaacccttcattcagcaagtccattggtgccatttatccaagagcatgtgctcaccttgcgtctctatgttacattttggtaattcttacaatatttaaaaattttcactatgattatatctgtgatggtggtctgtgatcagtgatctttgatgttcctattgtaattgttttagggcaccaccaactgcattcatataggacggtgcacttaattggtaaatactgtgtgtattctaactgctccaccaatcaggtgttgcctcatctttctcctgctccttggactctcaattccctcagacacaacagtgttgaaattagaccaattaatatccctacaatggcctctaagtgttgaagtgaaagaaagagtttcatgtttctcactttaaataaaaagctagatatgattaagcttagtgagtgtattagtctgttctcatgttgctaatagagacatacctgagactgggtaatttataaagaaaagaggtttaatggactcaccactccacatgattggggagacctcacagtgatggtgaaagacgaaggaagagcaaagagacatcttacatggtgtcaggcagagagagcttgtgtaggggaactcccttttataaaacgatcagatatcatgagatttattcactatcaagagaacagcagggggaagacccatccccatgattcaactgcctcccactggatcccttccatagcacgagggaattatgggagctacaattcaagatgaggtttgggtgcagacacagacagaccatatcattctgcccatggcccctcccaaatttcatgtcctcacatttcaaaatccgtcatgcctttccaacagtcccccaaagtcttaagtcatttcagcattaattcaaaagtccacagtccaaagtctcatcggagacaagctaagtcccttctgcctataagccagtaaaatcaaaagcaagttaatcacttcatacatagaatgggggtacaggcattgggtaaatacagccatttcaaatgggagaaattggctaaaatgagggggctaaagaccccatgcaagtctaaaatccagcagggcagtcaaatcttaaagctccaaaatgttctccttcaacttaatgtctctcatccaggtcacactgatgcaagaggtgggttcccatgatcttaggtcccctgtggctttgtagggtacagcctccctcctggctgctctcacagggtggcattgagtgtctgtggctgttccagacacatgatgcaagctgttggtggatccaccattctggggtctggtggatggtggccctcttctcacagctccactaggcagtgcccagtggactctgtgtggaggcttcaaccccacatttcccttccatactgccctagcagaggatctccatgagggtcctgcccctgcagcaaatttctgcttggacatccaagcaatttatatatcctctgaaatctaggcagaggttcctaaatctcaatttttgacttctgtgcacccacaggctcaacaccacatggaaactgccaaggcttggggcttgcaccctctgaagccatggcctgagctgcaccttggcccctttttgccatggctagagcgggtgggatgcagggaaccaagctcctaggcttcacacagaagggggaccctgggcctggcccatgaaaccattttttcctcctaggactctgggcctgtgaagggaggggcttccgtgaaagtctctgacatgctctggagacattttccccattgtcttgctgattaacatttgactcctcattacttatgcaaatttttgcagccagcttaaatatctcctcagaaaattggtttttcttttctattgcattatcaggctacacatttttcaaacttttatgctttgtttcccttttaaaactgaatgcttttaaaagcgcccaagtcaactcttgaactatttgctgcttagaaatttcttccacaagatacccttaataatctccctcaagttcaaagttccaaaaatctctaaggcagggtcaaaatgctgccagtctctttgctaaagcatacatagcaggagtcacctttgctccagttcccaacaaattttttgtctccatctgagaccaactcagcctggatttcattgtccatatcattattagcgttttggtcaaagccattcaacaagtctctaggaatttccaaactttcccacgttttcctgtcttcttctgagccttccaaactgttccaacctctgcttgttatccagttccaaagttgcttccacatttttaggtatctttacagcagcccgccactctactcctactaatttagtgtattaatctgttttcatgatgctgataaaaacatacttgagacttggtaatttataaagaaaaggaggtttaatggactcatagttccatgtagccagggaggcgttacaatcgtggtggaggatgaaaggcacgtcttacatggagacagggcaggggccttgtgtaggggaactcccctttataaaaccaccagatcttgtgagccttattcactatcacaagaacagcatgggaaagacccgcccccatgattcaattacttcccactggttccctctcacagtgtgtggtaattatggaaattataatttaagatgagatttgggtggggacacagataaactatatcagtgaggaaagcatgttgaaagctgagagaggtcaaaagctaggcttcttg

SEQ ID NO: 6 - DNA, 9806 bp, Homo Sapiens
cttccggttactgactctgtggctgctgcctcccacaacgctgtgcttgcagaccccaggagcgctggctgtcccttcacttcctgaacatgtggatgtgtgctttgggttcttgacctcagctcttcccaaggtcttcttagagaagggtctaaatgaagtcatttttagagtatttgtttttggttacacaggtgcttccgcccatgtggcctcggagtgggaccctgcgggtcatcaatctgtacattgcctgagagcagccgtgtatgctctggaagggacaagaccaggtacctgtcgggggatgcggccgtggtaccaggcatggctgcgcaggtcctcgctgctcaggagcagctcctcctccagctccttcttcagtttctcgggggtcctgtccatgatgtgcctctccttggagaactgcaacacagagtcaaccatgagctcaccctgcccaggccacaccaggccatgccagctggaggtgaccgcctgcttcactaatccaaccagttatgctacagcctgcattcagggagatgtggccacaggactcagttctgaccaaggagctgagatgtgatggctggagactcaacaccattctggacgccaaaaagagctggccttggctggaaggttctggctaggaggagagggctaaagcatgcgaaggcacaacaatgatggaactgagcgaagaagatactctatcccacttcagtgaaaacatcatgaggcttgaagcatggaagttgcctcacccccgtgtttcctgccaggtggaacaaagtgctgagagaatcaaaccagcaagcaaagagaagaggagcaagagatggaaagtgacctctagcatgcacatccctaagccccagctgattatatcagccggcaaactcctcttgtgacctaggctagtatgagtggaatccctgtcacttgtgaccaaagcagtcctgacccagaaacgcagggactggctgagggcagcccaacattggtggctgagggtttagaccatcacactccagaaagtcagagtcacggaaaatctttgcccaggaaggcaacaggtatataaaaagatacttttagagagatctggctgcagtgagagcaatgggctggatggggccagggctggaggcacaggtcagagtcttttgaaatgtgctgacaacgcccagatctccatctccagcccttagggtcggtgcctggtagggatatttactggaatccgcattaaagctcagatgtcaatatggataaattgaactcatcccctctgcaaagcctgatcttcgcccttttccccagtcactggcatctcttctgtcctcattacctgaactagaaccctcagaatcggcttccattggttaagacattcctgattcttttacctatccccattcgaatccccactgtttagattactgttcttttctcctagaacttctgcaatagcctcctaacagtttccctacctcccatttctagtcccacaacctgccacctacaataccaccaaccttgtcatattgcccctaggttcagagattttagtccaagggtgctccagctaaggccgacatgacagccacagtctctttcaactcctctcccaccacacacacatatacacagaatcaacgagcttctaatatttagttttcattcatgccagggttcgggcctggtccctgggggcgcagaccccagtcctgccctgttcctccagaatcctgagctttaagcaccatttcctgttgccccagggagctgacccatggcccctgacatatactgaacttgcagacacactgggatttggctctgaatttgctaggaggcccagatcatgagagggctgtggatgcaaacaggaagcgtccctgtgggcccccagaaataactgtcagaggcatgactggcaggggagatgggcaagggtcctgccattatgaagtgggttccaagagtcagcagagttgaggcattaaagttttcaggacattatttggggctgttggctgccaaggcctgaggaaatattggttatgcttccaagggctcacagtgacctccagataaagcccaaagcctccttcataagtcaagtaatgcctttttccacctggccacaagctaacttgctaacatgttctgacgcagggtccaattgcaggaaccttccatggctccctgaacaaaacatccctcatgtcctgcctccatgcctttgtcttgtggtccagcagacagtgacacatctgtagaggtacacggcctggcaggagtccaggatgggaactggggaacagccaggggaaagtcagacaaggtaggtggggaccttgaaggccaagcagagaccatgccttatttacctttggctcccagagcctggcccagtgcctggcacacagcgagtgcccagtagacagtgactggctggaaccatgctcacttgcttgccctctgtctagcaggttccttgtcacattgggtgtggaggagaggagagagcttggaggctggtcaagaacaagtgaccttgggccatctctacacttctgagcttgtttctctatgcataaggagtggggataataactcccaccttacaggactataggacctgatgcaggtaaagcatctggcactatacctggcacatggatgctcgcttgacacaatgtggaatttgaaccctctttcaaagacggcttttagcaacaaaatggaactacttcactaaagaagtaaagaaaaaaaattacaaaatccatcagaggttttagagatatctggccctcgataatttagttctaatggaataaaaaagctagaagttggaaaactgatctctacttaggcacaggtttgtttattcgtttatttcagtgcaaagtcaacagttcctgggattttgagtagcactcaatggttctatagatgcagggtgagtaagcaggcatactgtcgcttggtggcaagcactttgtatgcatatatctcactattaacaagtatatgtattagcgccaggtggctcacatatccacaaatacacaggtgacacagcccagcatgcgagtgcaagacagttttgtgtttgcacaagactaagaggtccttgtatgtagattctgtcttcttggacacttagttgttgagaaattttttgttgaattttaaaaactgagatgattttctagtcattcatttattccatgatcaagcctggcaattaacttggttgaataaagaaaaagaagaaggagggaatgtgtgcataaaaagaggaggtggggaggagaagggagaggaggctggagaaggagcaagctagcaagctgctgggctattctatcctagttgggagtgtcaggctccaacacccggaatgctatcagggttctcaaacaaaagcctcctttcttcagttttggaacagtttattagcttgagggagaagtccacaacagtccaggcctcttatcaaattgtatcaaacaactccacaggttgggattttctagaaatcctatccagaaattttgattacaaataaaattataagtctgactggagttctggatcttcgatgttaacattggtctaatttctttttcatttttttttttgagacagggtcttgctctgtctcccaggctggagtgcagtggcgcattcatagctcaagtgatcctcccgcctcagcctcccaggtagccaggactacaggtctgcaccaccacacccggccattggtctaatttctaagcaaggccagtgtcttccaatgagctcagggtgggaaaccccacgggggttgggctgtgaactgtaccaggtggcccaagctgggggtccaaaaagacagatccacatctcaaatccactgaactctgggaatccctgtgatgacctgagacctgcatcatcactgcccccaataatgttgtaaacatgtaaagaaactgaatccccaaaaagcacactttcaaaagcactacacaaagcagtctgaacccttcctctgaagaaggctgctacatctggcatcgtcttacaagtaaatccaacccgaaatgaagttctttggagaattcagaaactcagcccttttgaacccctgccttgcgttgaatttcaagccaagtttacaaccaaattctgaagtatataaaggacttttaaagacccaattggtatttttacaattgaaaacctgcataaattgatcatgaacccaaagaatgaataaaccccaattactttcatcactctaaaccctgcccgaagctgaaaataaaaatccagttctccacaagtttgaagaccagttacttctagtacgagcccttgggtgttttcatctaaagtagaacagaaagaacaggaatggcacttgtggcgatcctaaagccttgcaatgaaataattagtagattggttctgtttcaccttttactgacacttgctggttttgtggcttacttaaaaatagtttattttattataatccaaagataaatgaagaaaggtttgaattcaccaatcctacttttcccactgggatgctaggctagaaaaatagtttcttatgctaataactgtgattaaagccaaagcatttacttaaataattaactttacaaataaaaaagttcaaagagaaaaaaattcatattttatatccctgttgggtaaacaaaaccaaatgtgaacgtgggcaattgggcatctttgcctgacccagcccagtgggcacatggtggcctggccagcggtccaggacgttgccagaaccatagctaaggaggtgccacttgtacacagctgtcatggatctatatattgattacaacagctgcccaacatatgacaataaagtgtcctgaggaaagggtgtcttactcttattcactcaagaggcactctacaggccagcagggagggtccctgagtgtgtccctgagacttctctgccttttaggtgttggacccttggcagatgaggacctctggcctcactgggccccttgctatgagccagctccttcaaattctctcattaaagctcagtgaagcagcctttgcagagagcttcctaatccatgcacacttcacccttttggctaaagttctgcagaaatagtcaggggctccattttcaatcaagagtttgatagtcactggaacaccgtgccttaaatgaaacccaaggacttactgcatgcctgccgtgctactctgcctctctggctagatctgaggcagccgcagctgtgatggaaggaggactccatgccctgcagcagtcacagcctttttgaggagacaaagcatttgaagagaatgtgcagcaataaacatctatcttatctggggtcagtgagggtttctggtcccttctgacaaagaaattggcagcagagattccataaaaatttcaataagttttagcattctgaaacacttcaattagtttgatgttaacgtttaagcaccttgatgaaataaatttatctcttccaaatcctagaaagaatctccctttcggcaaagattctgcagatgggttttgatgccatttttccattttgtagttagatctctatcatttatcacactgtagaccaaatggtcgttttagtgccattaaaaactgatttgcaatttgctgttaaattaagatgtttcattttcctactgtatatgattttccttttcacagatgagtgaggatacaaggggcaatcagaccctagtgcagacaagaaaataccatcaaaacccctagagatcccaaatctaagagatttccttttattcattatcaaacctaatcaatctcttatcaaaagaggctcagaaatcatgtatagtaaatatgaagaggatatctgtagaaccccttgcttatcaaagttctgagaaattcccattaaatttctgttatccatgtgtgcaaactaaaaagactaatttaattttaatttgtgcagactgaagtcttagagcagagcactctgtaagcaggcagcagtaacttaatcctacatgacaaactaattacattagaatcattgtgataggtgcccatgccttctttgatgttaaacccctgttacctttgatccacagtcattctctgggcaaggtctcttgcacacattcccatcctgccagatcatgaagctgttgcttttgaagctcagttttattttgatagaacaccaagggactgaaaattatttctcactgattttgttctgaaaacttcgggtagaattctaagcttgacagaatgtagcacatacaacgccaacaaatgtggcttcttttcttcactaagatcacccactcactggtgaaactgctcaatgtactcattgcactgtaacgtctctctccatcccttcttgaccccagtgagtttgcccatcatgtttcttaccccttgataaacatcatttacctacagcctcactcaaagctcagctccaagggggtctcaccttttcgttaatagataaaccgaaacacgatgagatttccaacaggccatttgttaacatcttgccacgctgaaagccctggcgggtaccttccgtctagatcaaatttagatgatgacttcctggagcagcccacagaggaccagacatccaaatcaccccaagaggcaggcctgtattctcattcctcctagagagaagtcggatgtgccacacttcagaggaaggccgaaggtcaatgggtgcacttaatcattattggactagagaaatgaagggctttgataaaagctaaacaccagtccaacctactgtgaaaaccctgtctaaactactttgctccctttaaccatgtcctcgagcgactttgaataatatctctcttgctttcacagggctggcacttgggttaaaagaaacaatgcaagtgaaatattaatcgctgagttcagcagcaagattacactcagtaatagtagtgctttcttaacatctttaaagaatgaaaagaacaaagactgccctggctaaggcagaccctaataaaagagtttgaaaaccggctgatcagagttcaaaatgctagaagatccaagccagaaatcctcaccactggtaattcaatcttgttaattcaacatcttaatgcaaattatgaatgatctggaacacagctattcatcaaaccagatgtcctatttgctcttcaataagaatgtcagcaaatcaaaatcaacttaattcaaatactctcatttcctaattcaccttgaatgaatgagatgaattaggaaaaggagagtactgaatgaacaaaatgcaccgtagttgaaagacacccaaagatgtaattggaaggaaaaacaagatatgccaaacacatggaggaaaagccaaagattcagacagccttccagcgtggggtgtagaacaaatgactttcaaattctctctctccaaaatagtaccatgactaactaccatcttagaactctgctctgggacaaagcgcatcacatgtcagtgctaagtacgcagcaggcttgcagtaaaacaaaatgattcatcacaagatgggttttggccagacatcaactgcaccactttcaatatacaactcacaggtcactttaaagttcctcctctagctcaccagggacctgggggcgggcctgccagcggccactccctgtgctccccttccaggctgatgcctccctgcctgcccacaccggggtactccacgtctctacactttgtgcgtgctcctctctccacgaagaaggccaattctcctccttctctggataacttcgactaattcaccagactcagcaaaggctctgcctccctgcaggaggccatccctgatcctcgccactcctgccccatctatgccaggcatgtgcctccagggagccacagcaccctctaaagagagcaacaccaaatcagtgataaccgatcgtttccttcaaccagagttaaatgtctgcagaatgcccaccaggcatggtattacagcagagatccccactggaccaacaactcccactgggtccccagcaccgacacatccgaggtaccacaaccggtgactgctgagctgaactaaggatgcaatgggatgaaagccaatggggaaatgtgcctcaaatacttattaacccctggtacaggaggcctggctgctgggattattcctagatcctctgtgacttctctgaccatgtcacacactaaccttcccagtgaaccttctgctctgagcaggcctggccttctgcactcctgcaaatgccagtggcttttctatctctgagctactgggtctgctgctcccccaggctgaaatgccgtccctatgccattcttttctttgtccatccaaatccccagttattaaaaaaaggagaaaaatttaaaaggggttacctgttcttaaaaacaaacaaacaacaacatcaaaaacaaaaacagtcccacatcctccctgaagctttcctaaaaactaaggctcacactgttctctcccaactgaactgcaaaataaagtattaacatacacaatatcatcttattttaggcgtcaattgtcttaatatagtacagtagaaagaacgctagcagccaggcatggtggctcacacctgtaatcccagcactttgggaggccgaggtgggcagatcacctgaggtcatgagttcaagatcagcacggccaacatggtgaaaccctgtctctactaaaaataccaaaaattagccaggtgtggtggtgggtgcctgtaatcccagctactcaggaggctgagacaggagaaggcggaggttgtagtgagccgagatcacgccattgcactccagcctgggcaactacgtctcaaaaaaaaaaaagaaagagcactaggcttcagcccagaaaatctgctttctattcctagttccccacgaaatgattctgggcgggctgtttctctgagccttggtgtgtcctctgcggaaagggtaaattattgccctgctcacctcacagagcttattttcagactccagtgagacaaagttgttgaagtcttcatagcatagagagcttgttttgagactccaatgagacaagatgtgaaagaactcatacatttgaaagtcttttgcaaatgtaatgaagtgatattatgacctaataatatccttgtggtaagtctttgaaggcaggaaccatgcctcaaatctcatttattgccccacacctcccacaaatccctccccacctaacagagggcttatgcatggactttacattcaacacccattctacattcaacacgcatggactttagaacttgaatatgtctgttaatgttatgatctggaatatctccattacaagtttctttccactgggcttaaataaaacactttcgtcttttttcccccagaaaaaagatccagtagtcttttatgtaacggctgtctactgtgaaccccttcgggatattaaagtcatgaccctcaacatggctggaacatcttgtatttggccccaactctatgagggccagcacatccctgatccttctctccattttcggcctcccatttaattcctttccaaggtctttatacacaagtccgtatgaggcctctaaatacatcctaaattctgtaagaccgctgcaaataagatcttactctctaaaaacacctgtataatcattctcctatgtaaggagggaccctctatatttttagttttgttcccat

SEQ ID NO: 7 - DNA, 1586 bp, Homo Sapiens
atggcagtggctggggcagtgtccaaggagccactggtgtaatggtgcacccagcaggtagggaaaagtgttggcctggatgtcagcaaggagatcatgcacagtgcttccaaaaagatgaaactttacatgggcagaaatcaagggaccagctaaagctgggtaggaggaaagggagagatagagaggaagttcccgtatttgctgaacctgacacagctgcagaggtaaaacatcttttgatttgcccaaggcacgagagaacagcaactcctttaagaagaagacaaagtttgtcaatttacacacaagagagggacccacaggcctgcagtctgctccccagttgccacccttgtgtttgcctgggccagaagcacaagctcatcaatagctgtctgatctgtgggcctgttgtttgtgaacaagagggctccaatccttgcttattctgtgtgacaaccatatgtactatgaagaacaggatattttacagcataactcaaatgagagccagaaactgctaaagaagctcatgccattgatggagaattctggaaaggtggacaactctgccaaggactttctatgtcatcgagaatttcaaattatgtctggtctggagaaggatatcaagcacaaagacaggctgttagagttggatagagctagttttcaaaggacccaagttattgatgatcagattttttgccagtgattctaaccagtggttgtccaaacttgagtgggaaacgaaatgagaagtgagaagaagagctgagagaacttcgacatgcctctgtactctctaagaaggtcaccattgactttacagcaggaagatcctggaagaagaaaatccattagcagaatatcacagcagactagatgagacaatacaggccattgctaaggaaaccttgaactagacactgatcacatttgatatatctcctgaagaacctttggaagttctggtaaatctcagcacatacgagtcccctccccagtgggttgaccacacaggtgcagcctcacagaagaaggctttccattcagcaggattgggactagaattcaactcatttcggtacctcttgtgaatccaggatcaagactttcagggaggttggacagtggctcatgtctctctatacatcagccctgggtttctcagcttgttagagggattagaaaatgatggagtacagatcctggtacatctgccacagaggacaactttggatagtagtcatagccaaaacctccctctgccttcaaaaagtctcagaactccgggctacatatcatcttcttcatagaaaagatgtggaattccccagtgactatccatcaggttgttttttgggctgtctggacctaattgcttgtttcagaggcaatttaaggagcagtttccagacatcagctaagaatcacgttctccacttgttttcatctgcaaaagtcctgaggaaatggttgtgaagtttcctattaaaggaaataaaaaaatctggaaactggattccaagatccattaaggagcaaagaagaggtaaatgaagcagaataaagctttctga

SEQ ID NO: 8 - DNA, 22888 bp, Homo Sapiens
agagagccaccggggcccgctcgcgcgcctctgagaggctgtccgcgcgcgcgcgtgtgtgcgtgagtgtggatttgccgggactggagctggaaagttcaaactaaacgtgttgctctcgccgagtgccgaggccgcggcggaggctgcccaacttccccgggccaagtgagtggcgttgcccagcgcctttggcgaggcggcggccgctcggccctgcgcccggccgcggcggcggcggctccgctcgccccgggagggagcccgcggccagggctggactctcgccccgccacctccaccgactctctcctcagcctccgcgcctggcaccgcagcaagacttgaatgaagtgatcatgtaaactagagaaaggagattaaaaataacctctggatattcctctcatgtgatctttattctggatgaagcattaggacagctaatagccgtgtgtcacttaaaaatccaacttgagaactgtcaccaaagatgtctaggaactttgaagaaacatgaaggattagactggagagaaggctgtttccaccataaagacatttacccagccagccctatgaaaacaggagcctatttcactacttggttattgactgaacagagtagccaagaggtgggcctttcagcccttagggcctgccagacagcattaaaactaagtcttctgtgaagaagctccctgtgcttgggagtatgcagctttaatgtttgaaagagtgagggagggaagaagggagataaccctcccagaaaacagaaacgcagaccgtgctttagaaaagatctttccatatgtaacaaacctgcacgttgtggacatgtaccctaaaacttaaagtataataataataataataaaagaaaagttctttctcacaatcctatcagatggaatgagtcacccacctcccttgtgagggaaggagtaaggcccccaggataatgcttgttggggcagccttggcttactcccctgagaaagcacacagctgagcagaagctgcctctttggaaccagtggtggaatagttactggttttacgaatacaatggacacagcagattttgtttgtttgtttgttttgagacagggtctagttccgtcacccaggctggagtgcagtggtaggatcttgggtcactccagcctcaatcccctgggctgaagcgatcctcccacctcagcctcccaagtagatgagattatgcctggataattttttaaatttttaaaaaattttaaaaaattttgcccaggctgctcttgatctcctgggttcaagcgatcccgtcgcctctgcctcccaaaatgcaaggcttcacagcagatgttttcagtagaaattgtcttatatttgttttgtgttgttattgaaatgaatataatgctagatatttcttggtatttcggaagtttatatcttataggatagattttatggtaactttttacatcttgaaaattatgttaaaattattttagtttaactttgttgattatctgcttgtatgaattggctttaatgacaagaaaatactttaaaaccccagggttacctccagctggcttgtcctttacccctgaaaattttggtttcctaatataggcaatgacaaaaagaatatttaaattccacactctccaaagttgcaaagtaaaaataaataaaatattcataaacgtatctgaaatgggtccaaaatcaaagattcaggtaaatattaaaatacatgtccttttttctctgttgtagatggacagagagagaaaaaaaatcactgagtagagagagaaattatattgtaaataaaacatatggcgaaagaaaacttttcaggcaaattaatttttaaaaagccacatcatacacgatattaattaaaaatgtgtatatatataatttaaataaaaatattttcctttttgttatcttcttcatcttccaaattttggcattaaaaatattaggaaggcatttctatggcttttaaaaaagctttccaagcagctctcaatttattgtttcacataatgctactcttttctctaagtctgccttgtcagctaacgtgttttgggaagaaaaaagaaaacaaaacaaaaccaagactctgttcttctcatctctttgattgagttatcctttgctaggtgaagtgttgtgagctttcatacccttccctgggcttccagcagctctccccacggagtgctgccacagcaccaccaggagccccagatccctgcaaggaggagatcaaacctccacagcagggattcctcaagacaggtcaagctccagtgcttggaaaactcagcctacatcacacaaaaatgttatcatttatttggaattctttttcaatggattgtctccacttctaaaacatttctaagtctagttcaaatccagctgcagattcctggcacttgcttccttcccattctttttcatatatcttcttttatgttgcatatacttacttcagattaagtatataagttaaactttcagtctattctgccattagaagagtttatttccatacacaataaaaaaggatcgtttgtattatcctcaagattagtgtatgttatgaatgcaatatctttgcattcaagtgaatttaaatattataggaaggggtagagaaggaaatgcaagttatcactgactgacttgccaaagttaagcaatttttaagcattttggcatgcatgattgattgtgtacttttaaatttaatattgtatggtaattattttctcacgtcattaaaaagtatttttttcaatggccagataatagtttatcatgccatgtactgtatttaacttcaaattgatagtcttgaacacatatattaatttcaattccacagatacaaaaaataattgacattaaacttctttgagaataaaaccttgtccaaatttgatatatccttaggatgtattcctagacatggtttatttcatatcttatgaactctttatttgaaggtatttggtatgagttgagaaattacattacagaaaaaaattttgagtgtgtatttcattcaatctttgcattgtttgtaagtgcctatattaagaacttttttgttaaagtttgactatgaaatctgatgagtgaaaatttaatctttttcttattttaattttaatttcttcagttaatagttaaactgaacgctttccatgtgtttattagccacttctcaatttttatatatttatttagataaaattgtgcttaccaactccagtctcaatactctctgttaaggtctacggtgtattcatctgttgaggtttttgtgcttagagtatcaatttttgtgaatgggatatttattataactaacaattctaggttttatttattaaaaattgaacaatctgctatctataaaatccgtaatatttcctttgcaattttcttccaaacaattgtaagttttacaccaaaattattccaagaacaaagcacgtgagactattttattgacaaaactttgttggctgaaagtttatcttccgtatacttcaattttttttcccataggaggtttaaagagcacacacacacacacaccacacacacacacacacacacacacacacacacacacacacacacacacacagtgtttctgaagcccaggccatttttggtaccaactatatcaagttagaatttttacatgtgtctcttctgtacgaatctataccaaaatacatggacagaaaatacagtgatacattcttttaaatgaatgctgattgcactttacagtttaagaaacaaggcttcgatgtagggatttcagagtgaacacttactatatatctttggaaactagactgctaacctgttactgaaatgtttgcatcaaattgtttatcaggttattttctctcggtatataaatataacaaacttggacaaagtggatgtattttcaaaggataataaaaactaagaatggagtgggtcaatatacaaggagaaataaggcaatagactggaatgtagagaagagagagagactggcacagagggacagtggggatgataggtattttaaaaaataatgggaaatgaaaagattttctctatcacagaaaaccaaggttctgtggagacagaccctaaactagactcctgcagagtctaatgctcgttcatcacaaggcatgctagacactgcaagacccattggcccatctttttgatcctcactctcaatcatctaaacaaggctgagagatgactctctgtacagcctctgcattgtgtaataataactctgaaatagtttctgatcttttctcttaggggttgcataaaattttgcttctagcaagagaaataaacaacccataactaaatctagaaacttagcaggcaaagctctgtagtcagaatggctactttaatttgagcaattctgaacacaatttgaacctctccacactatgaaaatagcataaaatgaaagaaataatagctaatacaccaacaagaagtacagtatatatgatgtacttacaaaaaaatatagaattatggataatatgacacattcattgagcaaagagaacatggcatacatttatcttatataaaataatgctttataatatatatttaattgaacatggattcttaatacagaaacaaaaaatattttagattgattatcattgtacaattccttagagacaaaaaatgtaagtaaaatgtctgtggattttccaatacaacctactcttcctatctaagtgataataatagcctttaagtaattttctaaggatttttattttaaaaagtttaatttaccaatgaaaaaacataaatctttgacattaaatgaaagctctaacagatgacgcagatatttctaataaaaacaactcaaaaaatggaggaactaagctcgtatatttcattagagatattggatatagcaaattagcctttattttaaaatgaggtctctcaatctaattttaaaaataaatataagcggacttttacttacagcaaggtggaggaaatatattttttttctctatatttccttctaacaaggaatgaaaaccctagacatcatataagaaaaaacaataagaagattttgaaagatagagagaaatcagaccagccagtggctttggaaccctaggaagaactcagtggtgagtttcctggatcttcctttaatctcacatatctgagccttattgctgaagaattcaacaacctggagataccaagagcacagagaaaaccacaccccgacaaaagtctgctctttctagccaaagggtgaggaacgggcctgcctagaaagacatcatacttctagacaacaacccatcaactccagcaaatgccacagaaaaaaactgtggccccgctctcactcccacaatacgtatcaattggggggcacaaagtttcttcctctcgaggccataacgatgtgctccccaaaccctgctggggtggttggtgtgagagagagccagataggaaacttgatgttcatcttctctcgctgtaagaaatccccatgccccttcccctcactcccggccatagtgtcagtttatgtgatgtgaggatcctagtgctgcatcctcaccacacaagaacaagcccccctccaccaccctgcccattatgatggagtcagcagagcccggtggagagtcccatagactggtcacatagactggccgcgtagactggccacaggggatctgggcttctcactccgccaggcagcaatgaagtggcaccctcccattctgtcagagtggagtcagatcatgccagctaaaatgcacggtttaaatacaggcttcatcacatgattggaaatgtccacttttaaattgaaaatcacttatcataccaagatccaggaagacctaaaaccaaatgcaccaggcatggtaggtaacacctgtaactctagcactttgggaggccaagacgggaggatcacttgagctcaggagttcaagaccagcctgggcaacatagcaagacctcatctgtacttaaaatttttaaaaagctagccaggtgtggcagcgcatgcctgtagttccagctgctctggaggctgaggcaggagaatcacttgagtctgggaggtcaaggctgcagtgagccatgattgtgccaccacactccagcctgggtgacagagtgagactctgtgtcaaaataaacaaacatataagctgaatgaaaaggacagtcagcaattataaatatgtgataacagatatagaattacctacaaacgttgtgaggcagccattgtaaaatgtttcaaggagcacttacaaatagaaagtgccagcaaagagatataaagaacaaaggggaaatttgaatatttaaaaattaataatcaatgcgaaagtttagtgtttggactcaacagcttaatggaggagatagagtaaaagatcaggaaactggaagatagaataagaaaagttacccggtctgagcaacagagaaaagatagctggaaaacaataacaaaaatgacagagcatcagagatctaagggactataacaaaagatattagaaaaaggccaggtgtgatggctcaagcctgtaattgcctgtaatactagcaatttgggaggcccaggagggcaaatcactaggtcaggagtttgagatcagcctggccaacatggtgagacccccgtctctactaaaaatacaaaaaaaaaaaaaaaattagctgggcatagtgttgggcacctgtaatcccagctacttgggagactgaggcaggagaattgcttgaacctgggaggcagaggttgcagtgagccaagatcacaccactgcactccaaccccgggcgacagagtgtaactcagtctcaaagaaaaaaaagatattagagaaaaaaaaatcatgcaaccagagtccctaaaggagaggaggaagggtgcaaaggtgaaaaagttacttgaaaaataatgacttaaaaaataatgatgtttggccagatacaggacactacagaatcaagaagctgagcaaaccttcaacaaaataatccaaagaaatccacatcaaacaattaacttctgaaatctaaaaacaaagaaaaatcttgaaagtagccaaagaaaaaatgacaccttagttacaggagaaattcataatcacagtaggtttctgatctggaacaatggaagccaaattaataggacacaatatttttcaagtgctggaggaaaggaaccgtcaacaccaaatcctatagccttgaaaatgtcattcagaaattaagggaagatcaagacattctcagatgatatataattaagaatatttattaccagcagacataccctaaaataatgactgaaggaagttctctaaacagaaaggaaaaaatagaaaaaggaatcttggaacatcaggaaggaagaaatcatatgattaaaacaaatatgggtaaatattataggctttccatctcctcttgactttaagagagtgggtttgatgtttgaagccagaattataacactgcctcaagtggttctatatgaatgcagatgaaatatttatgacaaatatattataaatggggaagaatagaggagcataaaagaagtaagttttccctacttcatttgaactgatgaaataaggacactactggagtgttatgagttatgtataaataatgtaattctgagaaccacaggaaaatcacccaacacattgaaactaagcaacaatcttttaagtaatctcactatcaaaggggaaggatcaaggaaaataaatagaaaataatgcatattaaaagttatgtgacacagataaagcagtgttaaaggaatttttgcactaaatgcgtaattagaaaagaaaaataatctcaaatcagctatcatagtttgcatcccaagaatctagaaaagtaattttaaaacatcagaaagaaaaaaatgataaagttatgagacagttaagagcagaaacaaatgaaattggaaacagcaaaacaatataaaaaatcaatgaacaaaaaagctagttctttgaaagatcaacaaaattgacatgaatgatgaaaaataagagaaagacatgaattaccagcatgtagaatggcactaaagatgcttcactatatcctgcaatcatcaaaaggatgatgagagattacaatgaacaactctagacacataaatttgataccttacatgaaatggaccactttctttaaaaaaaaaaagaaaagctaccacaattgactcaacataaattgctaattgggatagtcttttaagtagtaaagaaactgaattcataattagacattgtcaaaatgaaatctctgagcccagatggtttcaccggagaaattatttaaagaagaattaacatcaattctaaagaatccagattattgagggggagggaacactttttgatagactttagaaagctagtattactctggttttgattcatatcaaaaccagaataaaattgttaaaaataaaatataaggaaataaagagaaagcaacatatcaataaccctcataaatatgacagaaaatatttaagaaaatattagtaaattgaaataaaattcagcagtatatcaaaaggattatatattataaccatgtatcttctattctaaggaaacaaggcaattcagtattcaaaaatcaaatagtgtaggcccccatattaacagaattaacaaaactcttctaattttccaattagaggaaaaatcacatggtcatacaattgatgcagaaaaggcattttaaatattcagaaaccatttataataaaactctcagaaaactagaaatagagagggatatttctcaacctgataaagaacatctacaaaacctgtgggtattttcataatgatgacagagagaatgctttttctctaaggtcaggaacaaggaaaaaatgctctcaccacacttatctaacagtgattgaaattctaatcagtgcagtagggcaaataataataataacaacaaacacaaagcagaaaggaagaaacaaatgtccctgcctacagatgacttggttgttcgcatggaaaatctcaaggaatctacaaaaatattcctaaaaacagtaagtaagttcagcaagtttacagaatacaagatgtatattaaaaagttatattcctatatattcacagtgaatacatgggaaatgaaccaaagaatgtgatatcatttataatcactaaaaatgaaatgaaatatttaggtataaattgaaactacacaccactgctaaaagaaatcaaataagatccaactaacagagagtaaacttagtttcttgaattgaaagagtaaacttagtaagtagtcaattctttctaaatttatactggaggtttaatgcaattctgatcaaaatctcagcaaaatgtttcgtaggtatagaaaagattgttataaaatttatctggaaaggcataggtcctaggatagctacagtaatttttacagagaataataaagtaggtggaatctgaatacccagtatcaaaacttactttacatctgtgttcattaagaatgtttggtgttggtggagagatagaaatattggccaatggacagaacagagagcccagaaatagacacacacaaatacactcacctaatctcttaagaaggggcaaaagcatttcaacaaatggtactggagccatcgaactccacagaccaaaaaacagtatcttaatgtaaggcttacatcttattaaaaaattaactcaagaaaggccacacagagacataaatgtaaaacaactgtaaaacttttagaataaatataggagaaaatttccagtgtctagggctaaacgaagagttccttgtcgtggtatcaaaatcatggtctctcaaagaaaaaatagttaattggatttcatcaaaatgtttactttgcaaaaaaaaaaacacctctgtaaagagggtaacagatcagttactgggcagctaaaatatttgaaatctacatataggtaaaaggactaacatctaggtctattttttcaactctcaaaactcagtagtagctagttgcagtggctcatgcctgtaatcccagcactttgggaggctgaagcaggcagatcacgtgaggtcaggagttcaagaccagcctggccaacatggtgaaaccctgtctctactaaaaatacaaaaactagcaggacatggttaattaattaattgattatttaaattaatacttgggaggcagacgcagtagaatcgcttgaacccgggaggcgaaggttgcagtgagttgagatcgcgccattgtactccagcctggccgacagagagagattctgtctcaaaaaacagaactcaacggtaacaaaaacaaagagagaataggcaaaagatatgaagaaatttcacagaaaatgaaaaacatatggcaaaaaaacacatgaaaagatactcaaaattatttgccatttggataattaatattaaaaccgtaatgagatatcactgcatatctttcataaaaactaaaatcaaagacagtaaaaacactaaatcctggtgaggctgcaaaggaactggatcactcacacaatgctgatggaaagataaaacggtagatacattctggaaaatagttttgcagtttctttaaaaaaagtaaacttgcattaaaacccaaaaattgacctcctagccttttatttcagagaaatacagacttatgttgacacaaaaacgagtaaacaaatgtttataataggttgattcataatatccacaaactaaaaactatccagacagacatcctttaccagatggagggttaaacacactgcggtacctctatacgatggaatactattcagtgatcaaagggaaagaattattgatatgtgcaacaacctggataattctccagaaaatgatgcctgctgacagaaatcaataccaaaaagctacacgattccactgaagtcacattattgaaacgacaaaattaccaaatggaaaagatattagtgatttccaggaattaaggaggggatgaggtgaaggaagtgggtatggctataaaagggtaaaatgagtgggttcaactgtattccccgcccacactaataaagcatatgaatatatgctaatgcctgaagcctatgaatatgaccctatgtggaaaaaggggttttgcagatgtcattaaagatctcaagatgacattatcctggattatctgggtggaccctaaatccagtataagtgcccatgtaataagccgaagagatgagagaaggccatgtgaagacagaggcagagattgaagttttacaaccacaggtccaggaacacctgaagccagcaaaataggcaaggcaatagctggactaggccaggaaggattcacttctaaaccttggaagggaatgcagcactgctgctaccttgattttaggcttctggcctccagaacggtgagagaataaatatcagttgttttaagctgtccagcttgtggtcattggttaggggttaggacagctctagaaaacgaatatgggggatcctcatggtgatgaaaatgttctgtatctctggtttaacaatgtcaatgtcctgggtatcatattgtaccagagttttgaaagatgttgtcactagggaaaactaggtaaagcagggcgatgtttttgttttattttgcataactgcatgcaaatctatcattatcccaaaataaaatgttgataaaaataaataaataaaattgaattataatttgatctctgggttacacaatcagaatgagttgatggcacctgaagggcatctattttatagtacaccttcatccaaatatttacttttaatgattaacaaaccgacttagcatgtttgcattaatatcttaagtgagtctctggaattattcatcttttagcaaaatactatgaaagcctctcacacaggctaagcagagaatattaatgactaactatgatttatcgttttgtgtttgcttcaagaaactggtacataaatatgtaattcttataaaaaatttgtggcagcttataaaatatacatgtaatataaggtgaaaaacaaaataaaataggagagaaataaggataggaaaagtaaaggaaggcaaagttaaaattagaatacaaaacatcagagagtgatctacacttcacaagtttgggcttctaatttttccagagaagaaatatataattccataaagatatttaagcaagtataaattagtcaatattctcatgtcaaaaaactaaaacataaaaataagtatctcaattagagatgtcaaatttagtcagagtttagaatattctatttaaaatatatccagtacgatttcagaaataattatctcagttcaagaagggaaaacctgctaaatatttaaatgtcaaatatatcagtgatagtttctgttcatatttttagtcttttgtcctggtataactgaaaaatttgcatgacttaaaatgtcatattttatttcagccttaatattggttagttgaaaggcataattatgaccagaaaatgtactttaaaattacccaatgagaaaagctatgctagttttaactgaaaatgctttacttaaatgccaaaaattgaaatagtctactttattaagatatttaaaataaaattatgaaaacgatgtcatatcctttgcaaagttggcacccgaagttcgagttctgtctttcaaaatgtaaagtgatttttttctgtggaagtagaattgtcacctgtaatggttttcagtaaattactctgaagcatcttgtcaagaacattcataaacttaaaaataaaacaaagattttcatgtctatcaagactaaaataacaaaaagttattcccaccatttaatatcatataaagacaaaaataaatagatatataataaaaaataaaatatatatatttaaagatacatacttttttcaatagtaaggatcacatttgcatgtatatgaaatacaacataaaaatcagcataaaaatcatccactatctcatttttacataaaatgatatctaacacgaggactgcttggaaaatagcatcttaatctttgcttaacttcttaggttattttggaactctcttgatctcagattcttcttctataaaattgagacaatctttctccaggagaataggttcaggttttataaagtgatagatataaaagtaatataacagatatgattattaataatattattatttgaaatggacaagcagtaatgggaggatagaatgataaggatgtgtatcattgccaaatccttgagggaggtgctggtatttggaaaaaaaaaaaaaaacaacgaatacctaaacgtgaataaatttgaggaaactctattgaaagtcttccccacctgttcatgaaacagatgcccttttctcctctgttattgcataagtaaggtatatgtcttagtccctttcaattccagtctggccatgtgcctgagctctatctagccaatagaatgccagcagaaattatatgtatcacttccaggtcttcccttttagaaccctaacacccaccctctttcatgctcattcttcaccaactgattgcacacacccgtcaaggaacttggagctgtcagatggcagaaggttgctgccctgaatggcagaatggaaataaacgcacaccggaattacccgcaattaaccactgcaactaaatgagacatcaactttacttatgttaagccactgagattgtaagttttgaatgtagacccaatatactacgccggttaatttacaagcctagaatagtacgaagaactatcatatataataagtaatgccaatatcaaaattatggtaatgtttcttgatacaaaaacataaactggaaaaggaaacaattactactaacaaaattcactataagatgtgtctaatatgtcaagcattgaccctagactacggtcaaatgtcagttggaaggttaagttgtgtactctaagacaagcacgtgaaataattcctgtggattcctgtcagtgcagcagtttctcagctagtgttagtctaggagattctgaccagcagcacttcttgttcagctccttttccttaacgtgtaattttcagcagaataaaactgcattctctatattctagcacaaatgaacattttgtgactaacagtattcactgatagtataatgtatcggccttattgctgtcaataattattatttgtatttatattacaatattacatttcagttattttggttcaaggttttagagtcatcaacttctgtgaacatttctaagaattttccatcccttatcttcctacccccttcatcaggaacccttagtctaagtaaccccatatacttttgcctatgtaacccctctcatatcaaaaactagaacacagacatattgagatggactcagtcataaagggatataaatttgttttgtagattcatatgttaattttataataatagattacttttaattgacacaaaatattacccagctcagataatattttattttgcaatctttcaacaattagctgttaggaaagactgtttaagtgaaggatctaccataaagaatccaaaataatataccactttttgcccagtggcttttgcgtatcaggcactatgttacagattttatatgcctaactactatgtttttataaagtattattttctaaatttacagatgagatagcctcacctcactgagattacatgatttgctaaagaccacaaggatagaatcaagatttgaactcttttctttctccaaatctagagctctttttccttacttctgttctatggaattgattgttctgcttcttttctataattaacctttacaatcacttaataacaaatttgtgatatatacggtagacaccaatataagtgctgaagctacaaagataaatgggaacccctggccaggtgtggtggtgcgcgcctgtggtcccagctactcaggagattgaagcgggaagatcacttgaactcaggaatttgagatcagcctgctccaaaaagcaagtccccaactctataaaaatatatttttaaaaaattagccagacatggtggcaggcatctacggtagcagctatgtgggaggctgaggtgggaggattacttgtgcctggaagttcaaggttgcagtgagctatgattgcaccactgtgctctagcctgggtgaccacaaagccctgtcttaaaaacaaaacataaaagtaaaaatatggaaccatcagtctagttggagaaaaattcatgaaaataaatgattacattgtggtgggatatgcgagtagaggtgaaagagaagacacagaagccctgccgtgaaggcagtgaataacttgctatgggactttcaaggactgtttggaggtgaaggcagtaccagagcaggaattagaggtacattggaaacttagtaggccaacagaggagatgagggtgtgaggtgtggaagagaagatacctgagtggggtctactcatggcaaacctatatacaatgctaagaaatttgagctgttgtcctgtgcatgagaggaaacaatgacaaattttactgaaaataataattttaagagatttttgatgtaagaaattactatcagcaacagcaaatatgggtcagggatggagaaactaactgggttgtgatggcagattagagatcatgtttccatttatccaatctatcaatccatttatccttccactttattagaaaaagcctggtctagctactcaggaggatgaggcaggagaatcgcttgaaccaatggaggttgcagtgagccgagatcacaccactgcactccagcctgggcaacagagcaagactccttctcaaaaaaaagaaaaaagaaaagaaagaaaagaaaagaaaagaaaagaaaagaaagaaaagaaaagaaaagaaaaagactggtctaacaaataatagttgggacattgggaatatgataggtttttgacatatttaggaactgaaattcaggcattttagagatttatgggacatccaggtagagttctatgataggcaactgaatagttagatttcacaggaaagcagatcaatcaataaatgtgggacttatgtatttacatgtggttattaaaaccaaggacaaagatttcattaccttagagtatagtaaaaaagagaggattgaatagaatcacaaagagggacacagggacagagaagaaggaggaaggagactgggaaagaacatttaggaagaggacagagacctagagaggatcatgtaaggaaaccaagtaaggcatgttctcaagactataaattgctgataggaacagaagccacaggaagtttaagaacagtgtacattggtctcacaaaataggagaccatttgttaaaacactgtccaaggcactacttatggcagcagaagtgagattaaaggggattaagtagttggtgaaaattagacagtgaaaatataaaagtaaattactattttcataaatgtatataggcacacctcattttattgaaccttgctttacaaattttaaccttgtggttaaaacaaccacagatactacattttttacaaattaaaggttttggcaactgtgtggagcaagtttattggcagcatttttttccaacagcacgttctttctctcttttggcctctgttacattttggtaattcttgcaataactaaaacttgttcattattatcacacctgttacggtaacctgtgatcagagatcgttgatgttactgttgtaattgttttggggtgccatgaaccagaaccatgtaaaacggcaaactcacttgttaagtgttgtgtgtgttctgaatgccccactgacctgttgttctgccatctctgtccttctccttgggcatccctattctctgagacacaacaatattgaaattaggccagttaagcctacaatggcttctaagtattcaggtgaaaggaatagttacatgtctcttactttaaatccaaagctagaaatgacgaagctcagtgaggaaggcatgtcaaaagccaatatgggacaaaagctagacctcttgcaccaaaactagccaaattatgaatgcaaaggaaaagttctggaaggaaattaaaagtgctactttaatgaacgcacaaatgagaagaaagcaaaaccttattgttgacatggagaaagttttagtggcctgagtagaagatcaaaccagccacactattcccttaagccaacgtctaatctaggggaaggccctaactcacttcaattctatgaaggctgagagaggtgaggcagctgcggaagaaaagtaggagactaggagaggctggctcacgaagttaaggaaagatgccatctgcataacatagaaatgtaaggtgaagcagcaactgctgatggagaagctgcagcaagttatccagaagacctagctaaaataattggtgaaagggcctacactaaaacaacaaatttttagtgaaaaacgcagctttgtattgggagaagatctcctctggactttcatagctaagaaggagaagttgatgcctggcttcaaatctttaaagaataggttgactcttctattaggggctaatgcagctggtgaccttaagttgaagccaatatgaatttaccattctgaaaattttaaaacaagaattatgctaaatctacgtagcctgtggtaagtggaacaaaacctggattacagcacatctgtttatagcatgatttactgaatatttttagctttcttttgagacctagtgcacagaaaataatattcctttcaaagtagtactgctcattgacaatgcacctggccatccaaaagctctgatagagatgtacagggagattaatgttgttttcaggcctgccaatggaacatctattctgccacccatggatcaaggagtaattttgactttcaagcactatgattcaagaaatacatttcatggggatatagattccatagatagtgattcctctgattgatctgggtatagtcaattgaaaaccttctggaggctgggcatggtggctcatacctgtaatcccagcaatttgggaggctgagaagggcagatcttctgaggtcaggagtttaagactagcctggccaacatggtgaaaccctgtctctactaaaaatacaaaaactagcctggcaaggtggtgcacccctgtaatcccagctactcaggaggctgagtgaggcaaggcaggagaattgctggaacgtggaggcagaggttgcagtgagccgagatcccgccactcactccagcctggataaaagagcaagactccatcgcaaaaaaaaagagaaaaccttctggaaatgtttcattactctaaattgcattaagaacaaggaggtcaaaatatcaacattaatagtactttgaaagaagttgattccaactctcatggatgactttgaggggttcaagacttcagtggaggaagtaactgaagatggtctggaaatagcaagataactagaattagaagcagagcctgaaaacgtgactgaattgctgctacctcataataaatccttaagggatgagaggctgcttgttatggacgagcaaataaagtggtttcttgagacagcctctacttccggtgaagatgcgatgaactttgttgaaatgacaacaaagggtttagaatactctgtaaacttagttcgtaaagcagccacagggtatgagaagattgactccagttttgaaagaacttctaatttgggtacattgttatcaaacggcaacgcatgctacaaagaaatcttttctgaaaggaagagtcaattgatgaggcaaacttcattgtcttattttaagaaatcatcggccaggcatggttgctcacacctgtaatcccagcactttgggagaccgaggcgggcagattgcctgagctcaggaattcacaactagcctgggaaacccaggtgaaaccccatctctactaaaatgcaaaaaattagccgggcgtggctgcgtgctcctgtagtcccacctactcgggaagctgaggcaatagaattgcttgaacctgggaggcagagggtgcagtaagctgagattgtgccactgcactccagcctgggccacagagtgagattccatctacaaaaaagaaaaaaaaaaaaaagaaagaaaaagaaaagaaattgtcacagccaccccaggatttaaccaccatcgttgtcatcatcagcagccatcaatatggaggtaagaccttccaccagcagaaatgttataactggctgaaggctcagatgactgttagcagttttagcattaaaatatttttaattacggtattttcattggttttttagacatgatgttattatacattttatagactacagtgtagtgtaaatgtaactgggccgaaaaaattgtgactttattgggacagttgcttaattgcagtgatctcgaccctcacttgcagtatctctcaggtgtgcctgtataacgtgaatggaatttattaacagggagtgaaacgaaagagtggcaactagagagaagcatggagtaaggagagggattttctcttgatttcatttgttgacataggaatcatttatagatttgtttttcatttatttcaatgataagaaagaatgataagaggtggcagagaaagagaagttgaaaatagaataaagctaagttacttattattgaggaaaacctaaatgaaaaatagggaaataggatgaagtctattaaagagattatccatgaggagggagacctcatcttctgagacaagaataaaagatacaatggtggactcagaggtaaagtaattataagtcttggtgaatgtgtgtggtggatagggaggtatgactattctttctcaaagtaagtggtaatttaactattggggaaagggagatgcttgatattttgaggacattgataaagtctaagccaagccacctttttttttttgaataattactgaaccattccttttctttagcaagtaccattacttgaatataattgactctactaaaagtcttcatatatttataataatcattgttaaatcaaaattattttctaaaaatatctaggctaccataacataaataacatatcacaatattttcaaagacagttatcatttagcttattcatataataattatcccgttaacttttttattttctgaggtgataaatctacctattttcattaagattttatgcaagcataatttatactacatataacaagtttttttcaactcacaatgaccttttaaaattgttaataagagtatataaggggttttagaaaactccttggcttgtaggtgtgagagaaagtcacatttattattactagaagcagtgttctgttggcatattacaatgtggcagacaatccttcaacaattaattaccagtaaagtaattatagaatatcctttgatgtttataatgttttaattgaagtaaaaatgtgagaatatgcttcaggggaatataatattttaattatttatgggccaagatatctatatactttgactagagtgcatttctctattctgtggcatctctgttataatagaacatttgtagactaaaaaaatagggtgttttccccccacagcgtattacagtgaatgtagtctactttataatcctcagggttcttttaacttgacgtgaatcaaacaccttaaggaaacagaaactaagactgaaagttttgacaaattagttttgaaaccttcacaaactaaacctgtttttgatattggtttcaaaaagtatgcatagaaacttgacatgaagtagctaaatttatgcactcaattgatatttatatgtgtgcaggtctatcaacgttattgaaaagttaatccaaaggatttattgattactctcaatttctcagatactgtcagttcacttttgaaaattattctcttatgtaatattgcactcttttcagtaaaaaggagagtttgtggctgttaaatatgcatgaggcacaatagtttcacaacaaatcaaatttaattaaatgatgcatttcctccacttacaaaaggtttattaaaggtttatttgctcatgcaaattaaagtgttagagtaaaaatccacatgaaacttggcactaacaattaaaaaaatattgaaagatttctcgcctcgctgcaataccttgctatgtttaaactgctcagcttgtcatttagaatctttaatgaaaccagggaggaggctatttatttgcataataggacataatttgctgtggtgaggttttaattatttataggctgtctgaaatatttaaaatggcatcactaaggagcatgaagtgttggataatgccttcatttcaggtttcctgccgtttcttttatgggtcaagcgatttatttctaattagcataccaggctagtggctttaaaaacataaggaaaacaaattggtttcagtctgtttgcagcttgagtagttggagacggccaagggtcactgacggagactgagcagagttaagagatgaagccagaagccatcccagcacatggaaatcactgactcaacagagccatactttcatttgtgcacactgattactgtatgtagtagcttctctttggtaggtagtgggttagagttaatggatttcatgttaattgtcccttaaatattttctaccattaacacatttcttattggaaatgatgtgtaagcaacagaaaatattccatttccttggataaaagatacagtaattactgtgtgcatagggaaaaattcggcagtttcagggtgagatttaacatttaagtatatgcaatcttatttatatacaagaacaagagcctgtggttaaaacacaatagggttcttttttaataaaccatatggaaactcatatatcttgtgagaggttgtgaattagcagagtacactaaaatatgttcgaatttctaaagcattcttattgtgcattgtctgtgttctaggtaaaaggaaaaaaaaaactcaggaatcatctataaggtctcttatgttatgataaatggattttcatgttctttactatctattttaaatatgataattttcttgaaagtagtttaaaagtggtcatgttgtaaacatcattgtatagccaggagaaatgtgtttactgcaagagtttattatatttccgtgatgctctagatatccccatcatcatgcacatagattgaaagcaggggtagcacactgttgtcagacattctctcatttgtcaccttctggcctcaaaacatgaatagagaaattgctgccagatgtcaagaaacagccttagggcattacagaggatattatccatgcccttttaagtagtagacagatgctgtattcagagagaggatttttatgattatcgttcacacagcccaggtgattggtcaaggccataaaggagtctgcaatccttggagaacttttggagtcactttaaccataacgtaatgtattgcaacagttacaataaattatgttatggttcctgaatgtaaccgtcaattatcattatttttttaagtatccactggatacagatagtgg

SEQ ID NO: 9 - DNA, 22946 bp, Homo Sapiens
agagagccaccggggcccgctcgcgcgcctctgagaggctgtccgcgcgcgcgcgtgtgtgcgtgagtgtggatttgccgggactggagctggaaagttcaaactaaacgtgttgctctcgccgagtgccgaggccgcggcggaggctgcccaacttccccgggccaagtgagtggcgttgcccagcgcctttggcgaggcggcggccgctcggccctgcgcccggccgcggcggcggcggctccgctcgccccgggagggagcccgcggccagggctggactctcgccccgccacctccaccgactctctcctcagcctccgcgcctggcaccgcagcaagacttgaatgaagtgatcatgtaaactagagaaaggagattaaaaataacctctggatattcctctcatgtgatctttattctggatgaagcattaggacagctaatagccgtgtgtcacttaaaaatccaacttgagaactgtcaccaaagatgtctaggaactttgaagaaacatgaagcagtactgaaaactacaatgtaagataaaaaaagatgggagaagaagaaaaagagcaggattagactggagagaaggctgtttccaccataaagacatttacccagccagccctatgaaaacaggagcctatttcactacttggttattgactgaacagagtagccaagaggtgggcctttcagcccttagggcctgccagacagcattaaaactaagtcttctgtgaagaagctccctgtgcttgggagtatgcagctttaatgtttgaaagagtgagggagggaagaagggagataaccctcccagaaaacagaaacgcagaccgtgctttagaaaagatctttccatatgtaacaaacctgcacgttgtggacatgtaccctaaaacttaaagtataataataataataataaaagaaaagttctttctcacaatcctatcagatggaatgagtcacccacctcccttgtgagggaaggagtaaggcccccaggataatgcttgttggggcagccttggcttactcccctgagaaagcacacagctgagcagaagctgcctctttggaaccagtggtggaatagttactggttttacgaatacaatggacacagcagattttgtttgtttgtttgttttgagacagggtctagttccgtcacccaggctggagtgcagtggtaggatcttgggtcactccagcctcaatcccctgggctgaagcgatcctcccacctcagcctcccaagtagatgagattatgcctggataattttttaaatttttaaaaaattttaaaaaattttgcccaggctgctcttgatctcctgggttcaagcgatcccgtcgcctctgcctcccaaaatgcaaggcttcacagcagatgttttcagtagaaattgtcttatatttgttttgtgttgttattgaaatgaatataatgctagatatttcttggtatttcggaagtttatatcttataggatagattttatggtaactttttacatcttgaaaattatgttaaaattattttagtttaactttgttgattatctgcttgtatgaattggctttaatgacaagaaaatactttaaaaccccagggttacctccagctggcttgtcctttacccctgaaaattttggtttcctaatataggcaatgacaaaaagaatatttaaattccacactctccaaagttgcaaagtaaaaataaataaaatattcataaacgtatctgaaatgggtccaaaatcaaagattcaggtaaatattaaaatacatgtccttttttctctgttgtagatggacagagagagaaaaaaaatcactgagtagagagagaaattatattgtaaataaaacatatggcgaaagaaaacttttcaggcaaattaatttttaaaaagccacatcatacacgatattaattaaaaatgtgtatatatataatttaaataaaaatattttcctttttgttatcttcttcatcttccaaattttggcattaaaaatattaggaaggcatttctatggcttttaaaaaagctttccaagcagctctcaatttattgtttcacataatgctactcttttctctaagtctgccttgtcagctaacgtgttttgggaagaaaaaagaaaacaaaacaaaaccaagactctgttcttctcatctctttgattgagttatcctttgctaggtgaagtgttgtgagctttcatacccttccctgggcttccagcagctctccccacggagtgctgccacagcaccaccaggagccccagatccctgcaaggaggagatcaaacctccacagcagggattcctcaagacaggtcaagctccagtgcttggaaaactcagcctacatcacacaaaaatgttatcatttatttggaattctttttcaatggattgtctccacttctaaaacatttctaagtctagttcaaatccagctgcagattcctggcacttgcttccttcccattctttttcatatatcttcttttatgttgcatatacttacttcagattaagtatataagttaaactttcagtctattctgccattagaagagtttatttccatacacaataaaaaaggatcgtttgtattatcctcaagattagtgtatgttatgaatgcaatatctttgcattcaagtgaatttaaatattataggaaggggtagagaaggaaatgcaagttatcactgactgacttgccaaagttaagcaatttttaagcattttggcatgcatgattgattgtgtacttttaaatttaatattgtatggtaattattttctcacgtcattaaaaagtatttttttcaatggccagataatagtttatcatgccatgtactgtatttaacttcaaattgatagtcttgaacacatatattaatttcaattccacagatacaaaaaataattgacattaaacttctttgagaataaaaccttgtccaaatttgatatatccttaggatgtattcctagacatggtttatttcatatcttatgaactctttatttgaaggtatttggtatgagttgagaaattacattacagaaaaaaattttgagtgtgtatttcattcaatctttgcattgtttgtaagtgcctatattaagaacttttttgttaaagtttgactatgaaatctgatgagtgaaaatttaatctttttcttattttaattttaatttcttcagttaatagttaaactgaacgctttccatgtgtttattagccacttctcaatttttatatatttatttagataaaattgtgcttaccaactccagtctcaatactctctgttaaggtctacggtgtattcatctgttgaggtttttgtgcttagagtatcaatttttgtgaatgggatatttattataactaacaattctaggttttatttattaaaaattgaacaatctgctatctataaaatccgtaatatttcctttgcaattttcttccaaacaattgtaagttttacaccaaaattattccaagaacaaagcacgtgagactattttattgacaaaactttgttggctgaaagtttatcttccgtatacttcaattttttttcccataggaggtttaaagagcacacacacacacacaccacacacacacacacacacacacacacacacacacacacacacacacacacagtgtttctgaagcccaggccatttttggtaccaactatatcaagttagaatttttacatgtgtctcttctgtacgaatctataccaaaatacatggacagaaaatacagtgatacattcttttaaatgaatgctgattgcactttacagtttaagaaacaaggcttcgatgtagggatttcagagtgaacacttactatatatctttggaaactagactgctaacctgttactgaaatgtttgcatcaaattgtttatcaggttattttctctcggtatataaatataacaaacttggacaaagtggatgtattttcaaaggataataaaaactaagaatggagtgggtcaatatacaaggagaaataaggcaatagactggaatgtagagaagagagagagactggcacagagggacagtggggatgataggtattttaaaaaataatgggaaatgaaaagattttctctatcacagaaaaccaaggttctgtggagacagaccctaaactagactcctgcagagtctaatgctcgttcatcacaaggcatgctagacactgcaagacccattggcccatctttttgatcctcactctcaatcatctaaacaaggctgagagatgactctctgtacagcctctgcattgtgtaataataactctgaaatagtttctgatcttttctcttaggggttgcataaaattttgcttctagcaagagaaataaacaacccataactaaatctagaaacttagcaggcaaagctctgtagtcagaatggctactttaatttgagcaattctgaacacaatttgaacctctccacactatgaaaatagcataaaatgaaagaaataatagctaatacaccaacaagaagtacagtatatatgatgtacttacaaaaaaatatagaattatggataatatgacacattcattgagcaaagagaacatggcatacatttatcttatataaaataatgctttataatatatatttaattgaacatggattcttaatacagaaacaaaaaatattttagattgattatcattgtacaattccttagagacaaaaaatgtaagtaaaatgtctgtggattttccaatacaacctactcttcctatctaagtgataataatagcctttaagtaattttctaaggatttttattttaaaaagtttaatttaccaatgaaaaaacataaatctttgacattaaatgaaagctctaacagatgacgcagatatttctaataaaaacaactcaaaaaatggaggaactaagctcgtatatttcattagagatattggatatagcaaattagcctttattttaaaatgaggtctctcaatctaattttaaaaataaatataagcggacttttacttacagcaaggtggaggaaatatattttttttctctatatttccttctaacaaggaatgaaaaccctagacatcatataagaaaaaacaataagaagattttgaaagatagagagaaatcagaccagccagtggctttggaaccctaggaagaactcagtggtgagtttcctggatcttcctttaatctcacatatctgagccttattgctgaagaattcaacaacctggagataccaagagcacagagaaaaccacaccccgacaaaagtctgctctttctagccaaagggtgaggaacgggcctgcctagaaagacatcatacttctagacaacaacccatcaactccagcaaatgccacagaaaaaaactgtggccccgctctcactcccacaatacgtatcaattggggggcacaaagtttcttcctctcgaggccataacgatgtgctccccaaaccctgctggggtggttggtgtgagagagagccagataggaaacttgatgttcatcttctctcgctgtaagaaatccccatgccccttcccctcactcccggccatagtgtcagtttatgtgatgtgaggatcctagtgctgcatcctcaccacacaagaacaagcccccctccaccaccctgcccattatgatggagtcagcagagcccggtggagagtcccatagactggtcacatagactggccgcgtagactggccacaggggatctgggcttctcactccgccaggcagcaatgaagtggcaccctcccattctgtcagagtggagtcagatcatgccagctaaaatgcacggtttaaatacaggcttcatcacatgattggaaatgtccacttttaaattgaaaatcacttatcataccaagatccaggaagacctaaaaccaaatgcaccaggcatggtaggtaacacctgtaactctagcactttgggaggccaagacgggaggatcacttgagctcaggagttcaagaccagcctgggcaacatagcaagacctcatctgtacttaaaatttttaaaaagctagccaggtgtggcagcgcatgcctgtagttccagctgctctggaggctgaggcaggagaatcacttgagtctgggaggtcaaggctgcagtgagccatgattgtgccaccacactccagcctgggtgacagagtgagactctgtgtcaaaataaacaaacatataagctgaatgaaaaggacagtcagcaattataaatatgtgataacagatatagaattacctacaaacgttgtgaggcagccattgtaaaatgtttcaaggagcacttacaaatagaaagtgccagcaaagagatataaagaacaaaggggaaatttgaatatttaaaaattaataatcaatgcgaaagtttagtgtttggactcaacagcttaatggaggagatagagtaaaagatcaggaaactggaagatagaataagaaaagttacccggtctgagcaacagagaaaagatagctggaaaacaataacaaaaatgacagagcatcagagatctaagggactataacaaaagatattagaaaaaggccaggtgtgatggctcaagcctgtaattgcctgtaatactagcaatttgggaggcccaggagggcaaatcactaggtcaggagtttgagatcagcctggccaacatggtgagacccccgtctctactaaaaatacaaaaaaaaaaaaaaaattagctgggcatagtgttgggcacctgtaatcccagctacttgggagactgaggcaggagaattgcttgaacctgggaggcagaggttgcagtgagccaagatcacaccactgcactccaaccccgggcgacagagtgtaactcagtctcaaagaaaaaaaagatattagagaaaaaaaaatcatgcaaccagagtccctaaaggagaggaggaagggtgcaaaggtgaaaaagttacttgaaaaataatgacttaaaaaataatgatgtttggccagatacaggacactacagaatcaagaagctgagcaaaccttcaacaaaataatccaaagaaatccacatcaaacaattaacttctgaaatctaaaaacaaagaaaaatcttgaaagtagccaaagaaaaaatgacaccttagttacaggagaaattcataatcacagtaggtttctgatctggaacaatggaagccaaattaataggacacaatatttttcaagtgctggaggaaaggaaccgtcaacaccaaatcctatagccttgaaaatgtcattcagaaattaagggaagatcaagacattctcagatgatatataattaagaatatttattaccagcagacataccctaaaataatgactgaaggaagttctctaaacagaaaggaaaaaatagaaaaaggaatcttggaacatcaggaaggaagaaatcatatgattaaaacaaatatgggtaaatattataggctttccatctcctcttgactttaagagagtgggtttgatgtttgaagccagaattataacactgcctcaagtggttctatatgaatgcagatgaaatatttatgacaaatatattataaatggggaagaatagaggagcataaaagaagtaagttttccctacttcatttgaactgatgaaataaggacactactggagtgttatgagttatgtataaataatgtaattctgagaaccacaggaaaatcacccaacacattgaaactaagcaacaatcttttaagtaatctcactatcaaaggggaaggatcaaggaaaataaatagaaaataatgcatattaaaagttatgtgacacagataaagcagtgttaaaggaatttttgcactaaatgcgtaattagaaaagaaaaataatctcaaatcagctatcatagtttgcatcccaagaatctagaaaagtaattttaaaacatcagaaagaaaaaaatgataaagttatgagacagttaagagcagaaacaaatgaaattggaaacagcaaaacaatataaaaaatcaatgaacaaaaaagctagttctttgaaagatcaacaaaattgacatgaatgatgaaaaataagagaaagacatgaattaccagcatgtagaatggcactaaagatgcttcactatatcctgcaatcatcaaaaggatgatgagagattacaatgaacaactctagacacataaatttgataccttacatgaaatggaccactttctttaaaaaaaaaaagaaaagctaccacaattgactcaacataaattgctaattgggatagtcttttaagtagtaaagaaactgaattcataattagacattgtcaaaatgaaatctctgagcccagatggtttcaccggagaaattatttaaagaagaattaacatcaattctaaagaatccagattattgagggggagggaacactttttgatagactttagaaagctagtattactctggttttgattcatatcaaaaccagaataaaattgttaaaaataaaatataaggaaataaagagaaagcaacatatcaataaccctcataaatatgacagaaaatatttaagaaaatattagtaaattgaaataaaattcagcagtatatcaaaaggattatatattataaccatgtatcttctattctaaggaaacaaggcaattcagtattcaaaaatcaaatagtgtaggcccccatattaacagaattaacaaaactcttctaattttccaattagaggaaaaatcacatggtcatacaattgatgcagaaaaggcattttaaatattcagaaaccatttataataaaactctcagaaaactagaaatagagagggatatttctcaacctgataaagaacatctacaaaacctgtgggtattttcataatgatgacagagagaatgctttttctctaaggtcaggaacaaggaaaaaatgctctcaccacacttatctaacagtgattgaaattctaatcagtgcagtagggcaaataataataataacaacaaacacaaagcagaaaggaagaaacaaatgtccctgcctacagatgacttggttgttcgcatggaaaatctcaaggaatctacaaaaatattcctaaaaacagtaagtaagttcagcaagtttacagaatacaagatgtatattaaaaagttatattcctatatattcacagtgaatacatgggaaatgaaccaaagaatgtgatatcatttataatcactaaaaatgaaatgaaatatttaggtataaattgaaactacacaccactgctaaaagaaatcaaataagatccaactaacagagagtaaacttagtttcttgaattgaaagagtaaacttagtaagtagtcaattctttctaaatttatactggaggtttaatgcaattctgatcaaaatctcagcaaaatgtttcgtaggtatagaaaagattgttataaaatttatctggaaaggcataggtcctaggatagctacagtaatttttacagagaataataaagtaggtggaatctgaatacccagtatcaaaacttactttacatctgtgttcattaagaatgtttggtgttggtggagagatagaaatattggccaatggacagaacagagagcccagaaatagacacacacaaatacactcacctaatctcttaagaaggggcaaaagcatttcaacaaatggtactggagccatcgaactccacagaccaaaaaacagtatcttaatgtaaggcttacatcttattaaaaaattaactcaagaaaggccacacagagacataaatgtaaaacaactgtaaaacttttagaataaatataggagaaaatttccagtgtctagggctaaacgaagagttccttgtcgtggtatcaaaatcatggtctctcaaagaaaaaatagttaattggatttcatcaaaatgtttactttgcaaaaaaaaaaacacctctgtaaagagggtaacagatcagttactgggcagctaaaatatttgaaatctacatataggtaaaaggactaacatctaggtctattttttcaactctcaaaactcagtagtagctagttgcagtggctcatgcctgtaatcccagcactttgggaggctgaagcaggcagatcacgtgaggtcaggagttcaagaccagcctggccaacatggtgaaaccctgtctctactaaaaatacaaaaactagcaggacatggttaattaattaattgattatttaaattaatacttgggaggcagacgcagtagaatcgcttgaacccgggaggcgaaggttgcagtgagttgagatcgcgccattgtactccagcctggccgacagagagagattctgtctcaaaaaacagaactcaacggtaacaaaaacaaagagagaataggcaaaagatatgaagaaatttcacagaaaatgaaaaacatatggcaaaaaaacacatgaaaagatactcaaaattatttgccatttggataattaatattaaaaccgtaatgagatatcactgcatatctttcataaaaactaaaatcaaagacagtaaaaacactaaatcctggtgaggctgcaaaggaactggatcactcacacaatgctgatggaaagataaaacggtagatacattctggaaaatagttttgcagtttctttaaaaaaagtaaacttgcattaaaacccaaaaattgacctcctagccttttatttcagagaaatacagacttatgttgacacaaaaacgagtaaacaaatgtttataataggttgattcataatatccacaaactaaaaactatccagacagacatcctttaccagatggagggttaaacacactgcggtacctctatacgatggaatactattcagtgatcaaagggaaagaattattgatatgtgcaacaacctggataattctccagaaaatgatgcctgctgacagaaatcaataccaaaaagctacacgattccactgaagtcacattattgaaacgacaaaattaccaaatggaaaagatattagtgatttccaggaattaaggaggggatgaggtgaaggaagtgggtatggctataaaagggtaaaatgagtgggttcaactgtattccccgcccacactaataaagcatatgaatatatgctaatgcctgaagcctatgaatatgaccctatgtggaaaaaggggttttgcagatgtcattaaagatctcaagatgacattatcctggattatctgggtggaccctaaatccagtataagtgcccatgtaataagccgaagagatgagagaaggccatgtgaagacagaggcagagattgaagttttacaaccacaggtccaggaacacctgaagccagcaaaataggcaaggcaatagctggactaggccaggaaggattcacttctaaaccttggaagggaatgcagcactgctgctaccttgattttaggcttctggcctccagaacggtgagagaataaatatcagttgttttaagctgtccagcttgtggtcattggttaggggttaggacagctctagaaaacgaatatgggggatcctcatggtgatgaaaatgttctgtatctctggtttaacaatgtcaatgtcctgggtatcatattgtaccagagttttgaaagatgttgtcactagggaaaactaggtaaagcagggcgatgtttttgttttattttgcataactgcatgcaaatctatcattatcccaaaataaaatgttgataaaaataaataaataaaattgaattataatttgatctctgggttacacaatcagaatgagttgatggcacctgaagggcatctattttatagtacaccttcatccaaatatttacttttaatgattaacaaaccgacttagcatgtttgcattaatatcttaagtgagtctctggaattattcatcttttagcaaaatactatgaaagcctctcacacaggctaagcagagaatattaatgactaactatgatttatcgttttgtgtttgcttcaagaaactggtacataaatatgtaattcttataaaaaatttgtggcagcttataaaatatacatgtaatataaggtgaaaaacaaaataaaataggagagaaataaggataggaaaagtaaaggaaggcaaagttaaaattagaatacaaaacatcagagagtgatctacacttcacaagtttgggcttctaatttttccagagaagaaatatataattccataaagatatttaagcaagtataaattagtcaatattctcatgtcaaaaaactaaaacataaaaataagtatctcaattagagatgtcaaatttagtcagagtttagaatattctatttaaaatatatccagtacgatttcagaaataattatctcagttcaagaagggaaaacctgctaaatatttaaatgtcaaatatatcagtgatagtttctgttcatatttttagtcttttgtcctggtataactgaaaaatttgcatgacttaaaatgtcatattttatttcagccttaatattggttagttgaaaggcataattatgaccagaaaatgtactttaaaattacccaatgagaaaagctatgctagttttaactgaaaatgctttacttaaatgccaaaaattgaaatagtctactttattaagatatttaaaataaaattatgaaaacgatgtcatatcctttgcaaagttggcacccgaagttcgagttctgtctttcaaaatgtaaagtgatttttttctgtggaagtagaattgtcacctgtaatggttttcagtaaattactctgaagcatcttgtcaagaacattcataaacttaaaaataaaacaaagattttcatgtctatcaagactaaaataacaaaaagttattcccaccatttaatatcatataaagacaaaaataaatagatatataataaaaaataaaatatatatatttaaagatacatacttttttcaatagtaaggatcacatttgcatgtatatgaaatacaacataaaaatcagcataaaaatcatccactatctcatttttacataaaatgatatctaacacgaggactgcttggaaaatagcatcttaatctttgcttaacttcttaggttattttggaactctcttgatctcagattcttcttctataaaattgagacaatctttctccaggagaataggttcaggttttataaagtgatagatataaaagtaatataacagatatgattattaataatattattatttgaaatggacaagcagtaatgggaggatagaatgataaggatgtgtatcattgccaaatccttgagggaggtgctggtatttggaaaaaaaaaaaaaaacaacgaatacctaaacgtgaataaatttgaggaaactctattgaaagtcttccccacctgttcatgaaacagatgcccttttctcctctgttattgcataagtaaggtatatgtcttagtccctttcaattccagtctggccatgtgcctgagctctatctagccaatagaatgccagcagaaattatatgtatcacttccaggtcttcccttttagaaccctaacacccaccctctttcatgctcattcttcaccaactgattgcacacacccgtcaaggaacttggagctgtcagatggcagaaggttgctgccctgaatggcagaatggaaataaacgcacaccggaattacccgcaattaaccactgcaactaaatgagacatcaactttacttatgttaagccactgagattgtaagttttgaatgtagacccaatatactacgccggttaatttacaagcctagaatagtacgaagaactatcatatataataagtaatgccaatatcaaaattatggtaatgtttcttgatacaaaaacataaactggaaaaggaaacaattactactaacaaaattcactataagatgtgtctaatatgtcaagcattgaccctagactacggtcaaatgtcagttggaaggttaagttgtgtactctaagacaagcacgtgaaataattcctgtggattcctgtcagtgcagcagtttctcagctagtgttagtctaggagattctgaccagcagcacttcttgttcagctccttttccttaacgtgtaattttcagcagaataaaactgcattctctatattctagcacaaatgaacattttgtgactaacagtattcactgatagtataatgtatcggccttattgctgtcaataattattatttgtatttatattacaatattacatttcagttattttggttcaaggttttagagtcatcaacttctgtgaacatttctaagaattttccatcccttatcttcctacccccttcatcaggaacccttagtctaagtaaccccatatacttttgcctatgtaacccctctcatatcaaaaactagaacacagacatattgagatggactcagtcataaagggatataaatttgttttgtagattcatatgttaattttataataatagattacttttaattgacacaaaatattacccagctcagataatattttattttgcaatctttcaacaattagctgttaggaaagactgtttaagtgaaggatctaccataaagaatccaaaataatataccactttttgcccagtggcttttgcgtatcaggcactatgttacagattttatatgcctaactactatgtttttataaagtattattttctaaatttacagatgagatagcctcacctcactgagattacatgatttgctaaagaccacaaggatagaatcaagatttgaactcttttctttctccaaatctagagctctttttccttacttctgttctatggaattgattgttctgcttcttttctataattaacctttacaatcacttaataacaaatttgtgatatatacggtagacaccaatataagtgctgaagctacaaagataaatgggaacccctggccaggtgtggtggtgcgcgcctgtggtcccagctactcaggagattgaagcgggaagatcacttgaactcaggaatttgagatcagcctgctccaaaaagcaagtccccaactctataaaaatatatttttaaaaaattagccagacatggtggcaggcatctacggtagcagctatgtgggaggctgaggtgggaggattacttgtgcctggaagttcaaggttgcagtgagctatgattgcaccactgtgctctagcctgggtgaccacaaagccctgtcttaaaaacaaaacataaaagtaaaaatatggaaccatcagtctagttggagaaaaattcatgaaaataaatgattacattgtggtgggatatgcgagtagaggtgaaagagaagacacagaagccctgccgtgaaggcagtgaataacttgctatgggactttcaaggactgtttggaggtgaaggcagtaccagagcaggaattagaggtacattggaaacttagtaggccaacagaggagatgagggtgtgaggtgtggaagagaagatacctgagtggggtctactcatggcaaacctatatacaatgctaagaaatttgagctgttgtcctgtgcatgagaggaaacaatgacaaattttactgaaaataataattttaagagatttttgatgtaagaaattactatcagcaacagcaaatatgggtcagggatggagaaactaactgggttgtgatggcagattagagatcatgtttccatttatccaatctatcaatccatttatccttccactttattagaaaaagcctggtctagctactcaggaggatgaggcaggagaatcgcttgaaccaatggaggttgcagtgagccgagatcacaccactgcactccagcctgggcaacagagcaagactccttctcaaaaaaaagaaaaaagaaaagaaagaaaagaaaagaaaagaaaagaaaagaaagaaaagaaaagaaaagaaaaagactggtctaacaaataatagttgggacattgggaatatgataggtttttgacatatttaggaactgaaattcaggcattttagagatttatgggacatccaggtagagttctatgataggcaactgaatagttagatttcacaggaaagcagatcaatcaataaatgtgggacttatgtatttacatgtggttattaaaaccaaggacaaagatttcattaccttagagtatagtaaaaaagagaggattgaatagaatcacaaagagggacacagggacagagaagaaggaggaaggagactgggaaagaacatttaggaagaggacagagacctagagaggatcatgtaaggaaaccaagtaaggcatgttctcaagactataaattgctgataggaacagaagccacaggaagtttaagaacagtgtacattggtctcacaaaataggagaccatttgttaaaacactgtccaaggcactacttatggcagcagaagtgagattaaaggggattaagtagttggtgaaaattagacagtgaaaatataaaagtaaattactattttcataaatgtatataggcacacctcattttattgaaccttgctttacaaattttaaccttgtggttaaaacaaccacagatactacattttttacaaattaaaggttttggcaactgtgtggagcaagtttattggcagcatttttttccaacagcacgttctttctctcttttggcctctgttacattttggtaattcttgcaataactaaaacttgttcattattatcacacctgttacggtaacctgtgatcagagatcgttgatgttactgttgtaattgttttggggtgccatgaaccagaaccatgtaaaacggcaaactcacttgttaagtgttgtgtgtgttctgaatgccccactgacctgttgttctgccatctctgtccttctccttgggcatccctattctctgagacacaacaatattgaaattaggccagttaagcctacaatggcttctaagtattcaggtgaaaggaatagttacatgtctcttactttaaatccaaagctagaaatgacgaagctcagtgaggaaggcatgtcaaaagccaatatgggacaaaagctagacctcttgcaccaaaactagccaaattatgaatgcaaaggaaaagttctggaaggaaattaaaagtgctactttaatgaacgcacaaatgagaagaaagcaaaaccttattgttgacatggagaaagttttagtggcctgagtagaagatcaaaccagccacactattcccttaagccaacgtctaatctaggggaaggccctaactcacttcaattctatgaaggctgagagaggtgaggcagctgcggaagaaaagtaggagactaggagaggctggctcacgaagttaaggaaagatgccatctgcataacatagaaatgtaaggtgaagcagcaactgctgatggagaagctgcagcaagttatccagaagacctagctaaaataattggtgaaagggcctacactaaaacaacaaatttttagtgaaaaacgcagctttgtattgggagaagatctcctctggactttcatagctaagaaggagaagttgatgcctggcttcaaatctttaaagaataggttgactcttctattaggggctaatgcagctggtgaccttaagttgaagccaatatgaatttaccattctgaaaattttaaaacaagaattatgctaaatctacgtagcctgtggtaagtggaacaaaacctggattacagcacatctgtttatagcatgatttactgaatatttttagctttcttttgagacctagtgcacagaaaataatattcctttcaaagtagtactgctcattgacaatgcacctggccatccaaaagctctgatagagatgtacagggagattaatgttgttttcaggcctgccaatggaacatctattctgccacccatggatcaaggagtaattttgactttcaagcactatgattcaagaaatacatttcatggggatatagattccatagatagtgattcctctgattgatctgggtatagtcaattgaaaaccttctggaggctgggcatggtggctcatacctgtaatcccagcaatttgggaggctgagaagggcagatcttctgaggtcaggagtttaagactagcctggccaacatggtgaaaccctgtctctactaaaaatacaaaaactagcctggcaaggtggtgcacccctgtaatcccagctactcaggaggctgagtgaggcaaggcaggagaattgctggaacgtggaggcagaggttgcagtgagccgagatcccgccactcactccagcctggataaaagagcaagactccatcgcaaaaaaaaagagaaaaccttctggaaatgtttcattactctaaattgcattaagaacaaggaggtcaaaatatcaacattaatagtactttgaaagaagttgattccaactctcatggatgactttgaggggttcaagacttcagtggaggaagtaactgaagatggtctggaaatagcaagataactagaattagaagcagagcctgaaaacgtgactgaattgctgctacctcataataaatccttaagggatgagaggctgcttgttatggacgagcaaataaagtggtttcttgagacagcctctacttccggtgaagatgcgatgaactttgttgaaatgacaacaaagggtttagaatactctgtaaacttagttcgtaaagcagccacagggtatgagaagattgactccagttttgaaagaacttctaatttgggtacattgttatcaaacggcaacgcatgctacaaagaaatcttttctgaaaggaagagtcaattgatgaggcaaacttcattgtcttattttaagaaatcatcggccaggcatggttgctcacacctgtaatcccagcactttgggagaccgaggcgggcagattgcctgagctcaggaattcacaactagcctgggaaacccaggtgaaaccccatctctactaaaatgcaaaaaattagccgggcgtggctgcgtgctcctgtagtcccacctactcgggaagctgaggcaatagaattgcttgaacctgggaggcagagggtgcagtaagctgagattgtgccactgcactccagcctgggccacagagtgagattccatctacaaaaaagaaaaaaaaaaaaaagaaagaaaaagaaaagaaattgtcacagccaccccaggatttaaccaccatcgttgtcatcatcagcagccatcaatatggaggtaagaccttccaccagcagaaatgttataactggctgaaggctcagatgactgttagcagttttagcattaaaatatttttaattacggtattttcattggttttttagacatgatgttattatacattttatagactacagtgtagtgtaaatgtaactgggccgaaaaaattgtgactttattgggacagttgcttaattgcagtgatctcgaccctcacttgcagtatctctcaggtgtgcctgtataacgtgaatggaatttattaacagggagtgaaacgaaagagtggcaactagagagaagcatggagtaaggagagggattttctcttgatttcatttgttgacataggaatcatttatagatttgtttttcatttatttcaatgataagaaagaatgataagaggtggcagagaaagagaagttgaaaatagaataaagctaagttacttattattgaggaaaacctaaatgaaaaatagggaaataggatgaagtctattaaagagattatccatgaggagggagacctcatcttctgagacaagaataaaagatacaatggtggactcagaggtaaagtaattataagtcttggtgaatgtgtgtggtggatagggaggtatgactattctttctcaaagtaagtggtaatttaactattggggaaagggagatgcttgatattttgaggacattgataaagtctaagccaagccacctttttttttttgaataattactgaaccattccttttctttagcaagtaccattacttgaatataattgactctactaaaagtcttcatatatttataataatcattgttaaatcaaaattattttctaaaaatatctaggctaccataacataaataacatatcacaatattttcaaagacagttatcatttagcttattcatataataattatcccgttaacttttttattttctgaggtgataaatctacctattttcattaagattttatgcaagcataatttatactacatataacaagtttttttcaactcacaatgaccttttaaaattgttaataagagtatataaggggttttagaaaactccttggcttgtaggtgtgagagaaagtcacatttattattactagaagcagtgttctgttggcatattacaatgtggcagacaatccttcaacaattaattaccagtaaagtaattatagaatatcctttgatgtttataatgttttaattgaagtaaaaatgtgagaatatgcttcaggggaatataatattttaattatttatgggccaagatatctatatactttgactagagtgcatttctctattctgtggcatctctgttataatagaacatttgtagactaaaaaaatagggtgttttccccccacagcgtattacagtgaatgtagtctactttataatcctcagggttcttttaacttgacgtgaatcaaacaccttaaggaaacagaaactaagactgaaagttttgacaaattagttttgaaaccttcacaaactaaacctgtttttgatattggtttcaaaaagtatgcatagaaacttgacatgaagtagctaaatttatgcactcaattgatatttatatgtgtgcaggtctatcaacgttattgaaaagttaatccaaaggatttattgattactctcaatttctcagatactgtcagttcacttttgaaaattattctcttatgtaatattgcactcttttcagtaaaaaggagagtttgtggctgttaaatatgcatgaggcacaatagtttcacaacaaatcaaatttaattaaatgatgcatttcctccacttacaaaaggtttattaaaggtttatttgctcatgcaaattaaagtgttagagtaaaaatccacatgaaacttggcactaacaattaaaaaaatattgaaagatttctcgcctcgctgcaataccttgctatgtttaaactgctcagcttgtcatttagaatctttaatgaaaccagggaggaggctatttatttgcataataggacataatttgctgtggtgaggttttaattatttataggctgtctgaaatatttaaaatggcatcactaaggagcatgaagtgttggataatgccttcatttcaggtttcctgccgtttcttttatgggtcaagcgatttatttctaattagcataccaggctagtggctttaaaaacataaggaaaacaaattggtttcagtctgtttgcagcttgagtagttggagacggccaagggtcactgacggagactgagcagagttaagagatgaagccagaagccatcccagcacatggaaatcactgactcaacagagccatactttcatttgtgcacactgattactgtatgtagtagcttctctttggtaggtagtgggttagagttaatggatttcatgttaattgtcccttaaatattttctaccattaacacatttcttattggaaatgatgtgtaagcaacagaaaatattccatttccttggataaaagatacagtaattactgtgtgcatagggaaaaattcggcagtttcagggtgagatttaacatttaagtatatgcaatcttatttatatacaagaacaagagcctgtggttaaaacacaatagggttcttttttaataaaccatatggaaactcatatatcttgtgagaggttgtgaattagcagagtacactaaaatatgttcgaatttctaaagcattcttattgtgcattgtctgtgttctaggtaaaaggaaaaaaaaaactcaggaatcatctataaggtctcttatgttatgataaatggattttcatgttctttactatctattttaaatatgataattttcttgaaagtagtttaaaagtggtcatgttgtaaacatcattgtatagccaggagaaatgtgtttactgcaagagtttattatatttccgtgatgctctagatatccccatcatcatgcacatagattgaaagcaggggtagcacactgttgtcagacattctctcatttgtcaccttctggcctcaaaacatgaatagagaaattgctgccagatgtcaagaaacagccttagggcattacagaggatattatccatgcccttttaagtagtagacagatgctgtattcagagagaggatttttatgattatcgttcacacagcccaggtgattggtcaaggccataaaggagtctgcaatccttggagaacttttggagtcactttaaccataacgtaatgtattgcaacagttacaataaattatgttatggttcctgaatgtaaccgtcaattatcattatttttttaagtatccactggatacagatagtgg

SEQ ID NO: 10 - DNA, 1179 bp, Homo Sapiens
tctagttggataaatataaatatttggaaaatggtaccctggaaaatgataccattgaaaagggccataaaagaggaacgttctcattcttgatatagcacagaagttgggcatcattaaaggtgatgaactcaacttaaattcatcaaagaaacctgggtgtattgtaagtttttctcatttttcaggttaatgtgactttatcagaaataagcaagattttaaatccctcgttcctatagatcgcaagtttttaggactcccataaaacaccatgatttttttcttcattggaggttgttttacttgtattagaaatgatgtagctcataaaagggagccagttcaattcaaaacacatttatgggggcccacaagggaccccaactaggcagtgctttcctagagaagaaaaagcctacagggtttggattcagactgactgaatagcatttttccacttattaactgttaaccttgagcaaattgtgcttatctctgagttctcttgcagaaaacacactacctcactaggttactaggaagatttcaggagatggtgcttgtaaaaggccaagcctggggctccaggaatcttctgtccttgctttagttgctgggggatgtaggtgatacagacatgggtaggatttagtccctgaatgctgtcagggattgatagtctgggactttgcggtataggatactcacttggaagatacaaggtgtttgtttgtttggcatttgttttttgtgttttattttatttatttattttttgagactggattgctctgttgtccaggctggagtgctgaggtgcagtggtgcaatcatagctcacggcagcctcaaactcctgagcccaagtgagagatgagtcagagccaagcccttctgctaacagagctatttgttgctgaggaagttctcagtttctcctctgaatggtgccaatatcctccagttgcttaaggcagagtgagagaagctgactgtggatacccacatgaagattaatcccacctggaggaatggggcaaggagctgctctctagaccagtcaagcttgcatttgaattgggcttgtaatgagttccccagaaggaaaacacacgcacatataccccaacagaaaaagcatcctggggctgtggactcatccattgtctttgataa

SEQ ID NO: 11 - DNA, 1882 bp, Homo Sapiens
gctcttatattttcaaggctattgtctagggaaaggcagggtggaatagaggaaaaatcctaagaccagggctcaggtctcttgggtcctcatcccagctctgtggtctaattttgccaaacttcttgacttccctgggctttaatttcctcatctgtacaaagagaagactggctgagaacagaggcaaaatggttgtcacgctttggcaatcaaacagccgtacatgtttcaggtgttaaggaagatagatgctctaacacaaaattctgtcttctcttactctcttgaaaaacaaacaagacaaaacattcgcagagctggagacaggaagaatgagcttggaagatcaggaccacgtgctggtttcactacctctggtcaccccagctcattcttctgctgaaaagaggcaggagaacagtgagaacagggtggtggtccccaagggaagaatgatcaatggagacagtttcatgatgccattcatgaaattcatcagaatttcatgatgccccttggggtgactatcagggttttaagttattcttgagagtttctcgaacgcttttctgtctttgttttctaaaagactttgatgatggcagtgggagctcagattcatgttggagttaccattctggtttgccaaggtagtggaggaatgtggaaagacgtcgctgcactttagtcctgtacttctgacctgtactcaaaggcctttcccttcctaccctggggcatctccccacacaggagcttcatgccagcttcccctctgctggggttgccaactcatgactccctgggggaggcctccgcactagcctgccagcaccttcttctttccttgaaggcttgtgactcatagctgctgtgtaacgtgtggcacccccagacaggaacacatcttgcaaattgcatcgggggctgcttctctggtcttccttctggataccagatttggaggtgccaaatggaattgaattctttataggttagagagcatttaactatacctggcagggctctttaactcagactttagagtttttttttcatatctatacacacacacagatatatttcataataggcaacatgactaatatttgcagtattgttttgattctatcagtgcaactggttcactcattcctgagtgtctaaacatcattaagattctaaaggtttgctctgaagaacatactcagaataagttctggtatttttctctggacatgttgttttccaactacttagagaaaacaacaaagtgggataagactggataggcaaataggtttgattttatttgccagtgccagttgatgtatcatggcttcctcgtggctgtgttgaaagggatcgtgagacactgacttggcaggaagaggtgccttggcaggaagaagtgcctagtggatgagcaatgcctgctctgggcaaggaggggaccaaatagcatgtgtgccacttttagaccctccctggacaatatctttccagccactgcctgcctcatcctcctccttgaaaccagagggcaaggcatgatgttccaccgataggattattgtctatgatggaggaaaatcctatgaaactatgattatttcagtgataaaccaaactagagagtaagttattacataattctggggacttgctgccacatcaacatatcggtggattctgttgaaaatgaagtcattgtagcttgaaaatgaagtcattgtagtggagactaaaatgatttagttgggacttcctgacaatgacaagaaggggagtagagaaggaagtggagatgccatacaatttgctacacggttataactgcacacgcagcaagttacagatgactcttacaggatcctaa

SEQ ID NO: 12 - DNA, 3338 bp, Homo Sapiens
cattcctgaatttttacacggtgctgaataggtactgaaagtaaaaattttagtaactaaatctgccaggtgcaatcacatgtgcttgtagttccaggtattctggattcaaaggcgggaggatcacttggtcccaggagtttgagcctgcagtgcactgtgattgcatctgtgaccagccactgcactccaacctgggcacatagttgagaccttatctctttaaaaaaaagcagggaaggggatgattaaatcttctttgataaattgattttgagaatatttcattgaaaaactagataatttgtggagatacattgtcagttgtatacagactaattaactacattggtgattcactccatggaccattttcttcagatatgtttggaattattatctattcctacacttattgcactaatgactcaccttagaaggaaaagaaaaattttaatttacttaaaaaaaattttttttgattgaatagataattgtgtatatttgtggttaattattattttacactccagacctatttctacacctgtagggaagaaacttaatcactgatatcgtcagcctgtcagataccactgatatcttcagtctagttttaagaaaaactaggactaagaagaagtatataatcaagttcaagctaatcatggccatttttaaattacttggtcttttttaatactttttcccagagcaaccttctaaatggaagggcaaagcctcaactatctaaaatgcagcttttaaggactcttagatgtatgatatgccttatgtacaggagattccatctataccttgacacccacaccactcccacccctgttctctcttccaagaaggtttttggcagcaaatagttctctttaattattatatttaaatatttgtatatatttaattcacattagggataacaactaagaattatttaattggcaggtttattaggtagttgttgattgatgacatgtataacaatccaaatggtatgataggtgaagccaatgcagtggcacatgcctgtaatcccagcactttgggattgcttgagcccaagagttcgaggttgcagtgagccatgattgcagttaaatgttccaaaaatgattttcagagcattactggacattttaattaaaaagaattagtatgaggaggtagagacaatggcaactatctactgctactccctgcccccagcaaaaaaagtgccattcagggagtaagaaacagcaaaagtagaatttaagttttcctgaatggatttaacctgttagcatttaaaaatagtattttgtggtcagtcatcttaagcttgtctctattttatctatatttacatagtttttattagaaataacacccattaaaatttaacagaaactttgtatgctgcctagaacgctaactagtttattggaagtcaaataaaaatataatttttttaaggtttcaataagattcttaaatgtataatgtaatgtattactgctcattcttaaacagaattgcctactgctaacagttttgaaaagattgtccatctttttcatctcttccctttgatagttgaagatcagaagaccaaacataaaattcactgccagaacttgtccagaggcaaacagtaaaagcataggaaaaatattaaagtgagccaataggatttcagaggcctagataacaaacttaagggcggctaacaggtttatacttgcacctacatttttatatctggcttaattgcataagtaaatgagcatcaacattgaaatatatttttctttttcaaaatgggagcttatatagtgacttattaacatctaaaagtgtaaaaccaaatttcaaagaggtaaattgagagatatgtttgattaattcctctggtgaaacaaaatagcttttcatagatctttactaaactttttaaacagctttaaggtatatttgacacaataaactatacatattcaaagtgtacaatttggtgtttgacaaatatatttattgtgaaatcgtaacaagatataatctacatattcatccctcccaaaagatgctcctttgtaatcctttcctccccaaacaccaaccacccaccaactccagacaagcactggtcaccatagattagtttatagttttttaatgattttatataaatggaatcatataatatgtacttttcattttacttctactcagcataattatttggagatgtatctatgttattgcagatatcagtacattcctgtaaattgcttagtagtagtattttgtatggatctgacactgtccattcacttgttgatggacttgtgcaagattttagctagagtcaactatcaactctccacagcttatcactgaaataacaagcttcgtgtgaccatattaaaaattatcagttttacatttgaaaggcccagtgccaacctggaaaaaattgcttgcattgatgagtaataaattctacattttgcatattctcacaactgcatgaattcatttcacaatgttggcaaataatctgaattcttggtggcacgggtcctccgtatgctgagcgccggtcccctgggcccacttttctttctctatactttgtgtctctttcttttctcagtctctcgtcccacccgactggaaacacccacaggtgtggaggggcaggccaccccttcatctggtgcccaacgtgggtgcttttctctaggttgaaggtatgctcgagcatgatcattgaggacaagtcgacgagattcccgagtacgtctacagtcagccttgtgacatttgaagttctacaatgaacccgtcggagatgcaaagaaaagcacctccacggagacagagacaccgcagtcgagcaccatcggctcacaagatgaacagttgattattctctatcccttggcaatctcattcactttcatgatttaaataattgcttccatatgaacaactgtatcttcagcctcacatgtccagtaagctacttactgcacagctcaacgtgaatatcctgccagttcttcacattccatactaaagttgttgttttctttcctaaatcttttcctcctttttctttctttttttccccctgttattaagattttattatccagccaagtggactaaaaaatatctattggttattttgccaaaccaagatttctcctacattcatcctcttttttagggttgagttaatatgtataaagtgcttaaaacaatgcctggctgaagtgtttgttttccgttaggagagagggagagacaggaagaaagtagcaaagaatctgaga

SEQ ID NO: 13 - DNA, 5808 bp, Homo Sapiens
acagattctctctgagccaaatgggttaagggagaagtgatggaggcgattcgaagctgtctttcctaccctcttcagtacctcttccagtgatgtgaagttaaaaccagagatggagtctccctgtgttgcccagtctggtcttgagagcttcagttttaaataataaattgttctcgtctttctaaatttcaatcaaaacacaggatgtattttaaaagggaaaaactgtgaggtaaaagaatagggtgaggggaggaaagaaataacttcatagagaaaaattcaatgaacccttggaagaaaatatatggaagtatggttactgacttgggaaagaagagaaaggtacaatgtaactgcacatagaagccagtcctgaaaagaagcaagccggctgaagttatctgcaactcagaagcacttggtaccacccaaggggagataagaggagatctcatcagaggtgcctgaaaagcacctcagccgaaggcctcacatagagagacctaagaatgaaggcacctggactaggaatgtgaatatgtgaaagaacatgaccggccaggggccctgagttattgaatgcaacccccttcagacactgcaacacacaggctgtgcaccaagcctagtatgggaaggacagcttttcttcatgaggcctgccaggtaaagccagctatgaaacaggaagttgaccttcaccagacactgaacctactggcaccttgatcttggacttcccagccttacaaactgtaagaaataaatgtctgttgttcataagccacatagtttgtgatagtttgttatggccacctgaacagacttaggcagggtgcctcattataacctggcaagggtgtaaatttaggtggttcccttcttggacttttctggtggaagtggaggtagggccacagcttttgggtgtgtgtgtgtgtgtgtgtgtgtgtgtgtgtgtgtgtggaagcagaaaatgtggtgtttggtggaagcagaaaatgtattgtctagatgttttctctcttattataatagattacccctttcatggtcttttggctagacagagtaacctttttgggggtctttttcatcagtgcccattggtgctttcaagtcaatggcttctttagctccaaaaaggtacacaaagacaactctgggacctcaccaccatatcattccttaaattcatagtctgccttcttctctccatctttcaagatatttttatgtttatatgttatctagagttctaaattttacttagcaggaggaatagggaaaaatacaactactctatcatcctggcaacagtttaatatttaaaatatgtattttttaaaatcagataaaatacatgtttttttgaaagatttagttcaatcacaagttacttcaggaagtttttcctaatctctcagtcttaggttagggccctgataaggtttgactctgtgtccccaccccaatctcactgtactcccataatttccacatgtccccatcccaatctcatctttaattatattcccataatttccacatgttgtgggagggacccagtgggaaacaatttgaatcatgggggtggttcccccatactgttctcagggtagtgagtaagtctcacaagatctgatgcttttatcaggggtttctgcttttgcatctttctcattttctcttgccgctgccatgtaagaagtgcctttcacctcccaccatgattctgaggcctccccagccttgtggaaatgtaagtccaattgaacctctttttcttcccagtcttgggtatgtctttatcagcagcatgaaaatggactaatacagtaaaatggtaccagtggagtggggtattgctgaaaagatacccaaaaatgtggaagagactttgaaactggatgacaggcagaggttggaacagttttgagggcttagaagaagaaaggaaaacgtggggaagtttggaacttcctagagatttgttgaatggctttgaccaaaaacctgaaagtgatatggacaataaggtccaggctgaggtggtctcaaatggaaatgaggaactttttggggactggatgcaaaggtgattcttgtcacgatttagcaaagagactggcagcactttgcccctgccctagagatctgtggaactttgaacttgagagagatgatttagggtatctggcagaagaaatttctaagcagcaaagcatttcagatgtgacttgggtgctgttaaaggcattcggttttataagggaagcagagcatgaaagtttggaaaaattgcagcctgacaatgtgatagaaaagaaaacttcatttctgaggagaaattcaagctggcttcataaatttgcataagcaatgaggagccaaatgttcatccccaagacaatggggaaaatgtctccagggcatgtcagaggtcttcataacagcccctgccatcacaggcctggaggcctgagagaaaatggtttcatgggccaggcccagggtctccatgctgtgtgcagcctagggacttgttgccctgcatcccagctgctccagccatggctgaaaggggccaacatagagctcggactgtggcttcagagggtggaagccccaagccttgacagcttccacgtggtgttgagcctacaggtgcacagaagtcaagaactggggtttgggaacctccgcctagattttagaagatgtatagaaacacctggatgcccaggcagaagtttgctgcaggggtggggagttcatggagaacctctactagggcagcatggaagggaaatgtggggtcagatcccccacacagagtccctcctggggcactgcctagtggagctgtgagaagagggccactgtcctccagaccccagaatggtagatccaccgacagcttgcaccatttgcctggaaaaacggcagacactcaattccagcccaggaaagcagccaggagggaggctataccctgcaaaaccacaggggtggagctgcccaagaccatgggagcccacctcttgcatcagcatgacctggatgtgagacctggagtcaaaggagatcattttggagttttaaaatttgactgccccactggatttgggacttgcatgggccctgtaacccctttgtttaggccaatttctcccatttggaatggctgtatttacccaatacctgtactgccattgtatctgggaagtaactagcttgcttttgactttacaagctcataggtggaagagacatgctttatctcagatgagactttggactgtgggcttttgggttaatgctggaatgagttaatactttgggggactgttggaagggcatgattgtgttttgaaatgtgaggacatgagatttgggtggggccaggggcagaatgatatggtttggctctgtctccccacccaaatctcaccttgaattttaataatccccatggtcaagggcagtagcaggtggaaataattgaatcatgggaacagtttcctccatactattggcatgatagtgagtgagttctcaccagatctgatggttttgcaaggggtttccctctttgcttggttttcatttttctcctgcctactgccatgtaagacgtgcctttgctcttcctcaccttccaccatgattgtaaggcctccccagacatgtggaactacagaattggttttgtctgtgtctttgttaaagatggctcaagtgaccagtttcataggaaacagactgtgcaagtgacctcaagagtgcagatgctgtggcttatcacgggtagaaaaaatattcataagtctgaggaaatgtttaatttcctgttctccagcctccatggtaaggagtcttttacatttataggctcccttctttccagcatctgtgacataactttcaggagactaaaagcaaaatccaccatattgattgtctcctagccctgtgggcgattcccagtaactggatcagacagactcatcccaaaccttgtacctcaattctgatcgttctatccctgtctaacaaattttgtgtcagttctggtcaccatccagaactcaagaagattaagccatgatcctaggcattaccctagacttcttcatcgcccaacagaatcatcaccagattctattcagtttaattcctaaacctcacttgaatccaattctcattaaccacagtttgagccattatcagttcacagctgtcttattatcacagcctctaaattcctctgccagcctccaggtttgctgctctcaaattattctctgcagccagagtaatcatcattctaaatgatccaccctcttcttaaagtcctttagtaacttcctcctgctccccaaataaacttcaaactccttagcaagaataaagggctcgacctgacgtgaccctgataaccacactgacttggtactgctcacccttccactcacacctacctgcaatctgcactccagaaatgttgaactacttgcagttcccccaaacaagcctttctctttctcacttcttggcctatgttcatgccgagaacataacctgttgcccactcatcctttgggtccctgtttacatggcacctcctcaaggaaccctttgattgcccaaaatgagttatatgcctttcgaaatgacctcatagaaacctgtactttaccctgtgatggaaatcttgctgaggtataattgcccacttacttacctttgtctgcccttggacagtaagcaccagaaggtcaaggtgtaagtagatctcatcacctctgcatcctcacatccaatacatatcctggcatatcaaagctccaccataaatattggctgaattagcatataaacacccaggctttagaaatgaagtcatgcctccatctttctgctttcccttgcacccttcagggagagtaatcctgcctaatctccagtcctgtggatggactctgtttaaaatccttccatgtcttctccctaatcatagaataaagtccaaatcccttaatatgacctaaaaactcaattccgctgggtccctgttccattaccacttgtggtaaccagcctccaagatggcccccaatgaccccagcctcctggtcttcacatctttgtccctcccgcattgtatcaatattagtctgtgtgaccaacagcacatagtagaagtgacaacatacaactcctgcactcaggtcataaaagccatcaagtcttctgcctctctctcttgaggattgcttactctacaggaagttagctgccatgtcatgagcaaccctatggagagacccatgtggtgaggaagcaaagtctctacagcagtgaagaactgaagcctccggccaacagtcatacaccggcacctttgtggaagcagatcctccaaccccagtcaatccttcaaattactacagccccaaccaatattttggttgcaaccccatgagagaccttgagccaaaaatcaccagctaagccactccagaatagctgactccagaaatgatgagataataaatgattactgtcttaagccactgagctctagagtaatttattatccagcaataaatagcattctagccctgccatagcccactgccccttgtgaggcttttctcaattccagaactatgccaggccccctctggcctggggcccttctcacatgctgtttctttgcctttcttcaccaggacaattgcttttttttttttttagatggaattttgctttcgtcgcccaggctggagtgcaatg

SEQ ID NO: 14 - DNA, 2881 bp, Homo Sapiens
aaattttttactttatgtttctgcttaggctagcaagtgccttcatcacctctatagcaaagaggctttcagaggagttttgcttgaattctcctgcctcagcctcctgagtagctgggattacaggcatgtgccaccatgcccagctaattttgtatttttagtagagacggggtttcatcatgttagtcaggctggtctcaaattcctgacctgaggtgatccacctgcctcagcctcccaaagtgctgggattacaggcgtgagtcaccatgctcagccaatgctggaaatttttaagggaaatatagtgatatatgcaggacactgtgcaaactgctattattaagctgttgggacctaattacttaaaacactgaactattaagtatatattttgacctggggcaccatgaaaaaagtaccaagacaactaatggcaccctgaacacagaaagtttaggaatctctggcacatacaattttttgttaggcttgaaggatatacaagaactgtaaaatacaaacaatttcaagccatgcccatacatactcgtttccatttcagatggcttaactgtgataaaagctgcttatttaacccatttgttctgattaaatcagtgtgaccaaacacagtctttagaaaaaatagattattcccccacatcaggaccttcaatcatagaagataggtgactttcacttgcaaaatccgtgatgacctgatattttatcaacaaacatatacctttatgggggttctatctccttcaaagtagtcattttgggagattacacttattctggtggaagaatgactctggttaaaaataatcatgcactttgggcaggggtggtgggggcggggtgtggaaatcttcatttgaaattatcttcagagcccatgacatggcgttttacaaagagtcaatgatgctaaaactccagctctgagggaagatttaacttctagaaattgtcaaacacaactttgtgcaaaatctgataaacaaggcaggtaaatcaaagagggaaacatctgctaaggatttttgtaaaaagcaaaacaaacaacaacaaaacctaagtaagaattctcaaatgatgacacacatctcagaggagggagtggattctaaagccttttctgaaagaggagtggcaaaaataatttaatagcattatgaatataaatatgtagtctctcaagatggctactctggtgggcaatattcactcatacgtacaaacatagggtaatagtcttaaaagttatgcatattactttttttggcacacctcttaaaccaataatatcaaaaaagatggctattttaataaacattttcaaaaattataacatggacaattatatgatacaaaatcaaatacatctggggaaataagcatgatctcttttgtagagctatactgattttgtaatacattgataggtgtagacagggctgatattcagatggtctatgctggtggggcattaactattttgagggtcatccgtgaacacagatgtctttatatataagtctatatgtacagaatactccccatttatatatagtttaggtatcttgattttttcaaaagttggttgattggcacttacaacacagttttccaaaaacaaaaccatgctctaaaatttagtcttgtgaggctatcaggtcattcttttgactttaccgtgtaagatatttaataacagtgcaaaatattgcttctctggggaaaaggtgttctacacttcctatcagtatcccaggtacatgccttctctcagagtgacaaagagatttccactgatgaggacagggaaagaaataggacctgtttttgttactttctgcaatggcatgttactccctgcaaatgttcaaaagaaagtaaatttaagtcagttctctttagaaggtactagataagtgttctgaacccagcttcacatcagaatcacatgaaggtgtgtaaaaaacaaaacaaaacaaaaaaacaccaattcctaggccccaccagttaaatccaaatctctggtggctggaacattggcagcgacagtgttcacagctcccagatggttccaatgtacacgagggttgagaaccatagactaactttttctctactctactattaatatgattgtttttgcaactttggcctaggttcacagatgggagaggcatacatatgagaagttacacattctgtttagaatgtctcaaagtggaaaaacaggtaagagtaatcggacctagaccagagagacaatttgctctacatcgttcaccaaaagctaaaatggagtaaccggattttttttcctattgcttcctgttttcataggtgggtgaataaagtaaggaatacaattgtaatttttctcttgatctccaagagaagaacttccagatttaggaagatagatgggaaagtgaacagccataatcactagggtgatactccttttctggctagaataaaatgaggacagaggtagcttcagagcagaggaagctcatgtttaatcaagcagatatatcttggaactgaatatgaagaagtgttcggaagtgtcacgctcattctgggcaggagcaactcctccttgtcaagaacaaggaggaaaaaatgcaaacagagaaaaacatatgattgcacttcaaaatctaaaaggggaaggaagagaggattcagggaagcaatcctctccatattgaacttgaggccaagaaagaaaaaataaggtttttttttcttctttttaaaatcaaaaccctctgtccttcctttcctgactcgacatttccaagctgtgcttcctcatatctaagccacctcaccacagcatttgacacta

SEQ ID NO: 15 - DNA, 3424 bp, Homo Sapiens
ggagcgccggtctctaggcctcctgtgaaatgggtggagccttactgatttactctccccttcggaatcctatccactgtaaaaagaggcccgcaactcctcctctaagtgttggggcagaggttggggtaggaacccggtcatagggcaaggacgtgaggcagggtggaaaaaagtacagggtagaatgatttccagtggtttggcgaatgcatcgtgtgtaaatagctttctggaaacctgttgggagggtcagaagtgccagccccagctcgatttcatgagtcgtaattctttctatttctccctaaatgtgagggcatttgagttccgtaaaggagtcgactccaaatgtttcctgctgcaccacacacttgactaccattggtgacggtgacttagctatgacttgctgagtgtagcgtttctaaaccttactaaactctgggttttatttttcccctttttatgcttacaaaactgaaattcaaagaataaaatgccttgtctcattgccacacagctaagtccatgcgggaggccaattcaggtggtctggctccaaaaccagggctcttcccatgatttgcccgctgtgacaccaggttggcaactaggaaatgtacaagcaggacttgacaaatgtaggagcaaatatatggtaaggataagtatgaacaccatcaaaattagccagttactcatgtaatagaaataaagtgaggagatcaacaaacaaggactgacatggctggaaaagtttcacgggggatagcaaggtcaaccaaggggatttgattattaagtaggaatcttcagtctttcttgcttttcggtttagtatctcccttaatttgatgagagtgattgtctcctctgttcaagaaacctgtcattttggtaaagtggcaaaaaacttggctttacaaggtgtgtgctcttgggaaagttagttaatgtccgtgggcatcaatttccttactgtaaaataaacatatcacctactttggaatatttttgcaagatttaatggggttttgtatgtcagaaattctcagtcatggatacacagtagaatcctactgtgacccatgctcacagtagaattacttgaggtggtttctaaatgacccagtccaaacaaattcaatcataatcagctgttagaagtaaatcatctagcctggtgcctgaaacatagaggccttcaaaaatattagctccccttccccaattccaaaaccagagcatatcattcacctgtgaattatattcttttggtagttaattggtatgtcttgatcaagcagggaggcgaacagacccataagagtgcagactctcacaaaccaagtgttgatatacatgctcatatagtacatgctatgtagatacagtgtgttgatgtagtcactatagatgagtttcggtggcaaatattatgtgaaaacggaaccctggactgctagtaatgagttctaatatttgcacaggagtttacagagcagtgtaatcttgtgaattaaataatataatcaagcccattttatagacgagagaattgaggattggatggtgaatgtaatcaaggttatctaactccacaaaatgaaaatatagcatagattcactgagccttcaaaatacctaccttagagttgtatggtttagatagagaatatacagctcctaccacagtgctaataagtaagtcatcaataaatgataacttgtaaagtcacgggcccaaattcagatctcatgccctttctatattcttcagtatctttggaaatatgatggagcttttcatttaagaggaattgatctatacttctctcaccccagaagttgtaacaattagctttaactgcataacacaccagtctaaatctgagtggcttaagacaacccccattcatgattatagttcatgattctatgagttaactggcagttctgctgttctggacagggttactgtggccccttatacagacctaacatgatccccatgttccttgcctcctgataatcatgcctttatgcaatccccttgtattacagattgagtatcccttatccgaaatgtttggtaccagaaatgtttcagattttagattgttccggattttggaatgtttgcattacaatggttgtgcatcccaaatccaaaaatcccaaattcagaatgttccaatgagcacttcctttgagtgtcatgttggcactcaaaaagttttggattttggagcattttgggtttgggatttttggatttgggatactcaacccgtacttttctactgctgtatgacaaattaccacaaactcaacagctgaaaacaacacccatttatgatgtcacaattctatagataagaagtcccaattctatagatcaaaaggtttggccaggttcaatcctggtaatcacggatatataacagcttataaacatcaaggagaaagtattttgaccttcattaaattctttttaaggcaagcatacctgtttaaactgatttgtctatagccagttggtttaatttcattgaattcttcccagagcctcaagataagaacccacccaagcttggtgcgttcttatctggagcctctgggaagaacaccttgatttgaagtcaagagccaagctggcttcttatctggaggctctgggaagaatttctttcaagtgttaaagataaataaaaatagaggctccagtttagatattttaagtccaaccacccatagccaggtagccaaaacttaagtcatccttatttccctgaaacacttgctctagacataaacaaaacacaaaatgtccttgacagtgtgagtcaatgaaattaaaccaatcagctatagacaaatcagcttaacagctctactcgccttaaaaagaatgtaacgaaggtcaaaatacttcttcctcaatgtttataagctgtactgtaactgctgtgagctgggcttcttgccacttttggttagatgtcttccagtttgtaaactgttctttgtatgcatgctaaacttttaaaaatttttaaagtttgatctgattttaacacagcgcattcagattgctggcaggatctatttccttgcagttgtaggattgaggtccccatttcttagattagacctacctggataatctccctttgtaacgtgttcataggagtaatgtatcatcgtattcacaggttctacccacgttcaaaaattgacttgcagagatttccaagttgtagtatttatgaaaagcaagagaaggagtcttattcccctgtgggtagcactgaaatcgggaaagaagccattggaaatataccaagatatgcaacaatgattaccactgagttgcaagatagggcaatgtttattttctttatattttatctggattttc

SEQ ID NO: 16 - DNA, 12776 bp, Homo Sapiens
gagcaaaaccagcgacgcgtcccggacgcccggggacccctgtgggtctcggtttccttcgctgtgaccctgacatgtttccctccaccggcccgaggaaaccgtcgcttccagcctccaggtaccgtcacctctgcggggctgcgagcggaggaccgggacagagaaggagccggcggtcctggccagccgcgcggctcaaaacccgacggcgcggggactccgggcctggggcctccatggctgtggcctccttatctcccgggccggctgctccctacgctgcggggctgagggcactggggacccaggggcttctctggcactagcgaggacctaaccttgagtgaagaacgatgtcaagtgaaagtgaagaataacgggggtgggcgcgaagagaatggtcttggggcgcgcttgcgcctctacccgaggaccgaggtggggattcgacagacgccagcggtggggatccggggcgagaagccccgactttctgagtcgtgagccgcctccagtcgccccaggacgtaaccccgaggagctttcagacactggccgcgcctaatatcgctgagaaccgcgaaaaccggagttccggccgcctcccggactggcgtcccgaggccaggggacccgcttggggctcccggccgagccccgacctcggacgtttttccgggagccgcgagaggcctgggggcctgggccaggcgccgcggcgggcatcgatcgccggctcccagagagtggccccgcgcaggtggaggtgaccccgtcacctccaggagcgcccccaagccccggtacccgcagcgtgcgccctctcctcctccccgaaggttaagttcgtctttttcggttctcggttacgcatccccttggcacgcatgcccagccacaccgtgggcgaaactagagggcccgcgtcccctgggggctgccgcggggccccgagtgaggtgtcccctccgggccgggcccgagtcggaggccccctttgcagcctagaggagcgcggggctggcgctgcgcaggaaccgccaggccggggagggggccgcgcccgggcctgggccaagagcgcgcgtcccccgcccgggccctgcggccctccccaggtgtctgagcagagctgctgaagctgcagaaatgtgctggcgcctgtccaccgccgcacacaaaacccagccaaaagcggcgagaggaaaagcgaatatggcgctgctgaaaatggagactccgcatctagaaagtctttctttcctttcctcttttcgctcttacttcgtcgatcttttcccccttgccctctcacgagggcctcctgcgctttccttcgggtgttctctacccctcggcccctttcctgttcttatgaataacctcctttactcggttttccttcttcctttccactcccggttcctctttctccattttgtgtcacaggcgccttgcttcttgttccctttcagggcgcgcactcccccgcccggctcactttattttgtgtgtgggtggcggagcagggagggggtggcaaggatcgtgaggctaagtatcgagtttgtttgtttgtttttctttctttcttcttcttctttttaaaggtgttatcttaggagccaagcatctcctttggtcctgcgctccttcgcctagcgcctggtgccccccacccggctgcatccgaggcttgcgcggcccggtcccatcagccgagcgtcgcccgcccaggaggaggctcgggttctccgcagaagcgaatactttctctttttgttttaagttagaaccttgcttttgcagtgattcgttgctgtggcgtgattttaaacaggtgagaaatcggagtctcattttcccaggggggcttccaatgaggattttaagagaagcgtgcaaagaagacagcaatgtccatcttttttttttcttgttttcttttgaacagagggaacccccacgcgctgagatagttatgtttttaaggctaaacttttttaaaattagtttttcttttacacttatggctgacttttgatccttttaaagaaaggatgaagtcaaaacagattaatgcttttgaatacacaacgtccccacgtccccaaattgtggtgctgggatagttcctctaagatgcattctgattttgaagttcaaggtctctaagcgctgttaagcggaaccatgaaaaatacgttgctacattaaagataaaacagacggtgatactgactgcagaatcgtagtagaaactttttttttttttttgaggctgtgcaggatttgccttggttttattagggaacctgctaatagaagcaatttcaagtgacgggcttccctcagtaaaaagctggaagcaatgacatcttttctatctgagtgactctccttagtcgtggtaaataaataaataaataaataaatagatagatagatagataaataaataaataaataaaaattagtttacatgcagtgtttgaaaagaaaatgattttgcttcccaagtttttatgtgttttcttttttaccaactatatttcactttatttacaattgtcagtttattctcacaccttctggttagttttatcttctcaccatggtctgttagaaccccatcctcgagcaaaaaaacaaaaacaaaaaccacccccccaaaacaaacaaacaaacaaacaaaacaggtgttcatccctgtgagatgctaatgcccctggaactgtttgaaaagagcaaaattttgtaaggagattcttttcaaaaagtgttagagaagtattcttcaaaaacatcttagaatgtttccttaaaaaatttcctttcttggttttcattaattgcctttgattaaaattaggttacaaacatatcttaatttcagactgtttctttataaaagaaaggagaaagtaaataggtgttggcaaggactaaaccaatgcaactaggccctgttgagagcctaaatctgtaaactggtacccttaaaaaacatcaatcaacttgaggttcgtacaggtagttctttgactcaaacagttgatttttaaaagtcttataaaataggttaaaatgtgtttttagtccaggttcctacttctttgttatgcatttctcctcgtagataaataaatgaatctaacttgatgagtaggtagatttttctccagaagaactttctaaaaatgggcaaagttagggaagtgattaatacccttcagtttaattggaattattcagtgcttataccaagttaatcctattaagatgctatttcctgctcagggggataaattaagcacaacttagattattttaggtggacaactggtatatagtctaagcaatgggggctggaaaaaagtatctcttctccaaaaaatatagattatgtaccagtaatgttcaaagtactttgaggaagtgtattgatgggatgaatataaatcatagtgactgttgttaaggggtttacggattataaagagcaattgagcttcctttattttctcttatttagaaaacaaacattcataagaaaaaaataaaattagatcccttcttttgcccacatacaaattcagtttcagatcaattaaaaagttaaataagaaaaatagaattaaaaaaatattggaaggctgggcgcagtggctcacgcctgtaatcccagcactttgggaggccaaggcgggcagatcacgaggtcaggagattgagaccatcttggccaacatggggaaaccctatctctagtaaaaatacaaaaattagctggttgtggtggcacatgcctgtaatcccagctactcgggaggctgaggcaggagaatcgcttgaacctgggaggcagcgattgcagtgagccgagatcgcgccactgcactctagcctggcagcagagttatctctgtaactctccatctcaaaaaaaaacaaaaaaaattgaaaggaaatatagaatttgtagtatgaaaggatttcttaaacaaaacattaaaatacacaatccattaaggaaatgatcaattggatgacagtcatgctccaaataatgatatgttagtcaatacatgataatagtcccataaggttataatattgtatatttactgtaccttttctatgtgtagatgtgtctaattatacaaataccattgtgttacaattgcctacagtattcaatacagtcacatgctgtacaggtttgcagcctaggagcaataggcttgtaccatatacaaaccatctaggtttgtgtaattacactctatgatgttagcatgacaaaactgcctatggacctatttctcagaatatgtccctgtagttgagtgccatgtgactgtatataaaaatttttaaaaatactttttacatgacaaaagatatcataaaatgttacaagataaactgagaagatattttcaaggcatgtacttggtgaaggattcatattcaaaatgtataaataacttatatagaaagaatttactaatttatgtataatgaatttcataaataaaagatgtgggccaggatatatacatatgaagtgaaagtatagtactatcaataggatgaatacatatcaacttcaaaaaatgtaatttcctttgggatagaaagaaagaaggaaggagggggaataggaagagggcaacaacttcctgcccagggggcaacaactctttttttttttttttttgagacagagtcttgcttttgtcccccaggcttgagtacaatgactcgatctcggctcactgcaacctccgcctctcgggttcaaatgattctcctgcctctgcctcccaagtagccagttaaggcacctgccaccatgcccgtctaatttttgtgttttttagtagagacggagtttcaccattttggccaggctggtctcgaactcctgacctcagttgatccgcccacctcagcctcccaaagtgctgggattacaggcatgagccactgcgcccagcccacagcaattctttataaaaagatcagaggcaactatgggaagacattaacactttttgttctttgtagattgttaaaagcttgttataatttatttaaaaatctctaacatcaattcctagtctaaagaatgaacaaatgacacatttcttttccttagtcaataataatcttgtaagatggtgttcacgtgcttttctttgagggcaaagaaaacaccattccccagtgtttttcctgggcagtgtttgaatattatatgatactcacagcagagattttcctagtttggcttctgttgtaagcttgttttctgagtagatttaaatgagaagaacagaaacatatttgaaactatgactatgtataagagcatttattctcctataatgaaatcgtggaaaatgtttttaaaaagtgagcaaacaaaaacctccacaccattatagaaacacggttaaaaaactattgaataatctcaagcctagtgtgtaataattattaagtgtgtctaatttgttgtgctaagtgtcaggaattggtattgtggaaggatatgtgagatctcattttctccttttatatggcaggagtttatacagtatttacatctgtcattgatactttttatgaacagaagttttgtttacttataacttccacagggattattcatatggagcactggaaagatgtaacatttcatttgctttgataccttgtgtttattttaggtcgaaaagcatcatgaagccaagtggttattgttttgcttattcagtgtgaactgagtgagccaggtttgtataccaagtgattctcgtggtggacaataccaatatgattatgccaaatgcattgcttctgaggcatcactctttgggcacatatagaccctgctgatttctgccaaagcactcttcttaaagttccaaaacattaccccaaaacctctatagccccctattgccaacaaaattaaagcctttctcttcattggcattagaagcccctgtaacccattgcttttccatttccagcctctttccaaaattaccaaacaaactctgtatcctgcagccaccaaactgtactagttgtaatatattcactaagaacagtggtctctcatttgtctctcttttctctcttcttatatcagttagaatgtaacagacaacccagctaacacagaggctcatttttcttatgtgacaagaagtctgtagataaagagttgctagtgttttcttgggggttcagtgatatcacctctgtgattcagttgaccttcatatcatagttgcaaaatggctgccgtaagtacaaaaaccacactgactgctgggtgggaaggcaacagaaaatttgttcttggtgagtcttactcacgtcaaggaagtataatattttccaaaatgccccaccaaaggatttcctcttacatcatattagccagaactgggacatattatcaccctttatctggggtagaggcccacatttccacatcaaagggaatttgctcaatgcctaaatcaaactggaattcagttaagcaaagaagaaacagaggaatggtttttgggtaggcagtaaacactgtcagctacatctccctgaaagccatcactcccttaaaatatctttgcgtaatgtcatcagttacttctgaactttttcatccaatggacagtgtttattttctaacttacttgaactttttgtggggcttagccacaccctttttgaaatttatgtattcatcaaatacccactcatcacttactgtgtattagtcactctgctgggcaaagagaatgaaaaaatgagtcatgcatggtcctgaaccttcacaagtttatagcctagtggggcagacaggtgaataaataagtgcaaaagaatgttatagatactgtgataaaattatgtttcgtgggccgggtgtggtggctcatgcctgtaatctcagcactttgggaggctgaggcgggtggatcacctgaggtcaggagtttgagactagcctggccaacatggtgaaaccccgtctctaataaaaaataacaaaaattagctgggcgtggtggcaggcacctgtaatcccagcgactgggaggctgaggcaggagaattgcttgaacccaagaggcagagattgcagtgagctgagatcacgccattgcactgcagcctgggcaacaagagaaaactttgtctcaaaataaataaataatatgttttgtgggtttttttttttttctttgacagggttcttactctgtcacccagcctggagtgcagtggcacgattatagctcactataacctcgggctccctggctcaagcaattctcctgcctcagcctcctgagtagttggaactatgcaggctaattattttatcttttgtagaaatggggtcttgctaagttagccaggcttgtcttgaactcctgagctcaagcggccttcccacattgacttcccaaagtgctgggattacaggcatgagccaccatgccgggcttagaatgatgaatgagataaaatggggtacaaagaaaggagcagccatttctggatctcaggtgtgatgtctcttttcagggaaggacaggggtgatacagccattaataaaagcaatctcactttcctggttggttgtctctttgcctcctcccctggaataatacagacctctgtagaaaatcacaggcagggtagggatgacggagctggcctcctcccttcccttggcctgacaaatatgcatggaattcccaggaatgttcaagctttttttttttttttttccaaacttcagattagaatccaactcatgtagaatccatgtagaatccgactcaaacagaatccatcaggcatgagaattctggaatgcccttcctggtttatctacttcatctgtgttccatgaagggcacctggtctcacacctagactccgggagctccaggtccctactctcttaggtttcagggcctaaccaatcaggatggcaagaaggatgtatttggggagatccaagcctgtctgcttggctgtagtgtaggactggggggaaaagaaaggcacagtaaggatcaaaacaaggctggagcagtaggtaaagatgagttcatgccaacgtaggaggcttgaagatgtttggtaagtcataggttcccaaactttccagctcactgcatctgtagcatcttcgtaatttgttcatggtgccctcagccagaagacatacttcacaattccattcgttaagtaggtaagtctaaacaacatattagtggtcatttgtgaggtgtttgataggtggggctgtatttctctcaaacatttaaaatatcccacagcaaccttgtgagtttgttccctgtggtgtcccagggtgacctgatgggaaatttgagaaccatggtataggtcgctaaagatttttcatctggtgaattaaatatttgattttgtatttgagaaagcgccatctttctgtagattggagtaaaggcgtggtgggaggtaaggagaccataagttagtggtagtcatttaggagagaagtgatggggatataaaatgagacatactaatgagcatgctgctggatctaaaatatgttatggaggtagaatggagaggaggatttccttatcaattggtttttggagagaaagaaagagagaggttgattcctagactgtgggcttgggttaaagggtatatgatagcagacatgttgaaaaaacatatctttgggagaaagaataacattttttggcatgctgaatttgagacgtgcaaggatgagatggatatagggcattggagctcaggagcagatctgaaaaatataagttaattatgaatatatagattagggctgacaacataagagtagacgaaatggctcaggatgagtgtagaatagaaagaagcatgcccatatgtgatggtcaattttcttttaattttaatttttgtagagatggggtctcactatgttgcccaggctgatcttgagctcctggcctcaagcaatcctcctgcctcagccttccagagcactgggattacaggcatgagccaccatgattggtctggattccttataaaaaatattataatgagtacatcatgtttagagagccaagaaagggcagggtcctgcctaggagacagagccaggacaggtatcatgaagcttgtgtaaagtgatatgttttgggtggagccaagactcttcccctactgttgttctgttcaatagagaccctgggtctttctttttcgtttgtggtggcgccccctggatagagcctcagagaggcagcatcacaaagagctatgcaaggaattggttctgcaggggagacagtggagggcaaggtgtgggggactgcggggaggaggagggggtaggggagaggtggtagcacacagtgcgaggattctgtgccatgccagttcagccttatgttcaaagcagctgttctttctgggcttccaagagaggagcaccatttttatgcccacattgtaacaaacaatgagatatgtactggttaacagtatcaaatgcaatgcagtgattaaataaggagtggagaaaatctatggaatcttacaatttggagggccctggtgacttatctaaataccttttttgcaatagagcaagtcagaaccctgaggatctcagggattaacaagggagacagccatgtcaaacaaacaaaaccaatgcactgtgataaggtgtaaggcttaatataaggtgggataactttctctcacctctctcattcactaatcacttcctatcagcacctgtcactggtaggtggtttctgatgctccgaaacgcccaggtgcgctggcttccagcctagctcctctcctccctctgcgtgttcttcctgagcaatttcatccaatttaactatcacctgtagaccagtgatttctcaacctgtatttctagtttcctgacttactgagcttgagttcagcattttgaacaatggccatagtactgggcacatggaggtactcagtaaatgtctactaattcacttaaaagttgatcctaagtaaactgatgatgtaggagtaaatttggatctcaagtaaactgaagtttacacagtgagtaagcagggaaatactttccaatagatttgacataaaacttcaatttcttttttttttctttttcttttttttttagagacagggtcttgctgtgtcacccaggctagagtgcactgatgtaatcatggctctctgctgcagcctctaacccctgggctcaagggatcctcctgcctcagcttcctgagcagctgggactacaagtgcagtccatcatagccaactaatttttttttttttttgagatagggtctccctctgttgcccagactggagtgcagtggcatggtcttcggtcactgcagccttgatctcccaggctcaagtgatcctctcacctcagccccctcgagtagctgaggctacatgcacttgccaccgtatgtggctaatttttgcactttttagtagagatgggatttcaccatgttgcccaggctagtctcgaactcctggattcaagcaatctgcccacctaggccttccaaagtgcttggagtataggcatgagccaccatgcccagcctgcccagctaatttttaatttttttgtagcgatggagtcctgctatgttgcccaggctggtcttgaacttctagcctcaagtgatccgtctgccttggcctcccaaagtgctgggattacagtcatgagctactatgctgggtctaaaacctcagtaattaaccggaaaccagatgagagtttcactatgggaattgggttaggtgcagctaatcacagtgaagaatagattaaaatacatggatttgcaaatcagaatgcaggttctgctgctaactttgggaaattcagctaattctctgtgtctttgtttctatgctagtaatgctttattttaaaatgtatttatggttattaagatgtaattcacataccataaaatttatcgatttaaagtgtacaagtcagtgtatttacagactcatgtaaccatcatcactaattccagcgtgttttcatcaccctaaaaaacaccctcatgccctcattccccattccccattaccccagtttctggctactgctttctatctctatatatttactatactgtacatttcatacgagtggcatcatataatatatgtccttttgtgtctggctgctttctcttaagcataatgtttaaccataaaaaaagttagcataatgttttcaagattcatccatcttacaccatgtatcaatactttgttcctttttatggctaaataatattccattaattggatgtatcagattttgtttattcatcaattgatggacatttgcattgtttccatttttttgctattatgaattatgctgctatggacagtactgtatgtcctgcatggacattacagaaacttttctgtgtggccatatgatgactcaatgtttgacatcttgaggagctaccagttgcttttctgagtggctgcatcactctgtattcccaccagcactgtataagagttccaatttatccatgtcctggccaacactggttattgtccatcttttttattgttgccatcctcattgatatgaagggacacctcattgtgatttgatttacatttccctaatgactaatgatattgagcatttttttcatgtgtttatttgccatttgtatatcttctttagaggaatgtctacaaatccttttcccacttaaaaattgattatttttctttttattgttgcattttaagaattctttatacattctggatgttagaaccatatcagatatatgataggcaaatattttcttcaattctgtggtttgtattttcactttcttgttagtatattttgaagcataaaagtgtttaattttggtgatgtccatgtccactttattttttcttttgttggttgtgtttttgttgtcatatctaagaatccattacccaatccaagatcacaaaaattaaggtctgtattttttctaagagttttatggctttaggttttacatttgggtttttgatccattttgagttaatttttgtatatggtgtgagttagggatccaatttcattctttgcatgtgtacatgtagttgtcccagcaccatttgttgaaaagactcctcttttcctcttaaattgtcttagtgcccttgttgaaatacattggccatagatgtagggactcccaattctactccattgaacaatatgctcatgcttattctagtaccacaactataatcccagaatgaaaaggtgaattacatagaagaaatttctattctcaaattacttcataactcaaaagacttgtgggcaattcagttctgggttttctttcatctctcgttggaaaaaaaaaatctctgcatcaaccccatctaaaataactaaattgtatgcataaacctaaatttaaatactcatctgcaggtctcgtttatagaatcctacttatgttgatgatgtgggctttggcaatctctttctcactgtattctatgaaatagcttaaaaagtcaattatgaattgaagcattcaattattagaatgcataatactagtttaatttaaaagttagtcttcagtttcatgcaaaaccc

SEQ ID NO: 17 - DNA, 2376 bp, Homo Sapiens
ctccgcttccagcgtcccccagaacgcggagaggcagcctgagtcttactctcccaccacatcaattcccagcaccgtgggccccggggccactttattttttgtatttttttgagatggggtgtctctgtcgcccaggctggagtccggtggtgcgatctcggctcactgcaacctccgcctcccgggttcacaccattctcctgcctcagcctccggagtagctggggttacaggcccccagtccactttcttggagtctgctgtgtctgaccaaaaagcccatcttcgccacatctaaagctggaagttcatttgccagcgttgtttagagcaaaaagagatgggatctcgttattttgcccaggcttgtctcagcctcagtgatccattcacctcggcctcccaaagtgccgggattacagatgtgagccaccacagtcatctctctggcagctttgaaagcctatatcgcctgtttacatcttgtcagctacagcatctgaagtgttttctttcaaggagtatccaccttttgagatggagcccaccaactaatatggaagctgaaaaatgaccagctcttgtctcctcaaactccctggcagctggggagtatagatacacaatcgggttctgccagcccaacagacccactcctgcaccttgaacctgctgggctgctgacctgagaagcagggccatgcggaatccacagagcaaggtgggggtgtccaagggcacgtgcagccaaggggcacgtcattgctgcagctacatctggtttcaaaggcagtcgtttttaaagtgcctgcgactgccggcaggaatgtaaattagtacaacttttatggaaaacaatatggagatttctcaaagaactaaaaatacagctactttatgatcagcaatcccattgctgggtatctaccaggtactgggtatctacctaaaggaaaagaaatcattatattcaaaatctctgcactcatgtttttcacagcactgctcacaatagctaagatagggaacccacctaagtgtccatccacagatgaatgtcttcatatacagaaaatgtggtgtatgtacaccaagaatactactcagccataagaaagaatgaaatcatgtctttggcagcaacatggatagaactggaggccattacactaagagaaataactcagaaacagggagtccaataccgcatgttctcatttataagtggaagttaaacagcgggtacacacagagacacagtgtggaataacagacatcggggactacacacggtgagctgatagaagggggtgagggctgaacatttactactgggtaccatgttcactgttcagatgtcagggatgccaaatcccaggctccaccgctatgcagtatctgcatgtgagaaacctgcccctgtactccctgcttctataaaaaaattaataaaaacatgtttaatatgtaattttgaaaaataaaaaattttttaaaatgtgtcttacgtggggatatcagcagtgcaagccaccatgtctgtgcccagcagcagcagctgtgaagtgttcactgttgggaaaaaaacttctccactaccaacttagttccgccgactgggggcctgcaagttaactgatgatagattaacaggagaaacatgcattgcacctgcaggagtaccctgtagagagagcagctcccagaacgtctgggagtaaagagcatacattagcttaagtaaggaatccggggtatgttagggcatgaaaggatggagggttctgatgaggcttgtttatgcaatgtttttagaatggactggagcccacggtgagtgccactctgagtggagaccaggggtaggggcagggagcagctgcggtggccgaccctctaaaagctctgcactagtcagataagagaatttcagatatgatttctttctgcatcttctgaagctcatatgttgtcactttgaagtaatttctgtaccagtttgggaggttgttggtctcttcatacttaccttgcagtgggatttggaacactcttagtggcacagttttcaattctacaggctctcctattctgtaagttcctaaaatatttttacgaatatggtttactatacaaataatttatttgctttcagtagcctttatctctgaaaacaattactgcatttaaagacaaattgaaggcatgtaatgacgaaaatttagaagcacttccattataatcagaaccagaacaaggatgattactatttctgttcatatttaacattatcctaggtaatgtccttgacaagaacattttaagaggtaaaataatcacaaatgaagagacacaggcatttattatttgcac

SEQ ID NO: 18 - DNA, 5677 bp, Homo Sapiens
caagattaaaaagggtggggaaagtgatttatctcagggtagcttcctagcttctgctccagatctgagtgtgccttcaggaaagaaggaagaggccttgggagaacactgagtcttcaggaaagagtaactatttgtctgtcttttttttttcttttgttttctttctttctttctttctttctttctttctttctttttctttctttctttttctttctctttctttattcctctctccctctctctctttcttcctttctttttttttgatccagcgagacagactggattttttcttctaatttttttttttaatgaaacgtatttcccctgagtctcagcagcagagggccctggtccttgagtcacttccttgttgcagttctgaattcattattttattatagcttttgaatgactgatacatggtaggctctgatcaaccaaaaggttcccaataaggtgaagagaaagaaaaggagtttgatagttttccagattccaaaaaaattagctttcacaagttgccaggtgtcaagaatctgaacaggtaaccctctctcagcatatctcatctgtcagcaatggcttgtgaagatgcatgtgtaaacagtaggaacacagacttctgggagacagtacaaactggtgctgctgtcatttggaaccaactagaacatagctggcaaccatttctcctgtttcctttcttccactggcttcactttttttttttttttttttgagacagagtctcatacttgttgcccaggctggagtgcaatggtgtgctctcggctcaccacaacctccgcctctcttggttcaagggattcttctgcctcagcctcctgagtagctgggattacagtcatgtgccaccacacccagctaatttttgtatttttagtagagacagagtttctccgtgttggtcaggctggtctcgaactcccgacctcaagtgatctgcctgcctaggcctcccaaagtgctgggattacaggcagaggccttacatttttcactgtttcaatcctaacttcccacagacaacttcccagtaccacaaatattccccagcttcttccagtaccacatgagaaatgggcaatcttttttttttaaccacagataaaatatagtggataacaatgattagcatttgctaaggccaagccctgttcttagtgttttatgagtattatctcattgacttcctccaacaaccttcctgaaagatataattattatatcctaattttatagctgagaaatttgaggaacagagaggagagtaacttgcccaatgtcacacagctactaaagagcagagctgggatccaaaactgggtctgactgcacaacccatgcttttttaacctcacagttccgccagcgggccaagattttaacatctacgaaatgctgttaagaagtataatagttaggtttttatttcctttctcaatgttatatccccacctgagtagaaggactctgctgggtactataccaaactacctacctatttatttatttatttatgtttttttgagacagactctcactctgttgcctaggctagagtgcagtggcgcaatctctgctcactacaacctccatctcctgggttcaaacctccagagtagctgggattacaggtgcacaccaccacacctggctaattttttgcacttttagtagagacagagtttcaccatattgaccaggctggtctggaactcttggcctcaagcgatcctcccatctcaacttcccaaagtgctgggattacaggcatgagccaccgggcccaattatttaatcctgattatgtaagcagtttgaaggaaaactacagtgttctttgatttagaatagaaggcaggaaggccttccctgaaaaagtgacactgagctgagatccaaaggataaatagaaattgaggatgggggaaagcatacccagcagagggaacagtgtgtgcaaaggctctgagaaaggagcatggctcagctgaggaactgagaggccagtgttgttgttatactgagaagaagaaggaagtatctttattcaaaaaaaaatttttttctagacacggggtgtcactatgtagcccaggctagtcccaaactcctggcctcaagcaatcctcccacctagcctcccaaagtgctaggattataggtgtaagccactgtgcctggccagaagcatgttaggtactatagtgagacaggaagataatgccaggcctgggaggctgtattaagaatttaggtctttatcttaagaatgaagagaaagattttaagccttcaagtgatcagagttgcatttttgaaagatttcataaagctaggaggagaaagaattagaagggtctaggggatttgggtagcccagtctggagtttattgcaactgtgtagggaagtgatgatggtggcttgaaccttggataagacacaataagtgtgtggctcacgcctgtaatcctaacactttgggaggccgaagcgggtggatcacctgaggtcaggagttcaagaccagcctggccaacatggtgaaaccccatctctactaaaaatacaaaattagccagtcatggtggtgcgtgcctgtaatcccagcaacttaggagactgaggcaggagaatcacttgaacccaggaggtggaagttgcagtgagccaagatcgtgccattgcactccagcctaggcaaaaagagcgaaactccatctaaaaaaaaaaaagacacaataaatgtgaagttgactgagctagggttcctggccttggagacagtccagtaggggagagcaacttagaaataaaaatagtatattgtgctatgagcactactagaggtaaacccaaataactctggaagctcggagaaaagatagagggaagatggaaaatgtattagttatctattgctgcatatcaaattaccccagcatttagcagcttaaagtaaaaatgataaacatttactagatcacagtttctgtgggacaggcatgttggcatggcataggtgagtgtttctgatttaagatctcccacaagattgcagtcaagctgtcagctgccaatcccatctgagggcttgaatggggggagatccacttccaagttcactcatgtggttgttagaaggccttgatctctccctacataggcagccctctccccagggcttcctcacaacatggccactgacgttccgcaacgtgagtgaccaagaaagagagcaagagaaccaagagtatgtgagagaaagcacccatggaaagaagccacagtctttttgtaacctaatctcagaaatggtcttatcacttctgccatactctatttattagaagtgagtcaataaattcagtccacattcaagaaaagggaaatacacaaaggtgatgaatacacaaaggtgtgaatagcaggaggtggggatcattggggttcattttagtggctgcctaccacagtaggttccacagaggaggcagtacatgagtagttgtattaaagtttttcaggagcatttcaggaggaagggctttccaggcaaagcaaaggacgtgtgcaaagatacagaggcatggaagaacttcatgtgttcaggatacgctgttggccattctgtgaccaggcgagaggggcttggggagtataattgattcagctgagcaaatttgaagaggaggtaaagtatcattggttgaaagatgatacatttacttctttgaattctaccagcatacctgcatctttgtgaaaaatatatacatacgaatatattcattaaagcatcatctttatattagtttgctagggctgccataacagaggaccacaaactgggtggcttaaacaacaaatttattgtctcagaatgctggaggctagaagtctgagatcaaaatgccagcaggattggttctttctttttttatttttcacacagggtctcactctgccacccaggctggagtgcagtggcacgatctcggctccctgcaacctccgtctcctgggttcaagcgattctcctacctcagcctcccgagtagctgggactacatgcgcgccaccatgcccagctaatttttatatttttagtagagttgaggtctaaccatgttggctaggctggtctcaaattcctgaccttaaatgatccgcccaccttggcctcccaaagtgctgggattacctgtgtgagccactgcgcctggcctaagattggttctttcggagcacccaacttctgagggttgccagggaaataatttgttccaggtctctctccttgacatgtagatggtcattgtctcctgtcttcatattgtcttccctccttaaatgtctctatccaaatttctgcttctttaaggagaccagtcatattggattagggcccccactaatgatgtcattttatcttaattactttgtaaagaccctgcctctaaatgaggtcacattctgagatattaagggttagaaattaatcatatgagtttggggggagggtacacaattccacccatatgttccatgaaagggctatatatgcaaagcaacctgcagacacaaaaggaaccaagaaaccaaagaataaggaagacaaatctggtttgttggtatagagtattttattagggagcttacggacaaaagtatggtcttcggtggccacaagacaggtagttcttcacaccacaaaccccctgatccagggcttatattttgaatcatacatgctctgggagaaatgtgtagatggttatggacctcacagcctgtgatttatgcaatgacatcaggggtggttttgaaggaaagacaaaacttacagtgaataggtgtttctacataaagagtaataactagacatcttggaggtattcctggactgggggttagtcaggagtcacatggcagattagcatctaaaatacagtcactcttgtccccacaccataaaaatcatgtgatgggaaaagagtgaaaacaactaaatgctcatcaatagggaatgggtaaataggttatggtatatcataaaatggaatactatgcagctgttaaaaagatgtactgataagaatattttccattgtggaataatctccaatatattttattaagggaaaagggcaagttgccaagtaatctatggcatgccagtatttatgttaaaaaatggaatgtgttgtaatagcataggatatctctggaaatatacacaaatatacacaagaaactggtaatagtggctacatacgtaaagaggaactgggagcctgagggtcagcaataggagggagcctttttactatatactcctgttgtacaggttgactttgttaccatgggcatgtattactttcaaattaaaaaagaaagaagtaggtgcagcaaaccaccatggcaaatgtatacctgtgtaacaaacctgcacgttctgcatatgtatcccagaacttaaagtaaaataaaaaaagaagcataagggagcttggtaattttggtatgaagtatatttagtctgaacaaaactgaagtttatgtctatgtttttaaagttgatgttggctgggcgccagtggctcacgcctgtaatcacagcactttggggggccgaggcg

SEQ ID NO: 19 - DNA, 2145 bp, Homo Sapiens
acgtgaccttcgaccgatcggaagtgggggcgggacggcagcgccggggtgggctcagatcgccaggcagccgtgggtctccagggtccggtcgcgacccttcccttcccgggcgggatttggtccaggaccgtcgatggcgtcttgacaggtccccgaggcttggatgtggtcccgaggtgtccgctgtcggccgtttggaatctcagagggactgacgtggctctcccaagacggcaccccgaacagtcgtggttcatcaaaagcctggtcctgggtagcccctccctgaaatggctgttggttgggaatttgggggctgagcgctttgaaagggcattgggacagcatcacagaatgtcagtgtcccacatttgcgaggagtcccgggccccagttcttacactgcagtttgcatgaggatgggccaccgccacttccgcctggggttgtctggtgatgcccccaggagagacgcgcccactgaaaagccagcgtggtgtcctcttacacggtccttaacaaactctgggactctgggggtgcaggaaataccacaggaccgtcattactcccataccggctgagtcacaactgtattgcaggaggcttcttggaacgcctatgtaactttaatggaagtgaccaggtacagatcttctacagcaaggaaggaatcttagtgctagaattcagttgagcctttgagttggctcttcttataagtgagcaaacaagtaacaaggtttagggggcgcccatttttgtgttagcacgattgccctcgtgtttaatatttcccaagccctattatgataaggagttggacttaatgaagaaccatgttgtcaaacatcttatgcccatcttgaagttgtgaaggaggatgagcaccaagaaaaggaaataaataaaatccaatacgggccgggtgcggtagctcacgcctgtaatcttagcagtttgggaggccaaggcaggcagaactcttgagcccagaaattcaagaccagcctaggcagcatagtgagaccccgtctctacaaaaaatataattagctgggcgtggtggcaaacacctgtagtcccagctacttgggaggctggagtgggaggatcacctgagccctggaggtcaaggctgcagtgagctatgatcacgccactgcagtacagcgtgggtgacagagcaagaccctttcttggggaaaaaagtcccatataactttccttgatgaccccaccctcacccctcactgtgtcattatgccaagagagctttgggcattctaaagaagtatgaggaatacttgaccaataaccaaagtatagttatttatttgttaatgacttctttcctagactgtgagttactttagagcagagacttatttttccctgtatccctagggtgtggcacatagtaggtgcttagtaaacttattttgcattcaataatgccaagtagaataattcatagattatggcaaaataaaagaatttggcaaaattgcaagattgaagattgctttcagaaaaaatgttccaacccctgttcaaaagtacatagcttgctgtgttgttgaagtgccagcacgaggaggaccatgccaacacatccatttattgcccattctgggtgtgttgagcgttttaagtttgctatgcttgtaaaaatcaaggaatggcaatggtatcaactttcatgaacacagtcgttcagctgaaccaagtatcagtgataacttctgttttgaattttagaaatatatctctgaggttagaatgttgattcatgcatattccagctggctttccctatgagtataaatagggaaaacaaggctattggcccaaatgtaagttgtattccaaggtttggtccaaagaccagagaatccctaagtaggaagacagttttgttttcccctcttttactggttaactttgagcaggtcacttatatttgggggcacagaagatgaagatgaccctgagcttgtcatgttcactgttaattgttctactaacaccctagacttcatcatcttgttatagcacttatcacagttgcttttaaatcatcatgcagttatatgtttattgtctgccttttccactagaataaagcctctgctgacataa

SEQ ID NO: 20 - DNA, 4249 bp, Homo Sapiens
gtgtgtgtgtgtgtgtgtgtgtgtgtgtgttttacagccctttaaaatgataaaaaccattgttaactcacaggcctcataaaacataggctgttggctattattctccaacccttgatctagagaattttaaacattagaattttgttttacatttgttaagctttacgtcatcttcaaatgacaccaaaactcagaattatgatctgcatttaagccaattttaaaataaaataagcagtcaatgctgcctcatttattgaaattcagtagattttagtttatttcttagtagtcagagaattgatttatagctattcaccaaacattcttactaacgtttccttatatctaaatcagattgattctatattttgctttgtttgtaatcaatagccaatgaagaataaggagtattggaagaagcagtgagtcagctttaggtgacctggttcttgtctcaactttgtgatttggggagatacagtttactttccctgagccttaattcttgtgtaactgaagtctaacttaacttcttaatgtccttccagaactaaaattttattgttcattctaatcgttggactactcttgtgaagtttatattttgagttaatacagtttccaaattaacatacatttaaaaaaaaaagggtagtatttttccatttctctgtgtgcacttaggataaacagtgaagtatagcttataaaacaattagtttgagggctgagagtgtaagaggaactataccaaaagtcaggaaacctgagctcttaccctaactctgttaccaactttgctgtgtgaccttaatcaaaacacataacctggaccccatgctcctcaccagtaaatcaagggcctgaattttatggcttagtattcccttccaagctccgaagttgcgtgattctgtgaaaggcagtgattgattcctttgtactcatcttccttttgacctgtttcctcatgatatattggggaacaaatactaaaaagtgttttatactagctttcttgattgacatttccctataatactgatgaatttgggtgatggaaagtaatggaaattgttaaaagttctgctctcaaatctgagtctccttgccctgtgtgccaatgtttaaccatatttgctaatctaagccatattgcgaggatctcaaggatgatacttgtcaagagtttggggccttgagagcacagttttcaaaataatacttagtattttctgactatagagtacatttgtcttgtaaagtatattttaaaatacagagaagtgtgaagtacaaatatctcagtgctactatttaaaaaaacacaattagtatataaatccttccccatttttttgacagtataattttagtatgttaaacttggttacttctttctctcttcctccatcattttccctgcttcctttttcttttgtcatattcttaaaacaattttgcaaccacaggtacccacattgctggcactaccagccttgggctactaccgaggataatggagccagggccttgtagaagcacagaggaagtctagaactgagggggcctatgatacaggaagttcaggaggcagagtctcaaaggaacacctgcctttaataatgtttacagaagtggagaaaggactaaaggacttaaagacatgcaggtgtcttcatcctgattctgtctttgttattgcacaatgactataaaataatgacctaatttttttttttttctggcttggctaatggaaatcgacactagcgcttccccagtattagacttaatctaattccaaagtaacattcaagaaaagaaaaaccagtggaacaggatcagtaagctcagactctccatctccattattttagccttgaccattcttctctaatccttttaaattatcttcagtttccagttcaagttacattgcttcagttacagtttgtttgaccctgtattcagagctgcattatgattcttgtgggccctagatagttttgccatcttagaccccttcttccatacaaaattaaaagtgatattttacaattgtatctgtatgaaatgaatgtattaatattttagattaaaacattttgtttagaagttcagttttttcttatgaggctaaaaaaaattaaaacatttttgtgggcttctaaaaaactgtgggccttaggtactgtgcctaatggataagttggcattgcctgtattctgaagggcatcattggaaaaatagcagtcattattctgtccccttctcccaccaccacagtccttggagaagcctttgccactccatccaggagcactgcagtttccacggttatagatctatagacttgaacttacttccttcccaacctaacgaaaactcacaaggattacttgggaccattcatcctcaaaaaagataggaggcagtggtttgttttagtcttcagatatttttgttttggtcagtccctaatctgtagttttgaaactcgtgccacacttgaaagggaaacatcctactacctttctttcctctccatttcccacaaaccctttccttcatcatcactccctgcattcttacttctcagcatataaatacaagacccttctttctattatttgttgaaagctaggcctgtaaaatagagatggacagaccatgcatgtttccatgaagctatttaatgctgctcccagtcttctgtccataccattccttccctgcccctaggagtggggttgaggtctgtgacatgcagactgtaagcacagtcagaacctctgcagctctcaacccaacagaggagactgtggcttcaacatgccaacctgagcaggtctcctctgcattaccttcctcccatttctcttcctgggtcctgatgaggtgagctggaggaaccaatagtcaggatgccctggaattgatgttgctctgttttgtgctcacaaaacagccatgtaacacatgagcacctgagttgaagccatccagtcgcaagtcagcagacagcagttgatggaattctcagtagaaattcagtaagggtgcccaaattttattttttttttcacctatactctaccaatatatggtatttaggaaaacttcttttatccaagcacaaagaaaagcacacacatttttataatcatctgcttcatcagggtaaataaataatttaacaaatttgatcagcatctctagtttaccagtactttaatattagttttcttacaaattaatgtattttgcaatatttccagaaaatcactgtgggagaataatgtaatatactttaggatatatttcctgaccttttcttaaatggcttcatgtgctattcccccaaattctgctttctctattttcttttttatttaacctataattatactttctagtatattctgagtctatcttctaagccaccttacatttttcctggaacaagggagggaataaatagttgcctccactaaatcaggaaaaaataaaaatatcccaggggagctgtgattatgccaagagctctaaacagaagtttgagaaggtaaaaattaagttgtagtatctgagttgtttttattttcttcctttggtgtttatgaaggtattcataagaactttaatttcaggggaaaaaaatgcctgatttgctatttttgacatttcctcgtctcttaagaagtcagttaaatatgttttcatagtttatattcctgtttcatagattactgtgaaacatgtatttaaacctatgaattataaaatagtatttagattctagcgtgagttaaatagattagtcatatatcttttagatttgtggatttgacatgtaaattatgtgttgtgtataagtaagttagttactaaacatatggcatggttattgataaacttgttgctatttttttccaaatgctatcagtgtttgtggacttttaaaaattagtttgaattttggaatgttctgtgataaaatgtaatttcaactattttgtacatttaaatatgccatgttgtatatgtctgtatttaaaaatgttgtaaatacctgcattttaagaattatgaaagattttcctcaaaaatgacagaactctccatacttaattgtgacacattataagatatctgattttaagcttttggattttgttctaaaaattaagtttaaacatgctgaaaattccataaaaataaaattttgaaaataaagtg

SEQ ID NO: 21 - DNA, 7614 bp, Homo Sapiens
gaacatttggacacaggaaggggaacatcacacactgaggcctgtcctggggtgggggaaggggggagggatatcattaggagatatgcctaatgtaaatgacaagttaatggatgcagcacaccaacatggcacatgtgtacatatgtaacaaacctgcaggttgtgcacatgttccccagaacttcaagtataataaaaaaagaaaaaaaaagaaactcagtaaaatgaataaagcagagaaaataatcagtgaaattgaaatgaaacagtagaaattacctaaactgaaatggaaagagaaaataaactaaacattaaaatgaacagagccttagagaaaagtggaagctataacaaaagatctaacgtttgtattattgaagttctgaaaaaaaaaataggtaggaggggctgaagaaagagttgaatgtcataatgactgaaaaaaattccaatttggtgaaatatataaacctatagtatgaagagctgaattaaccccaatcaggaaaatctgaaagaagtggacactaagacacataataatcaaatttctaaaaactaaaaacactgaaagaaaaccttgaaaacagcaagagagaatgagaacttaaatatagaagaaaataattcaaaacacagctgatttataagccaaaacaatggaggccaataggaagtgagatatttttcaagtctgaagctaaagataaccataattctataactagcagaattatctttcaggaataaagggagagtccagacatcctcagattaagaaaaactaagtgaatttgttgtcattagaacaatcttttttttttctctttctctttttttttttttttttttttttttttttttttttgtcacccaggctggagtgcagtggcgcgatcttgaccactgcaagctctgcctctcgggttcaggccattctcctgcctcagcctcctgagtagctgggactacaggtgcccaccaccatgcccagctaattttgtgtgtgtgtgtgtgtgtgtgtgtgtgtgtgtgtgtgtgtaattttggtagagacggggtttcaccatgttagccaggatgatctcgatctcctgacctcgtgatcctcccacctcggtctcccaaagtgctgggattacaggcatgagccaccatgcccggccagaacaatcttaaataaatagctacagacagatttctaaacaaaaaggaatgaataaaagaggaacattggaaaatcaggaagaaataaaaagtggaaaaaggaaaaatacaatcaaatacatacattttattatccttttgatttttctaaataatgttaggtacttaaaaaaagtgtgatactatatgatttgactcaaatatatttagaagcagtatttgaaacaattataaatggtggaggataaaagatggtaccaggatataaaatttccaaattttactcaaattggtagaatgctagctctagtagacatgacaaattatgtatatataatgttttaccaagaacaaccataaaaaatctatataaattcactcaaaagcactatggataaataaaacagaaatttaaaatattttcgagaatctctttttgttaccaacaacaggccattttggttactgtggctttatagtatagttaaagttgggtagtgtgatgcctccatctttgttctgtttgcttaggactgctttgctatttgggcttcattttggttccatatgaattttagaatagtttttttctaatcctgtgaagaatgacattgatattttgatgggaataacattgaatctataagttgctttcacaagtatggccatttacacaatattgatttttccaatctatgagcatagaatgtttttccatttatttgtgtcatctctgatttctttcaactgtgttttgtagttctctaactggctagccatatgcagaagatagaagctggacccttactttttaccatatacaaaaattaacccaggatacattaaagatttaaatgtaaaacctcaagctataaaaattctggatgacaacctaggaaatacacttttctacattggccttggcaaataatttttggctaagtccccaaaagcaattacaaccaaaacaaaaatagacatgtgggacctaagtaaactaaagagcttctgcacagcaaaagaactatcagcagagcaaacagacaaactacagaatgggagaagggagaagacatttgcaaaccatggatccaacaaaggtctaatatccaaaatctatagggaatgtaaggaaatcgataataataataataataacccccattaaaaatggacaaaagacatgaacaggctcttttcaaaagaagatagacggccgggcacggttgctcatgcctgtaatgccagcactttgggaggccgaggtgcgtggatcacgaggtcaggagatggagaccatcctggctaacacagtgaaatcccatctctactaaatacaaaaaaattagccaggcttggtggcgggcgcttgtaatcccagctactcgggaggcggaggcaggagaattgtgtgaacccaggaggtggagcttgcagtgagccgagatcccgccactgcactccagcctgggcgacaaagcgaagcgagactccgtctcaaaaaaaaaaaaaaaaaaaacaaaaacgaaaaaagaagatatataagcagccaacaaatgtatgaacaaatgcccagcaataatcaccacagaaatgcaaatcaaaaccacaatgagatatcatctctcaccagacagaatagctgttattaaaaagtcaaaaaacaatagatcttgatgaggttccagagaaaaaagaacacttatacactgtcggtgggaatgtatattagtccagccactatggaaagcagtctgaaggtttctcattgaacataaaacagagctaccattcgacccagcagtctcattactgggtatatacccaaaggaatataggtcattaaaccaaaagacacatgcactcatatgttcaccactgctcttttcacaatagcaaagacatggaatcaacctacatgctcaccaaggatagattggatgaagaaaaattgatgcatatataccatgaaatacgacacaagccataaaaatgaataaaatcatgtcccttgcagcaacgtggatggagctggaagccataattctatacaaattaaagcaggaacagaaaatcaaataccacatgttctcaattactaatgagagctaaacattgagcacacatggacatagatgtgagaacagtagatactgtggactgccagtgagtggagtgggaaggtgggttaaaaaaccaccaatcaaatgctatgctcattaccaaggtaatggaatccatactccaaacctcagcatcgtgcaacattcccatgtaacatatctgcacatgtactccatatatctaaaataaaagttgaaatttaaaaataaaatactaataattatacttcacagaaagtatataaattaattttaaaatctcaaataacatagaagaaagcagaaaaaaagagatacaaaatagacgagaaaaaaattaaaatgatacataagctctacagtataaataatttaaatttaaatggtctaaatgcacaattaaattaaagaaattgatggtgtagatttaaaaaacaggacccgagggtatgctttttataagaaacagccttcaaatataatgaggaaagttaaaagtaaaaaaatggggaaaaacatatcatataaatattaatgaaattaatcaagagtgattacaataatattaccaggatagagtgaaacattatttaatgataaaaagtacaattcaccaagaaaagtagcacttctaattatgtatgaatcaaacaatagagctgtaaaatacatgaagcaaaaactgacaaagctgaaaagaaaaataggaaattacactattacagtggaaaactttaacatttctctctcagcaaatgatatagaaattaggcataaatctgcaatgataaaaaactcaacacatgattaaccaaaaggatctaatcaacagtagacaatgaataatacacagtattttcaactgcctatataaattatactaaattagactacatcctggaccagaaaagaaacctcagcacatttcaaagaattaaaatcatacacagtatagtctccctctacaatggaatcaaactagaattcacaaacagaagagctagttatagtggcatgtgcctgtagtcctagctaccagatcagctgagagaataaatcaatgaaattgaagagagaaagaataatagataaattaaaatgaatgaaaatatggctctttaattatcaataaaattgacaaagatctaccaaaatgagaaaacaaagagagaagacacaaatcatcaacattaagaatgaaacagaggagatcactgtggactccacagatattcaaagatcaattagaaaatactgctgataaacttacacacatgaaatttgaaaacttaggtgaaatttaccaatttcttgaaaagcaaaatgtatcctgactcatctaatatggaataggtaatttgaatggtcctgaacaggtaattaacaaaattaaatatatgtattttttctaattaaaaaagataatatccaggctcagttttcactgagggtttcttacaaatattcagagaagaattaacataatctacacaaataattttcaaaaaatagaaggcttcccaactcttattataaagttaatattacctgataccatgaccaaaaatagcaatgaaaaagaaaactacggatcaatataaatgcaaaaattcttaacaaaatattataaaatagaattcagcaatatataaaaagaattgtatacaatcttcaagtgagttttactgtagggttgccaagatggttcaatactaaaagatcaatgtaatccaccatatgaaaaggtcaaaaaagataaatctcatgattatatcatttgatgcataaaaagttttccaagattcagcactcatttattataaaactctgaaaaataacaggattagcttcctcgcaaaaatcatttatgaaagatctacagcgagttattacattaaataataaaagattgaatgtttgagagcaacacaagggtatttaccatcactgttgctattaaacatagcaatggaggttctagaaagagtaataaggcatacgatggatatcaattgttaacacatttgaaagaaacaaagctgtctctatctgcagatgggaaaaggtatgtgtaaaaacctatgaaaaaccaacagaaagaaaataaaatctggaattaataaatgagtttattaaggttacaggatgcaagaaaaatgtgaaaagtcagtcttattggtatatactaacagtgagcatctggaaacccaagtgataaacacaacatttacaattacagaaaaactgaaatgctgatgtgttaaactttataaaacctaaacagcacctctagctataagtttcaaaatgcacatgaaaaaaataaagatccacaacctacgtaaataaagagacatactatgtttgtggattgaaagactcaacattgtaaagatatctattttcccaaaattgatcttcaggttcagtgcaattttaattaaattctaggagggtttattttattttattttttagaaatagacaagcgttttataaaatgtgtatggaaaaaaaaatatactcaaatatctcaatcatgaacaagaagaataaagggaattgttctacctgattacaatacttattatatacatacagtaatctagactctgtagcattggtggaaagatagaaccataggtcaactgaatagaagaataccatgcaatggtcccatgcaagggtgacttactgttttttgacaaacccacaaaaacaattcaatggaggagaaatagtcttttctataaatagtgctgggacaattggctatttctatagatttaatgtttatgtcttcaccacactgatatatttaaacctaatccacaatgtaatagtatttggaggtggggactttggaaggtaattaggtcatgaggtctgaaccttcattcacaggattagtgcacttataaaagggtttcagagggccccctcaccttttctgccatgtgaggatacagtgagaaggccatctatgaaaatggatggaggccttcagccactaattctacaagtcttaatttttgacttctctgcctgcacaactctgagaaacaaacttctgttgtttataagatactcattctacagtattctaacagtctgagaggactaatacatatatccttaggcaaaaagaattaacatcaacctaatcttcacacattaaacaaaaattaatgcaagatggattatagaattagatgtaaaatgtaaaactataaaatatctggaaagaaaccatgggagaaactcttggggaactcatgcttgatgagcaaatttagatctgacacaaatattatgatccatgcaatctttaaaagatgataaattatgctttgtcaaaattagaaacttctgctttgtgaaagaccatgttaagaggataaaaagacaagttacaaactcaaagtatttgaaaaaccacataactattaaaggactcatatctggaatatataaagaactctcaaaactcaacagtaaaaaaaaaaaaactgtaaagaaaaacaaaaactaaaaacgagccagttataaaatcggtaaaagcatgaacatatattttaccacaggtgatatccagaaggtacatgaaaacatattcatcgttattggaccatcaggccagcataaagaaagaccatggtgagatatcactacacacctactggaacagctaaaagaaaaacaaaacaaaaaacactcatgataccagatgttggtttgaatgcggagaaactagattccttgtatgttgctgctggctttctaaaacaatactagaaaaatagttttgctgttttacttttaatgtaaacttacgcttattacattatccagcaatcacacttatggacttttttttaaggaatggacacttgtgtctttacaaactctagtacaaaattgttcatagtagcattatttacactagaaaaaaatctgaataaaatttctcataatagactaatgaataaacaaactgtgatagaaccataacatgaaaaattactcaataataaaaattaaataaacaagaaactattgatctatctaatgacttgaatggatcacaaggaaattatgctgagtgaaaaagaagaatccaccatcaaaatgtcacatattttgcagttctatttatgtttgtatttatttatttatttatttatttatgagtatactttaagttttagggtacatgtgtacaatgtgcaggttagttacatatgtatacatgtgccatgctggtgcacgctgcacccactaactcatcatctagcattaggtatatctcccaatgctatccctcccccctccctccatc

SEQ ID NO: 22 - DNA, 2768 bp, Homo Sapiens
atttttgaaatagtatgcaagtcataagcacagtttcaataaaacacgtattctggaggtgcgtggaactttgtattatttgtagttgagaaaggcaaactttgctgacaaaccagtacctatcacaaacgaacacaaaaagtagctgttactgtgcaggctgtctttaactttcatttcataaagggtacattattgttaaactctactacatggtttggggagaaatccagtggttttatttaaatgaacactctcacactgccttttgatcaactttcaaagtattttgcagatgcattttgagcatgaccatttttttccccaagtaaaaacaattgtgcgtggcctccatataactcagaaagcatgctcttactacctatgcaagcaaacaataaaacatatagacatgaaatgttaagtcttaaaaaaaaaaggcaacaattatggagctctatttttaaatttgtgattttcaaaatatggcttactcatcattgtgtagaagagcatgaatgcgatttcttgttttgctctgcatatatttctctgctgtttttctgatcattggcgagattgtaaagtattttgcaagcagaagtggaattggatatgttgaacacacatcattggtgtacatactgtatttagcctgaagactttcctaaagtgttttgttctaaaaataacctgccattttctatagattttaattttttatatcttcaagggttctattttggtcacaaggaaagaatgtggcttctaatagtgctaagaattaaaagatgcttttatagagacttagagctattttgaaaagctttggggcttcccagccactgatcacaattagactaagcccatggaatttctgggagtgttgtgcagtggattcggttctagatccatcttacatttgtttagtgtttcccaatttttgggagaaggggtgcacagcaaatttgagagacttttttgaatctcacacatgtattttcctcaagattcttttaagcctcttctgaatgacttgtctgagatagtgaagacccacattaactagaatcagctggggaactttaaaaaatacagtgcctgggtcccagtccctagcttttgatctaattcatgtaggggtgggatccaggaattaccatgtattttaaaagcttctgggtgtttctaatttgcagacagattgagaaccactatgatacgtcatccctttactgagaattatggcgagaatcactgccatttgaattactcaggagtgactgattcctcagttgtgtaggagaagcagaaaaaataagaataaaaagaattgagagatactgatatcaaactcccatttgaaatacaagggcccttctgattcaaggcccagttggggagcttggaccatgttgtgaatggcctagcactcgccagtctggtggaaattggtggtcttagttgctggagcaggctgagtgtccccgcggggtttgcatctgtccccagaaccttttccccaggcccgtgggggaatagggaagtcactctgagctagaaattgtcgaagaagaaaagaaacaaccttcctagccttggaaagcctgtccctgcttttgatagaattattgcctttttgtaggaattacagtagcaaaccccaggctgccgctgaatttcctacttttgctcattctctaggatagttcttatccagaatgtggtttcaggaattcttttttttagtttgaaaatgaatgtgaaacattttctttggtgtcttttttttaaaaaaaaaaaacccttattgctattttttcgtgtttttgttttgttttgttttttgtttgttttaccattaagtaatacacatcccagaatttggcactctgtgttaactgtggaggcaaataaaatttagttttaatctgtggtgagctgaatgcactacaacaccttcgaagtaatctgatggtttcattctgtcgagcctcatgctgcctacaaaacaccacaatttacctggtgttttcaacattttaaggaatgaagatacaagtagacatgcaagttggaaatgtttctttagaaaggccatccagaataatgatatctgttgcagtcgtccaaatgcaatatgaaatttcctaggtgctattataaacggtgtggtgtcataccaaatgcaaaagcagttacagtatttccgaagttggagttctctttgtaggcctttcaaatacgtgtttgcattccatagaggtctgctcaccaactgtgcctctcaccactggttaaaattgaatttaagcctcattgacataagtcgtttcttgattgaactcttcagtttttacactggaatttctgtagttgtcttgaaagctgcatgtcacatcactgtacacaaagtgctttggtattactcatgcaccgtggatagtgatttctgtgtcgttttcattttcagttgtacagtaatatggaaggcaggatgtctttcctagaggctggaagaaaagtgtatcgtacattttaaatttattttagaacaagtgcatgagatgtgtcactgatttctgttatttatttgtatgttttattattcaaagtgtatgcacttttaagaagcagaatttatatttttacgtttgaaacgttttatttctgaaacagcgttgattatatagtatacagttggaattaagagaaaagtggaaaatgtaacaaaatacaataaatttattacaagatgtcctcttcaa

SEQ ID NO: 23 - DNA, 9392 bp, Homo Sapiens
gtggagcgacagcgacagagccttggagagggaggctctgctcaggatttgtccccagtgccttatttagttcacttggtgaggtcatgttttcctggatggtgttgatgctagtagatgttcttcagtgtctggacattaaaatcttgggcatgcagcaccatatgagaagtttaaaaaataaaatttaaagagagaaaagactcagagaagtaccaccttgacagccttcaacaagatccaggagaattttctggattactagccacagactctttccctacccttattttctctcaaagatacagagtctttctctctgttctaagccacctaaagctgggagaagaaagacacaagcacctctggccaccaccactatgactgccctggatcagacctgaagctagcacagcacaggtcttgctcaagtcctgctgcatgcaatttctgacgactccctatgttcactcaaggcctttggtctctacaattagcaggtggcaaagccagacaggcctgtgttctttcctttagggcagtgagatccctcagtccctggctgggtccagaagtgctattcagaagtcagggctttggccactttttaatagggttttttgtttttctcttgtaaatttaagttcctcatattgaatattagatctttgtcagatacatagtttgtaaatattttttcctcattctataggttgttcactctattgataatttcttttgctgagcagaagcttttaagtttaattagatcccacttgtcaatagttgtatttgttgtttttggtgtctttatcatgaaatctttgcctctttctatgtccaggatggtattgtctaggttgtcttccagagcttttatagttttgggttttacatttaagtatttaatccaccttgagttgatttttgtatatggtataaggaagaagtccaacttcaatcttctgcatatggctagccagttatcccagcaccatttattgaatagggaatcttttccccattgattgtttttgccagctttgtgaaagattacctagttgtaggtatgtggtcttacttctaacctctctattctgttccactggtgtatgtgtctgtttttgtactagtaccatgctgttttggttactatggtgctgtaggttagtttgaagtcgggtaatgtgatgcctcaagctttgttctttttgcttaggattgccttggctacttaggttctttcttggttctatatgaatttttaaatagcttttttctacttctgtgaagcatgtcattggtagtttaataggaatagctttggacagtacaaccatttaaatgatattaattctttctctccattaagatggaatgatttttcatttatttgtgtcttctctgacttctttgagcagtgttttgtaattttcattgtagagatttttcacctccctggttagctgtatttgtatgtactttattctttttgtggaaattgtgaataaaattgcctctctgatttggctcttagtttggctcttcttggtgtataggaatgctagcaaatttcgtacattgattttgtgtcctgaaactttgtggaagttgtttatcagcttaaggagttttgggtcacaactatagggtttagatacagaattatgttgtctgcaaacagaggtagttggacttctctttctatttaaatacgctttatttctttctcttgtctgattgctccagaaaggacttctaatactatgttgaataggagtggtgagagagggcatgcttgtcttgtgcgggtttcaaggaggatgcttcaagattttgcccatttagtataatgttggctgtgagtttgtcataggtggcctttattattttgaggtatgttcctttgatacctcatttattgagaatttttaacttgaagctttgttgaattttactgaaagtcttttctgcatctgttgagacaatcacgtggttattatctttagttttatttatgttatgaatcacattttattgatttgcccatgatggaccacccttctattccagggaagaagcttatttcactatggtgaattagccttttgatgtgttgctagattcagtttgcaagtattttgttgtggatcattgaatggatgttcatcaaggatactggcctgaagttttctttttttgttttgtcactgccaggctttggtatcaggatgattctggcctcatagaacaagatggggaagagtccctcctcctctatttcttgaaatagtttcagtaggactggtactggctcttctttgtacatctgttaaaatttgttaatctatcaggtcctgggctttttgggggttggtaggctatttattacggattcaatttttggagctcataattggtctgctcagagactgaatttcttcctggttcagtcttgagagagtatatgtgtccaggaatttattaatctcttctagggtttctagtttgtgtgtatagaggtgctcgtagtagttactggttgttatttttttttctctggggtcagtggtaacattcccttcatcatttctaattttctttatttgaatcttctctcatcttctttattaatctagctagtgccctatcttagtaattttttcaaaaaaccttgattaagtgatcttttgaacagtttttcatgtctcaatttctttcaattcagctctgattttagttatttcttgtcttctataagctttgtggttgagttctccttgcttctctaattctttcagttgtgatgttaggttgttaatttgagatatttctaattttttgatatgggcattacttcttatgccctactctaaattttgttcttctagaaaactcagaactatgctttctaaaccaattcaaactttctcagtgaatcaacctggactccctgaggccaagttagcaattttccattacacttggttctctttctctgtaagaatatctaatgcaacaattcaagtgtttctttccctcctggtaatgcggggaactccttttggctgagaccaagacttaaaaccttgttctttcaacattaatgaagatctatttagaaagcctccatttttgcagaaaagatatataaacaccaatgaaaatcaatatgaaattatatgacatacaattatattgtggaaagactgaataaataagtgaactaagctctaagaaaaaaagatgatgatataaaatgatatagaagtaaaaacctgggctggtatagcataattaatgtatcagtaaagtatgtacattgtagaagtggcaggaagacagcatagagagtgagacctgaccaaaagctttaaggaaagttctatacccttaaacgagattaaagtggactcaggaaaacatgggccacatgaggggaaggacacatgttccagatgagccaaagctcagagcatctctaccttctccaggaggaaaggggaggcaaagcagcaggcagaagacagcacggccaggtcagcacagggcacccaggccaagccaggtgggctccatcatacaggtagtgaggagtcactgccaggtgggctttattcattagtttgttttgtttcttttagtaacgaagacacatgatcaaagttgacctttgtaagtgttgctgcagctgaacaaaaagatggataagaccagtgttttaaaaattatgttgtatagagcactagcctcagtgagatattagtagaacacacaggcacacacacacacacacacactcacactaagcccagattattctggcaaatgctgggttaagcaaactaaaagaaacatctttagtgctggacttctcagaacctggaatgtcgctatatgactcataaaacagcaaggttaagacagaacatgtcattttttcccagaaatgctgaaacactttccttcccttggcttcagtgtcaccttctttctcctggttctccatcaacctctttggctgatccttcttgatttccttcttgacaatctgctgctgctcagccattctcttttcattccccatggatttctcaagtgcgtttctattcctgcattttaaactttccttgtttttcctgacacctctccttgtctgactcacccctgttctaaggcaggtgttccatctgtgtgcgcttttggcaccctgggatgctcccagcatgttccctgccacactccatcaggttttctccgcagactctgtgagggcagcagccttgtctccaccattccttcaatgctcagcacataacacagaagctgactccataacatttagttggccaactgagactaaatatatgttcctctagatcttaaaaagttacagaaacatagcacaatagacaaaatattctctttagtcaggagttctctatatatgtacaacagtttgaagtcattattaaagcaaagtgaaagagaaactgtcacagaattccccaagataaattattttgctttagtcttcatcatgtgagataatcaagaccatgtgttattgtaaatatttctagcttacaacacaacgacctgatttttattgtgtgaaataaccgcaatataaatcagttaattaaaaattgcataaataatcctttcaaataaaattctgcctaaattttacattactcatatgttcaaatgataatgagctcataggcttttccaatacctcagtcaaaacactgtactgattccagctgtgggaatagtatctgaaagttattttacagatggggaacaggtacttacctgacattggcctttacactactgtgcccttttaggtcaggaaaaagctgttcccttaaaatcctaaaatctcttctgtcaggtctgaagggtgggtgggaaacacagttttacaaattttagccacagatgttttattccttgcttaaagcagtgactagataaaggccactagaagagtctccaatgtttctttagaagcgtgtgcctgagaacatcttccagaaacactcccttgtctctgcccaaaatcaccttaggtaggaaaatcaaaactcagcaggctgagggatccaaggggatcactgagctctgagtcttatgagagaagagagagaggtctaagactttttgtgtataaatttatgggttccaagtgtaattttgctgtaagcatggatggcatagtggtgaagtcagggcttttaggtatccatcaccagaataatgcacattgtacccattaagtaatttctcactgttcaccccttccatcccctcaccctgctgagtctccattatcattccactctctacgtcaatatctacacatcttttagcacccgcttatgagtgatacaatatgatgtttactctgtgtctggcttgcttcacttacaacaatggcctccagttccatccatgtgtctgcaaaagttataattctattgttttttatgcctgaatggtatttcattgtgtatattttctacattttctttctccaatcatttgttgatgggtatttagtttcattttatgtctgtgctactgtgaatagtgttgcaacaaatacacaagtacagttatctttctgatacattgatttcttttcctttgcataaatactcagtggtgggattgctgaatcagacagagccaatagatgatcagtaatggtggccaatcatcagctagaaagaaagtgcttagcagggcttgaaaacaccaaaactctgagaccactgaccttcaaaaacttcaacagccctgagtgaaaagtccaaacacatttatctaccattcgaagacgctttattgtctgtcctctgcacatctcagtagtctctttttaccacactgtctatatactgcatgagccatttatatgaaactatctgacactccaaggcatcttgtactatatattcaactatgtatccctagtacctagcacagtcctggcatatagtttgctactaaacttttacagaatgaaggaattatcttgtatccaggttccaagttttaaggtgattcttcagtaaaaaaaagtattacagttcacaaataatctacttccctttttacaaatgggatcaattttaatcttatctcctaataacattactttcatttactctgatctaaatatactgtcctaagagagcaataagaaagagagttgaagctggagtttgaagaattgtacatggtcctgtgataccctaccttgttttaacctgagtgactctctcctagcggagagagagccggacagactccattttagtttcttcacgtgcagccccctttaccttccacccttaattgcataactagtgtaaactgactcaaagcaggtccaggaatgcacttagtgataagatattgaggcaagctgcaccagctgctcctgggtacgcactcggtgaatgtcacgcaaaacccctgcatttctctctttgtgatagtttaagcccctgcacctggaactgtttatttgttttgtaactgctattgtaaccaattaatattttaactatttgccagctctgcttctgtaaaacttgtttcagctaaactcccccctcccctatttagaccacggtataaaaacaaaaccagccccttcctcggggccaagagaattttgagcattacatgcctctcggttaccggctaataaaggactccttaatttgtctcaaagtgtggcattcctctataactcgcttggttacaacagtccacactgtggcctgaggtgcattgcccacctgagcttcatctgttatgtatgtcagggaatataagcagggtgagagtggcctcatcagaggaccccagatctctggcttacccatctggcaagtgcacctctgtgagcaaagacttcagagccaggtgacaagaatggcccaagcagtccaccaggaaaacctgggcccagtgtacgtcaatgcagagcatcaagcatggtgtaacaggtgcacagttgcctactcctgttcagagatgactgcatcccacataccgtaaaatgaggaaatgcatagaagcagatgtaactgaagaagacagcagaagcaacaaggagggacaaccaggacctaggagggcaccatgccagagacgcctggaccccatgctaggctcagtgcctgttatactcttgggagccagcactttccctctccatcacatggcatacttgccattatttgttgtgtaaaatattgtccttagttttcacctttcctaggagacacaggcagagcctgtgacactacagcttctggcacacagtaggtaggtgcatcacaaacatctgctgagttcacacactcttgccttctcaaaacttcttgtcaagtcttcagtgaaaaggaattgctgattgagcaagaattaaacttctagagactcctggatccactgaagtttgagacaaggtgagatttgtttactgtcatattcctagctcataacatattgtagtcacttaaaaaagtttgttgaataagtgagtaaattgattcatacgtcatacttagctatatattttctgagtagaattgataaagttaatagtttaagtctagtataattttgctttactcattcaatgaacctgacaattcaaataggtgccaggcacactgctgctgaagaaaaagaggtataagatataatttctgtctacaagaaagccacagtctaaaaagtagaaacatatgaacaaatcgtaacaataaataggctaaattcaaaatcagaggagtttgtttctattttaaacagctctagtcaggaagtgttagagagttctaaacaggaaatattccaacacatcatctaagcatgaagcaggagacacccataattgagtttgctgccaccaaccccaacagcaagaattccagtcctgctgctgcaaagtaagtgtcactctgattttattgctgctgtgtaacccagttttagactctctggttctcacttaatgttctaaaaaagtattaaagagaaaattttattctggtgatgagcccatccactgcagccatctcaacatcataccaattataagcctatcatttaaaaagaaagctgttagtttaacttatttatccaaatatcagtattacataaacatatttgtcatcagactttggacttatgggttaaatagcatataaatatgattagagccttaaagtttacacttctctggttcgctcaaatttttttcaaaatagcatatgcctttctaaacaatggttagtatatttttcaaaatgaacattaaaatgtatattttccaaaaacaaaatacagctcccattggtaaatgatgctattgagacacaacagacaacttctcttgggaaccatttaatcagtgctcacttttgcactctttccagaaatgtcaatggttttgaaatatagaagtatattatacaaataaacttatacttattcagtattgtgcaatatttagtatttcttctagccatctcttgctgaatagtaagccattccaaaacttacggaattatttattgtttaatattgtttattgttattatttgtttagtaattttaataacgttatttctcatggttttgtgggttgatgggcactacaaaagttctcttttggagtctttcttgcagttgcggttggttggctgctgctgaagtcacctgaaagctcaattaggctaaagagtctaaacgggtcacttacatggctggcagtgcatattggctgctgagtgtgatgcctatctgacctctccatgttacctggagtgctcacaacgtggtagtttgtcccaagacacacaggcaaatactacaaagcttcttagggcctagccttggaggtcctagaatacgacttctgctgcatcctattggaaaagcaagtcattgtgaccagcacagattcaagaaatgggagattcgactctacctgtcaatgtaaacagcagcatgtgcatgcagggaggaaagaaattgagggcatcatcttgaagactatcatatcacaccattattccaactagtgaacattatgttttagatgggtagtactagctactcatctgtcccccagaaacccaagctaagcatggacatattgaagagaatgtcaacaccattaaaaaaactctagaaaaatcacatgtgatgactgaggttaattcagtctgtcaactacatcaatataattgccttcttgtaaccctaagtatggtgaagcagaattgaattctacaaaagtctttcatctgttttcctatggaataattaacaaacccaataaatgtataaatagc

SEQ ID NO: 24 - DNA, 1750 bp, Homo Sapiens
cagatcccttgcccgtttttactttgtattgtctttttattgagttttctgaaatttttattctggatattgtctttttaatttattgattgtgtcctttgaagcacaaacttctttaattttcatgaatttcaatttactcttttgtcatttgtgctttggtgttatatctaaaaccattgcctaatttaagatcccaaagatgtattcctctaagattttatagctttttaccccttacattgggatttttgaatcactttgaattactttttggatatatcattaggaaggagttcattttattcttttctaatgtggctacacattttcttaatccagtctatcattgatggacatctgggttagtaccaagtctttgctattgtgaatagtgccgcagtagacatacatgtgcgtgtgtctttatagcaagctgatttataatcctttggggatatacccagtaatgggatggctgggtcaaatggtatttctagttctagatccctgaggaatcaccacactgacttccacaatggttgaagtagtttacagtcccaccaacagtgtaaaagtgttcctatttctccatatcctctccagcacctgttgttgcctgactttttaaatgattgccattctgactggtgtgagatggtatctcattgtggttttgatttgcatttctctgatggccagtgatgatgagcattttttcatgtgtctgttggctgcataaatgtctttttttgagacgtttctttttttaaatttcttcttttcattttcttttgagatagagtctcactctgtcactcaggctggagtgcggtggcacagtctctgctcactgcaacctccgtctgccagcttcaagcgattctcctgtctcagcatcccaagtagctggtaccacaggtgcgcaccatcatgcctggctaatttttgtatttttagtagagacagggttttgccatgttgatcaggctggcctcgatctcctgacctcaggtgatccacctgcgtcggcctcccaaagtgctgggactacaggtgtgagctaccgtgcctggtcctgacttcgttattattaaaaagattcctgagtctttcttattttaatagattcacttagtttattacaaattgttataggaaagtaattcaaccgtaattcttcttaattgataacttctgcatctcgccaatgttgcggtaattgatgatgatgatcttccggaagcactgcatgtttttcatatacctgctgaatattacagattatattctgttctatatacagattatattctgttttataaacttttattattaagtgcatcctattgtgttctaatttttgtataattgtatttcatggaaaatatttatcttaactctaatatatgtaaacctcaatacaagacacagaggatatattatctgcatatatatctcatgttattttcctgctaaatatgttcagaattagattgtataattctgaattctcttttttttttttttttttttttgagatggagtctcgctctgttgcccaggctggaatgcagtggtgcgatttcggctcactgcaagctccgtctcccgggttcatgccattctcctgcctcagcctcctgagtagctgggactagaggcgcctgccaccacgcctggctaatttttttttttttttttttgtatttttagtagagacggggtttcaccgtgtttgccaggatgg

SEQ ID NO: 25 - DNA, 12647 bp, Homo Sapiens
ttttcaaaagactccagaactggaagtaaaggagtaagacttaatggaagtgtgtggctgaactaaggagaactggggaaaactgctgaagaaggattagattcctagactcagatacccttgccccctcagttacatattgcttttgctggggtaggagatagaagtctgaagattcattatttgagtttagagagagagaaccagaaaacacagaggaaggaatcatcaacaaaataaccaacgaacatctccccaaataagaagatatcagtttctagaatgaaatagtctgcgtgttcaactcaatgaatgaaaatagaccatacaaagtcacagcaccgtaaaattttaaaacactggagacaaaaagaagactccaaaaacttccagagagaataaagcagatcatatacaaaagataaggagccagaatgtcttcagacttcaagagtaacactgagctggaggaaagccatggtgagtttagtcctcccacctcagcctccccagtagctgggactatatgtgtgtatcactctgcctggctaattttttgttttctgttttttgtggtgtttttttgtttgtttttttggtagagatgggttttgtcaccttgcccaggctggtctcaaaatcctgagctcaagcaatccaccacctcggcctcccaaaatgctgggatcacaggcatgagccaccacgcctggctagtttccacattcttaaggaggtaataccaataacagctgtaagaattaaatgaggtactccatatacaagtgtctagcattggcaacttttgcttggtctacagaaggtactaaaaaatattagcttcccaagagaagaagcagaggctgtttgtccaggccaagaagaacgtccccactaaaagaccacctgtccttcgagcaggagttaacaccatcaccaccttggaggagaacaagaaggctcagctggtggtgactgcacttaagcagtgaagatgtatcttaagttgcaggattaaagcattcagttataagatattaaaaatagggaacaggtgtggtggctcatgcctgtaatcccagcactttgggaggccaaggtgggaggattagaaactaacctgggcaacacagtgagaccccatctctacaaaaattttttttttttacctccttagctaaaagtagttttccttagcctgtggatgttttagctctttgcctaaacatttcttacagcccttgtaaatattctacatattaatgatttaggtatctgtgggattataaacccctaaacaaaggaagggactacattttattcatctttgcatctgtcatagtatctagcacagagcctggcacatgatgaggagttaaagatttaatgaatattgaatgtttgtatttgaaagcttacatggctaacaccaaatagttaatttgagaaacatcatggcacaaatattaacaacagagggtctttgttaaatatttcacagactaggaaagctagaatctataccaactatagtaaaatatacatacttaagctggtggttttatgagagtaataacaggtatcactaggtcaccagaagtctagtgaaaacttagagttacagctttggttaggctagaggcaagtgatttaggagctatgcttcttaagctcttttctcatttgtttatttattttattttattttttaaagatggggtttcgttatgttgcccaggctggtcttgaactcctaagctcaagcaatctgcctgtcttggcctcacaaagtgctgggcttacaggtgtgagccactgtgcccagccctaagctgttttctactcttcactataatttatagattagacaggttgtacagttgccagggagatgtcatggctaccaaaaaagaaagcataaacacattttaaaatacaccaagtgggccaggcgcggtggctcatgcctgtaatcccagcactttgggaggccaaggtgggtggatcacctgagctcaggagttcgagaccagcctggtcaccatggtgaaaccccatctctactaaaaatacaaaaattagctgagcatggtggtggacacctgtaatcccagctactcgggaggctgaggcaggagaatcgcttgaacctgggaggcagaggttgtagtgagccgagatcgcaccactgcactccagcctgggcgacaagagcaaaactccatcttaaaaaaaagaaaaaaaaatacaccaagtgttgggtagaaaagcaggtattaaacagaattcttagctttttgtttattgatttagtttcttggggcttccttcattacaggagaaaaatctcctacaccaaagtattcaagttctcagtaaatgtattcagaagtcctagtaaatacatgtatgtggtaagtcatactatattaactataataaagttcctcttgaaacaataaagattaatacatttaggaaagaataaaataaaacctatgcaaacatggaaaaaaatttctgatactagcaacacttacatggaagagaagattggatgtgaacatggataggtagaaataattagcaggtcagaactataattaaggtaaaagagattagattaaaggacatcattcgtctaaccctggacacaatcaataaactttccacaatcccagaacacatgtgaccaaaaaaaaaaggagttcattgtcaaatatacacaaacaagagctagacaccaactgtctaatttgaatcctaggaaataggtgggaggccaggcagacaataataatgtggaaggaacattgttttaactaagcagcttttggccaagttataactaagaaggttaaagtgttacacgtctgacaaagtccttaattagttgttttaaacaaaaacagtattttatgctcattaggtattttctagtatgagttgtatcattattctctattggaactttaggaagaaaatatattggagaggctgcataattagtgtttaaggcatagactctggtgccaggtttcttgaattcaaattccagctctcccccattactagctgtgagaccttagggatgttacttagcctctctaagcctcactttcctcatccattagtaaaatgggaactggtagtagttcccatctgataggagattccacttgctatgagtattcaataaattactgttcataaagcactttgaacatatatcccacagcaagttctaaatgaatatttgctaaataaaatctgtccttgataacttagatacttatctgatttaagacaaattttggctcctatgatagagaatatctctagatatatatagtattatgatgacactaggtggaaataaaaaaaagttttctatttttgaagaagcactgttctttttctgtcctttctttcccctatgattcatatctctggctttacaatgctagctactctactaaaaatacaaaaaattagctgggcgcagtggcgcgcacctgtaatcccagctacttgggaggctgaggcaggggaattgcttgaacctgggaggcagaggttgcagtgagccgagatcacaccactgcactccagcctgggcgagagagtgaactccatctcaaaaaaaaaaaaaaaaaaaaagttaaagtctaaaaagtacacttagaaggttaatacaaggaggcaagtgtcactacggctcacgacattagtaaagtatgttctattctagtgatactcttgtggttgatatagtgatgatttcctaatacagattacaaaacagatatagacacaatatacagtagtaacgggaaacgtcacctctcccagcattggggagaggtttcattctggtaaaaaaaaaaaaaagagcacctgataaggtgataccacattgacaatttcatttctcagaaagtggagaaaacaacaaagagaacttctatccaagactataatgactgacaagaaggaaactgtaagtgatgtggggtgacaagagttttataagaagacagtatgctagttagcttcggtgttgtaatagcaaaggaagcctggaaccttgaccctaagagagtaaatttcaagcattcagaggtaggataggtaattctaagccagaaactataacagggagtgtaaccccagacagacagaaggtaaggcttcaaaaacaaaattataatataactgactctgatggggaaaaatggagagaagcaacaaaacaaaaacaggtagagattcatttattacaggataaatgtgaagagtggcacaaactcagtaaactatcaggaaaggtaatgcccagcatgaggtaaataatttttggctacctattgtttttctctcttgcaattcagaacggccagttaagttctacctaggtgaagagaccaaagaatcagaacttgggcaaagaacttgggagtccaaaatggggaaggggtagtatatattatggttttggcagtagtctgaagataaacaaacatgactgtgattttcaaaaacgaagagaatatggttcttgaataccagaacaaccgctcagaaaaggggcatgaccatgggaggccaggtcatagtaggatactaacttctgctgccaccactgtgaaatgtctctaaccacatttatgctccagagtcaaagccccaggagacagcacaactggagagttaaagcgtgtaggcaataacatttcagcatgtatctcatgtactgatataaatatatgcatgtgcccagagggctccggcatcgccaggtaaatggcctgacagtatacatttgtttggcatattaggctgttagccttaaagaaaaaaaaataaaagatacacagccaccttgggaagaaaaatttaaaaagagaggcctccatgtgatattaataatcttaaaagcagaaaaatgtaggggttaaaatcacaaccctgaatgtaataagttcatttgttaagatttcaacactgctaaattacaaagaaatgatacatacagagaagaaaacttctaatcgtccttctaagtgagcattagaacatgatgaatatttcatataaattatgcatcttaatatggaaatggaatggaccttgacaaaaaatccagtttagccccatggtctcaggaacataaaatcttagcactcccaccttagaaaggagatgattaaggcccagagaggctcactatcttacctatagtcacccagtcaataaatagtggtggtgggatggtgtgcagttctcctgccttctgctatatgatgatgttgctagtctatagacttatggtagagaagaagatgatttcaggttagaagtgaacacaggaatgatctatcatctcgaattacaaagtttaaacctgggtctggttggtgggaatataaagctgtatgaaatagctatgggtttgaacagagtagacctggccagtaattaaaacagaagtcccagccagtaaacagtgaactactactgataatttctggggattaatgttatcgtgattatcttcctccaaactctaaagcctggccacattctcaccatgggaagaaggaagcagaataacagtgtcctccacctcactcagggaattcgctaacagcattccctcactcctctcccagctaatgacctcaaggattcagggatatgaaaaacaaaccttcttcaccagaaagactagaggatcaaaagggacaatgtccgtcataagcagcactctatcacaagtcacgtttggtgcaaaaacacagactaaaaggagtcaccaaacattctgcaagtctgaaaatgcacttcaagtcaaatattcattcaacatttttttttgtacctatgacatgccaaacaccatgctggatgttgcgatttctaaaacaaataacagaccctgttgtcaaggagctgagatcactgcaatggtgtgactggtggtatgacagagattatagtaagcttcttagagagaacataggaggggtcaagtgcacagactgaagaggacttggtggcaggggtagcatggagattagggaagacttcctggagaggaacccccaagttgagacctgaagggtgagaagaaattagccacgttttcatccctgagaggtgtgagaaaaaacaaacaaacaaaaaactgtgtgtatgaagccaccatggtgatagtgcaaactttctacttcaaaaacatataaatatctaattaaaacaaacaaaaaccactaataacttttctttcacttctgaaactgcttttctctgttaatagagcagatatcactgggtatggtgggtcatgcctttaatctcaacactatggaaggccaaggtgggaggattgcttgagcccaggagttcgagaccagcctgggtaacatagcgagaccttgtctctatatttaaaactgtaggccaggcatggtgcctcacgcctgtaatcccagcaatttgggaggccgaggtggacagattgcctgaggtcaggagttcgagaccagtctggccaacatggtgaaacctcatctctactaaaaaataaaatacaaaaaaattatctaagcatggtggcattagcctgtaatcccagctactcaggaggctgaggcaggggaactgcttgaaccagggaggtggaggttgcagagggccgagatcatgccactgtactccagcctgtgcaacagagcgagactccatctcaaaacaacaacaacaaaaactgcatatttttttaaaaaatagagcagatgttgaagaatgttgacaaagcccataaagagagaaaataatagtatcattaagctcaggttctggcatagaaaatccgggtttgcatcccaattctgacatttactagctctgaatttatcatgggtgatttatcattgacttctctaaccctcagtttttacatttgtaaaataaaaataataccttattagactgttgagaggattaaatgaaataatgtgtataaagtactcaaaacagttgctggtacacgtgaaattcttaataaatgttagtgaaaaacaaaaaaagcaaaagatgttggggccattatgaataagtcaactggaaataccataaaggcttaatatttctgaacaactggacagaaagactagtctgaactacaagaaaatctgagaaatctaagaaatgttacttgcagttcttgtacatagagttaccggtacaatgaacacgttgctgatattgtcttctgctacagatatttatctttttttttcttatttcccccaagagactataaaactcttaaggataaagactatgtttctttcacctttgtacttctgaaacacccagtacagggccttaaaacaaggaggccctcaaaaaatatttgatgaataaaatgattaggatgttcagatcaatgtagttgtggtcactgaagacaggctaaataaatttggtaactttgtagcatagcaatatcttaaaatgtatacattaaaatcataaagtaactagaatgtgattcattaaagaaactgaacagtattcttaagtggtaactttgtgactagggaggcaggagtcttgacacataaaattaaatgttaggttttgtggtctcattgacctattttctttctcaagcagaatttttttttctcatttctttcttaaatattttcccaacactactttccagtaacatgaccatgtgacatgagtatcacctctgacaacggtttaaagtggaagaaaaaaaattaaaggagaaaggtaaataagcagagtattacctaagaatacaaagtgttcctccacaggaagttttttgtggttgccagattaaaggaggtaacagataccatatgtgaaatacaaagctcaagataactatacaatatgtacatacttagtggttcagaatttaatgaaccaatccaataaataaccttaggatgttcttgctttatcttcaaaggagaatttttgttgtcattgcctcaatgcaataataaaatgattggttctatcaaaagaatatcttttttttcgagatggagtctcgctgtcgcccaggctggagtgcagtggcgtgatctcagctcactgcaggctccgccccctggggttcatgccattcacctgcctcagcttcccgagtagctgggactacaggcgcctgccaccttgcccggctcattttttgtatttttagtagagacggggtttcactgtgttagccaggatggtctcgatctcctgaccttgtgatccgcccgcctcggcctcccaaagtgctgggattacaggcatgagccactgcgcccagcctcaaaagaatatctttagactaaaatctggatttttaatttaattttaatttttttgagacagggtatcactctgtcgtgcaggctgcagtgtagtggtgtgatcttggctcactgcagcctccacttcctggggtcaagtgatcctcccaccccagcctcccaagtagctgggaatacagaagcccaccaccacaccggctaatttttccattttttgtagagatggggtttcgccatgttgcccaggctggcctcaaactcttcaaatgctaaagtgatcattgcaattaaataaaaacaattgagctgaagtgccaatttcattagtacagctgaactagtgaaaaacaggtacagccaaacaaaattaatgcaaaataatcaaaacttttgagtgcatcaagtatggaaaaaagttctcaagttctaaagtatttcaaaccacagaaagggtaagttcttttctttgcatttccagtaactttaaaaataaacctttattattttccagattattttaaaaaaaccttcttattaaaaaaatttaacactacacaaatacataatatcaaaaaccaacattttatttaaacttctcctttggaggtaactggtgctatcaattgagttttaacaaccacttttcaggccaagtgccctggctcacacctgtaatcccagcactttgggaggctaaggtgaggggattgcttgaggccaggagttcaagaccagcctgggcaacatggcaagtctccatctctacaaaaaaatttttttttaattagccaggtgtggcggcacatgcctgttgtcctagctactcaggaggctgaggcggaaggactgcttgagtccaggagttcaaggctgcagtgagctataatcctgccactatactccagcctgggtgatagaaggaggccctgtctctaaaaaataaaaaaaccaaactaaccaactaaacaaaaaaccaccttttgatcgcatgagacagtaataggagagctgctctaaataagtttatactaattgcttaaacttctccttttatctgtgcccttcctactccactgctaaggaaacacaaaaacaaaaatcaaaaatacatgctaatcctccaaaaagacaacccacaaataagattaacccctgaaaaaaaatcataaggtgactgggcaaaattgtgacaccaagtggcagaaacacatttcctttagttgccctcaataataaaaaacaggaacagcatttttctttcaaagatgattggaagaacctacctaattatcatgttttttagcttttaaaaaataattttgtgaggccaggcgtggtggctcatgcctgtaatctcagcacttgggaggctgaggcgagcggatcacgaggtcaggagatcgagaccatggtgaaaccccgtctctactaaaaatacaaaaagttagccgggcgtggtggcgggcgcctgtagtcccagctactcgggaggctgaggcaggagaatggcgtgaacctgggaggtggagcttgcagtgagccgagatcacaccactgcactccagcctgggtgacaggtcgagactctgtctcaaaaaaaaaaaaaaataataataattttgtggcggggcacggtgactcatgcctgtaatcccagcaccttgggaggcccaagtgggcagatcatctgaggtcaggagtttgagaccagcctaaccaacacagtgaaaccccatctctactaaaaatacaaaaattagccagatgtggtggtgcacacctgcaatcccagctattcaggaggctgaggcatgagaatcacttaaactgggaggcggaggttgcagtgagccaagatcgcaccactgcaagatcgcaccactgcactccagcctgggtgataagagtgagactcagtctctaaataaataaataaataaataaataaaattttgtatacaatgaggcattttgtagtgccagagagtaaggaagtactaaaaaaaaataataaagaaacaaaaaacacctacagcaacaaaaagcttgcaatggccaaaggtagaacactgtgagcagcaaaataagcagtattagattataacccaaagtactaaaaataaatatccatgagtccatactaccataaataaataagtaaataaggtagaacagacaatttcatggggagaattccaaataatttacgtaaatactctgccctcaaggaagtgaaacataactcctcccgccagctctttaactgagggctgcacatagtgacttccttctgaagagtacagtatggcaaggggaaaaaaaagagtaactttacagttgagaaagctgacaaaacttccttagccaggtgatcaaggttaacatcaacagtgataagtcatgttgatactatctacttttgatatggtatgacgagaatggcattttgcctctgtggtcttcctacccaaaacccacaactgcagtctaattatgaaaaacacaacataaaaatcccaattgagggacattctacaaaatatttgaccattattctcaaaattgtcaatttcttcatcaaaactgaagaaaagtctgagtgactgtcataggaacaagaagcctaaaaaaacaaaatgattaaatgtaatatggtatcctggatgggattccagaagagaacaaggacaataagcaaatctaaataaagtatggactttagttaatagcaatatatcaatattggttcactaattttgacaaatgtaccatactaatatcttagtgatagaaaaaactgggtgtggggtatatgagaactctactaatctttgaaacttttctataaatttataacttttctaaaataaaagtcttattgtaaaaaaactttaaaatctactatatatataacatatatataattttctcagatgggataagtaaatatcataaaagtcaattattcctgaagaattattttattaataaaaataatataacactaattttaaaatagtttaaatgagatataagaaatggagatgctaaaacaaaatactggagagtaattaagaattttgcatacttaggccgggcgcggtggctcacacctgtaatcccagcacttggggaggccaaggtgggcagatcacgaggtcaggagttcaagaccagcctggccaagatagtaaaaccctgcctctactaaaaatacaaaaattagctgggcgtggtggtgggtgcctgtaatgccagctactcgggaggctgaggcagagaattgcttgaacccgggaggtggaggttgcagtgagccaagatcgtgccacagcactctagcctgggcaacagagtgagactctgtctcaaaagaaaaaaacaaacaaacaaacaaaaaattttgcatacttaatattttcacaatcatggaattgtcgtggcttttgggattttcaccttcaagttcttttggtaaaatattaatactgttaaaatactgtatttttatcttgcaggattattttggttcatttgaagacgaatggctgtttccatttatcctccaagcttaaacccaataagattacctgttatctctttcctcaacagatgagaaaattttcagggggttttcctgatataacagaggctttcataacataacatggagaaagagagacctattataattggaaagtttccatttcaattaattctgtaactttacatgcataagcaatttctacttatttatagtctaggtaagactgactaaactaaatgatgtcaggttgactttgcaagcttcttttttcacattaaagaaatactacggtctcagtctgttcacacaaaacacctgaaactaggtaatttataaagaacagaaatttgtttcttcagagttctggaggctaggaattctaagatcaagatgccagcaggttctgtatctggtgaagaccttgggtctctgcttccaagatggcaccttgaacactgtgtcctcacacagtgaggcaaaaggaacagaaggacaaaaagagctgaactcactccctcaagcccttttataagggtgctaatcccatccacgagggcagagtcctcatgacctaatcacctcctaaaggcctcacttcttaatactgtgaaattgagaattaagtttcaacatgaatgtggagtggacacattcaaactatagcaagtactcactataattttttttttttttttttttttagatggagtctcactctctcgccaggctgg

SEQ ID NO: 26 - DNA, 3664 bp, Homo Sapiens
agcgagactccatctcaaaaaaaaaaagttccaactctgtccctgtactagctgggtgacctggggtgaagtgcttaatcttttggcatttgtttcttcatctgtaaaaatgaaataacacataatctgtagagttggtgcgaagtttgaatgagacagaatagcaaaaagtagtaaactaggccaggcatggtggctcacgcctgtaatcccaggactttgggaggccaaagagggaggacttcttgagcccaggagttcagcctgggcaagcatggcgaaaccccatctctactaaaaatacaaaaaaaaatagccaggcatggtggcacacgcttgtggtcccagctactcaggaggctgaagtgggaggattgcttgagcctgggaggtagaggttgcaatgagctgagatcacacagctacactccagcgtgggtgagagtgagaccctgtctcaaaaaaaataaaataaggctgggcatggtggctgatgcccgtaatcgcagcactttgggaggctgaggtgggcggatcacatgaggtcaggagttcgacaccagcctgtccaatgtgacgaaaccctgtctctactaaaaatacaaaaattagctgagcatagcggtgtgcgcttgtaatcccagctacttgggaagctgagacaggagaatcacctgaaccaaggaggcagaggttgcagtgagccaatatcacaccactgcactccagcctggacagcagagcaagaccctgtctcaaaataataattataataaattaaataatagtaaactgtatgcctcagcttagtatctccaaggtggaaatcatacaggacctaccttcagcactcctgtccctccctctttgtttatcttttttatttcccgcttccattcccctgtatttttccctcctccttgcctaagctgtgggcctgcacttggcacccttggacacgacctccccttcctagtgatactcagactaaagaagtcactgactattgtttgggaaccatgtcatgatacctagtgtcaacgttccataaacacccagtaaacataagtgtggtctaagggaagccacacatcgaaattcctgtcttggaatttggacaatggcaagatgcagccacattctttacaagcgtggaggcgttcgtgaggctctgccctgggactggcagggaatgaactggcttgggactaacataagtggagcagctatgtgaagagccacgggaaccgctacctgtgatggcaggtgggcagcagccactattgacactgtgtaatgaaaagagcaaatgtgtgcggctcggtggcagcacaactaaggacagggctcagtgatggaaaagaggcatgaagacaaggggctcccagcaagtgaggcagcgatgagttggaatgaaggctggagggtcgcagggaagctggaaagtgagttgggtggggactgtctgcagaggggatcttggctcgagtttgtcatctcaaggagcagctatggggctttttgaggcatggtaattagatgagacaaccctggcagggcatgactggcaacgtgggtggccctgtatggtcccccaggggttcccagtccccacagcttcccgactccctggccccagccattcctcaagctcccagcagctcaggaacttgcgtcagcagctcaggtcatgacaccaagatcaggcttggaaagggggaggtggagggaggggagtttttggcccggaaatggctgggaagacttcctttgctgggattaactgttgtccgtgaagctggtggcattcagcagggcacagggtgttctggggagtgaagtatgtgggggaaaggggtgtccataccttcacccctgcctccctctcagagctgcactccagctgtggtgaaagagtggatctttaggcagatacagatacagagattccccccaccccaccccaccaaaggctttcaggacctctaggttcattcgtgtgtggggatggagtaaggaggttgctcatgcttgccagccaagtgtatgtaggctgagctggggtgattttctttttcttttttttgttgagttagggtctcactgtattccccaggctggtctgaaactcctgggctcaagcgatcctcctgcctcagcctcccaagtagctgggactacaggtgcacaccactgcacctgcctggctgggggttgcctcgttagggtccccaggcccggaaggtcgcgtgcttgctattgctgccccgcagacccccatggcctgctggagctagggggcgccagaagccttacttctgtgtctctggccgatgaacaagagagcctggatactgctgcagagcagaggctgttccggagagcagggctggaaggtggtggggcggggtgaagtcctgactagaggctgggagcttctgggtgggcagggtctgccagggcaggagcctgtgtgagtgcagcttcctttctgcccgcccctagcttaaggccagagagtaggcagcttgttttcaagaatcccaatggctttcttcctcccactccctaaatcttcttgcccaccctctaaccatgcccagggcctctcgctgtgaggtggcaagtagcccgagaagcagatggtagcccaggccttgcagtccccgctccagcacacccctcccgtcctctcgccaggaggctgcctggctttgtggtccggagcaagtcacttctcgacgggcttcactttgcccatctgaagtctgaggttgttaggcgtgttttctaatggcctgcccagctctgacatttttggatcctatgtaaagggaaccctcctttccaccctcattcccagtccagagtgaggagattgggtaaattcccagagccctggcactcccgtggagcactcaggaaacgctccttcacccctcaattctgctctcacacaccccgtcacacatagactcacatacaccaagcagagaggagcaaagagaaggaccatgtaagacaatcacggacatggcgttagaaggaaactgagaaacgctctacaagagttcgatgtattacattatttttaatttagatgaaattcacataacacaaaatttaccattttaaagtgtacgtacacttcagtggcttttcatatattcacagtgttgtgcaaccactacccctatctagttcaaaaatattttcagttctcccctcctccagcatctgggaagcatccattcaccttccagctctgtggctttgcaggttctagacatttcatgtaaatgcagtcatataatatgtggctttttgtgtctggcttttttcatttagcataatgttttcaaggtttatccatgttgtaacatgtattcttttaaaaaaaattttaatgtgtaaaatatacatatcataacatttaccttttaatcattcataagtacacaaatcagtggcatgaggtggtcccttcccaatgttgtgctgtcatcaccactgtctgttttcagaactttgtcatcatcatccccaacagaaaccctgtacccattaaacagtaactcccggccagacgcggtggctcacgcctgtaatcccagtaattccagcactttgggaggccgaggtgggcggatcacaaggtcaggag

SEQ ID NO: 27 - DNA, 9137 bp, Homo Sapiens
ccccctctgcctgactccagtctgggcatttctggagcatcctgtgcgcctggctcagcccagcaagctgacatttgaaagctcacagctgtcctgtgaggtgggtgattcccgtgtcgtttcatggtgaagaagccaaggccaggacagaagtgacctgtccccgggccacagctgggcaggggcggagttggcatttgaacccagctgcgtgcctcttgagtgctgctctgtgggccccgcagcctcctgtcagctccttctggcgcctgctctgtgggtgttccttttgtctaaggcgcctgcagccctcagagggtctgtggggtggggacagagctcagcaccccgcatccaccagcaccatctccgacctctgtgcaggcttcgtgttagaggtggcagccaggtcctgccaacggaagatgctgggccttggaaacagcctgcactgtaggtgacccggccggccgggcccaaactggctgccaagaaaagggagcgggaaaggaaaacagctctcggccacatcgcctgtgtaaccgaatctgttttcaaagcccctcgcaacgcgggctccgcattcggcagggcaggcactcgccgccagatccccgaggactgctcagggggtcttctgggaggagctcaaagcgagtttgttttcggggaggaggtcattgcactcaaggtccccgtgactgcagcgttctcaaacgtcctgccatgtgctgggataaccccacccaccgcaggcgtgccctccgtggggcagggaggggaagcaggtttgggctgttagggctgcaagccaaggggcctgcagggcatcttagtgagctgctttggtgtccctgcagttggcgacacccattgtcacaccccctcggcaccctcggtctcccacatgacagacttacctggggatgcaaacagggctggtgatgaccttggccctgtgcggtggggtggccgtttatgatggggcctgcactcaactcactttcaggtctagatgcggggaccgggggaggtgtcagctgggctgggctgggcacgactagactgtggccccgtctgcgggagcccggccaccacctcagcaacgccacctccttaggatgtgggggcgggatttactctcgagactcttagagccagcgggtggctggaggctcatagcctggcccaggcagctgggggagggctttgctggtgcctgggaccccccaccccctgcattctcgcctttgctttctcttttgctctcgtctttaacaacatctctccactcctcccctccctccctcctctggcctgcccgctccttcattccttctctgctcctaacccccgcatagaggagcctggggagcccgcagcctcctgaccccatgttcctctttctctcctgtcttcctggagacgtctgccactgacagtcttggagccctgtcaaggggacctgtcctgcgctgggctgtccacagaggagcagcgtggaggagctgggagtgcccagcctgcctgtgggctgcattgccgcttcctgcccaggagccctgcagccgtctgtccgcctctgagtaggacagtggggtttcctggccaggagcagagtttgtcacattccagttatgtctgcccaatgttcagcttttggtgagtgtcaaagagtcagccccactctgcgggcgggaggggacctgagatgtgaatccaggggagttaaaaggcttcggaaagcatccaaaagtatagagaaaaaaaggatagttgaggggctgggacgatgcaagccttttattttcatcctttaactttttttgcatttctgtattttccaccatgaacaaagctcattgataatagagactgaaatatttcatggatgattcaaagagataatctgaaaagggaaataacgtttttctagggtctggctgaagctgccctgcggattatgcaaaaacctgtctgagggagtgagaacgcagaggcaccttagagccagccatggctccaagctctgaggatctgcaacagacacacattggctgggcctgagcaaagagggaaagccactctccttcagcaacgaaggagtggggatagcaagggctgagcttgtacatgcacacctgtgtgcagccacacacatacacctgtgcacacacatgcatatgctcatatatgtgcacacatgcaggcccgtgctcacatgcatgcatacctctgtgcccccacacttaatgcacatacatgtgcacatgcacacctacacacattcctatgcacccacccagtgctcatgacaaacctgtgtgtacttacgtgtgtacatccagatgcacccacacactcgcacacatgcctctacgtgtacgcccatgggcacgtgtgctcacagaggcctggaaggtgctgtttttccacgcgacgatggctgccgtgctcggtgggagcagccgcgttgctgcctgttcccgtgccccagtctggccgtcactcctcaccctcgtcaggctcagggtgggagggtgagtagcctggagtggcctggtcacgtaggtgggcagccagctggggcactgacctccagatgggccacgagagcccttcctgcatcttctgagtccctgactcagtgcccagtgagggtcccggagggcaaaagaatgtctaacgctccacctgtgggcgggtctggccttacggaaacttctccatggcaggtggaggcctggttgagtggagcaaagggcaggcattcccagtgatcaggagctggggccaggcctactgacaccttgatgctgaggggccagagcggtcctgagcgatgtcccgaaggcccagggtctgggcaggtggaggcagatggaccaagcagggcctttgtgttccagggcactttgcaggcagcaggacccccaggtcctctggagagggtggctggagacccggcctgaagctgctgcccccaacaccacaggatacctgcctgcaggtgccatccattgcttgggggctgcacagagcagttttgagcaggcagtggggtgtcaccttggagtggctgtgagatgtgcgggacccttgggggccacctggggtcaagcccagccctgcctcttgggctctgggaccctgggggagccactccgtgctctgtgcctaggtctgtgaccctggaggagggcggtgctgtccatctccggggacgatggttgcatctcaagggtaagggccccaggcctgccaggtgcttcgagtacagtccaggggcggcctctcggggctgctctggtgggcggccagaccctgctggaatgtgactctgttcctgggatcaggacctgccctgttgcttgtgggcagggttgcctttgtcaggtcctgccatttctgagcctcagtttcccaatctgtggtggggttgacgtgaggaaatgagaaatgcacccagggagcactggctggcgctgcagggcagcaagggggagccaccatggtcactcttggaaaagtccccagccctgcaccagcagggcagtaagaaagtccacggctgccgctgtcctggagagaggcagcagcccgggagaggcagcagccctggccacacccctgccaagagccagctcaggggcccagggccgctgagatcactgggcagttcccaggctggctgggctgtcccctcgtcaggagggcagggctggcaggtttgtggacgccttcccaggctgacccccacaatagccgccctgctccaccctgaatctacccgtcccaggctgcgcctgcctccaagtgcctgattggagatggccaagcccattcctcatgtacaaagaatttcccgagcagccacagctgctgcagctggaacttgtctccagatgggtcgttccgagggaaaccagcgtctcctgtctcctcctgcagacatgggctggcgtccgagccctggatcccctgccctggcttggcttcctctggaggggagataaggggctcctgacatcttgtaggctgaagaacccgcccagcacgctgacagggaggcgccagaggcagccgcagaccggcctcagcccctgcagcccctcccctcttgttgttgcagaaagaagccctcagggcccaaggtcgacccacccagccaggggactgctctgtagctgtggcccactccagccaacccgggagtgaggggctccgaagcgtgcccagcacatagggagggctcattccggggggcaccgtctcccagtcagagcaggctggagctgggcacagccgaggaagagcaaacgtgttctgtccttgactccttctccaagtttgtgatggcatctgccatgggccagacaggggcacacgagagtgagcgagtggacgtggctgccctctggagccttccagggcgcgatggcaggtgtggagaggcacacagggaaaccctggagtctcgccgaggtacaaggcgatgcagaaagggccagggagttcccagagactgtcaggggctccctgggcggaggcagagacccccacctggcccctggcacctccagcaccatgggcgccctggctagggatcccttcctgtctgaggtcagcgctgcaaacctgtggctgcggttaccccaccatgttttttaaaattggaacaattcatgtaaaagcccagattcattttttcttgaaaaaaattgacagccaactgtgaccacagtgggcttgtttctacgcattgggggctcttccctcggaacaggcagtgctctcagttgccgtagacgccccccactccctgtcatctcacccggtccctgctgggcctctttgtggcccatcccctggttcagatatttcattcaaagacccacccccccagggggaggccatccttctcaggaaggtcgcttggcctggactcggaactggacactcattactggtcaccctgtgactggagcaggactttgcctttctgcacctcggtttctccatcctaagaggggctaacgcctgtgtcgtgggactgtcccgaggcgctcagaagcagtaggcttgctcatgcttaagcacagagctcacagctgggggtggcccctgtgccacaggtccctgtgtgtgcccaactcccgctgcagagggcaacgctgtgtgtgcccatgtctgtgctgtggatgcaatgtgtaaactgcacagcctttgacggtggctgcctgggttggaacgcgggcctctatgtgtgctctccaacggcctgtggcggaagggcagcccctcccttggtgggggaagttctccatagctttggtgcttgggaggtttggagatggcttagagagccatcgggatgtgaggggatacatttatctctgtcttcttggggacagacctcggaggtccctctttcacccttaaaggcctggatgaatggaatccgtggggcaggattctcaaagcaagactggtggggcctcacaggcattcctggaaaagggctgtggagttaaaaacccaagcgggaaataaacagaactaggcttaggaagggtctctctgggaggcctgtctgccctccatctttcgtgggctcaggagcactgcctggggctgggagcgagagctcggatactttacgttctctgaggcgctgaccgtggctctgcgaggaggagtgttcctccggacagacatctttcagcggcgctggactaagccatgggacaggtctgactgtggctctgcgctccccgccgccccatctgttgccccctccccactgagagctgggggagggacgggatctttgtgagctgacttggggtctcagagccgcggggagggaggagtggggctctccctgcgcgggttccttttctgggtgaggcggagcctgttcaccaggcagatcgggggctccccggcctccacagatctcctggtgtctccccccaggctgttcacactttctttacttggggggctgataagtcacgcagctggcagcatttgcacctgattcaaggaggtgaacattttccctggagattagccttgaagtcagggctggtccccacccggggacgaggagaggacagaaggctacagagggctgcaccgggggagggtagatggggcgttcacccacccctgctgccgcattttcctttgttggttttgcccgaggtctgataagcaccctgctccagccagaggccttatctggccgcctaatcccctggccttggctggagaacaccagggctttgcccagtccgccctccctaccccctccctggcccctgcaggccgttggggctgggggtggagggagagggaggtggagtgaatacccccttcctcttgctctttctcttccaacagggcaaggggtgccggtggttgaagaggcccctctgggcaggaacctctcacctggggcacggctgaaaccaaagaattcaagctccataaggaagaacctagaggccccccacgtcagcctgccccagcctggagcttacccaccatggaaatgtgtctgttggccttacagaggagaaggcatttgggcagggctttgaggtatgagtaggagtttgctgaatgaaatgagaggaaagggttttcagggcagagggaacaggttggggtggtaagaagggtcctgaggcccatagagagtgactgctatgagtgagtggttggaactggcgtgactgaagatggggaaggacatctgggggtcgggggtgccagaggagttggggatttatctggaagatggtgggtgctaaggcaagaagaaccaattcctttttctttttgccaaagcaaagccctccataggatttccttttggactttctttttgaaagagtaatgcacactgacagtaaccatttagataatacagtttctaaaagaaaagcaatgatcctttgcctctcccacacccaccttttccccacaagcccccagaaggctgggggtctgctctccctcccttgacagctgcaggatgttttgtggtggggtgtgaggggctttggccagtccctggagatggacgtgctggtgtgtccagtttccccagcccacttaaatgggtgcagtgagtggcctttataagttccccgaagggggcgtgtgggggacagttacagacatgtcgtttaacaaatgctgcagatccccttccagaagtgaagaacatctcagccgtgccctggcaggcctggctcctccccctccacacctgaagtttctgtttaaaatgtttggccactggaggggtgaagacactcacctgtgcctgaggcactttattatcctgactgagcgcgccctgcacctctcactgtcctgaagtggctcggccctcgggcttcatctgggccttctgtacctgagcctgggcttggcccagcgtggccagtgggctccgggcccctcctgccagcctagcacttctgagacagaagcctggcgcagcaggcaggcacctctggactttgagcctgggcccttgacagccagggagagggcgacccccagcacacactaccctaacctttagcaacgtccccactgcagatgggggtgctagccttgaaagttgggtgccccaagggttggggcaggagggcaaggggccgccccagggaggtggtgcatgacacagcctataacaggcagtgactcactgctcatccagccataaagtcagggtgataggctcagtgtcccagccgtgctccctggagtccctgccccaacgtcattcccttctctgcagcctgcgctgggcagagctccctccccaggggggccgcctgggccactctgggaccatccacccattccagacccacccattccaactcacttgctactgctggggagactgagtgccagggagggggagcaagggtagatggagaactaacagtgtcagagtccacaggtcatctgtcccccactttacagtgtggactgcgggaggggatcccagtgtgggctgcagagctcagggccaggatgctcggcctgtccaggctgcgatctggaggaagcgggtactctctgcttagcccagggccttccacgctcctgggggctgcggggacagatccaagaacatgggccctggggccatggtgtccgattcaacccacgcttcctccctgttgacaccgggcaacttgctgagccgctccgtgcctcagtttcctcgtctgtaaagtgggattcatagtagctccttcccgactgggctgtctggggattggtgagtgatgccgtggggcaggatcatgatttacggggtgcctgtatgttctcccagagacgggaagggccctgaggggtgactcctcaccagatagcggggtctcccagggactaagcaggtgggagggatgggcgctgccctactgtgcagagccttggcgggatcccttgacgctgtccccaggctctgcggggccaggaatagggccactgggcctggggtccttgtagttcaagggtcaccctgaactgcggggctctaactatagagaccctggggcagtgacgcctgtgcaacctgcccgcctgtcactccctcccccaacccctcacacttgccctgcctccttgacctgccctgcccacccctcaccctcaccctcacgctgcccccttatcccgcccctggcacctgccctgcccttcccctcctgtgatggttaatactgagtgtcaacttgattggactgaaggatgcaaagtatcgatcctgggtgtgtctgtgagtgtgttgccaaagaagattaacatttgagtcagtggctgggaaaggcagacccatccttaatctgggtgggcaccatctaatcagctgccagctctgctagaatataaagcaggcagaaaaacgtgaaaaggctagactggcctagcctcccagcctacagctttctctgtgctggatgcttcctgccctcgaacattggactccaagttcttcagctttggggctcagactggctcttcttgctcctcagcctgcagacggcctattatgagaccttgtgatcacatgagttaatactccttaataaagccgc

SEQ ID NO: 28 - DNA, 12200 bp, Homo Sapiens
aatcagaggaagaacagcctgctctgaggttgaactttgcaaagctgggaatgttccttctttgaaggagatcttagtttaggcattcatttttattttattttttatagagttaatgaaccagtcttacagtcttcctttagccaatgagttaaagaaatctttgcataagtttattcaaatcagaggttccaccaagatatccctgtaaatgcaccttccagagccaatctgtgtgtaggcatggaagcaaacatcctctcttggcttctgcagcaaattccaagtggcaatggaactttaccttcgctgactcttttgtttcttttttcccgtggattctgtgcttttgtttttgtttctggttttggtttttatataactcagaagttatttcctaatgtgccagaaatgtttgtgaatttggttttatagcctatttgatcatcctttttaggtggagacctattctgttgggttagagatgacagaaaatcttatttgtcggttggtttgtttgttcaagaatacactgaccttctacaagaaaggagagctctttgacacctggaaattttacagaagcttgggacagctctgaatggcaacacggtcctgagatatgtgattacctgggactttcattggacctgcatttcagctctactctcctcactgccctatgctgctttgaccctaaaagtgaagccagcttggccaggtgcagtgactcacacctgtaatcccagcactttgggaggccgaggtgggcaaatcaagaagtcaggaaatcgagaccaccctggccaacattgtgaaacaccatctctactaaaacacaaaaaaattagccaggtgtggtggcacgcacctgtagtcccagctactcgggaggctgaggcaggggaatcacttgaacccgtgaggaggaaattgcagcgagccaagatcgcgccactgcaccccagcctgggcgacagagagagactccatctcaaaaacaaaacaaaacaaaacaaaaaaaacaaaaagtgaagccaactcaattgtctcatagaactgatctttacggtgtttttaaataaacatagaaattggccctcccagtcttaaaacttcaaaaacttacatttgtcttacctcagttcctttctcaggaatccaatcatcaaggctcccagatagtatcaatgaacggaaacttaccagatcacgatatctggacaatgagatgtcagatccccctcatccatcctgattacctaactgactacctgcttcctgttggccaactactcttccttacccctccctaattcttgttttcccacaaatggttacatttctgtcctgctatagaagcccttaattttaattggtcgaggagatggatttgagactgattttttgctctccttggctgttgcacctgaatagcctttttccctggcaatactttttgtctcagtgattggctttctgtgcagtgagcaatgggaccaaacttctggtgttttggtaacaaattttggtttcctgactgtgaatgcattgcttgtgactcagctgccatgagctgggagagtttcaaaagccctctaagcagctacctgaccattttggccagaggtggattttcgtctctccccatttgggcccacttctgccaaccccaaccatgttcctgattgcctaggaagaacagcctttgaaatttgacgtctatgtacagaaaggtgagtgtcttttatgggtactagacagtgggaatggttcctctccatttgggaaatcccaaaggcatatcagtttgcaggttaaacaagccaaactgatggagagaggataataccttgactgattcagtttgaacactcttggggcttgttcattgctacagaagttggattgtgttttggtgattgtttgcttgtgtatgtctatgtagttatgggatgtcagggtttgatcccagagtgcagcccacatgggtgcattctttgggttagtctgtatgtagttgtgggttgacagagcaggggaaattctacagccataccactctgagtgtggctgatcttgtctgatcgcgatgtctttgcattgtagtgctgtcttacaattgaattcattttgctgttgaatgggaaagcaggatggaggtccatagacggggttttaccatgctgctgcacactggtcttgaactcctgggctctagtgatccacctgctcagcttcccaaagtaatgggaatacagaaaagaccaaccacagtgattaaagggatgaaaaagatgacctgcttgaaaactctaaagaacccagtattatttgaaagaagaggaagctgaatggtaacttaataactatcttcagatttcaacaggactactacttctgttttatccatttctatagagtttgaaactactaaggaattattctgaaatctttctgtaactagcatatttgactcattttatactaattattataacttttttccatttaaaaagtctgaacttgtatttggcattcttccatttgaaagaataagtattaggaagagataatcaaatagtattactctctttttcttcttcttatatatgaaaagatggtattgtttttcttggcataaacaacctttgacttgttcttgccatttatcagactcaaaaatctgtggattgaagtcttctgttacttagctccagctatgctgtgagttattattgccaagccttaataatattgacaaaaaagggggaaataaacatgttagaagttaaattgcattccttgttactttataaactgaaataacaagacttggagtcattatcttgtagatttctggataaaattaatatgtagggcctttaacttgttttgaatctcttaatgaacattttctatgtgagaagtattgtttagtgctaggtttttgggtaaaagagaaaaaaagagaaagagtaagacaggatatcagagctcaagatgcttctaatctggtggtaaagataatttaatgaattagaggtcggtaagcaacacctaatcatatacatgtgtagtacctcaagggaaacacaaatcctgcttgggcaagaacactgagatagatgtctaaacaggatttcttgtttttaactctcaagtttcacaataacatagctcagttcgttttagtgcccccgtctactctcaaactccatccccgacatattttcatcagactattctttctttctctttgttgagttggtttttgctttgttgttcttatatctgagtttctccttacttataaattttttttacaacttttcacctgccaaagcctcaattttatctcgtttctgctaattgcattcttttatttcctgcttttatgagccactctcctataaaatttctcaatttaaattccagagaaggaacttctgattatccccacttagcttcataccgtattatgtcataggtcccaagccaatgcttgggtcagaagccaatatgcattcaatttagacttactcattatggcttctcctgcaacaggaactgtggtcctggcagtttcctctggaatgagataaggcatagcaagtatcgtaatgtgctgttaaattttgaagaaagtatggaatttgaaaaattgaaaagaaaaagataaggattgaaggaacatttggagacaacccagatatgctgatgaacacagtgaggatagggcttggagagatctactttatctagggagaaagcatgctcagtagtggaaacacttctggttaggcagggtgagaacaggaactagcagctctctaaagcaagccaagactttagactgattgttcttgagtccataacttaacaaacaatagttaagggaatttagttgtcctatgtgcctattaaataactggataggggttttaaaatcattttttaaaaaagcaattaaaaatacctttcattttgattagtaagggaattttttaaagagaaactcaggacatatttgactgtaggaagagattatactcctttcacttagaaaaatacataacactggaggagctagatgtgataaaccaggaaatagaaaaagtgccattgtaagtatagacagatatcgggggaaattcagccagatattgggcaaaattcacccccgatatttcatgtaggttcttttctattttccctaagcatcagccggtttgagaaataaagggacagagtataacagagagaaattttaaagccaggtgtctgggggagacatcacatgttagtaggttccgtgatgccccacaagctgtaaaaccagcaagttttcattagggattttcaaaagaggagagagtgtacgaatagggtgtgggtcacagagatcacgtacttcacaaggtaatagaatatcacaaggcaaatggaggcagggcgagatcacaggaccacaggaccggggcgaaattaaaattgctaaggaactttcaggcaccattgtcattgataacatctgtcaggagacagggtttgagagcaaccggtctgaccaaaacttattaggcgggaatttcctcgtcctaataagcctgggagcgctatgggagactggggcttatttcatccctacagctcgaccatagaagatggccacacccaagggggccattttagaggcccaccctcaggggcgcattctctttctcagggatgttccttgctgataaaaagaattcagtaatatttctcccatttgtttctgaaaggagaaatatggctttgttccacccggctcactggcggtcagaatttaaggttatctctcttattccctgaacattgctgttatcctgttcttttttcaaggtgcccagatttcatattgtccaaacacacatgctctacaatttgtgcagttaacgcaattatcacagggtcctgaggcgacatatatcctcctcagctgacaggattaagagattaaagtaaagacagccataggaaatcataagggtattgattggggaagtgataagtgtccatgaaatcttcacaatttatgtttagagattgcagtaaagacagacataagaaattataaaagtattaatttggggaactaataaatgtccatgaaatcttcacaatccatgttcttctgccatggcttcagctggtccctccattcggggtccctgacttcccgcaacagacagagatatttatatttcagcctgaccctaatcctaacccaaattctaattctaaaagagatcacatttaaaatatatctttattttggaagaattgcaaagctaaacttttctaaaatcctagtctttagcgagacaatgttattttgagttaagtcaaaaattttgcacacacacatgcacacatgcatgctgtggctgtcttgtggcttttccttgaaatgggtatgtgattatattattttccccctccctttagaaagacataacacatgtcattggtcattattttgccacatggtgaccctagtttaaagttttgttctatgttcatgttaaaggagaaaaaatgataaatgacaatgtaatcaagaaattgaatataaacttgccgattcgtctaattacagagtttagtgctgtgggttccaatttgtctcttcctagacagttgctttgtatccatgaatgaatgaattcgtagtattgaaaacctgctcccagtgctatgtaatttatcaaataatatgtgtgagtataagatataactgctgcccacaaaaactcataatttatttgaggacacaaaactcatatacataaaataattcatgaatgagacatattcacatgttatatgcaggcaggtcctgcttttactgtgcttgtggaaatccaattttaaaatatattattttaagataaattctcacctgggagtatgttgtattctaacactattatctttgtcttttggggcatatttggcttacatacaagtcaaagaatactagtttaaaaagttgttaaattcaaatttacccaacatatattatctattatatgttatgcattcttttttatatgttatcacaaactacaatttcagcactgtccatgttcttcgttttttagataagaaatggctcggaaaagttaggtaatatggccaaatttacacatctactaagtgtcaatgctgagatgtgaaagtcagtttttctcagtcaaactttaagagtctccttactgtctatgtgaatgtttgtgtcccctcaaaatttgtatgttgagacacaatccccaatgcaatgatgttaagaggtgaggttaggaggtgattagatcaggagggtggagctctcatgagtgggattattgctgttataaaagaggcctgagggagcttgttcaccccttcttccatctgaggacacatagaaggtgccatacatgaggaacaggccctcaccagagactgaatctgatggggccttgatcttggacttcccagcttccagaagtgcgggcaataaatttctgtttatagattatccagtcttaggaattttgttgtgtcagcccaaacaaactaagataaaaatcctttaaccttcatccaatgattgtgtggtaagttattgaggattgattaaagctctttactaggcattgccaatgcttaaagctctaaaatacaaaacagagagacatggatactacttatgcagagatcataaattctattgtttatatgattagactctacgactgttctacttaaatgctaattgaggaatgcaacaccaggtaaggaaaaggtctgagagggtttggttagtatgggttagcatcaggaggaagatttcatgggggaatttgactaatttcttaaaagtttaataatagcaaccatataaataaatatctttgcttttacttctttctttctcccctccctctccttttcttcctttctgtcttctatttgctgcataactactatatgtcatagaatatttgatgacattttcaagtgtaaatagctttcatctatattatctcatgttatccttgtaacaatcttttaggttaaatacagaagtattagcttctcttgctgatgagaaaatctgtaaacattgttttccaagtttttgccctacatacaaatataggacctcaaccccatataacataagttccgtcaagagttgctaaagtccctaagcagtatcttgtatgtgtttataaaccagtctggagctagctgattttccaggttctagcagggtttcttctgaccagtacttcgtttgccatgtcacatttactgggtactaccactcaagaatgcctttgctgtcacttccactggtctcataccactagcacactatgccttcagtttttagtcacatgccaatttcttttatttttaattttatttatttatttatttattgtttactttaagtttggggatacatgtgctaaatgtcaagtttgttacataggtatacatgtgccatggtggtttgctgcacctatcaacctgtcatctaagttgtcacatgccaatttcaagatttaagataggagttcaccaggagcttaggtaagaaaaaacactagtacttggctttgcctcctttattcttaagacttcgttattcagtcaaactcctgctagacttcctttccctaggaatggtttttcctgcttgccttttgcaagcaggttctttgctttttctgaatcctagtggtggtagatcaaggtggaacctatgagtaagaggtaggtcaagaactaaactttttgaattccagaaccaaaaatactgaatgaaaaaaaattaattaagagttctttttcattctaaaataggttttttacaaggctaaacagtgggaacaattttgagaaaggcacagagatgtacaaaagcttaatttataagaaacactagagttcccatatgctgtgaaaggttgctgctgagtaaggaaatgtgtagatgtttgaatgccagacaaagaaatttccaaatctcctttcaatttccttttaatagcccattaaacttttcatgccatgttttcatgccatggtttgtttgtttatttattgagagtctcactctgtcggccaggctggagggcagtggcactatcttggctcactgcaacctctgtctcccgggctcaagtaattctcctgcctcagcctcccaagtagctggattacaggcatgggccaccatgcctaatttttgcatttttagtagagacggggtttcaccatgttggccaggctggtctcgaactcttgacctcaggtaatccgcccgctttggcctcccaaagtattgggattacaggtgtaagccactgcgcctcgctgccatggtttatttgtagacccttatgatatacagcttataatttctacttatttcccatgatttcaatcacttcatgcttataaatacaaagagttttctgtattaaatttttaagatgaatttcattgattaatattatttaggacatagaaaaaaacacaacttaaattcagtgtttataataaaacaagttggtttatgcataatgtattcctatcttctagcaagcatctgctgcactaggaaccccaacactggctttttctgcaaagaaaaaaagtaacaaaaagaaaatatttacagctattttcagatccaaattcaaaattttagcttggactaggactcagtgggacttcattagaattgctgtagagaattggaaaactgaaaagagtttctgcattccctgtgcagcagcaggtctgcagaattcagaataatccccctgggaggcattaagcaacaagtcatgatttctcactttcctgtttcatttgtttgagagggtagttttccttttgtgagagagggtaaaaatgaagttattagttttggtttttgctctcctgcagtatcatgtcaagcttacttacgtctgaagttttcagctgttcctctatctggtggattaaaaaatgtgccctttataaatacgattagtatggagaattgatacattaacagttagctttataaattgacagatttctaaattaacctatggtccacaaatcaagttctatcactatttcctgccaccaaaatcagtgatgaagcctcttccacactaaatgaagagtggcgagggacagaattccacttgtcttccttttgctgcactaactacaccaggcaaagccttcttaaaaccctgatttttctagatacatgtttcttagataagttacatgtttcttagataatctgtaatatatttgactactaatgtagtagtttttaaaaatattggtagaacaacctgatattactttaaaaataaaacagaaaatagtagtggctaatgattcctttttttttctttccaacatttttatgattccaaaaattttctgttgtttttataggatcaaagatttttttaggtaaaagtagaagattttttgtggtgtgagatttgaggagcatgcaccaggttcatcttctcaagaacagtgtcttgcccatccctgagaactgacactccccacttagagatgcatttcctttgtgaattaaggagggcatgctgaagaactggaagtagcaactttattccctcaaagagggaagaggctctccagggtgtctcaatacctttatattattaggtttcacttaatacctttatattattaggtatccacaggttatcctggccttcattgtgcagcattgcatgagacactttagtttccatgcttagctgttagctgcttcaggcagggaacgaggatgctgttgatgaaagatgaaagatataaggaagggaaattaaatggcccctaaattacaagaagggtgataatattacaggctaaggttaagactgtgtaccaagacatttaacgcagtaggttaagaaggcagagtaataaagagacaaccttggcaagtgccaccacaaacccaggaagccaggactcctgcagtgggtctccatgtggtgaagagtcccactcttctgtcttctgactgtgctcctcttctaggtaggaggattttctgggtctaaggggatgtttccacccagaaccctccttctaaactatgccccagcaatcccagaaaccatcacttcatgtccagtgcctacatgaacctcttccccatatccatccttccagttatacccatgcatgttcctctagatccaagcaggatttccatttgtactcttgcccaggcctggaaaatgttaggacagcctgaccatgcttgttcgtaatacacattaatctggaactggtcctgtgtaagtctggaggttaccagagaatgaaggagaatgaagtctaattagttctttgcttatgttcttagggcttaggctgtttaggcctggatttgctcaagaaaattcacacacataaagatcaatgatgtgtatatggagatctgaaaagctgagttttacaactttggaatcaggttgtcttgttacatgggttttaggggagaaaagtggaaggagaaccatccctgcacatcagagcgccagtaatgaataaattattagttaaaagagatagcagggttgagaagagatttgacatggaagggctatattggacatgcttatagtcagagagaagtggtgagtgacaagggaagggaaaatttgctttagtatatactgacattattaaaacaagtactttgagtttattgaataatgaacgttcctctttatatagcaaataatttatcattactttttttggtagcgtgtagagttttcctataatgttttactatccatatactattatatattctatataataaagttcaatttacagactcctcagtgtaggactactaatactaatccatctagtgttgatgactcattgttttgatgaaggcacctgtacatctggagaatattatggatggaattttgtctaccaaaattcatatattcgagggctaacccctaatgtattggtatttgaaggtaactacctttgtgaggtagttaggtttagataagctcatgagggtgggagcctcatgatgacattattacccttagaagaaggaagcttggtctctccctcactctctctgccatgtgtgaacacagaaggaaggcgactatctgcaagttaggaagagggacctcacaagaaactgaccaggctggcaccctcatctttgacttccagcctccagaaccatgagaatataaacgtctgttgtttaagccaccaagtccatggtcttttgttatagcagactaagacaaatatacagacatagagttgataatttggggcataagaatgagtatatgctgaagccctgtagggcttgtcctgcaacttatttaaaatggccctggaagtcacattttttctttgactactaaaggaagcatatgtaactccacagtggaacacagtaacatatttgcttttctgtaaaattaatttgaaagtctgtggatctagcatttttctttctggtgatgcttggtcccaagaaaaccatattctctcctactatgatcagtgttctctgactggacaccattcagaacactagttctaatttatgtgctagtgacccagcaagccacagacttgcatattcacttgagcacatttatttatcttgtatgcaaggttaatggagagcaaggaagttagtccttgctatttcaagaacatgtacatgaacaacttggaagtagcttatttcaaatcgcacacattggtctcaatcaaaataactgtttacagtttatcagatgtggcatgagatccattgccagttggttgagcaaagtccaggcataaacaatggtaaaaattgtgtcttttttgataagattaaaaactatgataaatggttgaataaaaaatcaatgtgggataacttttattatgatggcttgcattcttatccatatgttaaatcagtgttgtcatattaagaagagaaaaaatgattttaaaataattctcagcatgtgtagttgattagaagtagatttccatgaccgggcgctgtggctcacgcctgtaatcccagcactttgggaggctgaggc

SEQ ID NO: 29 - DNA, 12262 bp, Homo Sapiens
aatcagaggaagaacagcctgctctgaggttgaactttgcaaagctgggaatgttccttctttgaaggagatcttagtttaggcattcatttttattttattttttatagagttaatgaaccagtcttacagtcttcctttagccaatgagttaaagaaatctttgcataagtttattcaaatcagaggttccaccaagatatccctgtaaatgcaccttccagagccaatctgtgtgtaggcatggaagcaaacatcctctcttggcttctgcagcaaattccaagtggcaatggaactttaccttcgctgactcttttgtttcttttttcccgtggattctgtgcttttgtttttgtttctggttttggtttttatataactcagaagttatttcctaatgtgccagaaatgtttgtgaatttggttttatagcctatttgatcatcctttttaggtggagacctattctgttgggttagagatgacagaaaatcttatttgtcggttggtttgtttgttcaagaatacactgaccttctacaagaaaggagagctctttgacacctggaaattttacagaagcttgggacagctctgaatggcaacacggtcctgagatatgtgattacctgggactttcattggacctgcatttcagctctactctcctcactgccctatgctgctttgaccctaaaagtgaagccagcttggccaggtgcagtgactcacacctgtaatcccagcactttgggaggccgaggtgggcaaatcaagaagtcaggaaatcgagaccaccctggccaacattgtgaaacaccatctctactaaaacacaaaaaaattagccaggtgtggtggcacgcacctgtagtcccagctactcgggaggctgaggcaggggaatcacttgaacccgtgaggaggaaattgcagcgagccaagatcgcgccactgcaccccagcctgggcgacagagagagactccatctcaaaaacaaaacaaaacaaaacaaaaaaaacaaaaagtgaagccaactcaattgtctcatagaactgatctttacggtgtttttaaataaacatagaaattggccctcccagtcttaaaacttcaaaaacttacatttgtcttacctcagttcctttctcaggaatccaatcatcaaggctcccagatagtatcaatgaacggaaacttaccagatcacgatatctggacaatgagatgtcagatccccctcatccatcctgattacctaactgactacctgcttcctgttggccaactactcttccttacccctccctaattcttgttttcccacaaatggttacatttctgtcctgctatagaagcccttaattttaattggtcgaggagatggatttgagactgattttttgctctccttggctgttgcacctgaatagcctttttccctggcaatactttttgtctcagtgattggctttctgtgcagtgagcaatgggaccaaacttctggtgttttggtaacaaattttggtttcctgactgtgaatgcattgcttgtgactcagctgccatgagctgggagagtttcaaaagccctctaagcagctacctgaccattttggccagaggtggattttcgtctctccccatttgggcccacttctgccaaccccaaccatgttcctgattgcctaggaagaacagcctttgaaatttgacgtctatgtacagaaaggtgagtgtcttttatgggtactagacagtgggaatggttcctctccatttgggaaatcccaaaggcatatcagtttgcaggttaaacaagccaaactgatggagagaggataataccttgactgattcagtttgaacactcttggggcttgttcattgctacagaagttggattgtgttttggtgattgtttgcttgtgtatgtctatgtagttatgggatgtcagggtttgatcccagagtgcagcccacatgggtgcattctttgggttagtctgtatgtagttgtgggttgacagagcaggggaaattctacagccataccactctgagtgtggctgatcttgtctgatcgcgatgtctttgcattgtagtgctgtcttacaattgaattcattttgctgttgaatgggaaagcaggatggaggtccatagacggggttttaccatgctgctgcacactggtcttgaactcctgggctctagtgatccacctgctcagcttcccaaagtaatgggaatacaggaaacaaagacaagtgaagcagcaaacttgccgaacaatctctgccacaccatatgcacttcaaaagaccaaccacagtgattaaagggatgaaaaagatgacctgcttgaaaactctaaagaacccagtattatttgaaagaagaggaagctgaatggtaacttaataactatcttcagatttcaacaggactactacttctgttttatccatttctatagagtttgaaactactaaggaattattctgaaatctttctgtaactagcatatttgactcattttatactaattattataacttttttccatttaaaaagtctgaacttgtatttggcattcttccatttgaaagaataagtattaggaagagataatcaaatagtattactctctttttcttcttcttatatatgaaaagatggtattgtttttcttggcataaacaacctttgacttgttcttgccatttatcagactcaaaaatctgtggattgaagtcttctgttacttagctccagctatgctgtgagttattattgccaagccttaataatattgacaaaaaagggggaaataaacatgttagaagttaaattgcattccttgttactttataaactgaaataacaagacttggagtcattatcttgtagatttctggataaaattaatatgtagggcctttaacttgttttgaatctcttaatgaacattttctatgtgagaagtattgtttagtgctaggtttttgggtaaaagagaaaaaaagagaaagagtaagacaggatatcagagctcaagatgcttctaatctggtggtaaagataatttaatgaattagaggtcggtaagcaacacctaatcatatacatgtgtagtacctcaagggaaacacaaatcctgcttgggcaagaacactgagatagatgtctaaacaggatttcttgtttttaactctcaagtttcacaataacatagctcagttcgttttagtgcccccgtctactctcaaactccatccccgacatattttcatcagactattctttctttctctttgttgagttggtttttgctttgttgttcttatatctgagtttctccttacttataaattttttttacaacttttcacctgccaaagcctcaattttatctcgtttctgctaattgcattcttttatttcctgcttttatgagccactctcctataaaatttctcaatttaaattccagagaaggaacttctgattatccccacttagcttcataccgtattatgtcataggtcccaagccaatgcttgggtcagaagccaatatgcattcaatttagacttactcattatggcttctcctgcaacaggaactgtggtcctggcagtttcctctggaatgagataaggcatagcaagtatcgtaatgtgctgttaaattttgaagaaagtatggaatttgaaaaattgaaaagaaaaagataaggattgaaggaacatttggagacaacccagatatgctgatgaacacagtgaggatagggcttggagagatctactttatctagggagaaagcatgctcagtagtggaaacacttctggttaggcagggtgagaacaggaactagcagctctctaaagcaagccaagactttagactgattgttcttgagtccataacttaacaaacaatagttaagggaatttagttgtcctatgtgcctattaaataactggataggggttttaaaatcattttttaaaaaagcaattaaaaatacctttcattttgattagtaagggaattttttaaagagaaactcaggacatatttgactgtaggaagagattatactcctttcacttagaaaaatacataacactggaggagctagatgtgataaaccaggaaatagaaaaagtgccattgtaagtatagacagatatcgggggaaattcagccagatattgggcaaaattcacccccgatatttcatgtaggttcttttctattttccctaagcatcagccggtttgagaaataaagggacagagtataacagagagaaattttaaagccaggtgtctgggggagacatcacatgttagtaggttccgtgatgccccacaagctgtaaaaccagcaagttttcattagggattttcaaaagaggagagagtgtacgaatagggtgtgggtcacagagatcacgtacttcacaaggtaatagaatatcacaaggcaaatggaggcagggcgagatcacaggaccacaggaccggggcgaaattaaaattgctaaggaactttcaggcaccattgtcattgataacatctgtcaggagacagggtttgagagcaaccggtctgaccaaaacttattaggcgggaatttcctcgtcctaataagcctgggagcgctatgggagactggggcttatttcatccctacagctcgaccatagaagatggccacacccaagggggccattttagaggcccaccctcaggggcgcattctctttctcagggatgttccttgctgataaaaagaattcagtaatatttctcccatttgtttctgaaaggagaaatatggctttgttccacccggctcactggcggtcagaatttaaggttatctctcttattccctgaacattgctgttatcctgttcttttttcaaggtgcccagatttcatattgtccaaacacacatgctctacaatttgtgcagttaacgcaattatcacagggtcctgaggcgacatatatcctcctcagctgacaggattaagagattaaagtaaagacagccataggaaatcataagggtattgattggggaagtgataagtgtccatgaaatcttcacaatttatgtttagagattgcagtaaagacagacataagaaattataaaagtattaatttggggaactaataaatgtccatgaaatcttcacaatccatgttcttctgccatggcttcagctggtccctccattcggggtccctgacttcccgcaacagacagagatatttatatttcagcctgaccctaatcctaacccaaattctaattctaaaagagatcacatttaaaatatatctttattttggaagaattgcaaagctaaacttttctaaaatcctagtctttagcgagacaatgttattttgagttaagtcaaaaattttgcacacacacatgcacacatgcatgctgtggctgtcttgtggcttttccttgaaatgggtatgtgattatattattttccccctccctttagaaagacataacacatgtcattggtcattattttgccacatggtgaccctagtttaaagttttgttctatgttcatgttaaaggagaaaaaatgataaatgacaatgtaatcaagaaattgaatataaacttgccgattcgtctaattacagagtttagtgctgtgggttccaatttgtctcttcctagacagttgctttgtatccatgaatgaatgaattcgtagtattgaaaacctgctcccagtgctatgtaatttatcaaataatatgtgtgagtataagatataactgctgcccacaaaaactcataatttatttgaggacacaaaactcatatacataaaataattcatgaatgagacatattcacatgttatatgcaggcaggtcctgcttttactgtgcttgtggaaatccaattttaaaatatattattttaagataaattctcacctgggagtatgttgtattctaacactattatctttgtcttttggggcatatttggcttacatacaagtcaaagaatactagtttaaaaagttgttaaattcaaatttacccaacatatattatctattatatgttatgcattcttttttatatgttatcacaaactacaatttcagcactgtccatgttcttcgttttttagataagaaatggctcggaaaagttaggtaatatggccaaatttacacatctactaagtgtcaatgctgagatgtgaaagtcagtttttctcagtcaaactttaagagtctccttactgtctatgtgaatgtttgtgtcccctcaaaatttgtatgttgagacacaatccccaatgcaatgatgttaagaggtgaggttaggaggtgattagatcaggagggtggagctctcatgagtgggattattgctgttataaaagaggcctgagggagcttgttcaccccttcttccatctgaggacacatagaaggtgccatacatgaggaacaggccctcaccagagactgaatctgatggggccttgatcttggacttcccagcttccagaagtgcgggcaataaatttctgtttatagattatccagtcttaggaattttgttgtgtcagcccaaacaaactaagataaaaatcctttaaccttcatccaatgattgtgtggtaagttattgaggattgattaaagctctttactaggcattgccaatgcttaaagctctaaaatacaaaacagagagacatggatactacttatgcagagatcataaattctattgtttatatgattagactctacgactgttctacttaaatgctaattgaggaatgcaacaccaggtaaggaaaaggtctgagagggtttggttagtatgggttagcatcaggaggaagatttcatgggggaatttgactaatttcttaaaagtttaataatagcaaccatataaataaatatctttgcttttacttctttctttctcccctccctctccttttcttcctttctgtcttctatttgctgcataactactatatgtcatagaatatttgatgacattttcaagtgtaaatagctttcatctatattatctcatgttatccttgtaacaatcttttaggttaaatacagaagtattagcttctcttgctgatgagaaaatctgtaaacattgttttccaagtttttgccctacatacaaatataggacctcaaccccatataacataagttccgtcaagagttgctaaagtccctaagcagtatcttgtatgtgtttataaaccagtctggagctagctgattttccaggttctagcagggtttcttctgaccagtacttcgtttgccatgtcacatttactgggtactaccactcaagaatgcctttgctgtcacttccactggtctcataccactagcacactatgccttcagtttttagtcacatgccaatttcttttatttttaattttatttatttatttatttattgtttactttaagtttggggatacatgtgctaaatgtcaagtttgttacataggtatacatgtgccatggtggtttgctgcacctatcaacctgtcatctaagttgtcacatgccaatttcaagatttaagataggagttcaccaggagcttaggtaagaaaaaacactagtacttggctttgcctcctttattcttaagacttcgttattcagtcaaactcctgctagacttcctttccctaggaatggtttttcctgcttgccttttgcaagcaggttctttgctttttctgaatcctagtggtggtagatcaaggtggaacctatgagtaagaggtaggtcaagaactaaactttttgaattccagaaccaaaaatactgaatgaaaaaaaattaattaagagttctttttcattctaaaataggttttttacaaggctaaacagtgggaacaattttgagaaaggcacagagatgtacaaaagcttaatttataagaaacactagagttcccatatgctgtgaaaggttgctgctgagtaaggaaatgtgtagatgtttgaatgccagacaaagaaatttccaaatctcctttcaatttccttttaatagcccattaaacttttcatgccatgttttcatgccatggtttgtttgtttatttattgagagtctcactctgtcggccaggctggagggcagtggcactatcttggctcactgcaacctctgtctcccgggctcaagtaattctcctgcctcagcctcccaagtagctggattacaggcatgggccaccatgcctaatttttgcatttttagtagagacggggtttcaccatgttggccaggctggtctcgaactcttgacctcaggtaatccgcccgctttggcctcccaaagtattgggattacaggtgtaagccactgcgcctcgctgccatggtttatttgtagacccttatgatatacagcttataatttctacttatttcccatgatttcaatcacttcatgcttataaatacaaagagttttctgtattaaatttttaagatgaatttcattgattaatattatttaggacatagaaaaaaacacaacttaaattcagtgtttataataaaacaagttggtttatgcataatgtattcctatcttctagcaagcatctgctgcactaggaaccccaacactggctttttctgcaaagaaaaaaagtaacaaaaagaaaatatttacagctattttcagatccaaattcaaaattttagcttggactaggactcagtgggacttcattagaattgctgtagagaattggaaaactgaaaagagtttctgcattccctgtgcagcagcaggtctgcagaattcagaataatccccctgggaggcattaagcaacaagtcatgatttctcactttcctgtttcatttgtttgagagggtagttttccttttgtgagagagggtaaaaatgaagttattagttttggtttttgctctcctgcagtatcatgtcaagcttacttacgtctgaagttttcagctgttcctctatctggtggattaaaaaatgtgccctttataaatacgattagtatggagaattgatacattaacagttagctttataaattgacagatttctaaattaacctatggtccacaaatcaagttctatcactatttcctgccaccaaaatcagtgatgaagcctcttccacactaaatgaagagtggcgagggacagaattccacttgtcttccttttgctgcactaactacaccaggcaaagccttcttaaaaccctgatttttctagatacatgtttcttagataagttacatgtttcttagataatctgtaatatatttgactactaatgtagtagtttttaaaaatattggtagaacaacctgatattactttaaaaataaaacagaaaatagtagtggctaatgattcctttttttttctttccaacatttttatgattccaaaaattttctgttgtttttataggatcaaagatttttttaggtaaaagtagaagattttttgtggtgtgagatttgaggagcatgcaccaggttcatcttctcaagaacagtgtcttgcccatccctgagaactgacactccccacttagagatgcatttcctttgtgaattaaggagggcatgctgaagaactggaagtagcaactttattccctcaaagagggaagaggctctccagggtgtctcaatacctttatattattaggtttcacttaatacctttatattattaggtatccacaggttatcctggccttcattgtgcagcattgcatgagacactttagtttccatgcttagctgttagctgcttcaggcagggaacgaggatgctgttgatgaaagatgaaagatataaggaagggaaattaaatggcccctaaattacaagaagggtgataatattacaggctaaggttaagactgtgtaccaagacatttaacgcagtaggttaagaaggcagagtaataaagagacaaccttggcaagtgccaccacaaacccaggaagccaggactcctgcagtgggtctccatgtggtgaagagtcccactcttctgtcttctgactgtgctcctcttctaggtaggaggattttctgggtctaaggggatgtttccacccagaaccctccttctaaactatgccccagcaatcccagaaaccatcacttcatgtccagtgcctacatgaacctcttccccatatccatccttccagttatacccatgcatgttcctctagatccaagcaggatttccatttgtactcttgcccaggcctggaaaatgttaggacagcctgaccatgcttgttcgtaatacacattaatctggaactggtcctgtgtaagtctggaggttaccagagaatgaaggagaatgaagtctaattagttctttgcttatgttcttagggcttaggctgtttaggcctggatttgctcaagaaaattcacacacataaagatcaatgatgtgtatatggagatctgaaaagctgagttttacaactttggaatcaggttgtcttgttacatgggttttaggggagaaaagtggaaggagaaccatccctgcacatcagagcgccagtaatgaataaattattagttaaaagagatagcagggttgagaagagatttgacatggaagggctatattggacatgcttatagtcagagagaagtggtgagtgacaagggaagggaaaatttgctttagtatatactgacattattaaaacaagtactttgagtttattgaataatgaacgttcctctttatatagcaaataatttatcattactttttttggtagcgtgtagagttttcctataatgttttactatccatatactattatatattctatataataaagttcaatttacagactcctcagtgtaggactactaatactaatccatctagtgttgatgactcattgttttgatgaaggcacctgtacatctggagaatattatggatggaattttgtctaccaaaattcatatattcgagggctaacccctaatgtattggtatttgaaggtaactacctttgtgaggtagttaggtttagataagctcatgagggtgggagcctcatgatgacattattacccttagaagaaggaagcttggtctctccctcactctctctgccatgtgtgaacacagaaggaaggcgactatctgcaagttaggaagagggacctcacaagaaactgaccaggctggcaccctcatctttgacttccagcctccagaaccatgagaatataaacgtctgttgtttaagccaccaagtccatggtcttttgttatagcagactaagacaaatatacagacatagagttgataatttggggcataagaatgagtatatgctgaagccctgtagggcttgtcctgcaacttatttaaaatggccctggaagtcacattttttctttgactactaaaggaagcatatgtaactccacagtggaacacagtaacatatttgcttttctgtaaaattaatttgaaagtctgtggatctagcatttttctttctggtgatgcttggtcccaagaaaaccatattctctcctactatgatcagtgttctctgactggacaccattcagaacactagttctaatttatgtgctagtgacccagcaagccacagacttgcatattcacttgagcacatttatttatcttgtatgcaaggttaatggagagcaaggaagttagtccttgctatttcaagaacatgtacatgaacaacttggaagtagcttatttcaaatcgcacacattggtctcaatcaaaataactgtttacagtttatcagatgtggcatgagatccattgccagttggttgagcaaagtccaggcataaacaatggtaaaaattgtgtcttttttgataagattaaaaactatgataaatggttgaataaaaaatcaatgtgggataacttttattatgatggcttgcattcttatccatatgttaaatcagtgttgtcatattaagaagagaaaaaatgattttaaaataattctcagcatgtgtagttgattagaagtagatttccatgaccgggcgctgtggctcacgcctgtaatcccagcactttgggaggctgaggc

SEQ ID NO: 30 - DNA, 2239 bp, Homo Sapiens
tgctttcaggataatgaccaaattccgtgatctgttccctgtttaccaagctatccaaatttatctcttggcttctattcccagccccaatttccatcccacacagtacgctccagatacactcgcaattcccaggattcattgtgccatcttgccttcatatgtttctctgtgctagaaatgccttccactttctccaatctgcctctttgttcaaaagccaattcaaacgtctctgggaagtttcccacaccacgagaaaagctggtctgtgcctcctctgcgccttcactgccgcgctttcctagccagattttgcaattgtatttctgcaattactcaaacgtgtttccttctgaccagacaaagctccccaaggccggacttcattcatctttactcctaatgcttgaggaagggcacatgagttgcagatgcttagtgactattttttttagtgatagactcatgggggaaggcagcttagctatagctaagacaaccttggggtgtgcaggtgggggcggtgaggtgacttccaaccagaaaagaacttgtaaatctataggcataggtcataaactgagcgtgtgtttcacccaaagatgtgttcatttctctccagggggacatagctgggggtgagagaagcgtggaggacacaagattttggcattgaaaaatagcaaagagtctaaaaatgttattcctggaagggacattcaagatcataaaacattaggacaagactgcatcttttaaatgtacattttaaaatatgcttcaacactctgctattgaggacactggctcagaaaggcggaactgactgcattaaggccataaaacaatttagtggtttcttcacccttttttttccctaagagacagggtctcactttgttgcccaggctggagtgcagtagcataatcacagctcactgcagccttgacatcctgggctcaagttaatcttcccacctcagcctcccaagtagctgggactacaggtgtgcacccccatgcctggctggtttttaaaatttttattattttttttttaatgtagagacagaggtctccctatgttgccctgcctgatctcaaacacctgggctcagccatcttcccctgcctcggcctcccaatatgctgggatttcaggtgtcggccgctgtgccatttcactttccccacagtattaagtcatagatgccattcatttccatgctatactgtcttttaatgattgccatatagtatttctttgtaacagaaataggcacttgaattccaattttaatttttaatttctcgtgaccataaactctgaagtgttacttcttctggctagaattaccattagagttattagacctaactgattgaaaccacataagtacaatacaaatttgataacagtttgcatatggagagttacattttatttattgagatggatttttaaaatgtatgttcatgtttacattgataaatattattgattcctagattggaacaggagtcactatcaacactatccttatttttttattttaatccatatatgagtttagaagcctttttcacaaaattatgtggaactggaaagagttttattattacagtgtcactcaattctttggattctttccaagatgcttggcaaaaatcacttggagctcttttattgaaaatcagtgaacagctccatcagttcctccttcagcgttgtatcatggcaacgccttttctctaagtctgttcccctgaaggagctttgctgtgatttgaatgtgtcccccaaagctcatatgttggaaacttaatatccagtgcaactgttttgagaggtgggacctagccaggcatcgtggctcacatctgtaatcccagaactttgggaagttgaggtgggagggtcacttgagcccaggagtttaagactagactgggtaacaacatagtgagaccctgtctctagaaacaaaaacaaaaaactaaattaactgagcatggtagcacatgcctgtagtctcagctattctttaggctgaggtgggagagttgcttcagccggtgtgggtgaggccatagtgagctgtgattgtgccactacacaccaacctgggtgacagagtgagaccctgtcttaaaaaaaaaaaagagagaggtgggatctttaaggggtaattaggtcatgaggactcttccctcacgaatggattaattccattat

SEQ ID NO: 31 - DNA, 4631 bp, Homo Sapiens
atcctttttctctctcacatacacatataggcatgcatacagacattctcattctctttctctctctccccccacccctcccttttctcacacagacacattctctttgtctctcacccttgccccctcctctgtgtctctcacacacattctctctccctccttccctctctctcacacacagatgcatacatacacacgttttcattctctttccctttctctctctcccctcctcatctctcttcctctctctctctcacacactttctctctccctccttctctcacacacacattctctctctccccctttttctcactcatctctctctcctctgtcatctctccccccaacacacacgcattttctctctctttccttggcttcctctctctttcacacacacacatatacacacacacgtgcataatctcattctcattctctctctcctcctctccttcttgctcacacacacacatacacacacttacacactctttcattctctctctccctctacccttcccatctctccttctctctttcttcctcacacattctctctcgcccctcctctttcacactcacattctctctctcactttctctccctccctctttcctcactccctctttcacacacacacataatctcactctcattctttctccccctccttctcagtcacacacatgcacacagatacatacacacattctcactctctctctctccgccttccccaactttcttcctctctctctcacaaacacacatctcctttccgtctccctccttctcttcccgtctctctctgcctctctgtcacacacacatacacactttctcattatttctctctctcacacacacagatacatacattctcattctctttctctcacacacacacattctctttcacacacaaacacacacacacattctctttctccctctccttctctcttccttcctctcatgctgggggaatcaagatggctatattgtgagctgccctatagagaggcccatgtggcatggcacacccaaggaactgagacactcagtccagcctttcacaagaagctgcagcctcaccaacaccaggtgagtgagcttagaaatgggtcatccagatccaggcgagtcctgatgactgcagccccagccaacagcttgactataatctgatgagaggccttgagtgaggaacacccagccaaacacctctcagactcctgatccacagaaacaatgaggtaataaacattcgttgcttaaagctgttaatttaggggtaatttgtcacatagtaaattataaccagaacaccttgccagcccttaattatttatcatttatttatatttttgctaatctaatgtgagtactaccaatgttgacatctgtatttgtgtcagtatgtgtgtgtaaattgcttcaaatcctttgcttatttttctattaacctgtctatcctttcttgttgttttgtaggattctaatgtatttaagattaatgctttatttttcatacatggtgcaaatatttttttccatctgtttaaccaaacataatttataattcatgtgcagttgagtttgctgattatgtctcttgtcatgtttagatttgtattattattagaaaagcattacagttccaagatacgtaatattttcatgtattttcttccaaaatttcagagacttgttcagtatttagcttcttaacctgcccatagtacattatttctagtgaggttatacagagagctaaataaaactttccagattgataatcagttgtcaaaatatcaatgtgatatagtccatccatttttataagttgaatcattataaaaacatgaatatttctgaactctatattatgtaccatcaattttcttactgtttcctgcaataaccacactgtttaaattgctataattctgtaatatgttttgataattggtgggattagtttctcactggtcttcctttcaaatgttgtcttagtgttttgcgaatattttttccataatgaatttaaagtaatcctatacattccttagaaattatatttagagtttaattttcagataaattttaacatatagaataattttggggagagtttacctctttcaaatactgaatacttcttaaccaagaacatagtataactttttctttttttcagggcctgtgttatgaccttcaatagacttctatattctaaataggttttacaagttttcttgtcaggcctaaccataagtatttaatgagttttgtggctgttctaaatggactcatttttctattacattttaaattcatcattgctggtgtataagaaagctattaattttttaatattgatttattttaatctggctactttcctggactcttactagttcttacagttttttattgattcttgctgatttttttcttttggtggacaataactttatctttgtcatgtgtgtatatatatgtgcttgtatatgtgtctatatatatatgtgtgtatgtgtatatacacacacatacacacattttgcttttattttattgcatggaatagcatcttcagcaaacatcaatattgacgtggtagctgggaaccttttcttatttctgatttactgcagattatcttcgtattagctttcctgctaccactataacatattaccacaaactttgtaacttaacccaccacaactgtatttccttacagttctggaggtctgaattcagaatgtgatgtacagggctataatcaaagtgtctgcagggctggttccttctgaggggaacatgctctcccttctgcaagggaggatctgttccttgtctctatcagctgctataagccacctgcattccttgggtcaacgcttcttcttcataacgctccaacctcttgcttgcttccatcatcacattgccttcacctctgtctaaattcctatcacccagataattcagaataatctctcagtctcaaggttcttaacttaatcacatctgcaaaccctcttttaacacgtaaagtaacacattcacaagttccgggaattaagacatttttgcggggaggggacattgttaaacctaccacgcttaaaatatttcactattatttatgaagttttcttaaggcttctggtagatttttttaagtcactttcaagagtatatttctataactcgcttactaagagcttctttcttctgagtcagtaacaaatattgtaatgaatcaaatcatttattcatccatattgagatgtttattcactgttctcttttgttaatgtactaattaaattaatgcacatgtttcataatttgaaatacttttgcactcccagtatacaccttttgggcataatgtattaatattagtctgctaacacattcctgaaattaatttgtgaatagttcatttataattttcatatctgtattcacaagttttcttttctgtgctttttttgttaaatcttgatatcagtgttatattactcccataaaattattttaaaaaaattctatttctttatgtcagtcgaaaaacattacataacaaagaagttatctctataaaggtacagttagcctcacccataaaacatcctgcacctgatttccctttatcgtgggcaataagctctcaatatttcccctgacattatcaatatttctgctattccttaggtgaacttttgtcatttgtgtcactagcaaataattcttactaagatgcttaatttataacataaaccgtacttatgtttgatatggtttggctctgtgtcatcacccaaatctcatgttgaatttaattcccagtgttgggggaaggacctggtgggaggtggtggttacatcacgggagcagatttcccccttgctgttctcgtgatagtgggttctcatgagatctgattgtttagaagtgtgtagctctttcccctttgctctctctctcctgtttcagcatggtaagatgtgcctgtgtctcctttgccgtccaccatgattgtaactttcctgaggcctccccagccatgcttcctgtacagcctgcagaactgatggaacaccaggctatagtttcaggaagccagacttgacccagacttgaccttgcaaaaaatagcaaccccttcagaactggtaaagcaatgagaaagaattgctcagaacttcatggagctgagccattcacccatcctggaacatccaccttcctctggaattatttttttaatgttttcttccttcttgtttaatccactaattctctctcttttcctctgtttctctctctctcatctctgttcctttccatagcaacatagactatatatgagtaaatatttgaatatatttaataataaaagtacatacacaaatatttacagaactgctcaatcagaaaaaatacacttaataaataattgttcaccaatggccttgatgtgctgtaatttgtatttccaccaaatgagtcccagttaccttttatgtgtattttccatgcttgttcacctatttgactttatactaaaattatattaaatttctctctaatgtttt

SEQ ID NO: 32 - DNA, 36328 bp, Homo Sapiens
agtcaatgctagaaatggacgtttagttattgaatcccgctaacgaggggagccaacaagagagggatgtcggcatcgggtgtgcggttccaagaactgattggctgtggagattagaagttaggaacctttgcaacggaaagcggcctcgggcaggcgccttttgagcagaggagtaaaaccgccagagcgtctcatctctgggcccggagccccaggctcgttctcctcagcccctgccggcggcggcgctcttgcagccattcctgtgaggtcgtttttcggagcagccgggccggccgaggagtaagtaggcgccagagttctagctcgggcatctgcctcggggccctgtcgccgccgcgccccggatcctgcgttggtcctgtccgataaagcggaggtcggccctgcttgctgacgagaccgtaaaaaccacggcgcttggcgccctgccgccgccacaccacaccaaagtgtacctgcccgaggctggcttcgggcgcgagcttgcatttgtgactttctcttaccgtctttgtttgcttcgttttaagtattacttccagataagggacacattctcgaaatactttgaaaacagttttgaattttgttcctcccgttgaaacggattaaatttggacctttcaagctacactgtgcaatcatcaatctcaataagctcttaataggctcattcttccgtaggctacaaacaaaataaagatcataacatcctgcggaggaagccattggtccatgtagagtcgccagatgtcaattaagagtagatcgcttttcagagaatacttaacgactctggtttagacctagacttggaactttgaggtgtttggaacactgggcagaattttcctttgttacaaaacaaagtttatgagaacgtaatttgtttttgttgtttttgttgttagtattgaagcaattttggtgcaaaccaaaggataacaaagcaaaacaatgaaaatcacccagagttccattacccacactgaaccaacttgaatatattggtttattttggcttttttccatatgaaatgttaaattttcttgtactcacgtgtagaatatgatagtttgctctttcatgtaacatgtctcccaatttttacatacataattctagtttcagtaagcatttttataactacactctttttcctttgttattgtatgtctaggttatttcaactttgcactgttgcttgtaactactatgtgatgaggcagtagctagattagtatttagaacgtgagcattcaagtcaggcagacctgggcttcacaacttactgtgcaatttcaaagagtttaacttttttgagcctcattttacacagtaacatggggataatggttctgattgcatagaattattatgagagtaagatgaaataatgagtggaagtgcctgcagcatgtattgttagtaaatgctgtattactgcaggcaaatttttcttttgttgtggttttttggtgacatgtatgatttatttccagattttgaatatacttaaatactattaaccacagtaggggtatggggtttgatccacagcttttcatatattttatacaatatattgtgtgtttgatacacagcttttcatatactttattataagtaacacatgaattagaaataatttttcacaataggaaaaactttttaaaaattaaaatttataatcctgctaaccgtaggtgaatagtcacattttgggcaatccttttttatgcatatatatgtagtggttttattttattttattttatttttattttttgaaacggagtcttgctctgttgctcaggctagggtgcaatggtgcgacctcggctcactgcaacctccgcctcacgggttcaagcaattctcctgcctcagcctcccgagtagctgggattacaggcgcccgccgctgcgcccggctaatttttatatttttagtagagacggggtttcaccatcttggccaggctggtctcgaactcctgacctcgtgatccactcgcctcagcctcccaaagtgctgggattacaggcatgagccaccgtgctgggcctgtagtgttttctaaaaatagaattatattataaattgggtttatcaacttgctgaaaatggcagaggccagtgcgatgagagtagggtgattaagggagtaggaagtaatgcaggaaagggagtttgtaggatttagatttcactgaaagtgtactggacaggttgggcatagtggctcaggcctgtaattgtgtcactttgggaggctgaagtggaaagatcccttaagcccaggagttcgagccagcctgggcaacatagggaaaccctatctctataaaataaaaataaaaataattattttgaaaaaaaagtttactggacagagtaagttcagggttgaggagtgacctgatttgttttagaaggctcatttggctgccatatggagatagactgcaagggaccaggggaggaagatgcaatccaattaggagagtatttaagtaatctctgtgagagatggtgttagtttcgatcagggtgtaagtagggaaaaatgattgggttctggatatattttgaagggagaagttataggattcactgattgatgggatgtggaattcaagagaaagtgacttaaagaattttggtttgggcagttaaacagatacagttgctacttaccaagatagagactgaaagttgggggaaactaaatagagttctgtttcagtcatgttacctgttgtggagtctaactagttggaacaggagtatgaaagacttaatcttctgttcttgaggtatcaatttgtcccttcatttctgtcagtttttgctacatatattctgttactaggtgcatctatccttgtaaattgttacatcttccttgtgggtttatccttttatcattaaaaatgtttctctttttctctagtaacattgttttaaagtctattttgtctgatattaatgtagctatttcagttctcacgtgattactatttacatgctttgtatcattgactctaaaatgtgtctcctgtagacatatagttggatcttggtttgttttttgtttgtttgtttgttttttgttttgagacagagtcttgccctgcctccttggctggagtacaatggcgtgatctgggctcactgcaacctccacctcccgggttcagacgattctcccacctcagcctccccagtaactgggattacaggggcccgccaccacgcccagctaatttttgtatttttagtagagacggggtttcaccatgttggccaggctggtctcaaactcctgaccttgtgatccacctgcctcggcctcccaaagtgctgggactacaggcatgagccactgtgcctggccggatcttgttttttttaatctgataatttctgccttttgatccaattgtttaatcattcacatttaatgttattgatatagttggatttatgtatgccatcttatttttgttttccttatgtcttgtctttttcttttcctgtctctcctttactgctttgttttggatcaagtgaatatcttctaatgtagcattttaatttcttgaatgattttttacactgttttaagttttttttagagactgtagtggtgctctagggcttaccgtacaattagcttaacttattagaatcagcttcagatttatactaactcaattgcagtgagatatagaaaccttactccaatatagttttattccatgtccctgtttttttgtggttttgttgttgtacatgttatagttgttacaaactcaacaatacattactacaattattacttttacatcatttaaagaaaatgaacaaaggaaagcaaatatatatttgtagcttttgttatagtaaccttatttatcatttcaggttgtttgtttatttttcttgtggattcattaccatctggagtaattttgttttctttttctttcttttttttttttttggagggataacagggtcttgctctgttgcccaggctgctggagtgcagtgtcatgaatatatctcactgtagcgtcaaactcctggactcaaagtgatccttccacctcaacctcctgagtagctgggactacaggcacatgccaccaggcatggctaatatttgtattttctgcacctcagccttctgagtaactatattactctataagcacacatcaccacacccagctaatttttaaattttttatagagacagagtctcactgtgttgctcaggctggtctctaactcctggcctcaagtgatcctccagctctggcctcccaaaagtgctgggattacaggcatgagttctttgtatgagttccttgtatattttggatattaaccccttgttagataaaaggtttttcagtattttctcccattccgtggactgccttttcattttgttgtttcctttgctgtgcagaagcttttttgtttggtttagttccatttgcttatttttgcttttgttgcctgtgcttttggtgtcatttacaaaacaaacaaacaaaattattgccaagactaatgtcatggagcttttccactgttttcttctagttttacagtttcatgtcttacacttaagtcttttcacttttttttttttttgagacagagtctccctctgttgcccaggctggagtgcagtggtgtatgatcttgactcactgcaacctccacctcctgggttcaagtgattctcctgcctcagcctcccgagtaggtgggattataggcatgtgccactgtgcccggtttatttttgtatttttaatagaaatggggtttcaccaggctggtcttgaactcctgacctcaagtgatccacccgcctcagcctctcaagggactaggattacaggcaagagccactgcgcctggcctcttttaaccattttgaattgacttttgtggatggggtaagataagggtccaatttcatttcttggcatgtggttatctagctttttcaacaccatttattaaagagactatcctttctttattgtgtacttttgacacctttgttgatgattagttggccacataaacgaggatttatttctgggattcctattctgttccattggtctatatgtctccttttatgccagtaccatacagttttgattactgtaggtctgtaatataatttgaaatgaagtgtgatgccaccagctttgttcttcttgctcaggatcattttagatattctgggtcttttgggttctgtatggatgttaggaattttttttttttttctgtgaaaaatgtcattggagttttgctagagattgcgttgaatctgtagactactttgtgtattgcagacattttgacaataatgattcttctgatcctgaacatgggatagctttccatttatttgtgtcatctccagttctttcatatatgtattatagcttttagcatacacatctttcccctccttggtaaaacttattcctaagtattttattccttttgatgctattgtaaatgggattgctttcttaatttctttcttggatacttcactgttagtgaagtgtaattgatttttgtatgttgattttgtatcctgaaactttactggattcgtttattcattctaacagtttttagtggcgtatttagggttttctgtatataggatgatgtcacctgcagagacaattttacttcttcctttctgatttggatgccttttatttcttttccttgcctaatttctgtggctaggatttctagtactatgttgaatgtaagtgataagtgtgggcatccttgtctgtccttgtcacattcagttgtatgtgcaatactggaaccatccagctcatagtcacgtaattcctctttgtgcagcctcatgtaaaatcacacccctattcacatttttttctgtctgtctcccacctctccaggtccctgccctgcaactttcagttacttcagactctcagaagactagcctctaaatacctcaatttatctgcactactgtggtctacttgaaattctcttccctcttctgcagtttgtaatggcattcaggccaaaaactgtagtagttttagggctctcttcatttgcttctctgctcctagggatcatagtgctgtgctatctgttgtccagcatctgacacagttggttttatattttgtctggttttctagttattaagcaggttaagtctggttcctgctgttctatatagcaggaagcaaaggttctctcatgaatttttagcataataacataagcgtggattccaaaaattcattacacagatcctggaaatctgtttactatgttttatacattctgtgaaagctggagaatatatatttgttttactatgtgtatcgcaaataaaatatcaatttcatgtgccagagaattgaatacattatcaaagggtcatttcataacgttataatcaccatccatcctgtaagtcctttgaaatttcttcttttctatggatctaacattgatcaataacgaattcctaagcatctatattagttagcccagtgtttctcaaagtccaccgcatgtaaaaatcatctagggaatctttctaaaatgtggattctgatttagtaggtctggggtgaggtcttcccttttgcaattccagcaagttcccatgggatgctggtactggttaatggaagtcacttagagtagcaaggagcctgtttgcctagtatttacaatgagcacgttttgggtatcatcaaaacaagagaatctaaaaatgtatggtgtgggtggaaggttgtgttacttgatatttcaaaaagatcattgaaatcagaaaatctcagagatatgttggatttcatcacatttattctatggcttaatgttgttttattttgaatatataataagagagataccacaaatctttagctattaatatttagggatgttaatgtccttaattcatattgtctcaaatgtgattcattccctctataggtatactaaaacaggcattcatgcctacaaaaccatcttcctaactttctttcctctttttagtctcttcctgaaccagtgacagtggttctcaaacattttggtctgaggacccctttatggccttaaaaatgatcgaagagcttttatttatgaaggtaatacctgctaatacttgttgtaatctattaacattgagaaatgtaaaaatttttattaattcacttaaaatatcaataaacccattatttgctaatataaattgcactttttaatgaaaaataactttagtttctactgtgtgcttctgcattttgaaaatatgtctaggatacggtatgtatttaggagatattttctaaataaatgcatattcattttttaaaatgggacaaatgtagcatagacatatttttgctaacaatatccatatagttgcaaatttcacttttagaatttgctttcaaaaacaggttgtttattcttctttgttatgccttagttagtaaatcatatattataaaacttcttcaatgcaattggtctttggtcagccattgacataggaagagttagaaagagtccagggctccttggtactggctgtgactggataagtaggttgtggcttagtttgtgtttaggtgtcataactaggctaggtttgggtcccagaaagtgctagccttactgtaggagaggaagtggtattgctgggtgtgtcctcaggtcaggaagtgggacgagtgcagtatggaagcccaggggggtccttgtgactggaggaaaggtgaggtttccagtaaaggattcagaattcgggcatggtgcagcatgcctatagccccagctactcaggaggctgaagtgggaggatcacttgagaccaggagttcaaggttgcagtgagctgtcattgcgccactgcaccccagcctgggtgacagagtgagacctgtctcaaaaataaatacataaaaataataattaaaaaaaaaggattcagaattctagaatacatattatctttctatcatgcagatctgttcttaggattgtattttccaaatcatgaataaaataatttccaaaatacttattgggaaattatatatatgtactgtattacttggaataaaaatcaaataaaagtcaaacttcttaatgtggctgtaaagccttgattatttaaaccttgcctatttttcagtttaatctttcagccacactggcccttgtgttaatcctaaaacatgccatgctttttcctacattaaagcttagggtttttgatatttctactgcctggatttctctgttctcactcttcctcttgatcaccatgacttatttttcaagtgttggcttaaatgtccgtctcacagatagcccttatctaaataacagctttccctctggttcctagataaattaggacctgtttttttctataactttcttaaagtatcctattattttccctgataaaaccttgttggactgtttgtcagtatatttatttgcctgtttgtttggtgtcagtttctctttttttcctgtgtgttttgtttgtttgtttttttgagacgcagtttcactctgtcaccaggctggagtgcaatggtgcaatctcggctcaccacaacctccacctcccaggttcaagcaattcttctgcctcagcctcccgagtagctgggattacaggcatgtgccaccatcctggctaattttgtatttttagtagagacagggtttttccatgttggtcaggctggtcgcaaactcccgacctcaggtgatccgcctgtcttggcctcccaaggtgctgagattacaggcgtgaaccaccgcacccggcctgtttgtttgttttcttattagactataaactatatgagatcagaccatgtctcttttgtttatcactctggcctacctgctaacacagtgcttacacataatagtaggtgctcaagaaatacagtgtttgatggatgaacgtaaaattgtaagagcctgaactagtgtaatatcgaaaatagggaggaagacatgaattaggaaagcctttgaaaaattagcatgttctgtgataaagctacatctaggcaatattttttgatacttttaaaaaaaaaactgtaatagctacccaatatttaggaatgatacacatcacacatctcagtgaggtatgtagccttttgtactggtgaagagagccaggtgaagtctaactctaaggatctaaacactccattctagtagagagcctggagaagtgctcttgcataagctcatccatgtaagaccatccataacttagtgaaataattttcattgctgtttagttgcaaaaatcactcactgttttgcctccataagattatcggttttagtgtttaatcgttcacagccttgtcaaaaccaaaatggctagggagagaactatttccctacattaaaacttcgagcaatgctcttcatagattttgttttgaattgtttaggcccatctcagagttcaagacacttagtctcttctaagagaaatcatggtcacaacaaacagagattaaataaagagcaagaaattagaagaaactcaaaccattcacttagattatttgttagattttggccttaaaaagagacaaagttgcttgaaacaagtgattaaactgacatttttagattattattttattcatacctttattgtgaataaattggccacatgataacattttataatgttaaataaatatgatatatataaatctgtataccacaacaattaaattggagggcgatttgccatttaaataatttatcataggatttttataagatcaagcgcttagtgcatatcaaagagacagaaagttttcattgcagttctgcacgttcactgagtaccttttatgtaccagttgcattgttctagaatcttatctatcatgtaaagctaggtacacctgaaatagtttagttatggtggcaaagttagactgcagttattggctgggaattttttgtatatctatgtacatcttccataagagggcagcaaaggaccagcatgattttttccttatcatgaagtcatagcagagattgcctcatattgcaaacttaatagaaatcttctcagagtaagggcaaacagagggcatggttacaagtttacttactgtctagcctgtcttttatatggtctgatatggctttttagtacatagattatctcacatcacagtgatagcctagtgattaaatgttgatcctggggtcagttgtcaggctttaaatcctggaaccataacttaactagcttcgtggtctagaaagactactcagtctttctgagcctcagtttcttcctcaattttttataaaaaggagggcaagggatagtaacaatgccacttcacatggttttaataaacaaaataaaatttgtgtcctgaagaggctaagaacagttaaaaggtggagctagaaaaaccaccctatactagccttaggtgtattgtatttatttaagttaaactcttattaaaaagagtctcataaaggaaaatataggtcattactttctgtaactacttagtatttttagttaactaacatatatatctatgtactgaccaattatttgctcgtacaatttatcaaaccaattaaatatacactgttaaatttatttccctgtcccccgagacagatcctggctacgttgcccaggctggagtgcagtggcgcgattttggctcactgcaacctctgcctcccaggttcaggcaattctcctgcctcagcctcctgagtagctgggattacagaggcctgccaccatgcctggctaatttttgtatttttagtagagatgggatttcaccatgttggccagggtggtctcaaactcctgacctcaggtgatccagccgcctcggcctcccagagtgttgggattacaagcatgagccagcacgcctggcctgaaaatacattttgatgaacaaaaaatttttaatttttttttttttttttttcctgagacagagctttgctctgtcacccaggctggagtgcaatggcgtgatcttgcctcactgcaacctatgcctcctgggttcaagcaattctcctgcctcagcctcccgagtagctaggattacaggcatgggccaccatgcccggctaattttttgtatttttagtagagacgggatttcaccatgtttgccaggctggtctcaaactcctgaccttgtgatccgcccccgtggcctcccaaagtgctgagattgcgggcgtgagccaccactcccagccaaaaattttttaattttaaaagtcaatgtatatcatttgtattttatagttagtgctttttttgtattgtttaaatttttaaaattcttccattaatctaaaatattttcatgtgtgctttctactaagagaatttaagttttgtttttgacattatagtttttaatacatttggatttggatcttatatcttgtatgatacagaactctaattttcgcctttaactacatgcataatcattttttccacctccacttattgaatagttcctaattttcccatcaatatcatgtgtttcttctggcatagccaaagtcccataaatgtgtgggtctgttgtagtttcctatttaattcagttaatttgtccaatttgttttattatgccttaattaccacagcttcacagtaagtctttatgtctgatagggcagcttcctctagtgtcttcagaaatttcctgactttaaaaaaaatccttattgttcatgcttttttaaagaattagctttacatgatgcaagaaaaagatctgttggaattttgattgtaattttgttaaatctataggtcaactaattacaatattgaatcttcttatgcacaaacatggtatatttctccatttattcaggtctttatttaatgtctcctaatgtctttttgtagtttttacttagagatcttacatatttgttattatatttactcctaggtacttggtattctctaagattattgaaaatgctgtcttctttttaattacattttcaggtatttgtcattggtataaagaaatgtatttgacaataatcttatattcaccttaaattctcttatttctaataaattgtactttttttggttttctacaaaaatgatcatatctaaaaataaagttagatttgtttattcttctgcatcattttgaattcagtttattatttcatgtgctattagaacctttaatttagtattatttattttttgatttgtaaatcggaatgcttttattatcttttcatttaggatgatgtttactgtaggttacttagatacgctctatggaaatctcttttattttttctaagaccttttattatgaatttaatgttgaattttatcaaatgctttctctgcatttattagaataattatgatttttctctatctgttattataatgggtcagatttatagatttttctcatactaagcctatccttgtattccttggataaatctaacttggtaatgtttacttttttcataacttttagctattaagtagataccaaattttctttcaaggtcaagtttgatagttataaaaaactagtgatactaagtcatagaaaatatactttaaaaaactagtgatactaagtcatagaaaatatactttattttataaaaagactttaactgtaaaaagtaaaaaaaaaaaaaaaaaaaaaaaaaaaaaaaaaaaaaacctggccgggtgcgctggctcacccctgtaatcccagcactttgggaggccgaggcaggcagatcacgaggtcaggggatcgagaccatcctggctaacacggcgaaaccccgtctttactaaaaatacaaaaaatcagccgggcgtggtggtgggcgcccgtattcccagctactcgggaggctgaggcaggggaatggcgtgaaccctgggggggcggagcttgcagtgagccaagattgcgccactgcactccagcctgggagacagagcaagactctgcctcaaaaaaaaaaaaaaaaaaaacccctagaattttaattactgcctttacttttaattcagtggtttttagtatattcacagagttgtgtaacaatcaccatgatcaattttagcatatttttattacttcaaaaagcaactctggactcatgagcagtcattcactccccatctgctcccaacccctttgttcccatccgcccacccagccctaggcagccactaatctactttctgtctctacagatttgcctgttctggacctttcatataaatgcaatcaggcaaaagaaaggagatttcagtgctcagtgttgccaggtatctctgcctccagttttgcaccttcctggaaagctcattttgttcagattgtctgcctgcctctatctatcctgccttcagtggatggcagagatttcatctcttttgtttgcacagccttgaaaggtgcttgatacagagatgcttggtaaatacttgcagaataaattataaaagtaacacatactcataaaaattttaaagtaaaaatatgtatagtaataaacacttggtgcttattacatatcatccagtgggataaatgcttgtaagtatagtcagccttctgtttccctgggttccagatttgtggattcaaccaactgtggctctaaaatatctggggggaaaatggcatctgtactgaacatgtacatacttcttttcttgtcattccttaaacaatacagtataactatttacatagcatttatactgtattaggtattataagtaatctagagattatttaaaatatactggaggatgtgcataggttatatgcacatactatgccattttatatcagagatttgagcatccaaggatttgggtatctgcaaattttggtattcttgggaggtcctggaaccaatctcttacagataccaaaggatggctgtattctccattccttttcaccagctgagatcgtactgttatctgcacttaacagattaagaaataggtgtgatgagtaatttgtttaaattctgtggttgattgtgttacttttcgactgtattctgtgctcttccctacaggaggattattcattcctgtttacttgaattcaggcaacatcatgtaacttgatttaaggaaccgatacatgagtggaaattctgtgtggcatttctgagcagaagttttatgaggcagcacatgctcactgtgttacctgttccttctgccatgagactggcagatggacattctctatcagccaggatatcagaatgaagaaatgtagaacatagaccaaaacaccaatgagaaataagcgtttgttgttttagggaaagtgtgttaccacagcataatttaacctatcccaagtgaatacatattcatggagttaatatctatacctgaaaattgaaactcaggttgtctacatctaactatgcctctgtcttttccaaaggtataaagtaggagaaacttccccatgatcctactcttccagtgttaactacagttaaaatttagtgtaaaattgtttaatactttttcctatgtgtatgtcaatgttcatttttttaaaactgggaccactttatatgacacatactattttagagcttccttttcctacttagtaatataaaatggaccactgtcacaggttaggttttccataaacagacactgagtttggaatataagattattttcagggatcatcacctttaaaaggagaagtgaagaagtaggattggggagagcaagaagtagagctgtgatgctggcccacagatgtctctctggggttcgtattgtttgtcagagttatcccatatcttgtagaagtggccatgcttttcaacccactccttactcagtggcctgatgtgggctgccctgagcaaggtagctttctgcagctgaagcagacactgaagttgctggcagctaactccatctttgcagctgggcagcaaatcctttcttgaagtgggatctggacatttatatttgtctagcacagttcattttttgcatcacttggaaacccttctctgttttcattccttttgttcttaatgtatattctcaagcctcttgtctacaatcactagataagtttgttgtaaactgtcttaactataaaatgaagaaggtataggtaactataatatgaagaatgcattggaagtgtaaattttaaaggagtttgctgattaataactcttttgttgtaacttttgttcaatgatgtttgacaaatactttttttttttttaatttgaggcagagtctcactctgttgcccaaactggaatgcagtggcatgatctcagctcactgcaacctccgcctgttgggctcagagatcttcccgccccagcctcccgaggagctggaactacagccttgtgccaccacacccagcaaatttttgtattttattgcagagatggcatttcaccatgttgcccaggctggtcttgaactactggacttaagcaatccgcccacctgggcctcccaaagtgctgagattacaggcatgagccaccgcgcctggctgacaaatactttttaaaaatatccaagtttctggattttattcacctctacaaaaatgatttaagtcctgtagaaacatgtgcccacaaatgacacagtaatctccagcaatgtgttcaacagcacgttgagcataattgagcataacagacatttttaaatttgttgtctcaaattccatttagatttggctattgatgcaaaattagggaggtcatttttcactagattactttcaatgctggaatccatacttaaaaaaaaaaaaagaagaaactagatttagtatatctttctttgccacttcaggcttccaaaggagaaaaattcatggataagtcattaactgttacaaatgcattatgtcttcagttgtgatggttatgataaaacatgtttattttatatttgtaatttagtaaaattagttgattcaaggagctctatcataaatgggaagtaataaaatgataataattaaagcaggttatttttctctggtcatttttgcattctttgtagctcatgaagtagatttgttgctttcatctgtgtctgccatgtatgctaggcaggaaagaaaggaagtaagaaagatatagccatgtggggaaaggagacagagggaaggaggaggaaagagaaggaaggaaataaaatcaactcttcgttttctgcactttccctgagcaagttcttttttatttgtgtgtacaatgaatctgcgtttctccctgccacgccccctcccaacccctttggctaatagaaagctctgaaaaaaattttgaaacttatatccaaatgcagtggatataaataaagttatttcccctggcttttcaaaaatatgagtgagtgttggatattagaaagctaccttacttctttagatcgagaccatcctggctaatacggtgaaaccccatctctactaaaaatacaaaaaattagccgggcgcggtgttgggcgcctgtagttccagctactcgggaggctgaggcaggagaatggcatgaatccgggaggcggagcttgcagtgagcagagatcgtgccactgcactccaacctgggcaaaagagcgagactccgtctcaaaaaaaaaaaaagacagctaccttacttattggaaagagatgatctgtgtggtcagtatcagtttcttcacaggaaaaaaaaagtagattagtaatagtgtttactaggcacagtgctttacatttctttacttagttctcaaaacaatcccattacataggtattatcccatttaacagttgagaaatctcagtcacagagagttaagtgactccccaaagttcacatggctagtaaattatggagctctggatttcatgccctgaaccaatgtgctattacaagccacatactaaggttaatacacaaaatacatgtcataagataggctccaaattgttttagagcttcccagcagtcaaacagaaaaaaggaagcatggttattttcaagacttaggatacatatgataaaagcaaagcagttactcagcggaagtgcaccttcctcagaagttgggcctggaaaaaaacttcagatatttataaaattgatgccatacaatgttgtgaacactatgtttcaaaactgccccctaaaatagtatgaagctttttttttcacatgacaaatatatgagaaaccattattattattattattactgttttgagacagtgtcttgctctgtcagccaggctggagtgcagtggctcactgtatcctgaaactgctgggctcaagggatcctcctgcctcagcctcccaactagccaagactacaggcacacacaaccatgcctggctaattttttttttattattttttgtagagacaaggtcttgctatgttgcccaggctggtctcaaactcctggccttaggcaatcaatcttcctacctcggtcccccaaagtgttgagattacagacatgagccatcacgccctgctgaaaccattatcttatgatttctgatatgtgactctttcattgtatggcatgatccaaggatagattatacatcgattcagtgaacgcatggactctattcttctgagcaatcctccatgagtatgtgttttgaggctaatcttttgataaggatagactagcaaagaatttgattgattccgtcaggactctagagtagaaatatcatgtattgtcagttaaaggcagatctttgaattttaacaaagccagcagaaggcaggattcatacacttccaggtatgtctgaacagaagcctgcctgaccacaacacagatgtgatcgtctaagagtctttcttggtgtaaaatcccatgattctacagggtttattcagatcctagtgtcttaatgagttgatgtaagagtacagtgctatattctatgagggtgttattatttgtaatgaaaatagggagaataattacacattcttgctttctttggatcagagcttctttactggtaaatactccccttttcatatttttgtaccagtcatcataatttcaaaaatagtataatactgtattctaagcataacattttaacttgtgtttatatgtgagaagtttagaaaatataataagaaaaaataaaaatctcccacaatcctactggaggctatgaatcttctcactcccatcttttcctgcacacatgccaacgaactaaaaaggatcagaatatgcacactgttatgtaatctacctcattcatgtaataatgtatcatggatgactcgatgccattacatattaatagacatagtgcctgcagagtattatgtggacacactcagggctgatgctctgctagtatcttcaaggctgctggaatagccatgctggttgctaaaatatggaaagacttccatactggttagtaaatggtgctgccctgagccctctgaatgccttcccactggacctcccccccatcacactccccagcaactaaagggttaacgcctgtcccatctggggcctctaggatcctgctatagtagtgtggccagcctgctttctgattgatcagtgcccataccaatggttaaaattttggatatcattcttaaatgtatcataccacattgttggtaatatttcgtgtgcttattagaaagtatttttctgttaaatatatatatgtgtgtatatttttaagtcttccgacagacttctttgacatgttatgtcttcaggaagccataggctctcatgggaaattggtgtctggaattatcactgcattaatgtaataatatatatttactagaacagtggtttgacatatgaaaatcttaatttatacaccaagcatacttgaatgtagacttttccttctctatagaccagaaaccatggcatttatttggaattgcttgatgtcactttaaattgagacattcaatccattcctcttttgaatatgaaaaactttttcctttaagacaatagtattttagacttcaccatcctcccatactgttcttttatatttcttcatgttctttcttcactaatccatttctaacacacccatataatttttcagatttttttcatatttccatttttaatattccacattatatgggtaattttttataatctggctttctgcatttgacctcatactagttaccagcttttattttttttaaataaacagctttgttgtaaggttcattaaaacaaaacaaaatttctttttttaattgagttagggtctctctctgtcccccaagctggagtgcagtggtgcgatcttggctaactgcaacttccgccttacgagttcaagcagttctttgcctcagcctcccaggtagctgaaattacaggcacacgctaccaagcctggctgatttttgtatttttagtagagatggggtttcgccatgttggccaggctggtcttgaactcctgagcacaagtgatccacccacttgggtcccccaaagtgctgggattacagtcgcgcaacaccacacctggctaatttttgtatttttagtagagatgggttttcgccatgttggccaggctagtcttgaactcctgagctcaagtgattcacctgccttggcctcccaaattgctgggatcacaggcgtgagccaccacacccagcgaaaagagcaagtaattcttgcaaattttttacccaaacctttagaatgtgttcttttttttttcttttttttttttttttggttttgggtttttttttttttttttttttgagcatttatgaaatggctgtgaacttcttctaacttctaactttccaagttgtctccttttggccctaggagtagaatttttctttaattctcagctggtgagatctgttgccaccacagttcaaaataacgattaagtactgaggccagcccatgcctgatccttcagtgatgttaggaaggtgaatgcttggctgtttgaaagcctccttattgtcatttccaatccattctctctgcttctattccttttctcccaaaacatttcagtgttgtcagttcatactctggagtctttggaaaaagagattgttgtctttttatgaatttgtccaaattttagttgtttctggttaagtttagaccaagagggatccatgtccctacaggattacccctatttcaaccagtagatgaggaatatccagctttaatttgtcagagcaaaaatccattaatgttttctcattactcataaaaaaaaatccagctccttactgtggcctataaacctctccatgattggccctccttaatttatctcttttagtcttgaagtttcaggcacacctccttttcttttattgaaattctcaaagccaggtacagtggctcacctgagtttattcaaggctaatccgtaattagggaaataaaggttacagctgcctgttagtgactcaggtcgtataatcacattcctttaaggctcaaaataacgttccaatagctttgattttgaattacttattttcacaagttctataaaattacagagttctcatctatttttgttggcagctgtttgcctagcagttgaaagtgcttagcacatgatagtatatgataaacatttgtttaatttatttcaatattgtcagtccatattccagcttctttggcaaaggagactgttgtttttatatgaatttatccaaattttagttgtttccagctaagtttagaccaagagcccccacagaattacttccatgtcaactagtagaggaagagctttaatttaggatttaaatgccacaccacaattatctaaagtgactgaattgagctactgaataatagtccttctaaagaagattttagacacacatttcatttctgttattgctgacaagtgttttattttacagaataaaaggcatcttgcctgggataaaatttcgaaaggctgtgtttttgtagcactttcttttttggaaggatctctttttagctactctgtgtcatggtgatgttgagttctctgttggaagctagagttcctgggttttttgatgtttctaggcttttgggttttgtttaagatttgtgttttgggaaggaacatttccatggttacgcccattccttctaccatccttgaaaaaacgagccagtagagtaatctgattcctggattactactacacagatgtcttttgtatctgcctacacatgaaactgctaggcaagttccatttccatgcatttacttccttcagtgctttttaaaaatgaagcacttttaagattaggaatgaaagacttggattggcaagttaaacagggattggcctacgttatgttaatagtctaaactcaatgtaggattaatttagaggtacagtatatgaagggagagactgttttgggaacaactaaatcgaagctttgagcagaatttgcacacatgtgagtaatactatatgcagaaagactgctgtacttaaaaatagttttcaggtttttaaatataaagtttcatgttggaatagtaaaataaaacatatgaacttttactgacatgaagcagtaaaattaacttttccttggaacagcttgcatgctcattgctgctccacacaaacctaggttaaagatgcccatgatctagcagttttcttctctgaacattgcagagcatttgcacagacatgcttgaatttacactcatgagtccatttcaagtaagaagagggagtaagagagggacctccttctcagggttaaggaaggcctaaattatgaaaaagtagtgcagcttttttcttaagttaaagtaacggtaaatttacaccacatttctctatgaatccagtatatgaaaagtttaatttgcgtgttaactattgctgtgcagacagcttgtcaagtgatgattttgacagcctggtgtctgtctccattctgctggaacatcagacgccatttctcttcttcctgagaaaaccacctctcatactttggtatccctctaaagtgtttcaattgtaaattactactaatatataattactattcatttatagaagcttctagcttaaacataaaaatatactaaaagtgaaacaaccgtaatcttaacctctagacatagattatttttctatgaacacattaacatatatgtcatagttactattgttttttacaataaaaggctcatactatacatacatacaacttgttctggtatatattttgaatcttcataatagcatttgtagatatgctttattttttgtagttttgtttttttctttagccatccttgcaaatactatgtattttgcttccttaaatcagtatttcagtaggaaaaattcttagaaattaaactgtgagggcaagcaattgtgaacatttacattttaataagtaccaacaaattaccttaaaacgtgtaccgatggatactcttagtaaaatgtaagagagtgattcactacattcttactagctcaggcattatcaatttttttttattttaaattactgcctaagaaatacagtcatatatcttgttcttttattttaaatttctatttgagaagttatgcacttttgtttgtttgttttttgagacagagtcttactctgtcatccaggctggagtgcagtggcacaatctcagctcactgcaacctctacctctcaggttcaggtgattctcgtgcctcagcctcccgagtagctgggattacaggcgcctgccaccacgcctggctgagttttgtattttcagtagagatggggtttcaccgtgttggaccagctggtttggaattcctgacctcaggtgatccccccactcagcctcccaaagtgctgggattgcaggcgtgagccaccatgcctagccagttacacactttttaatgtgattattaatcaccattatttctacttattcaagctgactgttcacatattttactctttttaaagcatgcattttaaataaattgataataaatgtttttgtcaaatattgcacgtcttctcccctacatttattgaatgcttactgcatgctaggctctgtgctaaatactttacatacattattccatttaatcctcacattaattttggggaatgtgttattttcatgttcacacaaggaaaatgggttcagagaggttaaggaatttgcccaaatttacagttagtttatttttatttttattttgagacagggtatgtctctatcacccaggctggagtgcagtggcacgatcccagctcagtgcaaactccgcctcctaggttcaagcaattctagtgcctcagcctcctgagtggatgggactgtaggtgcctgccaccatacccagctaattttttgtagaggcagggtttcaccatgttgcccaggcctggtcttgaattcctgagctcaagtgatctgcccgcctcagcctcccaaagtgctgggattacagccacgagccactgtgcccgctccacagttttagaagtggcattcaaacagagctcaatcacaataaaaggcacatcacaaactatgataatcccccacctcttggattgtcttttatctcttaactttgtggagggtttttgctttgattttgtttgttatgttataatgaagttttaaattgttaatcattccatatggtgtctaggttttccgccatgattataaagcccttccctagccccatgtgatacaattttctttcttataatacttttatatttcatttctttttaagtctttggtatatctgacagcaatttatgtatgattcagatgtatatttttttccccaaaggtcccaacacctttactgaataatctttttcccataatttgagatgacacctttatcatacacttatatgccctgtatatttgagtctatatctggactcccttctggtataaagaagtgcagttgacttttgtataacgaccttatacctgtccaccttgttaaaccctcttactatttctaatatcatgtctacagattctgattttctgttaaaatggttaataattctgtctctctctctttttttttttttttgacatggaattttgctcttattgcccaggctggagtgcagtggtacagtcttggctcactgcaacctctgcctcctgggctcaagtggttctcctgcctcagcctcccaagtagctgggattacaggcgcctgccactacacctggctaatttttgtatttttagtagagatgaggtttcaccatgttggccagtctggtcttgaactcctgacctcaggtgacccgcctgtctcagcctcccaaagtgctaggatcacaggcgtgagccaccgcgcctggcccttaacatggttaataattctctgataaagattgttctagtctttttcaatcctttctcatccttttgattcaacttatttttcttatgtgctattgaagtccttcaagtctatgttgtttttttttatttctaaaaataaaaccaagaataccagaaaaccctaaggctgaagtaactgaaaaccaaactcaaaaattgatctgtagggttattcagttactctgttggttagtcaccaggtcgtgtaagtgcaagtcctaatcaggaaaaaccaagactttgtgaattaggatggggacactccagaggattcggagacctccttgactccatggagtactctgaactcaatgccttgagcctcctctgcttgtcaaagcctttccttcctcttaatcctcccgagggtgttttcctcctgacaccaaatgtgtgatgtccgttctaacaccagccatttctccagttctctagacatcaaccggatgtccaataattcaattaaattctgatactgtctgcctgcgttagcatccacccctacaagttaaaggctcagtcccacaatacttccctacttcagatgtcagctgtaaatggggtgcccaggtgatccacatttctgcccaggtgactacaaatttgggggttcccatggccccttcccctcagtttctataatttgctagaatgcctcacagaactcagcaaagccctgaagcactgattattctcattttattataaaagataacagctcaggcctggcacggtggctcacacctatagtctcagtaacttgggaggttgaggtgggagtattagagcaggtagttagacgtgagcagggcagaagagggtccttccaccaccaggaatgttaggcaaccatcaggtgatggtcaggtggttgttaactgtctctttaaaataataattggttgcagccagtgctagggaaaggcagtctcccaacagatagaaaacacctgaaactggtgactagcagcttcccaatatgatctcaggagttgggtgagtgggctcaagcatgtgcactcaaaggcaaaatggcagagtttaacgggtatatgaccttcctctaggaacattcaacttgtaggaaagaacgcctcaatgtgcatttgttcaacttcagtaaacacactgtgcattggccccctcctaagtgctggcaggccaccgcacatgcagaataccagcatatgaaaccccaagtcagaggtcaaactgggcacttgaactcctcaagactcctgcttggctatcttccaagtgtaccttacattctttgattcctgctttaaaactttttaataaactttcacgcctgctctaaaacttacctccatctctctctctgccttatgcccttcagtcgaacgaattctttctcctaaggaggcaagaattgaggttgctgcagactcgtggatttgccactgctaacaggaggattacttgagcccaggagtttgcgtctccagtgagctatgatgttatcactgcactccagcctgggcaacagagtaggaccctgtctcaaaaaaaaaaaaaaaaaaaaaaaaaaaaagatactgctgaggaactgccaaatggaaaaaatgcagaagagaagatatagggagaggggcagagagcttttacgccctctgtgggtgcaccagccctcagtacctccaagttttcaacccggaagctctccaaaccctgttctttaggagtttttatggaggatttgttgtgtggacttggatcgattaagttattggccattggtgattaactcaactttccgtcccaagagattgggagtggggctagaagttccagcctctaaagatgcctaggtcttttatcaatccaccctcatcctgaggccatccaggcaaccccaggcaccagtcagctcattatcatacagaagataatcttatcacacgggagattccaagggttttagaagccatgtacctggaactggcacaaagaccaaatatgttttcttgtgctttacctctcttttaaaaacatgtaactccttgttatgggttgaattgtgtcccctgcttcacgaatttcatatgttggagtcttgacccccagcacctcagaattgttgatgaaaagagtcaaactctgtaaaatatttgaagagatttattctgagccaaatatgagtgaccaatgcccatgacacagccctcacgagatcctgagaacatgtgcccagggtggttggggaatagcctagttttatacattttagggagacatgagacatcaatcaaatacatgtaagatatacattgatttggtctggaaaggtgtcacaactcaaagatggagggtgaggggcagttccaggtcataggtagattttaaaattttctgataggcaattggttaaaagagttatcaatagaatgtctgggtttcgataggggttgtggagaccaacttttaaattatgcaaatgaagcctccagatagcatgcctcagagagaatagactaaatgtttcttattagacataagttctgtgttgatgttaaatgctggttggctctttctgaattccataagtggggatggtataacgagccatgtctgacccccccatttccatcatggcctgaaccagtttttccggttaactttggaatgctctggcagagaggaggagtccattcagatggctgacggatcttaagattttatttttggtttacagaatatagccttatttagggataaggtctgtaaagagggaatcaagttaaaatgagttcattatgtaactgagtactctcatttttcagtttattttttaattattttctcctctcccctttcccccggcttatgcccccaaagcatgcctgcctcagaaccttcaccctctaggaggggttgccttggaactcccacccaccaggagggcatgtcaaaagcacgcccacttggccacttttataacttctgcccaggaaggcaccaactcagctacccagtagttaaggcactgggccagcagggggacccctcgcccttgctcactccttccccggccttggataagtgcctactttctgctctgggagcaaaacgtcacatgtaaaggcaggactaacgttcacgactcttccccaagctagcttcggaagaaaccgctttctttatgccagacctcgctcttgttaattggactacgcaggcagcaagcaactaaccctctgtttggtgacggttatggatgggcgccctaatccggtatgactgctgtgcttatagaaaggagaaactgtccaggcgcggtggctcacgtctgcaatcccagcactttgggaggcacaggcaggcggatcatgaggtcaggagataagaccatcctggccaacatggtgaaaccctgtctctactaaaaatacaaaaattagctgggcgtggtggcgcgtgcctgtagtcccagctactcgggatgctgaggcaggagaatcgcttgaaccagggagtcagagcttgcagtgagccaaaatcgcgccactgcactccagcccggtgacagagcgagactccgtctgaaaaaaaaaaaaaaaaaggagaaacttgtacatggagatatgcgtaaatgtacagggacacaggaagaaaatggctttctacaagccaaggacagaggcctgaaacggatccttgcctcacagcccccagaaagagcccaccctgccccaacaccttgatctttgattcccagccttcagaactgtgaaacaatacatttctgttgtttaagccacttggttacggcagctataagaaattgatacactttttttttttttttttttttttgagatggagtctcactctgtcagccgggctctggagtgcagtggcacgatctcgtctcactgcaacctctgcctccctggttcaagcaattctcctgcctcagcctcccgagtagctgggattacaggcgcctgccactaccgccagctaattttttgtatttttagtagagatggggtttcaccatgttggccaggctggtcttgaactcctgatcttatgattcgccctccttggcctcccaaagtgctgggattgcaggagtgagccactgcgcctggccctaatacacttttttatatgaggaagttacattgtaagagcaagtaaatattcctctatacatccccaaccacttccactgtatatagaccagtagctagagttaaatccctgtatgccccaagggaaattacagatttaacacaagagaaggcttacacatcaaaagacttgtaagactttgataatttatgtcttctcttccctgagataattcttccaaagcttagcattcactggcttttgtttatcatgctcatgtccactgccattttttgatgtacttaattcataggtcccttgttggctctttagtcctcattattcatttgaaagcttctggactaccataaggctatctatgagatgttggtatagcgccctgaacatctctcttatcttacttagtacacttgtatgactttaacttgtattttccccactaggccctgttttgtgtgaggattcccagtgtctagcacaatgcctggtacataccatgtgtttaatacctagttcttaaaggaagaaggaagagaggaagaggaaggaaattctatccaataaatgctatctaggaacaatgtggatttatctttctctttagttacttaggagctacattagtatccttagaacttgtgctggagagattagtgttggcagtttattatttcgttacccttcgaaactgcatgggtaataacagactgtggatagtctcacatgctgtctccaaatactttctccctaaaactagagcatatcctcttaaacactggccttgttcgccaccaccatggcccagaagcaggcccaataatcctggggagtgttcctgactggaactctgggtcagaaaggataaagatgacttaatctcgcaatcccactttctactcggttctgatactcttgatgtacacatgttcctctgctaggtgcttttcatttttttgagggccttcagtcttctgttcaagtgtgcatggtgcttctaagccttctcacttagttttgaaattagcattctactcagaatagataaatgctgccaacttgcagttcttttgcttggcccagattcccttatagtttgcaggtaattttcagggtcttcagtatgagattattttcatttcctagtttcaacacagatggttttctctttacttttggttcatttccgtgcattttggggaaaggagatagataaatgtgcacttttcagctacctttctggacaatattagcatttcccctttacttctgaatatcctttggactctcctatattggaaaaagagggtgatttatgactattttaatggaaaacaaaaataaatctatagacaagttgttagatatattaagagtttaacaaggtgaatattataacagctataccttcacccagctacccttgctgggctctaactcgctgtctctttctcttgttattgttgttgttttcccccatgggtgagttctttatggcagtctccaccatttcctcataatcattttccttttgatttctatattctgacatccagttcccatcatactgcggcagctgatctctcaaaataaattcattgatttttttttttataattgcagttacattttttctcctttactttccttgcacacaggactgtatttgatgctgttaattaacccttctttaaaactttgttttttgtttacttctgtttctttactgactgtgtacagtaatcagaaaaatcagaaaaagacctgattttctctaaatcaggcctttttccctcaaggatctttgtggccatttcccctggttttccttgaggagaaaactatctctctacatctccctcttaacccaacttccactccgctattttaatagtctactggatgctacggtgaacaatttaaaagacagaaggactgggtgacaaacgtgagggaatttggactgatgtctgcatgtctggcttgagtaacagtagggacagcagtgctgtttcacatatacaaggaacatgagggagaaaagggctcaagaggatcattttgattacaacaaacaggaacaatggaaaccacctgacaccagtcccaaaccaccagtgacattagtccaaccactttaagagagtctgaactaggtagaaaggcaaactgatagaggctctcgggaaaggagtaactactgagaagtcagcaagagaaaaagtaacttgacaacactgttttcaaaccattgcagctacctgaaaagatcccctttcctgctctgggaggctgttccatcttcagcatcagcactttatcacagaaggcctaagcaggggagaatgttgccacagaagccaaagagggaaagtcttagtgaagagtcaagaaagaaaagtcttggagaaatacttttcggtatggcagtgaggagtgtggtggccttcttgagagcactctcactgccttggtgataggggtcattttgcagcatgttggctgcagagaaggcaacctaaagaaggcattcatgaaatgcagcctgcttcttgaacgaatctggatgaaaggcaggagaatgcatggcagctggaggaaagccaggatgcaggagggcattccttagggcagtaaagtggacgtacatgcggggttagagagcaacccagaagcaggaagcatgagccagagtccagggtgctttggaaagatttagatagggggtagggcccatccttctctgtcataggaagcaggatgtaaatggagtttctctggttggctggaggttgaggaagtttgcttcctatggcttctattctcatctactgaaatgtgagaagaggcagtgggaatggaaaagctaccatgggagtgagaggagaaactcaagataaatgaaggaatttctgcaagcagtgtggaaagctgaactgaggctggagccatgcatttggggtgacatcagatcttcagcggagtgctttttttttttccagcttcacttaataatgtgaataaagatgattttggtataggaatttgcaggatggctaatagtggaaaacaaaggaaaatggggtaataatagagcctgccatttcagagagtgatcaaagtgactcacagtgagatctagactagagagggcagaaatgaaaggaccaaagaggagaagatgatctcagtggagataaaaggtagatggacgaggaaaactagagagctagaaggttgtgattggagatcaggatgatgacatttaagagccagaggtgaagtttaaaaatagggattgtgagctgtccatgttggcacatgcctatagtcccagctactatggaggctgggcggggaggatcacttgagcccaggtgtttgagggtacagtgagccatgctcatgccactgccctccagcttgggcgatagagcaagaccccaactctaaaaaaaaaaaaaaagaaggaaaaatagggattgtgcaatagaatcaaacacagaggtcactggataataacaaacagtagtttatgagtagtttttgtgtagctttgtttttttgatttttgtttttttgttttttgtttgtttgttttttgagacagagtctcactctgtcaccaggctggagtgcagtggcacaatcttggctcactgcaacctctgcctcccgggttcaagtgattctcctgcctcagcctcccgagtagctgggactacaggcatgtgccaccacgcccagctaatttttatatttttagtagagatggggtttcaccatgttggccaggatggtctcgatctcttgacctcgtgatccgcccaccttggcctcccgaagtgctaggattacaggtgtgagccactgcgcccagcctttgtgtagctttttgagcagcaacacaatagtggatagagctgtaaagaacacaaggagaggaagggaaaattcaaacagctgcggcttgttggtcttttaatgcctggttcttgattttgaatccactgctgtctttacaggagggcactaatttccagcgaagaagtgtaagttgctttgatcgtatctcattcttacaaaatgtagactcaccaatggctgttgtttttttcagtgggcctaatgcatatagcttccagatgtaaaggtaaagtactccagtggatgattcattttaaattagaaattagcttaaaggctaataaaagttgaaaataaaatttatctcaaacctagttaggtgttttttctttttggcaagagaaaatggatatgaggaaagtattcttcctgtagtgggagatcaggggcaatatggtgataccatagccatggcacagataaagtgggatctaataatttagttaattttatctgtttatttgactgtaggtacttgagcatatagttgttttgttgttgttgttgtcatttttttaagaaaaagcatcggtgttcttttgttttgttttgttttgtttttttgagagagagaggtctcgctgtgttgcccaggttggtcttgtactcctggcttcaagtggttctcccaccttggtctcccaaagtgttggagttacaggtgtgagccactgcacccagtcaagttttccttcttaagtgataagagtgatacttagaaagatactcacttggaagaagagaaattaaaaattttagcactttttggccacctaaaataattgcatggaagagtgaccaagaaaaacgctgaaaaaaacttttctttgggaaaatatatattccttatattccttaaagcaaaaatgaatagagaaaaattggcacccctgttgtgttagaaactatttgaaaaatgatgaattgtaaatattgtcaatttcaatactctggttttgatttaaagtttgaaatcgagattttgtgatggaatgatttcttctgtttgtatggtagttaaagcttgcttattaccaccatactagaaacttggccgtaaacaggaatctatgtgcctgggcagaaactaccccataaacacgttgttattttaaaatcttaaaggagagaggatatcaaagtatattctttatcattttctcttagaaaatctgacattgtgtttttggactagtaagtagaatagatatttagcaggaaatttatatgtaggcctttgggcttcaaaaatacttatccctgtgatcctttgggcgtatctatgatgtcatgatgttgacggtgtcagcatagtttattttgtcacatttgtgctttcatgaacataaaacctttaattcgttttctttaaaaggtacagcagcaccatcttagttaagcagaacaagtttcacttcatgtgactcaatcaatgaaggaaaatacaacttttgataaagacaccagtgagcattttattgattaatgggatgcgttatttagctttatgcttgcagacaggctcaagattagatcttagtacattgggaaaaacttcagttatacaacatgtcctaacttttgttgtgttgacattcaagctagagtttaatactcctctgatgaaggtattaaataatgtaggtttctaagctgtatgcaactaaagcatatttgcttcatgaccaacatctatatgctgtgatgttatccagtgagtgaaacacaggtcaactctacacgaagcctttttttgtattcctattttgtcttctccatctctcctttcttattatagcatatttttttcactctaaggaaagaacatttatgcagggcttgcttaccccaacaaagcatagcacaggcagggctgacacaaaatcaacgggagaagtttgaaaaaagagaactgctgggattaaatgttcagtgatttacttgttgtattagtccattttcatgctgctgatgaagacatacccaagactgggcaatttacaaaacaaagaggtttattgaacttacaattccacatggctgaggaggcctcacaatcatagtggaagacaaagaggagcaagtcacatcgtatgtggatggcaggaggcaaaaagagagcttctgcagagaaacccccatttttaaaaccatcagatctcatgagactcattcactattaggagaacagcacaggaaagacccacccccataattaaatcacctcccaccgggttcctcccacagacatgtgggaatcatgggagttacaattcaagatgagatttgggtggggacacagccaaaccatatcacttgttgaatgcacttggattgtacggagtggggctgagctgctgatgtgtgtgcttcatccactttggggcaattttcttattgtataaactgaatcatgcgcctgtcctcatttggcttcacgttagaaccaaaagatgagagatatgtgccctttaaatgggcttttagtcacattttataacataataaatctaattttcaatgaatataccaacgtatatatctagaataagccatttgctcaggaaaacatatgtcaacatacttatatgcagtaaacgccaactgaagcttaactttttctaacaattctgaagtctcagaacatttactacctctttttaggaattgcttccagagccataagcacatttttataaatattgccaacagtgatataatatcttcatccattaacattaaattgaattttttgcaaatgatcaaaaggtcattccgagtaaattctgttgtatagtgcagatgatcaagctgagtatttgccatgtttttattttagaaaagagatgttgctataacataagtaaatagattctcgtatgtggcagataaatttacttgtaatctgctctagagtgaaattattttttacatataagcattgtcatcattctaaggattattgaataatgaatataaaatgttcttgtgtatttgtgtatgtgtatataattttttgaaagtttctttatcctattgacccttctcataaacagtagcatatatatattatatgtagtagaatttatataggaacattgtctttttcccagtaatgctgattctaaactagattatgtaaatttcatgtaacatgacattaagaatagtggggtgctaaagatatttagaaatgatttccaaaattgttgtatttctaacatagaaggatattgtcattttaaaataatgtaaagaaaaaatgccccaaactatctctttaataaagtttttttttaaaataaaaaaccatttgttcaacactttataatgtatatgttatttctcatacctggtgttttttttcataacaactagagaaaattgctattatcattattcccatttgaagaggagcctatgaagtttcattagaggtaaatcatcttgctcaagatcacagagcagtaagtgttggaactggaataaacctagattgtctgactccaaatctgtgcgtgtgtgtttaatgttttaacttttattttaaaagttcagggtacatgtgca

SEQ ID NO: 33 - DNA, 7113 bp, Homo Sapiens
gcgctgacccctaggcgccgctggtggccccgcgcgcggccctccggccagccccgcccctctcggggctcctccttggtccccgcgccatggcgcgtccgcgttgaccgctgtcttccctttcgggctgtgctgatcgcgaacgctgcgcagtccgtggtggcgtcgaggcacctttctcgtgcctttacctgtgttcactcctttgctttaaaaaacagccctagaagtacacatcgttggccccgaaggagccccagcagccatgtcggaccgcgaggtgaccttggagggcgggaggacggacgaggggcctggcggagctagactgagagggcgccgccggcgtcctgaaggccctgctccccgaatgtgtgggagtgtgtctgacggtgcgagggtggctgtggcggggcctgagcagcgtgtccgtgtcccgatgccgcccgcctgttactgagttaggcaggagtgcccgagtctggcgaacttcagcagttctcgttccagagctccacacgaggttggccaaagctttgcgggacttacatacccttcttcctccgcccagtcctgcttccttccccttcctttcacgggtgttgataccatgtcaacatcctcgtaccccaaactcagtcgcagcgtctgcttctggagaaaccattctgcagcattaaagctggtgagaagatgggattcgaggctgcatcactcaccagtggtgaagtaggagggtgaactagtgaaatggaatccacgagtgggtgaagtatcagacatttcatatatggtgaacgtagtagataaaaggaaggaaagggggattggatagctattgcttagtgccaaccgagactcttaagaatagtggtcagctgaaggcaagcaacaaacagttgtaagccagtgaatctgtcccgttacatatagagaagcttcatttactgcagcaggtcaaagacaagaaccaggcccaggaattaacatccctgtttgactgaactccaaaaatagcaaaacacccaaacaaggcaatactcttccactaagtttggatccctgctaagaaaagatgaggctgggcacagtggctcacacctgtaatcccagcactttgggaggccaaggcgggaagattgcttgagttcaggagttcaagaccagcttgggcaacatgacaaaaccccatctctactgaaaacacaaaaaattagccgggcatggtggccacggctgtggtcccagctgcttgggaggctaaggtgggtggatcacctgagccctggaagtcagggctgtagtgagctgtgactgcactccagcctgggcaacaggagtgagactctgtcttttaaaaaaaaaaaagaaagaaaagaaaagcccgtcatacatgggttggagatacctgggtagatgccttcaaaggttttgactccccaaactgccttaaacctttttttcgtagacagtgtctcactctgttgcccaggctggagtgcagttgctggatcatggcccactgtagcctcaacttcctgggctcaaacgatcctcccacctgagcctcctaagtaactgggactacaggtatgtgtcaccacacctggatacattttttattacttgtagaggcaaggtcttgctatgttgcccgggcttgtctcaaacttctaggctccagtgagccatcacacctggcctgccttgaacctgaagcctgccggggtggctcacctctcctattaacctgacactactcctcctccctccacttactgctcagtagatgtataattatggttgtttcttttgcattattcagctggaaacaatgagatagaaaagagaatatagctccctccccctcagaagaactgcgttattagtttgctggggcttcagtaacaaactgggcagacatttattgtctcccagttctggaggctagaagtctgagatcaaagttttcacagggttggttccttctggggctgggagggagaatctgtctcatgcctctctcccagcttctggtggtttgctggcagtctttggttccttggcttatagaggcattgtcccagtcctgcctttatattcacatggtgatcttgttgtgtgtgtctctccagacgaaggcataagtaacatcattgacaaaggtcattcgacatgggcctctttttagaaggacaccagtcatactgattagggcccactctaatgagcgcatcttaacttgtctacaaagacccatttccaaataatgtcacattcacattgaccaggggttagggcttcagcatcttttgagagggacacacttcagcccataacaagctgtaccacccagccaacatgtactgacaggagctgggaaagtttggggctggattatgagggtgcttgatgaagggagctggaatgtaaacttgcatagatgtgtttattgaaatacgtgatttaacaccttggcaaagagtggctgcagacttcctgcaaggatggctcctagaatggcggtatagctactgctgcctaacaaattactccacacttcgtggcttaaaacaagaatcatttcttatctctaggttactgtgggtcagacatagtggggatcggtgatctctctaggttactgtgggtcagacatagtggggattggttatctctcttccacagtgtctgaggcctcagctggagcagttcagaggctagaggttggaatgagtgaaggttcatctgctcgaatgtctgacagctgatactggagattggctgcagcccagattggggatgtcagccagcacacccctacacggccggtccctgtggccgaggctttctcacaatatgatggctggattccaagggcaatctaaagacaaaggacaaaagaaagctgtatcctttttgtgaaccagcctcagaagttgcataccatcacttcggctacttcctatttggaagaaatgagtcactaaattacccatattcaaaaggagaggaattaggcttcatcttctaaagggaagaatatcaaaaaatttgccagtatatttttaaaacaccacacttggaaaaagccatgggccatggtaagcaaaattgaaatggcaaaattgctatggcagacagtggtggaagggagtaaaaggttcaggggtgtgggcatgttgaaatttatatactccgtgcatctagaagacatttgagacgatcatattccacatgaaggtgtaaataacacgtcatttataaagatcattagacataggatgatgaaaggggcactgatgtcactaaaatattcagtgatggctcatctctgtaggcaagaatgacaatagaaaggctgttccagaacttggctgggtgatagcactggggatgataggatcctaagacaaaagaggccattctgggacatagtggggaccaaagaaaaaaacccaagaagccaaaggcaacacttagctggcagaagtcagaggattgcaattatagcagccagcagggtctgagtggcagccaaggggacctcacttgtatggttatagaactggtcaataaacatggcatccctggaggcaaaacaggtgggcagctaagaagggtactactcagctggcaaaaaaaaaaaaaaaaaaaaaaatccatccaggcacggtggcctgtgcctgtaatctcagcatttggggaagctaaggtgggaggatcacttgagcccaggagttcaagattacagtgagctgtggttgcaccactgcactccagcccgggcaatgtggcaagactgtctcaattgaaaaaaataaataaagatgcttgtcccagttttaaaaaatcaggattccatgcccagcttctggaactgagccagttttcagaaatggaaacattacttgagaggtggccaaacaccaggaagaaggacctataacagtacaagtacaacagaaatgaatccccaggtacttttccaaagggtctgatagcaatttcttttgataactacatcctggagaaaagtgattagccaaacatttggaagacttgtggacacagggtctaaattgatgtccagatgcctagaatatcatccccttctgttagagtggctgcatgtggtggccaggtaattgatggagttctgctaaaggtccagcttacagtggacccgtagacctagtggactgatctagtgatattttcttagccttcgagtgagtaattggcattgacatacttggcagtgaatgctcattccaggtccctgacctatagagttagataacaaaatggaaaaagccaaacagaaacctgaaactgccccatcccctaccaagattataaaacaattatcccagagcgggaatggcagagataagtgccacttctaaggatccaagtgatgtaaagtggtggttaccaacatttttaatttaccagcatgacccctgcagaagtcacaaggatcctggagaatggcagcctactctatttgctgtcaaccagtagttgttttgggtacactgctgcaaactcatctaagaagtatccctggccgggcacagtggctcacgcctgtaatcccagcactttgggaggataaggtgggcggaacacgaggtcaggagttcagtctggccaacatagtgaaaccctgtctctactaaaaatacaaaaaattagctgggtgtggtggtgtgcacctgtaatcccagctacttgggaggctgaggcaggagaatcccatgaacctgggaggtggaggttgcagtgagccgagatcatgccattgcactccagcccaggtgacagtgtgagactctatctcaaaaaaaaaaaaaaaaagtatccgtaatagcctctctgccagatatggtaggtagttgttgactaggtggatttgttcttttctgtacctatcagggatcaaaaacattttgcatttgcatggaattaaaatgcagttttgccggaaggttatgttacttctcttgctctctgtcgtaatccaaagagatctggaccacctagacatcctgtagaatattacattgttcctttacatcagtgacatgttgatcagccagatgagaagtgcagaagatcctggagacagctgctccagagagtggcatataaaccctacaggaatccaggagcctgctacaatcctaacatttttagggctccagtggtcaggggtgctctagggcatcccttccaaaagcgaatgaattattgctgcttgcacctcctgccgttaagaaagcaagacgcttgttggttctcgagctagttcttgcctcaggttctggaggcagcatgtcccacacctgggagtattgctctggtccagagactagtggaattgggagatttccaattttggaaagagcccagaactggaaacgtctgtacagtagatccgggttgtgatgaagtaatgctattgcctgggccatatagtccaacaggtgtttttttggtgttattaatggtgcagaatgatgcaatgtagagattctgtcatgccacctggagcagagaattgtatgcatttggggggcgggcgggtgtagatctgtcttctggtatgccacttgtctctgacagagatggaacgcctgaccgtaagccaccaggtgaccatgcaaccagaactgcctgttaatgttaaactagcaaaagtcataacatcagttggggccagcaacggtccctcataatatggaagtagtatattcaaggttgagcatgagaatgtacagaggttaccaaatgagctgcagagcacagatgcacatgacttccagaactgttggatcagccacaatgtcatttcacacctgtgacagtgtgagggggcccttatagccagttgacaggagtaaaaatcgtgagcatggtgtataaatgggttggctcagtatgagttcaaaatgaaaatagcagctacattacagccttctcaggggtgaccttgaaaaatggtgataagggcatatcctctcaataggcagaatttcaggcagagctcctggtcgtccacttttttgtggaagaagtagcccaaggtgagaatatacatggagccatgggcaatgctagagggcctgggtaactggttaagggcctggaaggaaaacaatcggaagttggagataaggaggtgtgtggtagatttatgtggtcagataaattggaatagcacgaagtacaatgttctttgtatacaatgttaatgcccaccagagagcatccatgaaagaagcattatacaaccaagtagacagttgactcagccagttgatattggacagcatcttttattggctactgtactactggcatgatgggcacatggacaaggtagccaaggtgatggacgctgttcatgggcctgacagcaacccatgctctctacccagctttggttaatatctagctgcccctgaatatctaacctgccagcaaaagagatctacccggctttggttaatatctagctgcccctaaatatctaacctgccagcaaaagagaccagtgctatactcccattgtgggtcacttcatcaaggagcacaaacatccaggtttacagaggtctttagacatagtccccattttataaggagagtttactgtattggaactctcccatcctggaagggctggtggttcacttttcacaagaatagtctcatattccagatacgaggcttgtcttttcctactcacaagtgtcagccagaaaggcttaaggagtgtttgtttcactgacataagcacacaacatttcaaacgagattcactttatagccaaggaagtgtagtgtccatgggccctcctgcctggcagagcgctgagacagcatgctaaaggcacagcctcccaaaggcatgagccactgagcccggcactgaagacttccttgaaaccgttctttgcaatctttctgttattgaccagctggacagtgcgtaactgcatgggaatgcttgcagatcagtaaattcagacaccttcctttccacataagatggaccaccagctgtaccctcccaagttttgccagctggaaatcttcaaaaat

SEQ ID NO: 34 - DNA, 2578 bp, Homo Sapiens
tctgtgacctgctgatgggtcataacctgcagggtttttgttttattttgttttgtttttgttgacagagtctcgcactgtcacccaggctggagtgcagtagcgcgatcttggctcactgcagcctccacctccagggttcaagtaattctcctgcctcagcctcctgagtagctgagattacaggcacccgccaccacgcctggctgattttttttttttgtatttttagtagagacagggtttcaccatgttggtcaggctgatcttaaactcctgacctcgtgatccacctgcttcagcctcccaaagtgctgggattataggtgtgagccaccatgcctggccataacctgcagttttaaacatatcgggctgaatatagttgagggtgcttaaatgctatgatgctgtgattcagctgggccaggaatatagagaacagtggcaccctactctgtgttgggccagagattgctgaaatgtctagcatattagatcaaccagatttttagttctaaaggtgaaaccagaagcatttttttttcctctcaaaaacacacatagactcagaggtatggatacaatacctgaagggctatagttctttttccaggattgtccctctcagcaggaatggaggatccctagctagagaggagagctgggggtgacaccttcttgcccagtggaggacagctggtggtgtggcctcaacaggttcttaggaaggtgagttccttagcctttctactagtgaggtgtttgggttaaggtgcagcaccattgactgggcccgtgtggggaggatattcaaagcatttcacaattacacagctgcctgggcaccgacagagtcctagagaagtgtcgactgtgccaggtccaacccttcagtcgctggatcatggggaggcatggagtcccattgtagaggctgggtggtggtagtaggcatgcaggaattcagggaagctgctacttaccaccatgtaaaaaggatttcaatattttcaccctggtagggatgcaccagtgtgtgcttctcagcctcagtcctggacgtatgccccattgccctaaggttgtcccaaagaggccaccattagacctcaccttttatggacaggtgggagatgtctgaacacaaccacatgttgcccagtgacaggggctgggctgaccaggacacggagagtgacttgccttctggggctgagccagtcactcatactcccagcgtagccctggagcttcactgcaactgctatgttacaggaagttgtaccagcagctctacactaaggtgtatagtcggtgaccactttaaagaaagactcattagaaagaggcattgtttggggaggccaacaggccagctgttggggaccatgccagaggtactgtgtcaaggtacctggcttgatgcttacttcccattgtctgtttcttgagtttattttgcgccatctgccttcttccacctgatttggaattccaggactgctgtgtaggcttctcttcagatgagatgcagcagtgttctcaactggcaggggcagctttcttgggggcagggactgggcatctgtgttatctatcctgggcccatctgtttctttccccttgacacccaccacaggggtctgtgtacaagagggttggttgataccagttttaatgagggaacctatcttcttggaaccatccagaagctgtggtctttttccctggaacaccccacccccgacatcccagtgctggattcaagctggtgaaccacaggtcaaaattttcagttgctgtcttccagggccttggttgttccattgtcccctctccctgtaccaggatcatcgtgatccaatggatttgatggagttgctacacccagcttggcgtgcagaggtgtttggcacatccctgcctgtggaattctacgctctaagggagatgctgccagggtattacctgattcacgaggcatgtcctaccatctgtgttatattttttttaagatcagaattatgaatatttcaggagtcatctgggatctgaagaagcaagaacccactttctgagtcttttccttaaccattcatagggggtaagaaatgtcacaggtttgttgtgaaggtcaaatgaaagagaacttgagaaaatttgcaaatccttcagttcaaggtgaaagaaggtaatttattattaattcatattgttattatgtagcatttcttagaatatgtataccaaatgccttttttgactggtgcaatctttctataattccattctgggatgttagcttatttgcttagagaatggtgtaaagaggggagcccgaggccggcagatcacctgaggtcaggagttcaagactagcctggctaacatggtgaaaccctgtctctactaaaaatacaaaaattagccaggtatggtggcgggcacctgtaatcctggctactagggaggctgaggcagaattgcttgaacccaggaggcggaggttgcattgagctgagatcatgccattgcattccactctagcctgggtgacaagaacgaaattccatgc

SEQ ID NO: 35 - DNA, 7401 bp, Homo Sapiens
gcaaacgagtcaggcatcgtggtaggacctggcgagtggggccggggagagcgggacgcctggatcgggaacttgtcgcattcacattggctgctaggaggcctcggcgaccacttccggatccggggcgggggtcgcaactcccagcccttgctcagagggctgaactagaattcccagaagcctctgcggccgccttcctgctccttcactcctgcttcccccacaaataacagtgagtgaaagcatctaacaagcgtttccaactcgccgaatcattactagtgcaggcattttattctaagctgctttttactaaaacgtgctcttgtcgctctgaacctttaggactacaatacccagaagtctctgggagtcgccgagccctgtagtttagggttgttttgcggccagcgagacgccggaagtctgggaataaggcgggaccagggaaaaagcaggattccgattggtgaagaggccacatggccttctttaaaggacgggatagagttgcacacgcgcattgaggcgtgtcttccctggttctgcgtccgtgaagcctagagattcccgagcctgggtcacccgggcggtgtcgcatgtcgtctgcggggaggttggggctgctcgcgcgaggcgctctgggtctcatttccgaggccgaaaatgctggctccaaagtggtgccctgggagatgagggcgactcgcagattccaccctattctctgaatgggcttcgagtctccatggtaacggcccctcccagttcccctgtgacttcatagctgcccacgggaggggagaaagctgatgtgaaggggctgtgggttctcagccaagctctgtctttgaggccacctaccctataccactcgtcccggaaagggtgagccggtgacctttcaccctctctgggcctcagtttccctttttgtgaaataatgtctggtacccctgctgtgctcccttactatttcagggccccgggcaagagacacactctgtgtctcagtttccgcataggtaaagtgaggatgatgttagaatttgatgttaaaatttaggtggtggttgtgagaattaagggaacctcagagcaatggccagcacacaatgacccttcaaatgtcagcggctttgatgatcaccattcttaccttttctttggagatttggacaagttaccgccccaccttcctccagggtctttgtgtattgatctgcaggttggatgtattggatgttacgaccactaaactttcttctgagcacacacgagcagtggtgttgttctctctgagaaatactacaggctttggtgttaagacactggaattccggaaacctgtccctgtcataccagttgctgtgtgacctccgtcaatcatggttctttactgagccctgagactccgcacgtgaaaatggatggggatgaacttccagtccaggcagtgccactgactttgcttggggacctggggcaagctctgtggcccagcattgcaccatctgtaacaacataaccaaggggtgcgcaattgagctttgaggttaatttcggtgctaaaatcccggtcagtagttccgtcatcttcacagacctcaccctacccaatgcccttattgtgctccacatcccaatcaacacttactgattccagatttgtaatttttgccattgtagtgagaagtaattaactattttatggttttttaaatttgaatttttgactatcaggattagcatattttttttttcttcgttaaagactagtcaagtgcattagtgaggaggggggaaagagtagaccaaggaatttggtctgtaactgactgtggacaatacattggtagaactcactacctttgagccagccagaatctttttattattcactggatattcaggttttgcctctgtaaattttctttcattgccatttttttcaaatagttcattcaatctttgttttcagatgtgctttccacaatcaggttacaaattctctgccactaatgatcattacaattcctcttctcagcctgtttattgtttggtctgtttatggtttctcaggcttcttatttatttatttagacagagtcatgctctgttttccaggctagagtgcagtggtgtgatcttggctcactgtagccttgacctcctgggcttaagcaatcctcccacctccgccacctgagtagctgggactacaggcgcatgccaccacctgcagctaatttctgtatattttgtagagatggggttttgccacattgcccaggctggtctcgaactcctgggctcaagcgatccagccgccttggcctccagagtgctgggattacaggtgtgagccaccatgcctggactaggcttctttaaacattgaatagtgttcctttctagatgaaggaggatcacatagcacttgggagcaaagatgcagccaagtaacccagtgctggagcccacgatggagaagatctcacggccactctggccttgccctgggtgctttagtaactcgggaggaaggccacccagacactgcaggacaccagcatgctgaaggtcaggaacttggcttcgttgaaagcatcaggcaggttccttgccagaaaggctacagcaagggaccctaaaaccaagaagcccaagtagcccaagacagagtagaaggcagtgacggagccctcattacactggataatgatgtagccaggcatgaactgagggtccttgtttacgaagggaggctctgtccccagccagattccacagagggtcacttgggtaaaggagcaaaggaagacaacagaatttgttttttggggacccatccactttcggatcctgctttctggccttatagcctggaaggccctgcagaaaacacagccactgtgaacacagctgcaaaggtggtctgtgagaggaggcaggtggcagggctggggcggccgatgaagagcgaggaagagagaaagcagagtgtgagggagacaaggagggtgtagctcagagtctggttgctggccttgactatgggagtgttttggtgccacacaaactccacaaggatcagaacagagaggacagagtagaacaaggctgtgcatgccagagtcaggcccaaagtttcatcataggccaggaaggtctcctatttgagaaggtatgttcccttttcttgtttggataatgatattcaggacaaagcctgcattgttttatatctgaaataaacaaaaagggtgtcactgtctccaaaacagagcactgcacgtttggtaagattccattgcccagagctctcaccaccacagcgccatttaggtggactgtttggctggtgtgtgtgtgtgtgtgagagttgtgtgtgtgagttgtgtgtgtgcgtgcacgcaagcatgcgtatatgtgttctgcatgtgttttaaaggaaaacataaatacttcaccagcttttttttttgaccattttaatcagttttattgattcatgcttccggttcttattcagttcaaaacaaggcacattaaatacatcctcttattgctttataaatgcacgtagctcattctctatatcaaaagtaataaataatggccataaaacaccaagacctttataaaaatgacaacccagccttgaacatagtatttaacagtccaatctagaacaataacccaacacggtacatcaaagtgccacatatgaaaacatgcagtgtgtgtagtcactctagtactgagcttgcactggctattctttaaaaacatactagggctttttcactccttaaaaaaggtggacatgatgcaaacattgcaagttatagcatcactgactttaatattacatttatgtgccaaaaatctttacagatacataagagaaaataaaatcaatgataacaccgtatatttaataaaagtgaaaatgagttttttgttgtgccaaagaggaagctacatattttgaaacagacaaagccaagccagaaactgaagcagaagagggatcacgcatttaatagcagaaatcctaatacactcagtataaattgattgaaagcaggaatattgcaaacagcatgatggatatgaggcagaccaccgtggctaaacaaataatccagcattatcattattgttatgactgtggtggggctatttaaaggagtatccaactctctagcacagatgggggttccttcacctgactccccttaaaggctcttgaaataaatcacttgataataaaaggcaatccctgcatacccaccccaaccccaacagaatcaactaatgtcaagtttatatgcaaatggaaaattttttcttttgttcttggaacgaatttcaaagaagctcattcccccctatttcttgtctccctttcttaaatcaggtaaggaagctgtacaggcttaattcagaacttatggctgggtgcagtggctcacgactgtaatcccagcactttgggaggctgaggtgggtggatcacgaggtcaggagtttgagaccagcctgaccaacatggtgaaaccccatctctactaaaaatacaaaaattagccagatgtggtggcgggtgcctgtaatcctcactacccggggggctgaagcaaaagaattgcttgaacctgggaggcagaggttgcagtgagccgagattgcaccaccgcactccagcctgggcgacagaccaaggctccatctcgggaaaaaaaaaaaaaaaaaaaaagaatttacacaaaatgctggggtgctttattcacagtaatggcttgaaatcagttcatttccaaacgagtctctgggattggtgaaggaccgtgtgttttagcatttagcagattttaagtaaaagcagatatgctcaaaagaagaaaagtgtgcttttctttgtccttaaaggaacttcattcatagcaaaatatgcacaaacaagacctgtttaacaaacacagatctgctcgggccagtcgcatcctaagcccggtccctcctgtaactatggtccactggaattgggactcttctgtcgaggttctcttctgcagttttcattagtataaagagccggcttccagacacccttcctttttgaatagcactcatcagctgcaaaaattcattgagttcaacctgtccatttttattcaaatcgacttcatttagaatttcatggagtgtattttcatccatttggacattgatactctctaatacacatggaacatcaacaatggtaataaagcctttctggtctgcatcagacttacaaaatctcttcttatacctgtcactgtctgaaggcagtaggctaatttcagagccatctgttaactgttctgatcaaagtttagtctgtttcataatatagaaacttcctggttgtttcaagttgttcctgtttcttataatcatctcaattctgttctctgcccattagttcaacaatcctgagtagggcttgctctgctgcccggacatttagaaaggccaggcgaggctgaggcaggcagatcacctgaggtcaggagtttgagaccagcctgaccaacatggagaaacccaatctctactaaaaatacaaaattagccaggcgtggtgatgtcctgaccaacatggagaaacctaatctctactaaaaatacaaaattagccagggtggagacccaatctctactaaaaatacaaaattagcctgtaactccaggtactcgggaggatgaggcaggagaatcgcttgaacccaggaggcggtgattgcagtgagccgagatcataccattgcactccagcctgggtgacaagagcgaaattctgtctcaaaaataataataataataataataagccaggcgagtacaacgtgaaatcatatccacggtggtgcaggaatactccttaatcccatagttcacctctgcttcaatatatggaaattctgacacaagacgtactccaacaataggccaccttttgctagtcacacttgccattgtggccacctcaaaagccttatcaccataggtggcagcaagatgctgtgccccctcgctttcaagtccataatcctggacaagcttcatgtagagtgtggggttccaatctttacccccttgaaggaaaagcccagctgttctacttggtcctgctttcaaattgtgggttttgatagcagcatttagggtatcttcgccacagaccggtaagttgtccactttccacctgctgtagtaataagacttctctcactgacatggacaacatgatttcaggagatagactgagtatctgcagatttgggatctgtaacaaggggacggatactgctccacgctgctaggatgtcgcccctcttctcacctcaacatcacagctcaggtaattacgtgcttcattcaaaatgaagttaatatcttcttctgaaggacttggatggtgtgtaatatcagttggggtatcagtagtgccagcaatcatcatcttttgccagggtaagaagaaaataactcgcccatcactggtcaagaagtcccatgccctctgggctgtaataaccaggcatcacaatgtggacaccagcagttggctggcagatagctgcagcatccttatcatctattttgcacacagagtctgtgaaatgtccaacggcattgataacacacttggctttcatgtcaaattcctgccctgtgaggacatccttgcaccatgcaccactcacacgcactttcgctgtctgtctgggtgtctgtcttcttaagcaagctcactacctccctgtcattgactgtggcatccccatatctggcagcagtcagcacaatggcaaggttcatccatgcatcgttatgtcgtccatcatagtagacaattcctcctaccagtttgtccttctggagcattgggaaatgttcaagggctcttgatttgctgaggacataactgcttttcaggcaattacttcctgcaaccaaatcatacagcttgattcctacccagtagtaaggtaactgccaccacttgtaaactggaagcatgataggcaatggagctgataaatggggagaaatttctggcaggttggcacgctcatcaagggcttctgttaccatccggtactgctcaatatccaacttcatcatggccttctgaagatatctcacaccaccatggatcaaattagtgcttctgctgctggtccctggcattgaagactgttcctttctgggtgaaggagaatcacgtagcaattgggagcaagatgcatccatgtaacccagtactggaggtcaagatggagacaatctccacagccaccatggcctttccctgagtgctactataactcaggaggaaag

SEQ ID NO: 36 - DNA, 2457 bp, Homo Sapiens
atgaacctttcataaattcgcagtctcagcttatggtttatggcctcgattctgcaaacctaacagggtcacatatgttctctaatgcagtccttctacctggtgtttacttttgttacctaaataatgagtaggatcttgttttgttttatcaccagcacacagattgctataaactgttactttgtgaattacatttttatagaagatattttcagtgtctttacctgagggtatgtctttagctatgttttagggccatacatttactctatcaaatgatcttttctccatcccccaggctgtgcttatttctagtgccttgtgctcactcctgctctctacagagccagcctggcctgggcattgtaaacagcttttcctttttctcttactgttttctctacagtcctttatatttcataccatctctgccttataagtggtttagtgctcagttggctctagtaaccagaggacacagaaagtatcttttggaaagtttagccacctgtgctttctgactcagagtgcatgcaacagttagatcatgcaacagttagattatgtttagggttaggattttcaaagaatggaggttgctgcactcagaaaataattcagatcatgtttatgcattattaagttgtactgaattctttgcagcttaatgtgatatatgactatcttgaacaagagaaaaaactaggagatgtttctcctgaagagcttttggggttgggaactattcttttttaattgctgtactacttaacattgttctaattcagtagcttgaggaacaggaacattgttttctagagcaagataataaaggagatgggccatacaaatgttttctactttcgttgtgacaacattgattaggtgttgtcagtactataaatgcttgagatataatgaatccacagcattcaaggtcaggtctactcaaagtctcacatggaaaagtgagttctgcctttcctttgatcgagggtcaaaatacaaagacatttttgctagggcctacaaattgaatttaaaaactcactgcactgattcatctgagctttttggttagtattcatggctagagtgaacatagctttagtttttgctgttgtaaaagtgttttcataagttcactcaagaaaaatgcagctgttctgaactggaatttttcagcattctttagaattttaaatgagtagagagctcaacttttattcctagcatctgcttttgactcatttctaggcagtgcttatgaagaaaaattaaagcacaaacattctggcattcaatcgttggcagattatcttctgatgacacagaatgaaagggcatctcagcctctctgaactttgtaaaaatctgtccccagttcttccatcggtgtagttgttgcatttgagtgaatactctcttgatttatgtattttatgtccagattcgccatttctgaaatccagatccaacacaagcagtcttgccgttagggcattttgaagcagatagtagagtaagaacttagtgactacagcttattcttctgtaacatatggtttcaaacatctttgccaaaagctaagcagtggtgaactgaaaagggcatattgccccaaggttacactgaagcagctcatagcaagttaaaatattgtgacagatttgaaatcatgtttgaatttcatagtaggaccagtacaagaatgtccctgctagtttctgtttgatgtttggttctggcggctcaggcattttgggaactgttgcacagggtggagtcaaaacaacctacatataaaaagagaaaaagagaaacttgtccatttagctttcataagaaatcccatggcaaagggtaataaaaaggacctaatcttaaaaatacaatttctaagcacttgtaagaacccagtgggttggagcctcccactttgtccctcctttgaagtggatgggaactcaaggtgcaaagaacctgttttggaagaaagcttggggccatttcagccccctgtattctcatgattttctctcaggaagcacacactgtgaatggcagacttttcatttagccccaggtgacttactaaaaatagttgaaaattattcacctaagaatagaatctcagcattgtgttaaataaaaatgaaagctttagaaggcatgagatgttcctatcttaaataaagcatgtttcttttctatagagaaatgtatagtttgactctccagaatgtactatccatcttgatgagaaaactcttaaatagtaccaaacattttgaactttaaattatgtatttaaagtgagtgtttaagaaactgtagctgcttcttttacaagtggtgcctattaaagtcagtaatggccattattgttccattgtggaaattaaattatgtaagcttcctaatatcataaacatattaaaattcttctaaaa

SEQ ID NO: 37 - DNA, 4554 bp, Homo Sapiens
gcttagttgtgcgcgcccgcgctctgctgtctgcagaccgcgtgcgccggcagtggctctaagggggccgcgagggcacagcggggcaggaccgcggcagagcgcagtaaggagagtgtggaccctcgccctgtcctctaagctccatgtgaaatgtggataatattccttactgccataaatagccactggccgctgactacgcgtaaggcaaacaagcgacctgcgttcaagggacccgaagactaggggagaagcagcgagcgggtcgcggccgcctacccaacggacgcctctgcccaggttctctgccgggaagcttcgtccttccgggccccagcgcagccggaggctggggagctgctgcctggaagggtcagataccgcctgttaggcggagggtgggaaagacactctcctgcttcaggagctatcgcagacaaccggagggcggcttatcgcagagtcccagagccagccagcaaggcaaggtcgcgggtgcacctttcactcccagaagcttgggtctgggactgcaccacgcaacgtttgcccattttgagggctttaggtgtttcatatttcagttaatagaatttcgattaatacataatttgataccattttaattgtttgctactcgggagcaagttttatgtttagctgtaggagttaggctaagttaaatgttgcaatgctatatatatttaataggatatgaaaaaactatcttacagccgggcgcggtaactcacgcctgtaatccccgcactttgggaggtcgaggcaggaggatcgcttgagctcaggagtttgagaccagcctggacaacatagtgagaccttgtctctatttaaaaaacaacaacaggcctggcgcggtggcccacgcctgtaatcccagcactttgggaggctaaggcgggcggatcaccggaggtcaggaattcaaaaccagcctggccaacatggcgaaaccctgtctctactaaaaatacaaaaattagccaggcatggttgcgggcgcctgtaatcccggctactcgggaggctgaggcaggggaatccttgaacccgggaggcagaggttgcagtgagatcgcgtccatgcactccagcctgggcgacagagcatgactctatctcaaaaaaaaaaaatcttactatttggtatggaattttctgatagctagggtaaagatgctctttttccaagaaggaatccgagtatccgaatacaggtggtttagtgttactctttgtttattggaagttgtagcagctgtgtttagatagtctgctaaaacaaaaactgcctaaaccagaagagtttatcttttgccattgtgtattaaaactcttcatagaaatatttattttggagtttgaaatttaagtgaaaatgtggctcatgcataggtgtgggtgtacatatgactttcaagtgacaaagaagattcttagcaaattgtacgtgttcattaagactcataagttacctctttcctagaaaaacaatatactcctccaaaagctcaactgacaatgagaaactgcatttctggacatgaaaagtcaaatgaatgcggggaaaagtaaattgcctatagaggtattttctgtatttccctagagggggaaatgtgtaatttctcaaaaggaagaagtcctcatttatccttctgaaccacaatcatatgaatccattcaattaatattaatcttatcttctattctccatcactctctacatctttctataattgcatcattttcttgtccgtataatacatcaaatgcagaggtgattttaagggagccacaaatcaagaagtctcaattcaataatttcgttaaaatgtaagaaatatatacggattaagaatattcttaggtaattatgttctgtttcaaatatcagtgaaaattttcatagacatttaaggggtaaaagacatttaacagatagaaaaaaatatctaccttttaaaaaatgaccttctcttttgtcctacgtgatttgttgagcagactgggttttttaaaagtttctgttgaaatgagcatgttgtaacatgctcatatcccatttcaattgacaaatatcacttggataataattgtatatcttaaatatgaacatatgaagcaatcagcagcagcatcctttcactgagcaaggcttaaaaataccaaagaatcagtgccagaagaaattctttaacttaaaatatacgtaatcactacattaccatataaaacaatgatttctaaatgctggaaagtatatatcttaatcatgagacgaggcagcactatgcacattgtgcataatatgtgagacattgaatggtataaaataaattttaacttttatctaaggtttacaggaaaagcagcaatacctatgattaagccacccgacttaaatgagtgtttttaagatgtggtgcttgcacataagcggaggagtggtggtaacaacccttgtacagttcacaaatccaggactggcaggaaggtagacaagtgtcattctcagatttcagaacccagcctgaaagtgagaggacgtcaggcaacaataccatgcaacgacagcgtgcaacaaatacacaactggattatctttttaagggagaagcttgtttgggtttctaattgcttttaatgaaccaagtattgattactgttttacccaaaactgtaccaaaatatgtgtaaaactgataagataatttatagctttctagttatggaaaagcttgcaaattaaataattcaaatctcaatttaagaactgtaaaaatgagaaattggttcatgtaccatagtgataataataccaacaatacttaacagtagactatgcagacactaaccataagagatttgtagtggctatactaatatcagatgaaacagactttaagaaagaaatttctttttcttttttcttttttttgaagtgcaatggcacaatcttggctcactgcaacctctgcctcccgggttcaagcaattctcctgcctcagcttcccaagtagctgggattacaggtgcccgccaccatgcctggctaattttttgtatttttttagtagagatggggtttcaccatgtcagccaggctgatctcaaactcctgacctgatgtgatccacctgtctcggcctcccaaatgggattacaggccagcgcgtctggctgacaagaaatatttttagagacagaaattccatactgataagagggtcaatacattgagaagatataacagttataaatgtatatgcacccagtaacagagccctaaattcatgaagcaaaaatgattgaattgaacagagaaatatacaaacaacagtagtttgatatttcagtatcctactcacaataatgtgtagaacaaccaggcagaaaatcactaagtatatagaaggcttgaacaagactctcaacctaaccaacatgtacagaccactgtacttaatgacagctgaatttatgttctttttaaaaagtatactctccaggatagccttatgttagaccataaataagtctcagtaaatttaaaagaattgggatcatacaaagtacattctccagttacagtggaattaaattagggattgacaatagaaagaaatttggaaaatccccagatgtttggaaattagattactcatgggccaaggaagaagtactaaaggaaattagaaagtattttgaaatgaatgaaagtgaaaacatattgaagtcatgcactgcagctaaaacagtgatcaaaagggtatttagtcctttaaacaccaagaaaaagagtctcaaatctacacttccaccttgaaaactagaaaaagaggaggaacgtaaacctttagcaaagggaggaaataatgatcatattgcaaatcaataaaataagtaacaaaaatagagaaaatgaaaatcaaaagtttgttttttagaaaaaaaaaaaaaccagtaaaattaatgagccaacattaaactggccaaaaaattaaaaagaccaaaattaggaatcaaaacaggtacatcactaccaacccaaattaaaaggattgtaagagactgtaaataacgttgtgccaataaattagacaatgcagatgaattggacaaattcctagacagacacaaattgccaaaactggctcaatagaaaatccaaaaagactttattttctatggtggttgtaaaaaaaaaaaaaagtattataaactaggtggcttaagacaacagaaatttattatctcatgttctagagacatgaagctcgatcaaagtgttggcagggctctgctccctctgaaacctggaagagagaattcttgtctctttcccactgctggtgttttcagcaatccttggcctttcttggtgctccttggttttacaactgcagcacttcagtctctgcctgcatctccacatgtgctgttccctcacgtgcctgtctcctagaggctgaagtgcccagcctactccagtgtgacctcatcttaatgaattacatctgcaatga

SEQ ID NO: 38 - DNA, 1710 bp, Homo Sapiens
cctggatgcagtttgcctatgtgaaagatcagtagaacttaaaaatgatcacagtgaataacttacagtagaaattgaaaaaatgataaatgagtttagtgtactaccaaaggaactatctgaaacaaaagaaattaggtcatcacagctagagagccaacaagttgaatgggaacaaaaactcagcaattttttactttaaaacaagaagaagagaagaaatgctgatatgttatatgaaaaaactagggaagatttaggcagaaaagaagaggaatataagaaagaaatcgaagtgaaacaacaacttgaactcagtccgaagatatgttgcatgaaaattgcatgttgaagggagaaattgtcactctaagactggaaacggacacaataaaaacccaggaaacagtaacaaaaacagtatctgactgtaatggagagctgaatgttttgacaggtgagagcaggtgagagattattgctcagttctgaactgaagaaagaaaaagaaaacacggaaagactggaaacagaagttgaatcctatggttatacactggctgctgctatatgtgatcttgatcaaggcaagatatcaaggaaacacctagaatttgctctccagagtgcaagagatgcttgtttacaagaaaaaataaattttgacatgtctaacctaaaaagtaacaatgaaattctttctcaacaactttctgaagctcaaagtaaattcagtaacctaacaatttagttccataacacaagagatgctctcagagatataactttggtttcagaacgtctacaaagagatctacgccaaacacgatgtcagatgaaggacactgaacaaatgtatgaaaatgagcaagataaagtgagtaaatgcactgcaaagcaggaagccatggaagagagattatcccagctacaaaatgaaaatatgctgcttcaacagcaactagatgaggatcacaagatgcagatacggaagaaaagataattaatactcaagaccaatttcttgggaatgaaaagcaacgttgttcactagaagataaatataaggagttattaaatgagtgtgatcatttaaaagaaatactatatcaatatgaagaagagaaagcagaaagagaactaagtaagaaactcttacaaatgacagaaaagaagctcaatgaatgtgaaaatggcaagtttagtttttatggagatgtaaagaccaatcaatttgatgtagatattcagattaataatctaaaatatatctaaatctggatacagagaataaattttttcaacaggagttattatctatgaaaacaatacaaaaaatgtgaaaaactacagaagaaaaaaccatgtttgaacaagaagtaatagacctcaaaagtcatgtagacataagtatggtagaatgtggtcaagtcaaacaatataaacaggagattggagaaagagcaagacagcgtatagaagaattacaagaagtcaatttttaaaaatgtagctgtttaatttgctttagacagaagcagcatctaaagaacatttagagcagttaagatggcatgatattacttcaataaataagatggaactcaaaattaaagctctggaagctgagcagtcccaaatgtaaattgctcaagaaaactttagtgatagcgaattagaaaaacagaagcagctatatctagaagaatt

SEQ ID NO: 39 - DNA, 21561 bp, Homo Sapiens
gccgaggtcctcttccaggattggctacctcctcataaccataagataattaaaacttggcggggggggggggcagggttaaaaaaactttttttatcagtcagaggataatgcaagtgtttaacagatgcttcactattaaaatattttccccccaagtctcaaatattgaagaatctctaaccagggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaaaaagaaaaaaaaaccaaatactacacttcaaaaagaaaatatgacaatgaatctctttttatggattctctctgcataagtggaaacaatatgatttaaatccccaacaccccatcccccttttcagacacagctgaagtgatacagatactgtcttctaacacataatctccctctctcgggagaggcacctgcctgtgctacattcgatttagtttgtaaggtttcaggcccctccccgacccatgtaatatgtaacaaggattatcaaataataaggtcttggatgtgaagtctgctttacacaagaattcaagaaagataggcaggacttgagtaattatgttacaacttcatattactttccaaatgaatacccattttcttctcatgtcaacttctagagatgggatgctgaggcagagaaatatttttatgagactctggagtacatactaaaatgtgcttccttattatttaagaatgtgtaaggtatggacctacatttgtttgctggtggtcataaaataaattcatagccattgtggccaataagcaatctccttcacgctttaaaagtttttggtttataatcccacctggattgtattttcactattctgtatcaccctcctattgcaatattttggttctcaatcttatgtaaagcaaacctcagaaatgatcgtttccataaaattgtgcaatggcaaagccacagaataatattttgagtccatatagccgtgcatgctcatctatatagctcttatacagttttctagctgattgctttggtatttcaagaaataggaagcagtagctacctattttaatgaaagggtaccatttcataagaattctattttcactgaaaaaattggtctggcacattattcaatgcaaaagattataatattactttcacgtgtgttaatctgtttagtataaaactgctagggtgtcttaaccattaacgcgttttgccacactactttcaaatggtgatctgagataattacgaagattttgatgttaatcccacgttaaatgaacaactatgaaaataatcttaaagcattattactcccatatacatgccagcaaacccaattgtggagagaacatgattactttttatctgacattatcctataaggatatggctacatttatttcttttaaaattggagcagttttcaattactttttaacagaattgttttcaacacagcattttgcagtgcccataaaccatagcaactttgtcctgatcgatacatatttttctgcattattattcattagcctctttgcaaactcactaaaatagaatagtattaaagtatgaatatatagagaacaattattaggttctacatatttatttaggtaaaccaatgttattaaaattaaaaacatgtgcctggcatataagtgcttcttcaggaattcttttttggatgcatagttattattttttaaacaaactcagattttcaaacactgattttcttctctgaacgggcattgcattgttttaaacagtagctcctggaataatgccacctttagtattttagactttcaaacaacaattggaattggataaatgctttcagctgggagcactttcctaatacctttgtaggtaatgggattctctatttgtgctgggtgacaaacggacagtgccctggacagactgcctaccctctgcagaatctaccaaaaagtagagttttcccatgagactgcttgtggtccatctaaaaatgaaaaaataatcagagaaaatgcgcaaagccttttctaactacagttatgaaatgatggcttaaagaggtatttagaaaataagagtggagtaatacagaaacaaaatctgaagaagaaagtttgcttaggagctgatgctctttgtctacaaacaagagggtaaggagctggatccaattgaattgaattgtttttgtttgcttgtttgttttcttccattcagtgcctttcaaactgttttttactggatgaagaaactcaaccaagaaaatatatgtcgattcttgtatatgggacaatattagctgctgtgatttttaatactagcataaaatataagaatctttttattactgtgatattgttttttcctaaatgaatgcatagtgtaacaattggtgtcaaaaagcattgaatttttttcagatggattaagctggaataataaagtatatctatgagatgatttctgtaaactctgacttgctgagaaaaaagtgaaaaagctttttctggaagaaacatggcaacttaaccgttattaatctggactaaataaaacaggaaactgcttctttacatttctagtaattttttctgcttttccaaacattgttaagttctatgcaacttgtgctattcaagtaaagatgatgtcagtaataaaattacagaatctaatcaagtgactatttttgctttattacaaaatttatgtatttaattgggatgtttaattgcttagtttttagaacactgaatttttctttttccagacaacagagtgatatttaatgaagtgcttataaagataaatacgatggttcatcaaagataaaatagtcataataacaagatggcatttgagtcaatgtggagtggactctgctttgtaaattatactgctttttaaaagcatgacctaggtatttacaatggggacatctgagaagagaaactcaagagtcctcaacttacacagccaagaatacacaatcatgtaggagaacttgccctcagaagcatttctctattgacattgccatttcttttcctccatctagtacttccatttgctctatttcactaaaaagtcacagaattaagagtggctgctgcaactcactgggctttctctgcttaaaaaaccttaatatcacatggtattaatacagctacattaataattgaaagattcactcagctgaccctatgatttttctaattattgttaactatctgaatatttggaaataattgtatttttccactgactttttctcattgccttgggtactagaaggttttttttttttttttttttttttttttagatggagtttcactcttgctgcccaggctggagtgcaatggcgcgatcttggctcgctgtaacctctgcctcccagttcaagtgattctcctgcttcagcctcccgagtagctgggattacaggtgcatgccaccatgcccggctaattttgtatttttagtagagacagggtttctccacgttggtcaggctggtcttgaactcctgacctcaggtgatccgcctgcctcggcctcccaaagtgctgggattacaggcataagccactgtgcccagccgggtgctagaagttttaacatataacttcagacacaactgagtaaatagttagctgtatatattttattgtattgttatttatattatgtcggctttgtgtcagaaaggatttaaagcacttgtttcaagaattggtatgctatatttttcaaaatctgtgtataaaaataattcccataagtaccactgtaatttacttttcatgtgtattacaaaatcagttatgtgttctggtaaacattttgatcccaagaggaagcaggattacatttagaatgtgacaaattttaaaaattaattttgttgtaaagaaatctttataatgatatgccataaagttattactatgcatgtaaggccgcataccatagtgattaagagcaggtccttggagttagaggcacagtctgaacttgactacaaaagttatcagctgtgtgatcttgggaaagtaaccattctcagctttagttaccacagctgtaaaaggtggataataattatagactctgtcctgttgttgtggtgaacatttagtgagacgactcacatgaggggctggcatagggtaagtacttactcaatatcagctgttctctttggcatagctctgttagagtggcatgccacagttaccttcttgagagccactaagcgtgggaacggtaacagtccacagaatttttggagattggtatgaggaggctgcattggctcccagccctcagggttgacagggtgaaggtaatggcttctggctgtctttagagctcccaaaagatatgagaagatggttctagtgatgacaacccactgttctgtcagtggaaatctagttttatgccatcttcatcattcgtggtgtagtctatcggtgcctgacacaaacgtctagagtggggaaaataacaccttaaagaaatagaatatcttaggtccatgatttgcctgctgtgtttattatgtaccccagcagtaaaatattttaagtatatttatttgcaaatcatacatctgtacatctttactgatatgtacatgataaacctgtgcaaaaaataacctaaaaaggggtaagattaaaatgaagaattagacaaaaggtttaaatgttttaaggtaagattcagcatcatcaacagtgggtataaatccatacttcaaatagccttggtggtttaaaaatcctctggttgatttacctttggattcatatcatcagtgtttccgtcttgttttgtggctgagaagaggaggagcagtgtcagttctgccattttcctgtcaatggtttatgtctgccttcttggaatcatatttaatgaaaggttctttgcaggaatatttttaaaccccttgttcatttggtgaagattagtttagttaaaactggattatataatatatttcaatctaactgagccagacaaattgtaacacatttcaggccatgtgtgcttctaagagggccactgttaacccctctgtggtcaagagctcccccttccctgaggttaccttgtgtgctcaaggcagctgagtaacataagaagaagcaagggtgttgatgccaatggttaccctattagtgaactcatttctgattgtttgtatgaaaacaaatatgatttctgttataatcttctgacaccccattccttggggcaccactgtcctagactctgaaatcactgtggttcctgccatttcttgaccttgacattctgtgacagaatgaaggagaccttaggttcagtggacttcattttctataactagctttactctattgatcacatagtggtatagctcttcagtgtttgcaaatcaatgttcacatatttctgtcatttgaactcagcatctttatagggcaggtagagaaggtctgattctgtccattgtaaagatggaagagatgaaaccaccagtgttgctgactgcagatggaagataattgcgtaagttcacacagcggtagacctgggtttgaatttgtttttgaaagcaatatcatcctgattcttttctatcatgttaacacaatttttaaatgatattcatattcatctgaatggagtagagacagacagttatatagtagttgcaagtttagcttttaaagaaactgccaaactgtcttccagaggctgtactattttacattcccattagcagtataggagtgatcctttttctccacatacttgccaacatttcttgttgttcttattaaaaccaaacaagtggtgctgggaatgcattaagagaaaacatatatattattaatagaataaataataatcaatagataatgtgcaggaaggggatttgcatttacgaaacatctattgtatcctatgttctttacacatattatccctttaatatagttctatacttgcagggacaggttttgcatgtaaagaaattgaggttcagagatgttaaataatttgtctaaagtacacagcatttaaattgtagagtttaaaccaaagggatctggtattaaaaaattccaggtaatgttaaaataaaacaatgcattaaatttgaaagtctttctgttactttttgttccaaattggatctctgtctttggctaaaaatcaaccatgacaacaagaaatgttggcaagtatgtggagaaacaggatcactcctatactgctaatgggaatgtaaaatagtacagcctctggaagacagtttggcagtttctttaaaagctaaacttgcaactactatataactcagttattgtactcgtcagcatttatctcagataaatgaagacttaagttcacacagaaatatgtgcatgaatgcttacagcagctttaataacagtgaaaaactggaaacatctcaaatatccttcaatggaaagacaaacttaaccattctgttaacagttaagcatgtatggttaatcgtggcacatggaatactacttggcaataaaaaggaacacattgttgataagtgcaacagcctgaatggatctccagggaattatgctgggtgaaaaaatccaaacccaaaaggtaacacactgtatggctccatttatatagaattcttgaaatgacaaaattatagaaatggagaaaagaaaagtgcttatcaggggttaaggagcagtggggtggaagagaggtgagtgtggccataaaaaggcaacaaaatggatgcttatgataatggaaattttctgtatcaatgtcagtatccttgttgtgatattgtactgtgtttttgtaagatgttactattgggagagactgggtaaagcgtgcatgggatctctattatttcttacaactgcatgaggatctacaattttctcaaaataaaaagcttaataaaaatgcctactgatcttcaggaagttcagttccctgttttccataactgatctgaaaataggggaaggacaattgagaatttaggagttgtaaactctgaggctgattttcagcgaactactcaaattattctgatttttccccttgattcttattatggattgtaggacattcttcctactattttggagaagaaaaaatgccacctctctatcataggacttctgttttacatatgatttaaaaatctattagctgactaatttacacactagaagatgaaacttggttacattagattccattgccacaatttattttaaaaatcagagttctcatctttcttgtttcttcttcctgccttactttattttcttttttccttattctatttgaacccatattttcctatattgtactgtttagtctaaaaactagtaagcatgcatattgttgattaaattagcaattgacgctcttaaaatgagaactataaagactcttgagcttccacacattatgctatgcttgccatatgcttgggtgttcttattttcggagagaagtaatggagattataaatgttatttttaaaatttactggtgatttgttgagaagataaagtaacaacactattacagagggttgctcttgatctcccaggccaccagtgcagtcaccgagccctctgcaaacacctgataatgctgaagagtgtgttagtcattgtagaggagctgctgtcatgacaaataggggttaaattgtgagaatttcaggatatattttggggaaggattaaataaatcaggggacttgctgacagcaaatagtatctttgatttgaaacacagaatcagagaattgagatgaatcccaggtggtggttgggagtttgaaaaagtcccagtgagttggctgactaagtgtagacttcatttcaacatcattaaatagtctttaagtggtgacttaataattgttgccccaagaaaagattttgctaaatacagaggtggaattaagtatattaatccaagaaacattttatttaaatgattttcctaacagtaaggttggaaggccctagaactgcttctaggagcttgaagtgcatttaatagttaactgtcagaatgaaaaatgaaattttaaatttcaacaatgcaattaagttcttattttcttatgatagtgaataataaatttcattcaaggacgccattggcagatgttgaaaagaaccattttcactccactagcttgcagtggactaagaggtagcaggaagggagattggtactacagatcctgaaaaaacaaaacaacacaaaacaaaatccacaccacaaatggacacttccagatgcttaccaacaggaagtgccttggaggacaagggctgtgagacaggtgaactctagggaacaagaattcctagttccatgtctgtttacaagaatttgtcatgactggttcacctcactttatagtttcctcagaccaaagagacaaagaaaaagcaaaaaacaaaaacaacaaaaattctgaaacgaatggacaatacaaccaaaactttaatatgaaccaaaacaaaaattgggctgattttatgaggttgacttaaagtcaggaaaagaatgataaacttttgagaggaagaaagaaatcatcaaagccacgaggagctcaaagtggtgtttaatagcagctatcacattgcgcccgagccttgaccacttctgacgcagctgtttcgttttaagatgttcccattcctgttccactcacacagtcctccacagtgacctgagtgcacgcacccaagccggcaggccactctagaaaaccgtaaacccctcagagagtcactgcaggaataggggaaatggaagtgatgaaattcaatatagcatttagctgaatcatcatctgaggttaagcccagtgaacaattagcagtatcgggagtctcctcgtacctgtcaaaatcgcaccgacgggattttgtgcaaagtatgtatgtgtgtggaagttgttttttatgtttaatagcaatggacctggggtagtaatttagatacaactttttaaaaaaaatactaaagggcaagtgtggtgagaagcttcttactcaggaggatcttttcaaacattgcaaaacatcaggccttgaaataattcattttattaagtagcgcactcttgtcttttcattcacaaaaggaggatgatttattatacagataaatgcttgcataggatgatgaacacctgtaggaatgcatgatattctggaagttgatcaaggtccactgtacaccagtaattagaggtcatgatgatgataataataataataataattaataatggcacatactatgtgtcagctcctgttctaacttcgtttctcatattaacttatttatttttcatgattagccactaagatacaattattatccctgttttgtagacaaggaactgagtgaagctcaaagaagtaactaggatcacactgtcacacaggcaggaatgaaacccatgcagattggctccttagtgtgctctctgatctattatcattcatcacatatttactgagcatctagtatatgaaaggtattaggctttatgcaggcaatactttagcgaagccagggagatgtctctgccttctttgagcttatagcttggtgggcaaaaagctaatggtttaactgtataaaaaacttgatgttgtgaaatgatatatgccaatgtttgcatggtatgatgattttgattaagcaccataataaaaatagggagcctgggtctcacacagccttgattgtcttcttccttctgctccccagtggagtgcgtaggaaggtcacaccctcaatgtcaggctccttcactgttctcagtgagtgtctcaggttgtaggctacatgagcaggtttgcacctggatatgattgtggcagtaacaatagatgtgactatacacagtggcagtggcagtaggggtgggagttgggtgatgggatgatcttagaatgcagtgttggtattaactcagttttgttttgttttgatgtacagccagccatacgactctggaatatgactctgggtttaccaacttggggatggcccggggatttaggagatggccccaatggctctcctcttttttagaaaggactgttcaagttccttttttttttctttttaaacaggatctcgttttgtcacccagatcgggggcagtggtgtaatctcagctcacttgaacctttgcctccctggctcaagtgatcctcctgcctcaggtgtgagccaccatgccaggctaatttttgtattttttgcagagacggggtttcaccatgttgcccaggctggtcttaagctcctgagctcaagtgatccatgtttctgcctcccaaagtgctgagattacggtttgagccaccacatctggtttaagctatttcttctaaagatatagtcacatctattatctttgacccctgcctaagcaattctgttcagatcttaagactatttcttcccgggattcaaactcagagttaagtagagtcaactatatgaggtatatgtgaggttaatttttgaaacttttatttttaatttcatctgggatctcctctagggaagaccactttatgattatgggttgcattcccaagttcagttgattgaatttattcatacattatttaataaatgtttattgagactgaaaataaacttgaaatcctagaattcattggttgtcttaaaaattctaaatatgaaatgctaactttagcttcatgagtatttagaatagaaaataaataattcaaaaattgttcaggaaaaaaatccatgatttattctactctggaggagcatattcaatttaaaacataccgattcgtataaacttattggtaatgaggcgatatactttttatgagaacatatcaaaccatagacattgagatccagcatctcctgagtgagtaaaatgtcagggttttattgatactaatgataatgggagtgacatatgtgcatagagtaagtccatggttgaaagcctggctgattaggcgctgcgttctgtggtttttgccacttgtgtgtgattaaaccctgcagaatagagtctgttgccatgtatttggttcgtgaagaaaactagtaaagtgatattgaatgaatgattcagtttctcaaaagggtagactattggcctaacaccttcctaacttggagctgtcaacgtgtttagtttggttctaatgggagctaggctggagaagagaaaagttttgtgagaaaggttatgtgatattaataagaaccacattccgtttgatgttttctcaaatgattttttttatcttcctaagaaattgaatgattcaaaaataataaatcttccttttctatggcccacaaatgatcaacattttggatgatcaaaacaattttgtctttaagatatcacaacttctagtgcctctttatttgccagtgctgatttacagcagaaagtatcacttcatattttttccaagcatcaaagtcatgtgttttacaaatattcacaagtgcttaaaatccatgaacctctctctgtattcctatttttttattcttctataagtatgtatttaaattggttaaacagatggctttctacttttgaaaaaaaaaaacccactaagaatattcacctcaagatggagaactcataggttaaatttcattctggaatgcacgtttacaaccaggtaattaacctttgaaaatgagggtactcgaaggaaacaaggaaaatcttaacaagatgatctcactaacgctggtgtgttagacttctcagaagtagagatgccccagaagtttaacaatgaaaaactttaaaatatttttaaaaacatagttaatctttgtagctttccagttttcgtcctttattacgataaccttaggaggtaaacgcttcaaggggtgtatccttataatcataggaattggtacacagattttggtggaaagatggaggtgtcaacattaaccagtcaacatatatttgttgactgcctaccacatgcacaagtctcttccatgcttgcgaagagatacagtgatgtgcaatgtgtagaatctgcccttcatgagcttttgatttagttagtctgagaaggaatagatcagtgaaaagttaaaaggaataatagatggagtgttgaggcagtccatgattgttatctgagacattgagtttacaatgctaagttaaaagaatgagagatcactatgggatagaatggacaggaagagttcctctccttgaagcttgcattaagccataaaagacaaagcaattttggaaatgcagaatttggagatatgaagaaagaataattcccagaaagggagaagagttttggagccagacagatctgggttcaaatcttggttctcttgttctctagctgtgtaatcttgggaagttacttagcttttatggacatcttctataaaaaggatatgatagcgactattttgttaattttttaggattaattgagataatatatataaagtgttttaagcacttgataaaaggtaatcctctcagttggagagaacatcctaaacaagtctggaggaaggagacagccagccatgttcatgggacaaaaagaagactattatgagtggagggaaagattaagagaagtagagtgagatcacatggaaagataaattaggattagcttcagccattcacttgtttcttcatttaatactttattgcactctttatgtgggaagctctctcatgtgggaaaccctctgctcggcatggatatgcagagacaaagaaaacttagccttggatttctcttgaatgtcaggttaaggagttggaacttcatgctgaggagaattatatctttcaaaagtggaggagcttgaaagtagcatttttggatagttaacatggaatgtgattcttgtgacccaagatatgcattaagttaccatctcctagtggttgatggttaatgttgtgcctggagatgtgacccagattctcttgtaggtcattcctgacagagggtccattccaatgagtgaggaggaggagcttctgggctgaacttaatctcatctcctgaaataaagcaatgacattgaaatttttcatattgcacttgtgtttacatttctcatctaatctgagatattccacgtttggtgagtcttgctttgggcctgcagtcttggtgacccttattagttgcactggaatagctgtctattcagggagaagtagaatcctgggaatctggtcttcagtgactttctccatgatcatgaatttcatgagaggaggtccccttcctgttagtagatctctatagcaagaggttctgaggcacacaagcacactggatactcacctacagttctagtttaactgatggaacataggtatttctttcatgaaactttgcctggataaacagcttctgtatcttctagtgacaaaattttgcctcctgttttcccctctagctctagtcttaatctctacttccttgttcagtccaaggctcaggagaacccagatcatataagatatggaacctattgcttcctaggatgtccttgtacacagtgactaactgctaatttcaaggatcaatttctttctggagttagaatcatattatattatgtttcagaactgaaataaaattcttttaaggtgattatattttggctctcagcttggaagatgccactggggcatggcatacaagacacataacttataggaggacctcctttaatgcccaagtgccagcttcatgcttgttgttatatatcattttattcctggctttgatgcccacacacagacatatatccacacaaagttcaatctatatattttttgtagctgtttagctcaggtgattagggcattgagctaatgagaacaaggtcacagtttcagtctttgtgtgggccagcaaggtttgctttgttcagaggccacagacctggtccagccagctgtccagcacatgtctgccccaagtcatgagaggacggggcaggagtgtgtggatggacaagagcaaatccatcaccacccttagaaaaagtcaagtcaagcacgtgtcctactaatgggggtcaataatgtctcatttaaatggggctgacattttattacctcttgctgagagggtcttttgagcaccaaatttaaacattgtcgcttttttgtgtgaatttatttctaataaatggaaggttgtacaagaccttagatgattacaggtttccaaatacagattaatgacttcaatatttaagaagttgatgtgatattaaaaaagaaagttcagtatggctattcagttatcttcccttattaaaatctgttttggctaatgaaataaaaagttcataagttcttccgagagtaagtgagaatcattgccttcattcaagaatgaaaacattattattaaactcattgataatgagaccattaaaagttagcatgaagcaggtacaatacaattctttattattgaagtcttcagatattacccagcctacacatcccacctttcatttttaggcaaacaaattccccaaactatattttttttaaatttagcattaggtcttgttaggcttcaaatgggatcaaaaccaatcctttccaaagtgttctaccccagctgtttccctcacctgggtggtagtgagtataaaggcatttgatacagaagggggtggtggggcagagaacagaaaggaaacttggtgagagaatgatgaagaatgatatattagagattcttttaaaattcattcattaaacaaatgtagcataatggaaatgtctattaaattttttggcataggtaatgcacttgcaagggtaaaaacagaaatatgagatggtattttatgaaaagttttgctcaccccgcatccatcatgaacccaattctactgcccttgtatagccatttttattagtttcttgtgtactctttcagaatttctttatgccaatatatcttaaactctttcctttttttcatacaaaaattaacaccctatcaattttgttcctggcagggtgaggtggctcacacctgtaatcctagcactttgggaggcccatgcgggagaattacttgagcccaggagtttgagaccagcctgggcagcttagggaaaccctgtctttataaaaaaataaaaaattagccaagcatggttggtgtgtgcctgtagtctcagataactcaggaggctgaggcaggaggatcacttgcaccagaaggttgaggctgcagtgagccatgattgcaccattgcactgcagtctgggtgacagagaaaaactctgtctcaaaaaaaaggtcttgagcttgctttttctacttaacaatatgttttgtaaatctttctgtatacgcaaagtagcctcatttttcatagttgtatatcattctattgatgtgccacactttatttatctacccccctattgatggaccttcatatagtttctaatattttctattacagacaacaatgtattgaattactttggaatgcattaggtagaaagcattcttctttctttaaacatttgcgtagcattccactgaatggctatatcataacttatttctctagccccctattgatcgtcattgagtttccaatcttttatttttaaagacaatgtcataatgaataactttatacatgtattatcttatatatgtggaattaaatttaccatgtctagataattttatttgaatgcaattaagtatgatatcaaaaattataaaatcaaaactgcagtgagaattcatcttaccccatgtaaaatgactcttatccaaaagagaggtgatcatgaatgctgatgagaatgtggagaaaggggaaccttcatacactgttggtgggaatgtaaattagtacagcactatggagaacagtagagattcctcaaaaaactaaaaatagaactaccatacaatctatcaatcccactgctgggtatatatccaaaagaaaagaaatcagtatattgaagagatatctgcactctcatgtttattacaacactattcacagtagccaagacatggaagcaacctaactgtccatcaacagatgagtgggtaaggaaaatatggtacatatacacagtagaatattattcagtcataaaaaagaataaaatattagttgggcatggtagcatgcacctgtagtcccagcaaccagggaggcctaggtgggaggattgcttcagtccagggaagtcgaggctgcagtgagccctgatcacaccactgcactccagcctgggcaatatagcgagaccctgtctccaaaagaaaaaaaaaaagaatacagaatgaaattctgtcatttgcaacaacatggataaaactggaggacattatgttaggtgaaataagccaggtaccgaacgacatatttcacatgttcccactcatatgtgggagctaaaaattaaaacaattgaactcatggggagagtagcatgatcattaccagaggctgggaagggtagtgggaggaaggaataaagtagggatggtcagtggatacaaaaacacagttagaaggaataagatctagtgttctgtagcacaacagggtgactatagttaacaataacttattgtatattttaaaataacgaaaagagtggaattggaatgtccctggcacaaagaaatgataaatgcttgaggcagtgaacaccctaattatcctaatttgatcgttacacattgtatgccttcatgaaaacatcacatgtgccccataaatgtatactgttatcatgtacccatcataattttaaaaaatagaaaagaattatcacaattattttaaatgaagaagcactaagtaggaaataaggtacaatttaattcagaatagctttccttagtagtgttcaacctactgtacacatcaacaacacgcccttgcagttaacattgttgctggatgtttactgttatgtgtgaccagctgacatgtccctctaaagaaagaggatttaaataagtcatgtatgaaagactgggtaaaggtgagacactgtaagacctagattattttggggctgtagcaatcagattagctattgagtattcattcataaattcattcacttcactgagtcatccacttcttgtcagattctgtatttattcatctcctagtaagctactcattgtgctaaaatgctggtaaacagaagtacaaagcaccagttataactcacagtcttgtagaggaattaagaaatggacaggaaacagtaagggtgcattgtaggtatctcaagaatgatataaagtgttatggcagatctaaggaggaagacatgactttccatagataatggatggtggcatctgttctggagtaccagaaaattagagtaacaaaaacacagcaggatagattttcttacaatgcagtgattcatacaaaggctaccttgactgttagtttgtgactggaaactctcagtcagggctgacggagggagtcctgcccctgccagctgttcacctttccctggtgctggggttgacacttcacatgctcacatagtctggttctgtgctgtctactagggttgagtgtgctgctgggcagagaattttggcatttctccagatgcacatgaggggcagaccgcctcagcagttgctaatgacccaaagaagccttctttcatgacttattttgtcccctcattttattttttgatgtattttggtgagctgagctactaccttctcaggcagtcccaacctcagaaaattaaccatgtagctttctcatatctgacattgcaaattgaggcaaggtcgcatgctttctgactacctgactgcctgggcatttctttcatgcaacttgtttaagccgcccatcctgatccctgttgctaagccaccatggctgcatttggacgcagttcttcccagctttgccgcagcataactgtggaaaggatcttgatgaatttggacctggggagggacgtgggaggaaagagaaatggtctaatggaagaaagtgaacaaacaaagacatgctcacagaaaactgccaagtgtgaggggtgggaaaacagagttcagcctggctgaacgtaggaatctggatgggaatggtagatcttaggctcctgtttttcagcttgccgctctagtgatgattcttgtagatatatttttccaagtaaaaggagcatttccaagtgactgttgtttaaaataaagtacatgttgcatttgtaatgtatgaattatgagtattaaaactgacaatgaaatgagagtaatatacttaattaaaattaattagatctgttggcacaccactagaaggacaaatatgatatttaatatatcactctactccagacctgtccaattaaacttttggccatgatagaaacgttccatatctgttgtccaaaaacagtaacccctagtcacatgtggctattgagaacttgaaatgaggctagtgcaactgaaaactgaattttaactttgtttaatttcagtgaaatttaatttgaatttaaatggccccctgtgagctagtagctaccgtattggacagggaagctctaaacagggttctaaacatgtggaattaacagcacttaagagctggagtagaccttaacctttaccaggtctcaaactttgatttacaaatggggaaatggcagccaagaaggtgaaacaccttgtccagaggcacactagtaggaattagcagaactggaacctggtgtttggatgtcctggctcccggcctgggggactcttgattccaacacgctctctcccagttatgacagagggctgtggctggacccaggtaaggatgctgggttggtagattgagaaaataaggccacgcgtagtctttcaaatcaaccaagcaagagatatttgctgtacatggtggcagacactgagatcaacagagaggttgttgtggtgtgggggagggcctgtaaaatggcataaggagtctactgggaaaaacaggatagtgatagattatatatctctatatttatctttctatataatctaccctgttttcccaaatggatttcccaaatgtgtgtcacttgtatatctggctgtcactggtacaaggtagtccaaatggacagggtacgcaaaccccagacagggctatggaaatttagggagatctgtgtgggtgagtggtcggggagagcttcagggataggacaggcttgacttatattagatagtgtaacacagaaggtaaaatacaactttaggatcattcaaatttaacagtggttgatatgaaacaaacttcttatccagagttggttttgtattcttgctttctgtattaattatatgtgtttactgattcaccacaatcagctatactgtccctagaattttaaaatgtgaaaagaatgtggtttgtttcaggactatttttctgtagaatggtgattgtatagaattaattaatattacagttgcattattagaccacagtaaggtaaatggtcacaaaagaccatacatttaaatcaggagaaaagtaatggctattgttatcctgtaggcatagctgggaaatcatatccttacttggcttgctaaagtcttaacctagtactacatgacagtatctccagagatttttttttcccattcgtaggcacaacaaatgagacccaagtgctcatagaacattccaaagagtcaacagagagaagtggaaagtattagaaacatgattgtgtttgcaaagggagacataaac

SEQ ID NO: 40 - DNA, 1960 bp, Homo Sapiens
actcttgctgcaaacattgggatcagccgtgactatcccataacataatatttctgatttcattcttttcctttctcctaccaatttaatctgcaatcacttcaagagaagtctgtttaaaggatattcacattctgttcacagagtttgagagaaactgtattcaagttgctgaaaccaagaagctacactcacgagtctcacctaaactcgaatctgatttagatgacatcatcctggactttgagttgatgaaaccttggaggtcttgggagtaaagcaagtgtgatttgcatatgatggatatgaattgtaatggccagagcatggctgtggtaggtaacatctagagatggccaccattattttttttttcctctatccgcacatactacttctcctgtactcttgaaactgggatgaaattagcaactttgttaaccaatataatgtgccacagaagtgacttttgcgacttgtgaggttagatcttaagaagtcttgtatcttctttctggatcacttggaatgcttactacgggaaccaagccactgttctatgagaagtgcaagtcacatggagaaaccatgttttggcaagctagtctgcatcttcagattccggtgcagtcctctgaccatattgggaaggatatgtaaaatgatacgagtttcagggaataagaatgggggtgagaggaatcactgaggatgcccaaggacaaagcagccggaacaagtttatagctcagcagtcccaagatggccgaataggaacagctccagtctacagctcccagcgtgagtgatgcagaagatgggtgacttctgcatttccaaccaaggtaccgggtttatctcactggggcttgttggacagtgggtgcaatccacgaagtgtgagccaaagcagggcggggcatcacctcacccaggaagtgcaagaggtcggggaattccctttcctagctgagggaagccatgacagatggtacctggaaaatcgggacactcccatcctgatactgcacttttccaaaggtcttagcaaatggcacaccaggagattatatcccacgcctggctcagagggtcccacgcccacggagcctcgctcactgctagcacagcagtctgagactgaactgcaaggtggcaatgaggctgggggaggggggtccaccattgctgacgtttgagtaggtaaacaaaacactccagcctgggcgacggactgagactctgtctcaaaaaaaaaaaaaagaagacatttatgcagccaacagacacatgaaaaaatgctcatcgtcactggccatcagtactggagaggatgtggagaaataggaacacttttacactgttggtgggactgtaaactagttcaaccattgtggaagacagtgtggcgattcctcaaggatctagaactagaaataccatttgacccagccatctcattactgggtatatacccaaaggagtataaatcatgctgctataaagacacatgtacatgtatgtttattgtggcattattcacaattgcaaagacttggaaccaacccaaatgtccatcaatgatagactggattaagaaaatgtggcacatatacaccatggaatactgtgcagccataaaaaaggatgagttcatgccctttgtagggacacagatgaagctggaaaccattctgagcaaactatcgcaaggacaaaaaaccaaacactgcatgttctcactcataggtgggaattgaacaatgagaacacttggacacagggtggggaacatcacacaccggggcctgttgtggggtggggggaggggggaaggatagcattaggagatatacctaatgtaaatgacgagttaatgggtgcagcacaccaacaaggcacatgtacacatatgtaacagctgcacgttgtgcacgtgtaccctagaacttaaagtata

SEQ ID NO: 41 - DNA, 2646 bp, Homo Sapiens
agacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttccttaggctccccaaagggacaagtactcacctcccagagacctggcccagcgggtcctcatggcagcaccaccccctcccggtgcccacgaccattcgtctcccatccggcgttctccaggatttccaaagacgcccgtttagatccacagagctggaagacagctgttcctggatcacaccagaatggagaagcaagctcctcccactagcagaaagcctttgctttctgtgcctggattcggaagattagttaagcactggaagaggaggggggaaacaacaactcgtttttgctgtatgttttttttttaattgtttttatatttatagaaagttatgctttgtctgattcttgcgctaatttgggttctgaaatttgagtaaaatcaaatttaaacatacaaaacaactttaaaaccacaaggaacaggaagcaaatgattatacataaaagacatatagaagataatgcatatgtgttcagtggaaaatagaaaagcatgaaagtaagatcacaaatatttattatttaaactcttccttgaactattggtctgccctttggaaaagcagactttccttaatgcagtagctcatattaatattttttgtttgcttaggaccagagcaagaaggttggacttgggagctagtttgctgtctggctttgagaccttgaacaagttttgttctccttctgtttccagttttcttttttgtaaattaggagattaactcatgtgatcactctattttcaactttttgttatgggaaatattcaaacatatgcaaaagtagacagaataaaggactctcatgtgaagatcatccaacttttacattttttcaatgcatggctgatcatgtctcatccataagtccactcactttatcactaccaatcctccctcttttttttttttttttaccaaattcaagctttatatatatcttttcagctgtaaacattcagtatgcatccacaaaatttaaggactgtttaaaaataaccacaatatcattagatgattctttaaaattgcagtgtaatttacacctagggaaatgctcagatgttgtgtccctttaaatcagttttgaaaaagccatgcattagtgtaacccacactattttgaagacacaggacattttcatcattccagacagttaccttgtaccttcatgtgcatattctagaatgtcataaagatctaatcacgtagtataaactttgttttatatttgtctgacttcttttactcagtataatatttgtgaggttcgttcatgtcgttgcatgaatgggtgttttgttttttattgctttttgttgtttctttttactactgttaatagtataagttttccattgtgcctctttacaactagtatctcaatagagtattacaacaattatttaatatattatttcacatgacatatttatagtataaccatgacctccttgagacctagtgctttaagtcaaagaggtaaataaaatgagatattttaggtctcattacaacagaccaatgtgagagaattatttctggacagttgcacttcttataaacgtttaacatgattccaaacttttatttggtaatttgttagtcctttggcaaaggactaatgtactatgttatttagtcataacaagcagatcaattacattttatgtaacttttatagacagagaaactgagctccaagagttttggtgatatgctgagatcacctagctattttaagtggcagagctgagacaatttagcagaaactgttacagaaggcacaattgtctcctgaattagcagtttgtgtctgaagcctcacagattgggtgtggtaaagagtgagaaggaaaaaggtagaacccagctgtgttagaaatagccttcaaatttggatgtgacaatggaaatcaagaagaacttatgttattatgaaacagttcattcatatttaaagttttgccttttctatattggtattcctcaatagggggagatgatttcttactacctacaaaaaaagaaaactgtaaactaatttcgttgtcattttgaattacaactatatgtttaactcttgtcactccttaaaatgccttgaacacagtaaacatccaatgaacttttaattacacataatattgatagtgatattgcatatgttctaggtctgtattcttaaggagggaaagctgctcaagtacaaagaagggaactagaagttaaaataaagtttttttaatttttcttttcattattgatggacagcatggtcttcagtaaatctttagcctctctgaatataacgttaaactaattgaatggcttgtacctcataagaaatatgaagttatgaagtaataacatatttggaagcattactaacatgcatattctgttcataactacaatattcatgttttgttttctctttgctaagtgaaatataaatattttaccagacc

SEQ ID NO: 42 - DNA, 5044 bp, Homo Sapiens
gaacactgctttgctctgcagcaggggagccatctagctggagctctggccagattgcccacaaactcacctgtgttgcctcctcgatgggaaaagaaacaagcgcactaatggtgcatttctgtggagaggagataagtgtcctaattaggaaggctctgaaaatgagtgattgaggcattattggatctgatttggggagcactacagtctaaagcctgaatgcattaaacaagagtgaattagagtcaaagggtttgttaggcagaaagaaaaaagtggaaagtctgtgggggaagaaaatccttaattgagttttctattgaaataaccaataacttaaaagtgcaagagggaggcagaagagagggtcagaatgatgagaggtcaggacttcacccaccattgttgtatctgcagatggaggaagggcacgggagccaggcatgcgggtggcttttgagagctaggagaggaaaggaagtggatatccctgtagagcactcagaaaagaatgtgtccctgcctacgccctaactttagtgcagtgagatccatgtcaacattttaacttttagaactgtcaggtaacgaatttgtattgttttaagccactacctctttggtcatttgttagataacagcaatagaaaatgaatacattcatctcaagtatcattctccctccaacaaccagaggggtcttgccaaaaccttggaaaattcatgtgccttttctgcttgcaaccctccaaatgcatcattttcactcagaggactccagagtccaacaatggccctcagggcactgtgggatctggctctgccacctctctggccctagctctgtaaatcttccctcttttgctccatggccattcctcagacacgtcaagctgtctcctcactgcaggttctttggctcaactcaggttccctctacctgaaatgatccaccttcagagaattggatggtgagtaaacacaattaaagaagttggccaggcctggtggctcatgcctgtaatcccaacacttggggaggccgaggcgggcggatcatctgaggtcaggagtttgagaccagcctggctaacatggcaaaaccctgtctctactaaaaattaaaaaattagccaggtgtggtggtgcgtgccagtaatcccagctactcgggaggctgaggcaggagaattgcttggacctgggaggcagaggttgcagtgagctgagattgcaccactgtactccagcctgggtgacagagcaagactctgtctcaaaaaaaaagttaatctatgtgaacaatttaagactgtactagcttcagctagcaagtaactgtcttaataactgtctcagctcatctgtgtggctcactgtgacttcctgtctctgctcagcttagcaccgtcattctccatcatttatcacattttccactctatacttatcactctctgatatgttaagtatttattggctagtttttattttctcctctagtagactgtacactctatgagagcaggaactttgttttgtccactgttgaactctcagccactgggagactgtgtagcaccggtaggctcctagtgtttgagaattaattcattcccaccaggaatgctgaaaaagggtacatctacagtgaatctgaggttgaactgagacctctaagtttattttcatctcgaagttgaagacattgctaattttttcttttcttttcctttctttttttttttttgaggcagagtttggctctgccacccaggctggagtgcagtggtgtgatcttggctcactgcaccctccgcctcccgggttcaagtgattctcatgcctcagcctctcgagcagctgggattacaggtgcccgccatgacacccagctaatatttttgtatttttactagagatggggattcaccctgttggccaggctggtcacgaactcctgatctcagatgatccacccaccttggcttcccaaagtgctgggattataggtgtgagccattgtgcccggccatggtgctcattttcataaagccaataagaggtagaaccagcacttgaattttgattttttttttgtttgtttaaggcaaagtttgtcacaggtattttctcatgttgcctctagctgatgcctttcccagcagggctctcccatgggacttcttggtttcaccatgtttctacctctgggaaacatatcgcacttgcctgagtccttaagcacctgcttgctgccatgtgatagttgttactcatgccttaataaaacaatcacatacacttaggaagcatgcagctctaatggagctcaaaaggtacatggcctcagaacacctcaaaaggtacaaaattttggccatgagatgaggctggcgggagggaatggcttgaaaggagtgtctccatatcgtatcacacaaagagttggtatttggagctcctgacacttgagctgtgatttttcagtcgttctgtagaaactgcaaaatgtaggatatgacctatttgagattgaagtcctgcagtggtataggccattgatagtcatcttattggaagatatttgtccctggatcttggtggcatttttttgccacatgcagactttgtgtacacagaaatactgggtcaattattttgaataaactgacttgcttagtctcttttgtgttgctttatataaaggaatacctggagctggataatgtataaagaaaacagatttatttggctcataattctgtaggctgtatgagaagagtggcaccagcatctgcttcttgtcagggcttcaaactgcttctactcatggtggaaggcaaacggaagccagaatatcatatggcaagagagggagcaatagagtaggaaagcgctagtctctttttaacaatcagttcttgcagtaactaatagaacaagaaatcactgaagatggtgacgatagcctcaagcctttcacgagtgatccgcctccatgacgcaacagctcccaccagatcccaaccctaaatttggggatcaaatttcaacatgaggtttggagggaacaaatatctaaactatatcactgactattcgggctattgatagatttttttaaataaaataaatgatggtgtatttgattggattaagaaaatcaaggctgggtatggtgactcacacctgtaatcctaccactttgggaggctgaggcaggagaattgcttgaggccaggggttcaagaccagcctgggcagcatagggagacccctatctctacgaaaaggaggaggaggaggaaggggaggagaagatggagaggaggagggggaggagaagaagaagaggaggaggaggagaaggaggggaggaggaaggggaagagaggagggaaaggggatgggggacaggaggagggagctaggaggtggagaaaaaagaaaaagaggaggaagaagaaatgaaaaaggaaaatcaactggttgtctaaaatgtcaatcagcattttggtgcagataataaacaccactttttaaaatattttctttctttttattgtggtaaaatatacataacatttaccactttaataatttttaggtgtacaattcagtagcattaagtacatctacagtgttgtgcagccatcaccactattcatttccagaacttgtccattgtttgaaacagaaactctgtacccattaagaaaaactgcccatagccccctcctcccagctcctggtaaccaccattctactttgtgtctctatgaattttcctattctaggtaatctatataatgggaatcatgcagtatgggtcctattgtgtctgacttacttcacttaatatgctgttttcaaggttcatttatagtgtagaatgtatctgaacttcactcattttaaagactgaatacttttccgtttatgtatagatcacattttgttgtccacttgcctgttgatggacatttggatttccactttttggtactgcaggtaacattgctatgaacattgctgtacaagcatccgtttgagccattgctttcagttcttttgggtgtatacctagaagtggaagtgctggttcatacagtttaacttaactctatgtgtaacttttaaggaactgccaaacagttttccacagcagctgcaccactttctgttcccaacagcaacgcacaagtgttccaatgtcaccacatccttgaaagcacttgtcattattatttatttttttttaggataatagtcatccttatggatctgaaatggtacttcattgtggttttggttatcatttccccaacagctagtgatgttgaacatcttttcatgtgcttacttaacatttgtgtatcttctttggagaaatacctgtataagtctttcgtccatttttgaattgagttatttggttttggttgtgtttgttcagttttatgagtacttcgtgtgttctgaatgttaatcttctcaaagtttcatagttttagctcttacatttgggactttgatctattttatttatttatttattgagacggagtctcgctctttctcccaggctggagtgcagtggtgcgatctcggctcactgcaagctccgcctccagggttcacgccattctcctgcctcagcctcccgagtagctgggactgcaggcgcccgccatcacgccctgctaatttttttgtatttttttgtagagacgggttttcactgtgttagccaggatggtctcgatctcctgacctcatcatccgcccgcctcggcctcccaaagtgctgggactacaggcgtgagccaccgcacctggccaggacctggatctattttagattagttttcgtatgtgttgtaaggtaaaagtccaacttcattcttttgcgtttggatattcatttttttgcagcatcatttattccaaagatgaaccttacccaattgaacgggctttgcaccattgttgacaatcaattgactatatacgtgaaggtttatttctgggctgtatt

SEQ ID NO: 43 - DNA, 1919 bp, Homo Sapiens
gcagaaacaggacggagaagggggctgtatttcccctggcgtgtgaaatggatgttagtgactaaagctcaattttccagttaagggaggagccgagacttttaagtcgagtgttcctgtggggccaaaaggatggtttcagagaaatcccaggaagtgagagtgctgggatatgcgaggggcccacggagccctcccctgcgtgtctgagatcacaccctgcgggtaccctgccgtcgtgtgctgaaggaggtgactggatctcgactccagagtttgctcctgagatcgaaaaacaaaacaacccaataatagtaatgacagccctgggtggggacagttgcagcaggtctcatgagaaactcactaattttgtaggttcagggaaggcgtgggcatgttggggaaatcaagggagaggagaagaggggaggagggaaggtgaggtgaggtgattggtattctgccaatcccattctgcacactagtgagacctagcaaggactagagtttcagggggaaaatacgagaataatgaaagataacagagaggaaagaaaaaagaaataattgaaaagtttgaaagaagaaagacaacagctgaaccaatggaggtgaaaatagaaggaaatgaaaattctgcaagcttttgtttcatggataaaaggactgtattttctggtccattatcaggatacaagatggaaaaaaaagctattgaacttgtggagaaagtggctggtttaaattagtcctgtccctgaaaatccaagctgcgtgtttgtcagtcttatggctgatttaactcataggcccaggagagaaaggatagaaggaagcctgaatgaccagcaaagaatctgcatccaatcaacactcagagcatgtatgctacattcttcagaaaccttcaggagtcatagactgtggtcagttcttcgtcagaattattttagatttacttcagttgttttttcatcaaatgcacataaaacatggaattgttcttagctgtgcagaccttgtctattttctgaaaggaaaaacaatgttaatttttaaagccctacatacattacatctttgtacttttcaaatcattgtgtcacccccttcccttctcttttgaaggtgcctggctgaatctctcctattctcacaatggctttgcctccattctgctgaagtcgcttcccattgctcacattattatactgtttttacttcacttccaagcttgtttctgactacacaaagggtgctgtaattctgagttccctatatatagagttgcttttccaggaacattattaataaaaggaaaggtcttccttttccattatggagatatacccatgttacgttgtgctttgatgatctgggctctgacttataaaaccagtgttactataattttcacatctttgagcagctctgcccagtcagttccccataggtccctcgggagtttttcttgttttatttttgaatcttagctggaatctatcttcattaggagtctagcgtcttgttctccgtagagctctgaaatggtataacagagaaaggggtactagaaacagcaggctgactctctttaattttctttttctttttttttttttttttttgagacggagtctcgctggtcgcccaggctggaatgcagtggcgcaatctcggctcactgcaagctccgcctcccaggttcacgccattctcctgcctcgccctcccgagtagctgggactacaggcgcccgccaccacgcccggctaactttttgtatttttagtagagacggggtttcaccgtgttagccaggatggtctcgatctccagacctcatgatccgcccgcctcggcctctcaaagtgctgggattacaggcgtgagccaccgcgaccggccgactctct

SEQ ID NO: 44 - DNA, 4860 bp, Homo Sapiens
gccatttcttttttttctttttttttttaagataagagtctttctcttgtcacccaggctggagtgcaatggtgcgattttggctcactgcaaccttcaccttctgggttcaagcaattctcctgcctcagcctcccgagtagctgggattacaggtgcccgccaccatacccagctaatttttgtatttttagtagagatgggatttcaccatgttggccaggctcctctggagctcctgacctcaggcaatctgcctgcctcagcctcccaaaattcaaggagtacagatgtgaacaaccacgcccggcctccatttcttttttgtagtctttaataaacagctgctatcattgcagacttgctgtttaggcacttaggaatttttcactagaaggcatgtaaataaagaccatgggcaattgtaatgaatttcgccttcattctttgactacatgactgtccccagagctgtaactttattgaattttttagaagccatttagctagcaactgagcctaaccagccactcactgtcattattcagtgctcttttattattgtctatttctcctccaacttggctacactcacaaagtgataaaaacttgcatttgttttctttccttttcagagacagcgtcttgctctgttgcttaggctacagtacagtgacatgatcatggttcactgtagcctcaaactcctgggctcaagtggttctctcacttcagtctcccaagtagctgggactacagacatgtgccaccatgtccagctaattttttatcatagagacgggatcttgccatgttgctccgactgggctcaaaactcctgacctcaagtgatcctcctgcctcagcctcccaaagtgctgggattacaggcaggcatgaccacctgtgcccagccccctattattattattttaaataatagctttattaaaatattcacataccattcactttatttattgaaatctgcaattcagtaggttttagaatattcacagagctgtgcatcgatcaccacagtcacttttagaacctttcattaccctatagagaaatccataccccttagccactacctcctactctccccacctacctttgcccccagccttaggcaaccattgattaatttttttgtcactatagatttgcctaatctggacaaatagaattgtacaatatgtgatcttttgtggctttttttccctcttagcacagtgttttcaaagttcctttatgtcatagtgtgtatcaatatttcattccttctatggcagtattccatggtagagacacactgcattttgtttatctgttcatcagttggtggatatttgggttgtttccatgtattccatgtattggtcattatgaataatgctgctatgaagattgttgtacaagtttttgtgtggacatatatttttatttttctgggatatatgcctaggagtgaaattgttgcattataggatgactgtacatttagccttttgagaaactgccagaatgttttctaacgtggctataccagttgggtgcaatggctcacacctgtaatcccagctactcaggaggctcagctaggaggatggcttgagcccgtgaattcaagaccagcctgggcaagatagtgaaaccccgtcttgattttttaaaaatccaattaaaatgacaagaaaagaaatacccaaacaaaatggttacacaattttatgttcccaccagtaatgtttgtgggttccaattcctccacatcttcactgacattttttttttctagataggggcttgctctgtctctcaggccgcagtgcaatgatgccatcacagttcactgcagccgtgacctcccaggcacaagtgattctctcatctcagcctcctgggtagctgaaaattacaggtgtacgccaccatgcctggctaatttttagatttttctgtagtggtgggattttaccatgttgcccaggctggtctcatactcctggcctcaagtgatctgcccacctcagcctccctaagttctggaattacaggctgccaccatgcccggccttcaccaacatttgccattatctgttttttttttcttcctttataccttaaagcagtataagaacaagtgtcttcaattataggaaacagtataatcccagggctttgggaggctaagacaggaagatgtcttgatgccaggagttttttttgttgttgttgtttttgtttttgttgttgttgttgttgttgacagtctcgctctgtcacccagggtggagtgcagtgatggggtccactgcaacctccacctcccaggttcaagtgattctcctgcctcagcctcccgagtaggtgagactacaggcacacgccactactgcccagctgatttttgtatttttgatagagtcagagtttcaccgtgttggccaggctggtctcgaactccagacttcaggtgatttgcctgccttagcttcccaaagtgctgcgattacaagcatgagccaccatgcccagcctgatgccaggagttttagactagcctgggcaacctagcaagaccttgtctctacagaatatttaaaaattagccaaatgtggtggtgcctgtgtatagtctctctccctctctcttttttttttctaactttttgtgacatggtctggctctgtcacccaggctgaagtgcagtggtgtgatcatggctcactgcagcctgaaactcctgggatcaagtgatcaatcctcccacctcatcctaccaagtagtagggaccacaggtgtgtgccacccaggtcttgctatgttgtccaggctggtcttgagctcctggcctcaagcaatcctctcaccttggccccccacagtgcaaggattacaggtatgagccaccatgcctggcccctaccctgcctactgagaaccaaaggaaggatccaaattctccttagctcaactcgagccatttcctgattgcttcatcagcgaggagctggttattgggctgtccaggcctcccaagcagcacagaaatgaggtgaaggagttttcctgttgctccactctgtaaggagttggagggtgatgtttactcgtttgcagagagagatgccttgtaggcacctcaggatggagagggccctgattccaatgtcctttttttcttcagaaacaggaccttgccctgtcactcaggatggagttcagtggtcctatcatggctcattatagcctcaaactcccaggctcaagcaatcctaccatgtcagccttcccagtagctgggactacagctggatctaccatgaaagacttgtgaatccaggaagagagactgactgggcaacatgttattcaggtacaaaaagatttggactgtaacttaaaaatgatcaaattatgtttcccatgcatcaggtgcaatgggaagctcttctggagagtgagagaagcttccagttaaggtgacattgaagccaagtcctgaaagatgaggaagagttgtatgagagtggggagggaagggggaggtggagggatggggaatgggccgggatgggatagcgcaaactgtccgggaagggaaaccagcactgtacagacctgaacaacgaagatggcatattctgttcagggaatggtgaattaagtgtggcaggaatgctttgtagacacagtaatttgcttgtatggaattttgcctgagagacctcattgcagtttctgattttttgatgtcttcatccatcactgtccttgtcaaatagtttggaacaggtataatgatcacaataaccccaagcataatatttcgttaattctcacagaatcacatgtaggtgccacagttatccccattttatgaatggagtgatgaaaaccttaggaataatgaatgatttgcgcaggctcacctggatattaagactgagtcaaatgttgggtctggtctgactttaatgtttgctttgttcatgagcaccacatattgcctctcctatgcagttaagcaggtaggtgacagaaaagcccatgtttgtctctactcacacacttccgactgaatgtacgtatggagtttctacaccagattcttcagtgctctggatattaactgggtatcccatgactttattctgacactacctggagttagcacagaccccacaagttaggggctcagtcccacgaggccatcctcacttcagatgacaatggcaagtcctaagttgtcaccatacttttgaccaacctgttaccaatcgggggttcccgtaactgtcttcttgggtttaataatttgctagaacagtttacggaactcagaaaaacagtttattttctttttttctgagagagagggtcttattttgttgcccaggctggtgtgcaatggtgcagtcatagctcattgcagccttgattgtctgggttccagtggttctcccacctcagcctccctagtagctgagactacatgcctgcaccaccacatctggctagtttcttttattttttgtatagatggggtcttgttgtgttggccaggctggccacaaattcctggtctcaagtgatcctcccacctcagcctctgaaagtgctgggattacagatgtgagccaccacatctggccagttcatttcctattactggttcattgtgaaggatacatctcagaaacagtcaatgaaagagacgtgcatgctggatgcagtggctcatgcctgtaatctcagcactttgggaggccaaggtgggaggatcgcttaaactcaggagtttgagaccagcctgggcaacatggtgaaaacctgtctctataaaaaa

SEQ ID NO: 45 - DNA, 4706 bp, Homo Sapiens
ggtttgaataagggttgctggacgctgttttcctattgacaaatccttctgttctgcaggtacacaggggtgggatggctggaggatggggaagggagaggatccaaaggcactaagaactgtcttggcctttctacaataaatttcccagcatgacacagaagcacagttacacacttgcacacacaccactgagcctcccaagtgttgaaatactacatccaggcatatattaaactaacaaatttaaaaagaaactaccatgtccagcaatactctaatcatccaaagtagtaatagtaaaggtaactgatgctaatgtctattaatgccccaaaacatttaaaaactcaagaagaaaaagaaatctaccctgataaatatgaatatatgtttttaatttatgcttttctttatttttaatttatgcttttcttgaaaaattattgtcttccaatgattaattcttttgagtcagggtgatgtatggttttgccctgaaactttctttctaaaagaaatccctagtctcagtttgctttctaaacaaatgacaggagaaaccataggaaaatgtaattcaaaatcaaaaaggctcataagtttcactttctgaaaaagttgccagcacctggatatataaaattatactatttctacaaacacaatccttgaattggaagctggcccagatttctacttccccagattcctacattccctgtgcaaccctcttcaatcctgggcttggtgtctttttggcttttcaccagtattcaaaacgttcccctagttcaggctctgcagccagctgtccaggaggctccctgatggttgcattaacatcctggggcaatactgccgtcgtgtgggcatgtaaaatgctgcaggttcatcccaaagtgaagttgcattttcccaactacaggcacaaatgagtcttctctctgctctttcacttctaggttaatgggactcctgggtgactgaagatgtcaagagggttttgggtagacaatttgtagtgcctgtttgtcctgtctctgagatcttgaataaactttgggaacctattgggtgagagttgttggaaatgtaaatttacaagatgcattcttaatatatcagacctaattaaaaattttgccaataaaacaatgtggcaaccctgtaccatgtgtgatggcatgcttgtgacttgatttatccttgtaaaaatgactttactggatatgtggtcaccagacctaatggcctctgtgatttaattttttaaatatgggaaatatctttgctgccgaaactcactaacatctttttgaactttacgggaattgatgtttccagctgaaagatggatttagagtttgggacagaaaacacagtgatgctaaaaaccaaaagttatttggaaaaaacatttgaatcagcaccgaaatgatgtagtttagcaaaaacattaacaataaaacattacctttcttgtcataagactattttcttttttacaaacagcttataaactttctctgtgatgaaccttcgtatacagttcagctgaagactataagcctgttagagtcccttgggaagaagaaacctatgcatctaggttgttcctaaaaaagctgttgttcaactaagacatgctgtccttacagtgctgtcaccgccagaaataatctttaattctgtcttcttggtgtgaattctcaactagtaaaactctatattgaaatgcaaattagctcttccgagtacaagcttgtaaaaatgtcaaaacacctcacaaaaattctaattgccacataattaggtatctaaacaaaagttctatgctgatattttaattttgcttcattgcaataatgtacattcaataatgggcccaactaggacaaggtgataagttagggaagaaagtagctaatagcaccaaataaggatgcccctgaacccagagcctggcagaaaatagaatggacttccagagaaacatcatggggcctagggaaataaacaccgcttagggagaattagattagccagagtacaacaaacttccattacaagctggaatttcttttagaaggaatacatgaaagtgtgtctttataaagaggtggtatcctggagtgagcactaaatcagtctaatgccttcaatcttcttgatttccccctacagaactgtacttcttattaatgtttgtaatgaccacctgtggcactgtaggatgctgaattaccaaagaaagattaaattatgtcctattgatgacacttaatagacgtctagcaggtgcacatgttacagaatgatatttgacaaatgtagaaatgataagggttatctgatctgtctgaaattaatcagaagcttcagttaagtagaactccagttctgataacattccattattattatcatcattattattgttactattaagaattatagccccttttcaactcatcactacctttattgtggaatcacctgtgttcaatgtacctatattttagaaggacaacggggcaccaaagttgctagcctgatcctataattgccatcttcatctttcagtatggaatatattatatttacattaaaaattatcccttacaagatccctttgaacaatttttcaaatatatgtttaaagacaagtacattaatttcaagaaaatttcttatgagattagaggatgtaatgttagtatgatctactaataacctagtaactatcatttattgattacctacaaagtcacttgtgttttatattcattatctctaatttttaaggtacccctgcaaggttggcagtattatcttcactgtccagaagaagaaatagtttcaagaggctaagtaatcacagtaagatcatatggtcaataagtgcaaaaacaagactcaagcctcactgggttttaatggaagaaccatgtggtgtttgagtagaaaaatctattccctctcctctctctctccctctctctctctcttttcccagtgataaacagtaggaagtgggattagtctgtgttgaaccctattacttcagcccacattcattgctcatctttccactatttttagtttttccttctgttctggactcttcctttcttccttcaaatagaaaaaggtcacacctctatttaaaacatcacagaacacccatatttttgctcttctatcaacttaccagtctaaatcttttttattttcagctaaacttattagatgaatgtcataattgccccattttcactttgctttcactctcatggccaccactggaatgaagctgttcttcagacttacttatgacatctgctccagtttcaaaggctgtctccaagtcctgactttctgaaattctctgcagcatctgacacaattaatctcatccaccctcacctactgccagtaaaaatactggcagctgacacacatggaacagcgacttggtgctaggctctgggttaagcactttatatgcattatctcatttaatccccacaacatccctgtgaggttggcactgttatgggtccccattttacagatgaggaaactgagtctcggggggtaaagtaacttgaccagtattacacaagcaaaaacatggtgaagatagctgttgatccaatatgctgtgctatctttaaaattatttagccagtcttttactatctgctgggcacaaagccaagttcattagaggtattatctgattattttgtgttatattttctcctattatacctaactctaggtctattgcaagatcaagtttgtgatcctctgcctatttctcctcttgactacttcaaattccaagtattttttagaagattttaacttgcatcaaataattattgatgtacaggtcatggtggcagggctctggacataggaaagtgaacaaggtaggcttgctgcctgcttgaagttgacaacatagtggatagaaagtgagacagagaagccacaaatcattacctgagccaatcagtggcccactgagaacactccttccaggtcatgaaatttcaagtgaagtggcacaccagctcacccacctacttcccaccccgaccccagaatccccttcctggaaaccttgtgctacctccaaagccaaactctcaaataaaccccagcaccttccagagatgccgtttcagtggtggggtttgaggtgagtactctgggacccagcctgggtttcacagaactaggagactatctgccctgggctggccccaaggccagtgtcagaagtacccccaccctcctgattatcagtcaacccagaacaaacgctttcctctactttcccttaattgtacttggtgctagtcatctctgtggcaagaatatgagcttctcacaagctaataatgaaacatatctttggttctttcacagcacccagctttgggctaagtatgtaaatgtgggcgtcagatacacctgcttgagtaaatgtctcctctcaatacctggaagaatgatgagtgtttgctcttctacaaaccaactcaaggcacccagaaagcaaggaagcttccaaagaaaaatggagttatattaaaaggatgtaggcattatcttgaagggttttctactggtcaaagttgggataatttaagcatcaaataaatgatagctgtaaattgaatatataagaa

SEQ ID NO: 46 - DNA, 4158 bp, Homo Sapiens
aaaagctttattgctcacacaaagcctgtttggtggtctcttcacacagacgcgcatgaaatttggtgccgtgacttggatcgggggacctcccttgggagctcaatcccctgtcctcctgttctttgctcggtgagaaagatccacctacgacctcaggtcctcagactgaccagcccaaggaacatctcaccaattttaaatcaggtaagcagcctcttcttactctcttctccaacctctctcactgtccctcaaccactttctcctttccactcttcactctcccttctcttaatttcaattcctttcattttctgggagagacaaaggagacatgttttatccgtggaccgaaaactccggcgccggtcacggactgggaaggcagccttcccttggtgtttaatcaatgcagggacgcctctctgattattcacccacatttcaaaggtgtcagaccacgcagggacgcctgccttggtccttcacccttcttccaaacgcctgaaccgcagcggccaggcgttcctccagaacctcctcccacaggagcttgctacatgtgccggaaatctggccactgggccaaggaatgcccgaagcccgggattcctcctaagctgcgtcccatctgtgtgggaccccactgaaaatcggactgttcaactcacctggcagccactcccagagcccctggaactctggcccaaggctctctgactccttcccagatcctctcggcttagcggctgaagactgacaccgcccgatcgcctcgaaagccccctagaccatcacggacgccgagcttcagagcactgctgatggctaacatttttaggttgcaagtgttctggccttgaagatatggtaactggttgggaacacaaagttgtcacctaggcaaaggatgagagtggatgtcaagaagcaaggctatgctggatcctttctgctgttctaccagatccatcctccaccgtcatctatcattgtctgtgtggatcttgatcaacggactttgcctctggctcctgattgggtttgcccaatgggaagcagaagagagtgaagttgtggctccttcttttcacagagctgcaggtttcttgaacttttcatcttgcaaaactgactctatacccactggtcaagtgatcttcaacaagggcactgagactataaagtggggaaagaatattttcttcaacaaatggtattgagaaaactgaatatctatgtacaaaagaatgaagttggactcttacattataccatattttaaaatgaagtcaaaatgggattaaagatctgaaactttaaaactcctaaaataatagggaagaatctttacaaagctgaatttggcaatgatttattggctatgacaccaaaagcacaagcaatgaaagcaaaaatagacaaatggaactacatcaaactaaaaagcttctgcacagcaaagaaagcaatcaacagagtgaaaagacaatttatggaataggataaaatatttgcaaatcatatatctgggaaggagtcaatatcaagaatatatgaagaacacctgtaacttaacaacaaaaataacccaacttaaaaaattggcaaaggacttatatacatatttctccatagaagatatacaaatgcccaaaaagcatatgaaaaggtgttcaacatcactaattatttagaaaacgcatgtcaaagccacagtgagatatcactttatacctattagcatggctgctatttaaaaaacaaaaacaacaacaaaaacaaacaaaaaaaaaacaaaaacagaaaataacaagggctggcaagaatgtggagaaattggaacccctgtgcactgttagtggtgatgcaaaatggttcaatccccatgaaaatatatctctggactctattctggtccactggtctgtatgtctgtctttacatcaataccatactgttttgattgcagtagctttggaatatgttttgtaatcaggaagtgtgaggattctggttttctcatttctcttaggattgttttgactatatggcttcttttgagatttcatatgaatttgagaattttttatttttaaaaattccattgaaatttcatagggatggcatcgaatctgtagattactttacatagtttgcatattttaataatattaagtcttgcaatctgtgaaaataggatgttttttcattgatttgtgtcttctttaatttctttcagcaatgtggtgtagtttttagtgtataagtctttcacctctttgcataagtttattcctaagtattatatatttttgatgctataataaatgaatttttttcttaattatcttttaaggttgttcattgttaatgtatagaaatgcaactgatttttgtgtgttgattttgtatcttgcaactttgctgaattcatttattagcttaaacagctttttttgtggagttcttacaggtctctacaaatatggtcagaggcgttcgaactagagtgactccatcttgaatagggggtgggtaaaataagactgagacctactgggctgtgttcccaggagattaagcattcttagtcacaggatgagaaaggaggtcagcacaagatacaagttacaaagaccttgctgataaaacaggatgaggtaaagaagctggccaaaactcaccaaaaccaagatgatgatgaacgtgacctctaaacgtcctcactgctcattatatgccaattataatgtattagcatattaaaaggcactcccaccagcgccatgacagttcacaaatgccatggcaatgactggaagttaccctctatagtttaaaaacaggagggaccctcagttctgagaaatctctgtccctttcccagaaaactcacgaataatccaccccttgtttagcataaaatcaagaaataactataaatatatccagttgagcaacccatactgctgctctgcctatggagtagccattcttttgtttctttaggtttttaataaacttactttcactttactctttgaactcgccccaaattctttcttgtgcaaggtccaagaaccctttcctgggttctggatcaggatccttttccagtaacaatgtcatctgcgaacagataattttatttcttccttttcaatttagataccttgtatttctttttctttcctaattgtttttgcctaattgctaggactgccagtactatgttgaatagaagtggagagagtggacattcttgccttgttcctgatctcttatatgaaaagctttcagtctttcattattgagtatgatgctagctgtgggcttttcatatatggcctttattttgttgaggtaaagtatctctatttctagtttgttgagtgtttttataataaaaaggcattaaaattttgtcaaatgctttttgtgtcaattgagatgattatgtaatttttatcctttcttctgttaatgtggtttattacactgattggtttttatatgttgaataacccttgcctcttagagataaaacccacttagtcatggtgtgtaatccttttaaggtacatttgaactctgctagaattttattcagaatttttgcattaatatttatcatggatattgaacctcatagtattcttttctcatagcagattgatctggctttgctatcaggttaattttgggctcagagaataagattgggttttgcctcctctttaattttctggaagagcttgagaaggattggtgttaacctttctttaaatatttggtagaattttccaatgaaaccatctggtccttgtcttttcttttctgggaggtttttgattactgattcagtctccttactggttataggtttgttcagactttttatttcatgattaaatcttggtagatggcatttttctagtaatttatccatttttttctaggatatccacttggtataaaataaaatatttcctgtcatatgcaaaacaactttcatttcattcttgagtggtgcttacttctgatcacaattgtgtataacagagatgtccaatcttttagcttccctgggccacactgaaagaagagttgtcttgggccacacataaaacacactaacactaatgatagctg

SEQ ID NO: 47 - DNA, 1003 bp, Homo Sapiens
cacatttatgtgtttaacatagacacatttatgtgtttaacatagacacatttatgtgtttacaatacatatgcagactctatataaacacataaatgtgtgtaatattcatactgtcaccttttcttactcttgcaaaggtgatgtaattcaagtttgacttccttgaaacaattctcgggatatgtctagttatattagaagtttagttgtgtcaaatattgttctaaaagagactaaaagcataggtgagaaatattcctggatgtagtgggaagtttttttaatttttattttttaatgagaattactaaagcagcaaaacacagcacaatatagtagaaagcactgtagatttccaatttgcatatattactgcagagtggattttgctacagacccactgtgtgatcttaattaattcatttcccatctctgatccttagttttcacatctgtaaaacaagaataaatgtctcccctacctcaaggcaggttgaaatagtatatgctaaagcccattaaaactttagaacactatatagatttaaggtggttgctgttattttatacagctgcaaatcactgtaagggtcatatttattcaagctaataataagaactccagactttgtacataaaatgctgtgtgtttgagtttactggactgaaactcatttgtttaaaatttagtttgaaaaataataaagaccagaataacaaaaatcttgtgggccctacattctttttcttactttccaatatggctttatccatttgtttcctcccagccaactaattgccattttataaaagtaatcttccctcacatttatgtaatccaattatagaacccattagaaattataaagtggaggccaggcctgataacaataactgtaatcccaatactttaggaggccaaggtggaaagaccacttgaggccaggagttcaagaccaacaggatgtctacaaaaataaaaaataaatgtggtaaaaca

SEQ ID NO: 48 - DNA, 3803 bp, Homo Sapiens
gccttcagccagaatgctggctttatttttgcggtttatgagcttgagacagggaattcatttccttggtataatatgaccctctggagaaagtcttgtccagatatattttgctcccaaacgccgccctagaagaaggactacactgaaatgaaacggagatgattaaagtctgatttataggctgtacaagccctgaaagcaagaacggggttcacggcatcttgatacccccatgtggggacgttttggcgattttatttacaagaaagggattttacaccggagaggcttttaaatatgctaacagactggaccagctttctcatccccactggctgattaatgattcctccatgccaacccggttctcagagacaccaaggccagctctccaaagacctgggaaaaaattacttcatgtccttgtaaaaacgttttcacaaatttaagtgcaccagctttgaagcaagacagaattgggatcaagtccctgttccacccttaccagaaagtcttttcgtagctcacaaggggacatcaaagatgacaaagaggagtggaagaagacagagagaatcaatgtgaggagcctggaacagggctctgaattgtcttcccacagtgaaatcacttgtctattgctgagccaagaatttgactctgagcatctaggatgagaaagaagaactggcacctacgccatctctgcccctcgggactgactattttggcccagtttcctcaacaatgaaatgggactaattatcccaggtcacacttctctctgggcttaccctgggaatcagatgattgagctttggatctcactctgttgcccaggctggaatgcagtgatacgatcatgactcactgcagcctcaaactcctgggttcaagtaaccctcccacctcagctttctgagtaactgggactacagaatgccccaccccacttagtccatagtgatgcccacctgtggttaatggagctgaggctgctggaccaaagggaggaagtctgttaggcatatgtggaacccaaaagaggaacttcatcaactgtcatggacagctctgccactttgtgaccctgtggactttttgggaagtgtttttgtggttcaccagtctctcattaggcaaggccatttgtcctgggttggtcttcttcattggtggaaagtacagctgggagatttggaatggttgcagattgacttgactctcataaggaactgccaccatgagcttttggggaaagacctcaagctgtggtgtgttgctgaggattgtgggattcctccaaatcttggggaacattttgagtcatcactggcagcagatttctgttgacaacttgagcaacttcagaatgaagaagccatcttcatctctcacatgaatatgactttgggtaaatcatctcgaaatctgaacccatggttgtgatccacactcctcctgagttctgatttttagtgtaacctttttcttctcattttttcttctttgtgcatctcttaaggaggtttttaaaatctcataattaaaaaatttatttcttcaaaactttttattttgaaatcactgtaaattcacatacatttgtataaaatgccacagaaaaatcctgtgtgccttttactcagtttattctaatgataacatccttaaagagatttaaaaattactgagatataattgaaatatgagaaaattcactcttttatgcatttaaatatcctttatgttttttcatagcttattagctcatttcttttcagtgctgaataattcttaattgtctggatataccatagcttatttatccattcacgtattgaaggatgttctagttgcttttaagttttggcaattatgaataaagctgctgtatacattcatgtttaggtttttgtgtagatataaattttcaagctctttgggtaaatattccaagagcacttgccgagttgaatggtaagaaactacccaactgtcttctaaagtagtataccgttttgcattcccaccaacaatgaatgggagttcctgtttctccacatttttgtcaatatttggtggtgcctgtgttttggtgccattctaataggtatgtagtggtatctcattgttttattattcatatatattcattgggtaaagtgcaattttgctgttgacatattgcactgtggtgaagtcagggccttcagtgcatcatttatcactagagcaaggcacattgtacccaccaagcaacctaccatcacccaccaaccttctatccttctgagtctccattgttcattatcccagactccacattctgctttgtgtgtacacattatttagtttcctcttataagtgagaacatgaggaacatgtctttttgtatatgggttgtttcatgtcagaaaatggcccccagttctatccatgtttctgcacaagatataatttcattctttttatggttgaatagtattccattgtgtatataccccacattttctttatccagtcctccattgatgaacacttagattgattccgtatctttgctattgtgagtaatgctgtgataaacatatgagtgcagatatctctttgatatagtgatttcttatcctttgggtagatactcagctgggtaggactgctggattgtatagtggttctatttttagttccttgagaaatcttcatactgttttccatagaggttgtcctagtttacattcccaccaacagtgtgtaagagttcccttttctccaaatcctctccaacatctgttatttttttatctttttagtaatagtcattctgattggtgtaagatgatatttcattgtggttttaatttacatttctctgataattagtaatgtgtaacttttttcatatacacgttggctatttgtttatcttgttttgaaaaatgtctattcatgtctttagcccactttttaatgggattattttttgttgttgagttgagttccttgtaaattctggatattagtcccctcttggacgtattgtttgcaaatattctctcccattccacagattgtttatcactctgtcgattatttcttttgctatgcagaagcttttaactttaagtcccatttgtctatttttgttttcgttgcttgtgcttttgaggtgttcttcacgaattcttgactagcccaatgtctacaagagttttccctatttttttctagcatttttatagtgtcaggtcttacattcaagtctttaatctattgtgagttgatttttgtatttggtgagtgataggggtccagtttcattcttccacatatggcaattcgatttttcccagcacaatttattgaaaaggatgttctttctccagtatatgttctggtcaattttgtcaaagatccgttggctgtaagtgtgtggttttatttctgcattctgtattttgttctattaatctatgtgttgatttttatataagtatcatgctgttttggtaactatagccttgtaatataatttgaagttaggcaatgtgataccttcagctttttttttccccccttaggattactttggctatttgggctcctttttggctccatatgaattcatttcttctaactctgaatcctgaattatttactctaattctgtgaaaattgacattggtactttttttagacctcctgtgtggacatgacattggcattttgatagggattgcactgaacttgtagattactttgggctgtgtggtcattttaagactattaatttggc

SEQ ID NO: 49 - DNA, 1000 bp, Homo Sapiens
gaaaagtctcaagtagtcggcatatctgtttttggctctaactctctgccatccctgtggaacttttagcctacacactgcagttgttttgagaaaacaaaggcatcattctcttctcaaggttatggtagtgatttaaggccaacagacccaagactcatcttgtaatgcatagccaaacagtcatagttcataagcagtcacgtgactggtgacattttaaatctccagtctttgactttgtcattggttgacttttgtcttcaggaaatattctacatttcttggaatacaataaaaatgcccaagtcaatttggttgttgtcaaattattcagctttttcttaccacttactagtactccacctctttgctctagcatccagccaactagactacatagaatttcacagtgatcttcctcagctccagctcttggcatttgctcctcccttctatctgacatatgtttttgttgtccttctggtatcaacctgcatatctcatccaccaaaaagtctacaatattgacccaaaacctggatgtcctatctgtgtgttccagtagtgccctattttaaatgtgtcatgatatctattactttgtgtgaaaattacctgtttgttttttcaggttatataatagtataacactgccaaggagcggattatctcatcttcatcctgtaattccagtgtttgtcacgtggttgttgaataaatgaataaagaatgagaaaaccagaagctctgatacataatcataatgataattatttcaatgcacaactacgggtggtgctgaactagaatctatattttctgaaactggctcctctaggatctactaatgatttaaatctaaaagatgaagttagtaaagcatcagaaaaaaaagtgggtattcctacaagtcaggacattctacgtgactacaatataatctcacagaaatttaacattaatacattctaagatttaattcttagattcttggtaa

SEQ ID NO: 50 - DNA, 1768 bp, Homo Sapiens
caaaacattgttatatatgggtataatgatttaatatttatgaattatagcaactcttcatcatctatttccaggtttctactttccaggtccactggtgtttggtgtacccatgtgactaatttgtccaaagagaggtgagtgaaagtgatgtgtcacttccagatggaagctttttgggcaagtatgtattttctagctcttttcttctgtgttatagaaactaggaatattccagttggtgactgaccccttagttgggttcctagagtgagtttgatgtggaggagcccaaaatgacctgcagtgaagttggagtgtgagcaagaaataaacttttgttttttaattttctgaggttttggaagttgtagattataactgcataacctatcaatattgatatgtttcaattcttaatgaaaatttctaatattctttttgattatttctaacttattaacttaaaatgtcaaatatctataatttcagtatattctgtatcctacatttaaaaataaaaaatagaatgttgaaaatgaaatcatttcaatgagatgacaactcaaaatcttatagtatcatccagaaacatgtagaacagatttaaaaatacacagtactgagattggcaggttgagaagaagacacatatgaagggtaacttctttggaaagaagcagctatgcacagtacttaagaatgaaatttccatgtcccgttaatacatctgaaacagttttactttctatcccaaactttaatgatcctagaaagctggtttgaatcagtttttacagggttgttttggatttaaaataactaaaacttgagagctgggagaaattttatttaacacttttttatcattcatggtttaatgtttaatgaataaattcttcactaagcttatgtggtgagggtctggtggtgaaaagtactttttcaactagatatattagaatgacaacagcaaagcaagaatgtggtagggtcacataaaggagtcgtgatctgtgggaaattattttttatgattctccaagatggctgtacatataagcataaaagtcaataaacaagtgcctaacctttagctctaaattaacttttgagcgctttgaatgcctggcacaaaaatatttaggggtttggcgccatctggtggccaaatatcaacttttcagcttctcttttatgactaagaagtgaattactctgcactttccaataaacactattaataaataaaattatttaaaatgttgatttccagaacttgagaagacaaatcaaagacagatttctgttatgttacctattgttatatgacagaatttcagtcttgagtaggttcttttatacttgcatttgatttatttatgaaagcattatagacataaatctgctatctttttcttaatacaagagaagactctttccccaaaagaaattagacgtgctcaataaaatctaaatttattttttcacaattctgtaaaagattgagctaggggtgcgtgtgtgtgtgtgaatatcagaatttattttaaaaatgcaagagggagaggggaaggagctggtagtgacattgttaattgtctgctttgcaatagcaaagacttggaaccaacccaaatgtccatcaatgatagactggattaagaaaatatggcacatatacaccatggaatactatacagccataaaaaaggatgagttcatgtcttttgtagggacatggatgaagccggaaaccatcattctg

SEQ ID NO: 51 - DNA, 3307 bp, Homo Sapiens
tacatacatacagattccaaatttgcacttaactgctatattatgtatgtacttgttcatgacaccacttggaattcaggtagaggtattttcaatcagctccaacatccctttccttccttggatgtttccaagacaccatcaagccaggcacatttaggcagagaggttgctggggagaatagaacattgccaagctctggcgccaaatactgcactctggcaacgtgtaagtgtaaggcaggcattgtgggtgtgtgacctctgcaatcacacagggcctcatgctcaggagggccctgtgcttgattcaatactctgctggccccatcttgaaattcttaatgatttttgaacaaggggctccacatgtccatttatcagtgagcccctcaaattatatagccagttttgtgtgaggacaaagcaatggacagatactatgaagctcctttctgggtggcattttctctttcttttctccttcctttcagagctaccaagtcaccccacactctagctcaagagctctacctgaccaaaactcaatggcctttcctcaggaaatccagctatgctaatgccaccagaactgagtcagaactcctaactctacaaatatggctcctctgtattgagtgcctgctaggtgccaggcacaacactcaactgggaccaatattatttctgatctgggagatagataggtatgatcagccccatttcacagttgaggacattgaggctcagagagattcagtgacttgtccaaggtcacacagtgcatcaaacacaaatctgatgagccttctcaaaggctcttgatgccacctgcttccagaacattctgccactcactctgcctaggctgctgccctgcctgacttgagctcaggcagttctgccacttgggtcagatcggctacaagtcctggagtatgggcccttcctagccccatgcctatagtttctggctcctcttacctcttccagatttggatgaaaacactctccagcatggggtgggaactggtctcctgagaggctgccattaggactgggtgatacaatcctgaagtgcagaagagttaacccccactaggaaaactttgaccagtggaaaataggagttgagagggagcaggacacatacattccttcttcctctctccatggactgcttcatgacagtctgccttgccgctcatccagctgaatcccacgtgtcatgctgaaaggtcttgtgcagtgaccttctgggtgtctccatggctgtttgtgacataatagccatcaaggaaacacaccacttagtgtggctttgcatccttctttgcctcgcttccttgtgtctcacctttgctgccatggatttgcatcttccaaatgaaacatctcactttcaatttttgccccaggctctatcttctagagaagctagcctaacatacatataggaagggcagccttcccactcagcccagggtgtggtggaacttcatttaggctgcatgtgaaaattggccacctgctttgctgtaaatgtgatttgtggttctctactgtccaactgctgtaggaatggcccccacctgagagatgcaatggccattccagcttgctggccagtacaggccttccttcttctctctctccccactccatctgcatgacccgacccaccccacctcaaggcatggttaattgttcattagtgacacctggcccaagttgacccaatgaatctctccctctgttgggatttttaaactcaggactaagtgattccatctccgcttctttctacatactctctccaaaaccacatatgcagtgtctacagctctaagtaagaaatcctgggagtggtcagtggacatcctttctgttatgtgggtaatgtcaatctgcagcatgagagaagaattccaccaatatgcagagagaaacagaggcaggagctacagagaatgtcctaatggcagtctcaggcttggagtccttgacagattggaaactccagatttctatgacagtaggattgaagccttgaaagatcttaatgtcaccatcatgagcctaaaagagatctttgaaaaagatactacatggatcatatgtgtctttcacagagcagaaatttttaatttccagccattatattccttgacattcacctcaaagacttgaaaattatgtccatacaaaaacctgtacatggatatttattgcagctttatccacaattgccagaacttgtaagcaaccaagacatccttcagtaggtgactgtatccattgtggtacgttcaggctatggaatattgttcagcactaaaaggaaatgagctatcaagccatgaaaaacatggaggaaactcaacacatattactaagtgaaggaagacaatctgaaaaagctacaaattgtatgattccagccacatgacgctctggagaaggccaaactatggagaccgtaaaaagatcagtgtttcctgggagtaggaaggcgggagagatgaataagcagagcacagaggacttttagggcagtgaaactactgtgtatgataccataatggtggatacttatcattacacatttgcccaaacccatacaaggaacaacagcaagagtgaacctaatgtaaactatggactttgagtgattatgatgtgccagtgtaggttaatcaattataacaaatgtgctactttggtgacagatatcgataatggaggaggctgtgtatgtgtggggggcaaggggtatataggaaatctctgttaacttctgctccattttactgtaaatccaaaattgctctaaaaagaggtctattcaaaaaggcattatataactcaatttaatcaatttaatcaagaccatgtttacacagtactttgtgtccacacatcatgatcataagaccaaaatcatgttggaaactgaagaaagaaaattacctgacagtcttccaatccagaggcgaagtccaggtcccatctcctggaattctgataggttccatgcctacttcaactaacacaatgtggacactgccagtttccagagccaggacttatgaagctggcagtttgtattctccgctatttgaaatactgtctctgggagcaatggacttcaaactctgaagccaccatgctaatgtggctgcatgtaggtgttctagccaatagttacaactcatatgtaagttgctttgctggagggatggcttgaaagcctgcctgaatttctgacccacaaagttatatcataataaaatgatgttatcttaaa

SEQ ID NO: 52 - DNA, 3306 bp, Homo Sapiens
tacatacatacagattccaaatttgcacttaactgctatattatgtatgtacttgttcatgacaccacttggaattcaggtagaggtattttcaatcagctccaacatccctttccttccttggatgtttccaagacaccatcaagccaggcacatttaggcagagaggttgctggggagaatagaacattgccaagctctggcgccaaatactgcactctggcaacgtgtaagtgtaaggcaggcattgtgggtgtgtgacctctgcaatcacacagggcctcatgctcaggagggccctgtgcttgattcaatactctgctggccccatcttgaaattcttaatgatttttgaacaaggggctccacatgtccatttatcagtgagcccctcaaattatatagccagttttgtgtgaggacaaagcaatggacagatactatgaagctcctttctgggtggcattttctctttcttttctccttcctttcagagctaccaagtcaccccacactctagctcaagagctctacctgaccaaaactcaatggcctttcctcaggaaatccagctatgctaatgccaccagaactgagtcagaactcctaactctacaaatatggctcctctgtattgagtgcctgctaggtgccaggcacaacactcaactgggaccaatattatttctgatctgggagatagataggtatgatcagccccatttcacagttgaggacattgaggctcagagagattcagtgacttgtccaaggtcacacagtgcatcaaacacaaatctgatgagccttctcaaaggctcttgatgccacctgcttccagaacattctgccactcactctgcctaggctgctgccctgcctgacttgagctcaggcagttctgccacttgggtcagatcggctacaagtcctggagtatgggcccttcctagccccatgcctatagtttctggctcctcttacctcttccagatttggatgaaaacactctccagcatggggtgggaactggtctcctgagaggctgccattaggactgggtgatacaatcctgaagtgcagaagagttaacccccactaggaaaactttgaccagtggaaaataggagttgagagggagcaggacacatacattccttcttcctctctccatggactgcttcatgacagtctgccttgccgctcatccagctgaatcccacgtgtcatgctgaaaggtcttgtgcagtgaccttctgggtgtctccatggctgtttgtgacataatagccatcaaggaaacacaccacttagtgtggctttgcatccttctttgcctcgcttccttgtgtctcacctttgctgccatggatttgcatcttccaaatgaaacatctcactttcaatttttgccccaggctctatcttctagagaagctagcctaacatacatataggaagggcagccttcccactcagcccagggtgtggtggaacttcatttaggctgcatgtgaaaattggccacctgctttgctgtaaatgtgatttgtggttctctactgtccaactgctgtaggaatggcccccacctgagagatgcaatggccattccagcttgctggccagtacaggccttccttcttctctctctccccactccatctgcatgacccgacccaccccacctcaaggcatggttaattgttcattagtgacacctggcccaagttgacccaatgaatctctccctctgttgggatttttaaactcaggactaagtgattccatctccgcttctttctacatactctctccaaaaccacatatgcagtgtctacagctctaagtaagaaatcctgggagtggtcagtggacatcctttctgttatgtgggtaatgtcaatctgcagcatgagagaagaattccaccaatatgcagagagaaacagaggcaggagctacagagaatgtcctaatggcagtctcaggcttggagtccttgacagattggaaactccagatttctatgacagtaggattgaagccttgaaagatcttaatgtcaccatcatgagcctaaaagagatctttgaaaaagatactacatggatcatatgtgtctttcacagagcagaaatttttaatttccagccattatattccttgacattcacctcaaagacttgaaaattatgtccatacaaaaacctgtacatggatatttattgcagctttatccacaattgccagaacttgtaagcaaccaagacatccttcagtaggtgactgtatccattgtggtacgttcaggctatggaatattgttcagcactaaaaggaaatgagctatcaagccatgaaaaacatggaggaaactcaacacatattactaagtgaaggaagacaatctgaaaaagctacaaattgtatgattccagccacatgacgctctggagaaggccaaactatggagaccgtaaaaagatcagtgtttcctgggagtaggaaggcgggagagatgaataagcagagcacagaggacttttagggcagtgaaactactgtgtatgataccataatggtggatacttatcattacacatttgcccaaacccatacaaggaacaacagcaagagtgaacctaatgtaaactatggactttgagtgattatgatgtgccagtgtaggttaatcaattataacaaatgtgctactttggtgacagatatcgataatggaggaggctgtgtatgtgtggggggcaaggggtatataggaaatctctgttaacttctgctccattttactgtaaatccaaaattgctctaaaaagaggtctattcaaaaaggcattatataactcaatttaatcaatttaatcaagaccatgtttacacagtactttgtgtccacacatcatgatcataagaccaaaatcatgttggaaactgaagaaagaaaattacctgacagtcttccaatccagaggcgaagtccaggtcccatctcctggaattctgataggttccatgcctacttcaactaacacaatgtggacactgccagtttccagagccaggacttatgaagctggcagtttgtattctccgctatttgaaatactgtctctgggagcaatggacttcaaactctgaagccaccatgctaatgtggctgcatgtaggtgttctagccaatagttacaactcatatgtaagttgctttgctggagggatggcttgaaagcctgcctgaatttctgacccacaaagttatatcataataaaatgatgttatcttaa

SEQ ID NO: 53 - DNA, 2534 bp, Homo Sapiens
ttaaaaagaagtaaacatgttaatgaaacagaaaaaaagtaaattaatagaccaattcctggcaaagatgatgagaatgctaattcagtttaagagggagaaaataaatcatcatctctgggggcctacaattcagaaagacagtccagggcaggcgggcagactctgctccacgaagtcatccagagattgaaactagcaggtgctctgccattgtataaggcatcctttttttttggtctgcatggcagaaattaaatctctgaaacatttgtgttccagacaataggaggagaaagaaaggagggagcattacaaacaagatcttaagaccaatgttctggaagtgacatgtgtctcttctgctcatattccatcagtaagaacctgatttttggtgagaacacaggggactgagaaatgtaatatagctgggatgccatgtgcctggctggtagaagaaaggaaaaacatatttttgtggtctacttagcagtgtctctcacacctgctacagtggacctttataaattatgtaaaagtagtgtatatatggataaaactaaatatttcagtgacatgaagtgttctgagaaaatgtaaatgaaccaaattgaagaaaagagaagtagaaaatatgaaaagataataattctttccaacattgcctttgtctaaggcagttttactgctttactgctgtgtcttttaactttcaataagtagataaataccatattatagaaacttcttcagagcattataaaaaacaatttgccatcaattccttttgaaaaggtagaataatcctgatgctcaagcttgaaaaatataatacatcaaaggacattctagacccatctcattgagaatagagatgtaaaactcctacataaaatattaccaaatataattcagtagcctattaaatgcatcatgcatgatgatcaagcatgacttatctcagaaatacaatgaagatttaagaaaactatcaatatgtgattacttatatcatgcttcccaaaagaaacactaaataatactactccaaaaatgaaaaggcaaaaagcatattttcttattcctgatttctttgaaaattgttttttatagtactaggcaaaggatgattttttagtatgataaataatatgtcctcaaccaatagccaaaatattttactgtgctttacactaaagttgccaacataagatacctactatcattattttaagtgtttctcataaagtacctacagatggcttatgtcttagttcattctgtgctgctataacagaatatccgagactgggtagtttataaagaacataaatttatttattatagttctggaggcaggaaagtccaagattaaggcaccagcatctgggtctggtgagggctttcttgcagcatcctcacatggcagagggaaagctacaaaaaactccttccatcaagcaagcccttttataaggacgtgtaataccattctcaagggaggaaccctcaagacctactcacctcctaaagggcccgcctcttaatactatcacactggcaacacctgaattttggaggggacacattcgtaccatagcatcttaaaaagagtacagatggctaaataaggaaaatctataatcccctgctcagcctcttcctactcacccttccctttaatcccctttccagtttctaataatcatagcactattttaatttctctattattatcttcatatacttaaaatacttttcatacacatgaaattatttttcctattttaccaaatatagactgtcttgattcttcactgtataattaggcaaacagttctctagcattcttagtaaataaattgttattcagtgtgtagaatcttgataaatgctaattgtgtttagtaataaattgcatcctaattttatttttaaacaaatttgtatttaatgcctgttgctttgaaactttcatacagagtatatacaactttttttccctaccagagaccaacagtgataataactaaatttaaaaataagaaggtttttaacttttatttcaagtttttatttaacaggacaaaaatataaaataggagtatatttctctgttcttgaaattcagaaaatatggaattagaataaaatatttttaaaaatcagtcacataatagcatttcagagaaatggggaaatgggaaatgatgaaataaataacataaacatattgactcatgctttcttagagggtagaatgatataagttcaaaaagttccagagaagatgaccacacaaactgaacaaaatgtaagtacatagaacatgaagaaagatatcatggtaactctataagttcattttaatatttccttgagaaaacaaataattgttccatactttaattgatttgagaacaccaaatttaaaatattggatttataaaaagtcagtaaaattatatttgtattttgggaaaatgaaaaagaaataaaaaagttgtcactctccaaaaaaaaaaaaaaaa

SEQ ID NO: 54 - DNA, 1180 bp, Homo Sapiens
catacagggaggaaatcatataacaatgataaatgtggaaaagctgctattaaaatgtcaagtctcattagacaccaaagaagacatgctggagagactgtccttcctatgcacataaggaaggtgggaaagccttcagtcgcaaatcacatctcacagagaatgagaaaaattcatccaggaaagaaagcccggaatggaatcaatgtggaagtgtcttagctagaagaaatacttcattaaagatcagaacattcacactgtaaataatgagaactctatgaatgtaagaaatgtggaacatcttcagccaaaaggaaaacttcattattcatcaataatccatataaaaaagaaatcttatgaatgtagtaggtatgaaaaagcttttattcggaagtcaaactttataccagagaggtcatactggagataaaccctacgcaagtagggaaggtgagaaagcactcagtggcaaatcaaattccactgggcatgagaaaatccagatttgaggccaggcgcggtggctcacgcctgtaatccctgcactttgagaggccaaagtgggtggatcacttgagcacaggagttcaagaccagcctgggcaacatggcgaaaccccgtctctactaaaaataaaatatataaaaactgaggtctctactaaaaataaaatataaaaacgatcacctgagcctggggaggcggagactgcagtgagccgtaatcacgccactgcactccagcctgggtgacagagtgacaccctgtcaaaaaataaaaagagaagaaaagaaaattcagatctgaggggtgccctgtaaagataatgaaagtgcaacgatcttcgggcagaagctattcatcattaaatattacaatattcatgacgagggcgacaccctatactaagggtgcagaagttttctctgtaatcatactgcttattgtacatgtaagaacccgtaagtatgaatgtaaaatgtgtggtaaagtcttctgtccattcttagccaatgctctacataagagaaccaataccaacgaaaaaaactaatgaaatatctcaaacagaagtcatgccatatttgacaccaaagaattcatactcattaaaaccttatgaataccttggatttaggaaaggctttagcaggaattcatatttcatagcac

SEQ ID NO: 55 - DNA, 2613 bp, Homo Sapiens
tcctgtgcaggacagcttctatccccgtcacttaacaatggagaggattcttccccagcttccttccagaggacacaaaagctcagagctccacagtctagagtctagaccaacaggcctccacactcacgtcccagagatttccctggtcccacctactcccagtggcaaccagacttctgcacataggagagatgtcatactcagagtccagcctcccacatccacaggaccacctcttcctcctctgagtcttgttaatagggccatcccctgccttagacctggcccagtggactctgatcttacagccaatatggggcagcaaagtgggacatctgtctacagggccagtagccccaggtcatctgcttgccaaaaggagggggaccagcccccggggggagcccagagctcggcagggctggggttagtaagaagagaaaacagggttagtaggggctgggttagtaagtcagagcacagcaccagcggacagggcacctcagcagacacacacaggagtcgctaagagaaaaggaagaacgcacgcaggtccgttagtttgttaagggatgatcggggtgcagttgaggcaccccaggggttagacgggttagtaatcgaacaaaagagctgcctacagaaaagaaagctgagacggaggaagaatgtggggaagtgacatggattcaaagccaagtgtcttgccccaggcagaaggatctgtgtgcagaacacccagagaggccagggcctaggcagcagacgtgttcaaccaggtttgaggggccttcctccatcctcatactttttttttttttaggtgtctgccatgtgctgagacccttatattgacgggaatcctcactgcaacctgtaaggtatcagaactcgcattctaccactgaggaaactgaggttgagagaagtgaggtgacttactcaaactcactcaacaggaagtggcagagttgagaaaaggccatgtgaggacatagtgagaaggtgccacctgcaagccaaggagagaggcctcaccagaaaccaagtcttaacaccttgatctggactttccagcctccagaactggcagaaaataaattcctgatgtttaagccatccagtctggcatggtgctgtggcagcccaagctgatgaatagtacacaccactccgcattctgggaaaaaggacatctggcttttaaacttgcctaagggaggccacaagctgctctcttgcaaacgctgggactgtctcctctggagggagctggaattgcagattgtggggcctgtcctgccaccttctgttccccaagaacagaatccaggagcagtgcaactagaagcagcgatctgattggagaagagtgtcctgagactgggctaaggtgaccccttaagcctttgggatggtgcactctcagcccctctggctgcccctcccagagttcaacagcacagggggaaggctccagctcctcccagatcctgactgtctcctctttgtaaccatcagggagaggaaaagcatggaaaagccccaccaaggaagtcccccacaaaatgacaattacgcactgagcaaatggagacaaaggactccagccagcggcacccgaggagctgcatctgccctctgcctgacagcccctccccgactcccatccttgttcctgtccccatcctgtagggtcctttgagacccagccttggggaaagtgtggtcagtggggacttggcccaggccaggctctgtctggtcaccggcagaaacgcgaggaggaatcaagttcacatggggcaggaaagggcccccagacccagacaatagggcccagcaggcagggcccgagcaggtgaggagggagtagtgggctgccaggcctccctcatacccctggagctgtcctccagagccagatcagtcatctgctgagcatcaaccaggaagagttcctatccatgggaggctccatcccaacaggtgtgaagaggatgagatcttcagggagtcacccagcgggctagaaaaccaccggagtctgaccgctaagtcactgtggccagaatccaaggtcacccgaggtccaaagagaagtccaggccaggagtcctggagatgcggcccagatggagccacctgggggagaagacagcgagtgaggatgaggccacagcctccatccccaacttcccacatccccccagcctaattctgcatctgaggggactcatgttcagagatccccccagtctctcatgcccccagcacacacacagggtggaagtgagggttttggacatgaaacatttttagaagaaacttaggccaggcacagtgactcccacctgtaatcccagcactttgggaggctgaggaaggaggatcacttgagcccaggagttcgagaccagcctgggcaacataatgagactctgtctctacaaaaaataagccaggcatggtagcatgcacctgtagtcccagctacccaggaggctgaggtgggaggatgtattgagccctggagttcaaggctgcagtgagccgtgatcataacactgtactctagcctgggcaacagagtgagaccctgtctctgag

SEQ ID NO: 56 - DNA, 3694 bp, Homo Sapiens
gagattcatctcacagcccgggccagggggccggggccggggccggggccacggcggccgccgcccgcagacaaagaagccagtgcggcttggctgggctcggctcggcccgggagctggtcgggacccgccgccgcccccaggcccccagcctgggctgggcagagccgaagggggctccgcaggctaagccgggcggagaggggacggccgggaagcgggaaggggaagccgggtgggggggcggtcaggtatatatttttcttcgttcccccttccacgaccccccccttttccctcccccccttttttccctccttctgctacttggatttttttagctgctgcgtcatgagcataatttatgcaaagagctttgccgcatgctgcaccgcccgcgccagccgccgggggcggcgggctgggagggcggtcagggaagggaggggagcacgggagccaggagcgaggggtgggggtggggaggggaccctctggccctggccgagcgggaggtcccggaggctctctcccgggacagggatggacggtcagtgggtctggttactcagcccctccgaggtgccgcggaggtggtttcatttcggaaggtgccagagtaggagctggagtccggaccctccatgccacatggccttcagctgagggttggggcggtgactcccggccaccgcctttcctctaggtagtcaactgtcctcaatgttgaaagtcaagtttatgtctatccctccctccctagaaaggcgggggaactcagacatcgctcagccaacgtggagaacctctgaacagctgtgccccagcgccaaagcagcgaagggtcccaggtctctcacccggtggcggccgtgggctgtgttgtctaaaagcagatttccggccttcttgtccaagtagacaaggaaatgtgaacagaaagacaaagttcagtggaatggtgaaaaacctctagcagcttcttaaggtagagaggggaccagaaaaggggtggatgtgggtggctgagggaaagcagattggagaagtggtggacaactgaaagaggaaaaagttggaagaccaaagtggaagcgtgggaatggagagaagaactgggaaggaaggaggctctgtaaatccagtgaatgtggatcccaatactgaggccacctgctgtcatcctaggctgttccccctcccaccctctcccgatatttggtggtctgaggatagctagaggtagatgggttagaggcagtgtgagaatgcagttggaggcctcagtcctccccgggactgctccgtaaggcctcgtggtggaagggcattgaatggcccggcctcgtcgttaacctggccagtggactaggctgttatcagcttgctgtttccatctggaagtgagcaggtactgctggcggcggatttatgagtaaccaatgtattaggagtcagaatacttaggttttagtcccaactcttccactagccgtccaggcaagtaatttaacttcttcattacttataaaacaaggataatatttataatgacatttataatgactacttcatagggttaagtttgtgagcctgtatgtgaaaaaactgaaagctgcaagctctatacaactgtaaggtgtcattccttgtacaatagtttgaactcgttttaatggccctgtgaaactctactgcgtggcttgatattacagttcttggggtttttgtttggccggtagtccctgtagtttctctccctggactgtgaattctttgagagcactggttgtgacttactcatgtttgtatttcccactactctttatgtgaaggaggggctcagtattgctgctgaactttgtcacatgaaggttgaaacttttcatttatgtcacttggtttggtgctacacatagatcaaaggctttggatagcatggatatcagcgacagtttgaagaaagaaatatggatgtgatcagaggagttcagggagacatacataaaaatgttaatcacggttttctttatgttgtatacacttctgcattgcttaaatatttgatgagcatatattactttttgtttctgtgtttattggggcataacatgtacacagtatgtgtataccttgataaatttttacatgtatatacatatgtacgtgtatgtatgtgtgtatacatatgtacgtgtatgtatgtgtgtatacatatgtacgtgtatgtatgtgtgtgtatacatatgtacgtgtatgtgtgtgtatacatatgtacgtgtatgtgtgtatacatatgtacgtgtatatgtgtgtatacatatgtacgtgtatatgtgtgtatacatatgtacgtgtatatgtgtgtgtacatatgtacgtgtatgtgtgtgtatacatatgtacgtgtgtgtgtatacatatatacacgtgtatagatacgtgtatacatatatacatgtctatatatacatgtatatactcacacacatatatatatccatgtaatccccacccaaaacaagatatagagcctttccaagacctgaggattcccttatgtaccttcaccggccataaattcccaaagtaaccattattctgatttctgtcaccatagattgattacttgagctgattcttgaacttctcataaatggaatcagacaatatgcaatcttttgtgtttggcttctgtcactcaacaaaatttttttttttgagacggagtcttgctctgtcgcccaggctggagtgcagtggtgtgatctcggctcactgcaacctccgcctctcgggttcaagtggttctcctgcctcagcctcccaagtagctgggactgcaggtgcgtgccatcacgcccagctaattttttttttcttttttttttcgagatggagtctcgctctgtcgcccaggctggagtgcaatggtgtgatctcagctcactgcaacctccacctcctaggttcgagtgattctcctgcctcagcctcctgagtagctgggattacaagcacacgccaccatgcccggctaatttttgtatttttagtagagatggggtttcaccatgttggtcaggctggtcttgaactcctgacctcatgatccgcccacctcagcctcctaaagtgctgggattacaggcatgagccaccacgctcccagctaattttttatacttttggtagacacagggtttcaccatgttggccaggctggtctcgaactcctgacctcaagtcatccgccctcctcggcctcccaaagtgctgggattacaggtgtcggccaccacacccggcctcaatatatgtttttgagattcatccatgttgttgaatgtagaagtattttttattgctgtgtagtattccattgcataattatactacaatttatccattccattattgatgggcatttgcttgttgtttgggcctcttaggaataaaactgctatgagcattcttgtacaagtattttggtgaacatatgcacttatttcttccaggtaaatactgaggagtagaatagctattctattttatttagcttttgtccatactgctaaatagttttctatagtgtttgaaccaatttatatctttatcagcaatgcatgagagagttctaattgttttacatcctcaccagtatgtggtattggtagtcttcttgcaatgaaag

SEQ ID NO: 57 - DNA, 858 bp, Homo Sapiens
ctccgcaacctggtggtgtccatctgcatcatgttcatcaacaaaaggatccctaacatgaacctgaccctggggcatcttgtggtcacctggctgcgcttgcacatctgtcagaaattggttatatttgcctcaacatgtctgccaccccaagatcctccttctggcctttagcttctgtgattacaaggtcttcaccaacttctctctgcagggcaactccacaggcgtccatcagctgatcaaggtcatcattacactggtgattatggccatgcagaccctctgctaccagaaggccttcttcaccagaatataacacaacactgattcctgtaactttaggtgtaatcctaaattcttattacaatgtgaaatgtaatgtccttggaaggatgttttctgctctcagtgttttagttatacccccttatccagtgtgggcagaaaccaagcagaatgagtttcaagtaaactcaatgctgctgcagcactatcaagcaccaataccttctgctgttattggttgcttctctgagtcagtgcatggagagcaagaaatatctagtctctggtcagcttctgctttgcctatggtgcagctatctgaaataatggttgtcatggtgaacttatcaattcactgggtcactaggtacacttcatcagtcacctatgacatgtttgggcacttcaagttctgacttgctttatttggaggacatgtgttatttaaagatccactgttaattaaccagagtcttggcattttatgtagttatttggtgtaagaataagagcttatattcattctgtactctataaacaggaaggaagaaaatgtaaattgctacaaag

SEQ ID NO: 58 - DNA, 3360 bp, Homo Sapiens
tgatactgaagagtagggcattgctataaagatacctgaaaatgtgaaatcagctttggaactgggtaacaggcagaggtttgaacaatttggtgggctcagaagaagacaggaagatgagggaaaatttggaaattctcagagacttgttaaactgttatgaccaaaatgctgttaatgatatggacaatgaggtccagggtaatgagatctcagatgaaagtgaggaacttattgggaactggagcaaaggttacttttgttatgtgttagcaaagaacctggtggcattgtacccctgccctaggaatctatggaactttgaacttgagagtgatgatttggggtatctggcagaagaaatttctaagcaccaatgtgttgaagatgtggcctggctgcttctaacaacctatgctaataatgtatgagcaaagaaaggacataaaactagaacttacgtttaaaggggaagcaaaacataaacgtttgaaaaatttgcaaactagtcatgtggtagagaagaaaagcccattttccggggagcagttcagactggctgcagaaatttgtatagctaaaaggaaggcacatgctgatagccatgacaatgggggaaatgcctccaaggcatttcagagatctttgtggcagcccctcccatcacaggcctggaggcctgggaggacagaatggttttgtgggcctcacttagagcctgactaccctgtgcaggcttgggacactgctccctgcatcccagccattctcgctccagctgtggctcaaaggggcccaggtacagcttgggccactgcttcagaaggtgcaaaccataagccttggtggtttccacatgctgttaagcctgtgggtatgcagagtgcaagagttgaggcttgggaacctccacctggatttcagaggatgtgtggaaaagcctggatgtccagacagtagcctgctgaaggggcagagccctcatggagaacccctaccagggcattgcagaggggaaacgtgggactgtagctcccacacagagtctccactggagtgttgcctagtgaagctgtgagaagagggccaccttcctcaagactctggaatggtagatacactaacagcttgcacctgttgcctggaagagctacaagcactcaacatcagcctttgagagcagctctgggagctgaaccctgcaaagctgtaggggtggaactgcccaagatcttgggagcccatccgttgaatcagtgtgccctggatgtgagacatggagtcaaaggagattgttttggatctttaagatttcaggactgccctactgagtttcagacttgcatggggcctctagcccaattgttttggccaatttctcccttttggaatgggagtatttacccaatgcctatacctccattgtatcttggaagtaactaacttgttttttattttataggctcatagatggaaggggctagctttgtctcagatgagactttggactttagactttcgagttaacgttggaatgagttaagactttggggggctgttgggaaggcatgattggattttgcagtgtgagaaggacatgagatttgggaggggccaagagtggaatgataggattcggatctgtgtccccacccaaatcttatgtcaaaatgtagcactaatgtgggaggtggggcatgggaggtgattggatcatggaggcagtttttcataaatgatttagcactgtccccatgcagtggttctcatgatagtgagtgagttctcatgagatggggttgttttaaagtgtgtagcacctcccccctttctctcttcctcctgctccagccatgagaagatgcctgctctgactttgccttccactgtgaataaaagcttcctgaggcctcctcagaagcagatgctgccatgcttcctgtacagcctgtggaactgtgagccaattaaacttttctttataaattatccagtctctagccaggtgtggtggtgtgtgcctgtagtcccagctacttgggaggctgaggcaggaggattgcttgagctcaggagttcgaggctgcagtgagttataattgcaccactgtacttcagccagggcaacagagcaagaccctgtctcaaaaataaataaataaataataaattacccaatcacaggtatttctttgtagcagtgagagaatggactaatacaccctccataccacaccctactacttcacctccctttccaactactgtagaagatactcactgttatcatttactatcttataagtgcaaaaactaaagtttaaagaggttaagtaattggctcaaggtatcacagctggtaaacagaggcactgagatttgttctcttttggtttgaccctagaaccctctcctaacattttttttttattttgactcttgtttggcagaataagtagcaaggacaccatcatctttgctgaggaaagatgactattattagtagtaggcaagtggagagtcgtcagtgttccatcagcttttcccctgtgtctctcatcccatgaatgaagagcagatgtgaaaattgctgccagccactcacttgtcagatgagaactgacttggctgtgctcattacaaaattaatttttaggcttattacaaaattaataaggcatgtgaaatatagatgtcctcaagatttataaactttaatttagaagtgtctttgattctaatacaaatctatttttacttacagtaagatagcaaagaaaaaagtctctggaaagattctggatatgtctaaggaaaatttgattagatgggccagtgtttcagtaacacacacaagaagcttctgaataacttgtaaaagtgagatgatgtgccccactttgatttaaattccattacatgtatcctcaggaattagcaaaaaaatttttttttcataataaaactcattagatgattttgacttataaagaataacttgtttgagaataaaatttgtctggacacaagtattggttctgtaaaatgaaaggaaatatctaaacttctgtgcaactctccgttaaagataatcctaaggctacttcagatatatttttgttattcaggatatggaatgagcatgaacgtttgcattttaatggtcaaaagaaccattaaggagagaagctcccaaaatataataagacatgactagtttcaactctatgttgcctctgtatgtttggaattccttgtaattccatatgtatttggatgatgtttacctttgctgtatctttgatgaaatgatgtgttaaactaacttcctgcagtaaataaaggaggaaattgtaaagc

SEQ ID NO: 59 - DNA, 1124 bp, Homo Sapiens
ggcccaaatctccagtactttttctgctcataaaaatctgattatttgctaatcctttagaatgtatggtttctattgacagttggaaaaggatcacttcattcacgctgcctagtcaagtgaccctagcctctttaggtaagtgattcaatatattattaataaaagttacctttggttcaagctttgaaaataaattatattgtttatgtaggtaaaacacaaagatcagaaatcaatgacatttgaaacagcaagacgaaagggagtttaacatccagcatatatgaataactacaaccctacagaaaaaaaatccagttcaaaactcggcaaaggatttaagtagacattttttccaagaagatatacaaatgtccaaggagtacgtgaaaagcttctcagcatcattaatcattaggaaaatgcaaatcagaatcacaatgagccattacctcatacccattaggatggctatttttttaaagcaaaaaaaaaaaaaaggtgtagctgctatggaaaataatatgctggttcctcaacaaaataaatatagaattaccatatgatccagtaattccacatttaggtgtatacacaaaaaagctaaaagcagaacctcaaagaggtcttgtataccaatgttcataaaatcattatttacagtagcaaaacggtagaaaaatctctaatgactatcagtggatgaatggataaacaaagtatggtctatctacacaatgaaacatacccagttttaaaaaggagtgaaattctgatggatgctacaacatagatgaaccttgaggccttatgctagatgaaatatgccagacacaaaaggacaattattgtatgattccacctatctgaaatacctggaattctcatattcatagagacagacagtagaatagtggtttccaggatggggaaaagaggagaacaggaagtgattgttcaatagatatggagtttcgcttgggatgatgaaaaagttctggagatgatggtggtgatgactgcacaacaatgtgaatgtacttaatgacatgtaaaaatggttaaaatggtaaatattatcttatgtatattttaccaataataaaaatactttaacactg

SEQ ID NO: 60 - DNA, 5328 bp, Homo Sapiens
atccggagccgggcggctcgcccaggatacggagcccggcggtcacgggggagaaggtagctgtcgggcattcccctggcgctgaagggcagattgctggtctcactccattgcccaggcttcagtacagtggattacagctcactgcagccccaacctcctggactcaagcgatcctcccagcctcctgaatagctgggactataggtgctcaccagcatgcctggctaatttttgtatttttttgtagagacagggtttcaccatgttgcccagactggtctcaaactcctgggctcaaaaaatccacccaccttggcttctccaaagtgctgggattacaggtgtgagccaccatgcatggccaagcacatgaaattgcatgcaaagctgccatgcttccgtatttgcaagagttcctaacctggaacaagattaagaatcagcagcaaaccaagtgagagtttccagggagatggtgcagctttcccgtgaatacctatgaattcaccacctaaatggtactcagagctcttaaggggacagcacaaggacgagcctgggaatctaagcacagtgggctgaacatctgctgggacaaggatggggccagagacagatcactctgactcaccaccctgccaccaaactaatgtttgaaagctctaaatttattcagcttatactgaaaggaaatgaagtctatgtccaaataggaaacaatgtggagtactgctgtgctgtgccttcattacctgagactacagcagcctgcattctccaccgggctcggaggagtgcagatgcctgagctatgcagtgtgattcaacaattccagttggacggaaaatacagctgtcttttttacggagttgaagtcaaatctacgtgcagctttttttacctacaaataatggacaagctcctgaatccaacatattctagctgaaacggatcccaggacggaatgctggagagatgcgtattccagctacaggccctcagagctcagtgtttacctgttctggtctttcctcacatatctgacaatcgttagctctctttgtatttcaaagaaaagctctggaatgtgtctgggacctgtgtatatatgggcaaaactcatcaacgaatgggctccctggtgattatttggcagattcctggcaatttcatcagaggatccaaaaattggagaaactccaagatgaaccccaaagatctccatctccagctgttcacactcctatgtaatctctagcccttgggtgtggaaaggacttgtgacttactttaaccaacaacagaatatagcaaagatgcctaagaactgcaaatgagaaataattttctcacctggtcacagcatctaccaagaatggcgctgggggagagatcagtgagattccatctttattaccatgtccctccttccctgtcaaaagcatttcacatcccgcaagtccattagacatggcaccactctgctgtgggagatacacacacaactaaatacagggtaacaatacctgcctggtcagcacttcagctccaaatcaagcttcactaatgactatgagattaacgaagatggttttgataattatgactgtttgttttgtttttcttaactattcttcatctgagacttttacttttgtttctgccagcatcctgacaaacatttacaaccagaaagggtaagccactagcttgaagccattaagttaagttcagttaacaaggctttgataacaaccctcatgtttttaaggaaaaacaaagaacctagtaatcctttaggccttaccctgaaagggtagccagaagaaaaatcacaaataacatgaacttaccggaacaatccaccggggtgtgatcatggatgtggaagacacctgaaataattttatatgtatgtatttactttttggaaagactgacttattttcatacttataatacttacttacatctattatgaaatccattctaggagggcaattcttaattcttaatggtgttccttgagctgacatggacttctaaatccaagacccttttctgttatacaacacagatgctatccctcaccacttaagaaagtgtcataattttgagaatctcttatctaaaaatttaccattcaagaatctattactactttcagttcacttaataggactgcccctacctcacacccagtattcagtttaacattttattttctgaaatttcagttaattaattacaaataatgatagccttcttggtagcagcctgaacaatggattgtgactaatccaaataaagagcaacaagaaagtacacagaaaaataatctgtttagatacagatcattctctaattatcatgtatgcatgaagaaagcgcaataaaaacacccatattgctcctggttcacagggcctttgatacattatttttatatgtttaactttctattataggtcatctatgtgtagaattataaactaaggaaacccacccattttactagtaatttagactagtccttgcattggtggccttacatactcataagaaaaaactaatgtaagtccaggtattagtaaattagataaccaccaaaagaataaaaacacaggctgggcgcagtggcgcacgcctgtaaccccagcattttgagagggcgaggtgggcagatcatgaggtcaagagatcaagaccatcctggccaacatggtgaaaccctgcctctactaaaaatacaaaaattagctgggcatggtggcatgcgcctgtactcccagctactcgggaggccaaggcaggagaatcgcttggaggcggaggttgcagtgagctgagatcacgctactcctggcaaaaaagcaagactccatctcaaaaaaaaaaaacccacaaaatctgactttcctaccaatactttttagatgcatgttaacagcaggaaataagagagaaaaaatatcataaataatagtaaacaaaaaatagtttgacagacttttccacacttgcagttaattcttatccttggtaaagtctttgtttattaatctaagctggtcattcccaacgggtggttcccagaccacatctgcaccacctgggaacatgttagaaacacaacttttcagaccccacccaagatataccaaaattagaaacttggaggtggggcccagcaatcttgtgtgttaacgtcccctccaagggattctgatatacacaaaaatttgagaattaatgatctatgcaaacattcagtatcatgtgtatttccaagccttcaggatggcatctagcccctacagcaattctcgtcatatcactcataaggtacaaagttagtcatttctgtttttttttttttttttttttttttttgagacggagtctcactgtgtcgcccagactggagtgcaatggtgctatctcggctcactgcacgctccatctcccaggttccagcaattgtcttgcctcagcctcccgagtagctggcgctacaggtgtgcaccaccacccccggctaatttttgtattttcagtagagacagggtttcaccatgttggccaggctggtcttgaactcctgacctcaagtgatctgcccacctcggcctcccaaagtgctgggattacaggcgtgagccaccgtgtccagcaaagttagtcatttctatctctctcatccctggagggaaggaactgtttcagttggccctccatatccatgagttgtgcatctgtggattcaacaactgtaaatcgaaaatatttggagggaaaaaaaggatggttgtgtctgtactgaacatgtgcaggcttttattcttgtcattatttcctaaacaatacaatataacaactgtttaccagcatttacactgcattagatattagaggtaagctagattatttaaaatatactagaggatatgtgtaggttatatgcaaacactacaccattttatatgagatttaagcatgcatggattttggtatccaaggggagtcctggaaccaatcccccacagatactgagggacaactatacttaatacagtatcttccagactgtaataatgattgatatgttcaatgccattcttacgctctcatctttctataaaactttttaaaaaattaaatatatccttattgtctcaagaaactgctttatccccatgttttctctcatttaatatgatgttgaattataaaaggcttatagagacatgtgatttgtagacagtgatacacaaattcaaagtggtaaaattttaggacagagaggcaatgctaagtggttattaaaacataaactcttatcaaatgaaaagtttaactgaattattaaaaaggaaaaaactggaatctagcaggaacatttttcaaaacagaaatttctttccatcatactattttaaagcatatttacctgaggtgcaactgtgtgatcaattagattctcagttagagatgcaagcaaggcatccaattcatctgtagcttcctatggaagacaggaatctagaattgttaaatgacccctttatcatcagatgttaagttttttccatatcctctcaatttataattctgacacaggcctgattagtgttaatcctttaaatacacagggacactcataaatcatggttgttaatgattccacttctgcatggagggaaacctatactacaatcaggatgtgaaaaagctgaagtgctatgtaaattttcaaatagctattctcctttggtaagacaaaacttgggtagggttatgactattctggctcttaactttttctttttaattacaaaaaaattattttggctggatgcagtggctcacacctgtaatcctagcgctctgagaggccaaggcgggaggatcccttgagcccaggagtttgagaccagcctgggcaatatagtgagacctcatctttacaaaaactgagctaagctgggcacagtagcactcagctgtagtcccagctactcaggaggctgaggtgggaagatcacttgagcccaggagacagaggctgcagtgagccaagattacaccaccgtactccagcctggatgacagagtgagattctgcctcaaaacaaattttaaaaaagtaaatacagccgggcactcctggctaacacggtgaaactccgtctctactaaaaatacacaaaattagctgggcgtggttgcgggcacctatagtcccagctactcgagaggctgaggcaggagaatggcatgaacccgggaggtggaggttgcagtgagccgagatcgcgccactg

SEQ ID NO: 61 - DNA, 1990 bp, Homo Sapiens
atcattatctgcagagaatttcagtatatcttcgagttccttgttagtatttatgctctcttatttgtgttgggatagaaagattaaggaaaggagagatgagaaggtggctcaacagttgagacagttttattgggagtaaacctgagaagggcttccagcggcagggtcaggtgcaaacttctcttacagcctgaggcttttttaaagggcccagtggagaagtgtgctttgaaacaaaattctgttagggaggggttggggaagtcctggctgttctgttacagttagggccgttattctctgttgaagttatgggcggggctgacattttcagttttggccaggtggccaaatagaaacttaaagcttaggatggtggagtgttataaagatggcggtgctcttgtcctgtcaatgtgttcctcaataaagtcttcaagcatgtcatagattgttttccccaccaacctcccttgcagcatttgagatattcctgatacttcatcaatagtggagaagctcctgaaatcattgacttcctcactccataatggtttccaacacccaatgaagtagtaggaggaaaacatgggtttcttctcctggaagcctccagaagaaggtatttcaatatggggagagtggtcagctgtgtcacaggtcactgagaatttgaataagacaaggaaaaagggttgactgtagattttggcaagtatttggtcactgggggccttgataagagctgtttcattgaagtattcatgagaataacttgtagtgaaatatatctcaaatagacctccacgatgttgcctagagggcagtgttaccctttgaactaccaacattaaccactggaactgctcatctggaagcctcttacagtgctggtacaaactagaatacacaaaggaagggatcattttatacgtgttactgtgctacttgctctatctacttagtgttccatacatgtaattacctattccatcctatcccaaagtactgaaaatctccattctactttctctgtctgtgaatttgactattcatagagagagagatatgtggaagtatgcatgtgtccttccatgtctggcttatttcacttagaacgttttcaaggtttatccatgtggtagcatgtatcaggaactcattgtttttgtgtctgaataaatttccactgtatggttaaagcatactttgtttatccatttttatgttgataaacatgggttgtttccacagtaataatttgactgctatcaataaggctgctgtggatgtggtatgtctatgtctgtgtgagtccctgctttcaattcttttggatatatgtatccctaggagtgtaattgctggttcacagaataattggtgtaaacctttttcaggaacaggtatattgctttacaaagtggctacaatgttttacattctctccagcaatgcataagggtttctattttccacattgtcacatatactggttgtcgtatttttttcataatagccaattaatggttctgtactgctttttcattgtggttttgatttgcatttccctaatgaccaataataatgcacattggtttttgtttttgttggttgtttatatattttttgaaccagtttgttttaaaatcctttgctcattaaaattgagtcatttgtgttttgttgttgagttataggaattcttatttaaaatttttagtttttaatatttagaaaatttctttcttttttcagctcccaagtgcttggaagagagttgtaggaattctttatacactgtgggtattaagcccttatttgatatgtgatatgcagatgtgttctccctttctgtaggttttcttttcatcttgagattgtcctttggtgcgcaaaagtttttaatttcgatgtagtccagtttatcttttattggttgtctgtgccttaaatgtcgtatccaataaatcactgccaaatttaa

SEQ ID NO: 62 - DNA, 3628 bp, Homo Sapiens
cttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttggtgagtatgtttctgtcatttttagggttgcttctgcagtttgccttggagtctgggctgtgggaaaggctgctgcgtcctggtgaggacactgcgtttctttcagactttgaagatctgtcgttttagaaaagtggctgcctctgtcaccagccccatggttactgtcctttagtgtgactgtcaggaggtgtttctcagtccttcgttgtaagaatgtagatgccggttgcaccttctgttgtcttggaagagactgcagtgcttggctggaaaataagctgctcgggactcctctgagaagccaaagtgaagctcagagatggaagtgggtatacttgtgctaacccagggttgctgaggttgggtgagcttccgcttctccgaggtggaggagaggcagctcctgagccatttctggcctcgtggtcagagctgcccaatttcagtgtgagaaataccagagaggcagaactttggctgccttctctaaaagcatatgaatgattgcaggagcgtattttacgtcctttccttttccttaacgttgaaagtcacaaactgtagtaaaatcaggaagaacgtaaaaatgctgggggccagcgctgggggtgggggactggggaggactgaggagggggccactcagtctttgaggcctgacttgatcttgataggtatttctcaggctgttagtattccgatgaagcttagctttactgtcaagtaaaatacaggaaacatttttttttaatgttgttctagttactgtaaatgaaacggttaaaatgtcataaataccttatgataaacatttttcaaatttgcttaaaaagcaacacatcagtaggcagggtatgacagggagctttttcagtacagtcatttgagtgtgtgggcttcctgagttaataatgagtcagcacccaattctaaaattggagcagctaagagaatgttcaatctgctcctcagcacagcacggtggctggccggccccccgtaggaaggcttggggttaaaatcgacttaggatgccgcccttatgtaagtgaccagctcccagcttgggtcccagctcctctgggctactgctgagagaccccctctgctaagggatctgtctctgaggcaggagctaacacatttggcttccaacctttggctaatgttgacgatttttaggttgtcttgaggcaacaggttgaacatagtttctgaaatgaaaaatctagtgtttattaaggctagggcagctgagggctgagcctgcatctggagccttgagatgttccgcttgcacgtcaccctcgccgagggattgggcgggagagtcggtcaccgagtgaacttcaaagttggcgctctgcatgtgacgtgtagcgtgggaagattaagtcagcttaaaatgagagaacaagattccaaggaagaaaacctccccagaaccttactcgtttatagataaaagaagataaatattgagaaaattaaaaaaataaaacgaaatagttgggctgcaaaccagcagctctgggaccagatgcagccctggtgaaggcatcccccaccaggttctgtttggcctgctcaggattgtttttttgtgttgagataactgtgggtggggtccacactctccggatctcaggccctgccacaccctaatgccacaaagcttggagagtgcgattacagcgaggctcagaagccaggctgagggcctgccagcctcgtggggctgctgtgtggtccccatgggttagcatctgcccggccgccggaacagggcctggatggagaaggaactccatcagcactaactctgctagactctcttattaatctgccctctgaaggcatttgggcttgtggcccttgagttagttccatggctttttcaagaaagatcctgcagttccaatgtgagcagcagttgtttccaaggctaacaatttcacgccaactagaagcctccacaagtcaggtgccaggcatttctaagccagtagagcagctccgcttgtttctctgggtgagtcctctcagggtgagaccctgtctccttgtaagcactcggagacgtgccaccttcatggagacgggagccaatcaaaggcaaactgcgttagacagctcttccatgcggtatggacaccaacattcgatcatccttgtttcagagaaggtgccgggccccagacatgtgcttatcactgggtcccatggccttcaatcctttaaagggttttaaggtggctgatttttatcccagacattgatcatgttttttttcatgcagaatttgggcagttgtctggacattaggagttgagtcacctcctacccatgaggaacaagcctgtggggggactgatattatcacttctgtcatcaagaaataaggccgcaggcatccctgaatatagagcatttattaatcgaactgtgaaaatgaaacacagacagtgatgacagctggaagttggccaatgtcctgttgtcatattgccctcagcctagggactggcctgtggctcactgaccctgtctcccactctccacctctcatcagcaactggacctggtgcacctggtctacctcatgtccagtgttttccgcagtacctgactggtatccccacccttggttgttgtgtggtgagctcgtccctatgttggcaagttacttaattcctaggtgtcccgccttcctcactgtaaaatgagaaaagtcatagcacgaatgtcatgagtccttgtgaagattttatgattagcacacaagttacaaggagacacgataactgttacgtacgtactcattcgttcggaaatataacagacagcttagtatctccacccgggtccctctgccctgtgggaatccataaagaattgattctcatcccccagaagtgagatcccgcttgtgtcatcaattacatggcatgttctgcatttacaggacatttatttattaggtaagtggggaatcctccttggttctctccaggaaaacctggagttctagttatcatcatcatcatcatcatcatcactgtcatcatcattgacatcatcacaataagaactcccattgtattcagccctaaccgtatggtagcaactttatggtattccctttaacctccccccaccccaatatccatcctggaagatgggaaggatgataggtttgttgactcactcaaggcggtgggactctccagcaggtatcaggcacagcatctgcttcaaagaacacatcggcgacaggggagccccttgcactcactcaggacaggagaatcaggaaaagcagcagatctgcagggctttgtgtgtaatccaaccagactgatgccacaggccaggaaaccgaggacggttggcttcagacctaccctggagtggaagcagctggattctgtcctcacgcttcctgtctaaagccagct

SEQ ID NO: 63 - DNA, 2586 bp, Homo Sapiens
cacccatggtcagggaagcgccatcgccctggctttgaggctggggcctccggggaggttccggtaggggctttgaagaggccgctgtttttgcaaggccgagacggcgggccctgcgcaggccgccctattccgcgccctcagggcgtcagtatccgcctgaggccggataccccctctgggcccggatgcccccgctggccccggagcatcctcggcgctgccctcccagagccccgcagaggctgaggtggcgcgggggcggccccggctccgcgagaagcggcggcagcgagggctggaggacccgggctacggggctccggggcgtctggcctggttgggactgagcccatccagggactgggactctgggattctggtgtaggtggatccggggcaggctcaggaccaagtccctctccttccaccaaggagcgcccagaggccggcgggagctccaggttcacctcctcctcctccaggaaatctcacttccaactggatgtctggatgaactactgaaagctgctgagtgtcctgcagcaggtgagctgtggccagagcccaaggatgaagggggctccctcactctgtgactgtgaagaggaagcctgaggtgtagcaggcccaggccccagaagtatggaaaaaatgaggccatttccaatccagcggaagaccttctagaagaggtgatgggtgggagagtgctggcatactacgtgaagctactatttggagttggacacgagtgcatgtgaccttgtgccacagcgggaatgtgagctggatgacaaatggagatttggacttgtgataattggcctctgtgtcattgtgtggaagactgactggtccctttatttcctgtagcttgactaccacacaaatgaatccactcaaatgttggcaagtggagcagagtcccaggacagtctgcaatctctacaggtacagaaacacccccagttcaaggatcttcacacctggatttaggcctactcctgcaactaccccaggccagttatccaggcagtgactttcagtgcagctacagtcacctctggaaacctgcggagactttaaaaatttccagaaggtcaggaatttttggagacctttctcatggctacattgcctgcaaaggtgaatcaataagcttctgaactgacttagaaaatgttgcagagactcttgtgaacagatagaccctctcctgccactcagatagacgtatcagggtcacacacacctgatttaacaacatgtcattatctcaggcaccaatttgatcttctactatgttgcagacatctgttctgcaaacaccaaacaaattgagacaatgaccttccgcaggacccaaaccacctcttactgaaggaaagaagatccagtgagatagttagtccacaaatggaatgtaaatccataaacactcttaagtaacagaataaatttagtatgaacgtttttatgtgggagctcttgacatggttgctgctcatatgtcagagacacatgcagtttaagaaaggtagcagttccaatcctggtttggcccaacagtcactgcatttttggtggggaaaagggatgtgggaggagatggtacctcttcatctttttctctgggttttctgtcagaaagggatgttgcttactccagtggcaaaaaatgccagtgtcttctgccagagtgggttactgagggccctggtgcttccaccttgtggctgatacagatagtccctttctgcttttgtttctagccaaaaaagatgtttctggcatctcaggtatgctgatttcagcagctgttttttctatatggctattttttttttctttcactctctctctctctctctctttttttttttttttgttggcttcactgtgttgccatagtttcttaaatggtcccttgaaccctcccagtgctattttggtttgtacataactatctatatattttttttctttgggggagtgtgtagagctaaaggctggtatatgctgctcctgctccccgaaagtgacattattcccctaagctaatatttcaggctttcaatttattcgtggtttcacctgtttaaacataagtagaaattactttttctctccatatttagatttgatctatctactttaattgctaatagtgtcttagtcatagaatagattagttagaaaaaagtgtttttgacattataaatgattctttcaatttgtgtctaaaagtggaaaatactagaaagcttaacatttattattgtattcagaccagtatttcctccagatgacctttattacaacaaagataatttaatgaagatctctctaatggtaaagctgatggctttgtgctattacaatatccttcgaataaagtgacagtctggtggaaagaacaactaaagcaaggattaggaagaaaatagttaataccttcattttggtctcactctgcattaagagttgtcatcgtgttaagggtttattatacattaagtaatttaatgtttatttaataataaatggatcctattaaatatgatttttaaaattataatcaca

SEQ ID NO: 64 - DNA, 7458 bp, Homo Sapiens
gagggatggcgccggcgcaggcctgcgcgccacgcgctttaggtggatgagggatggcgcaggtgcaggcctgcgcgcctcacgctttatgtacatgagggatgaggcagcacaggaattggcacaacctgaagtcagctctgcagctttccaagcttcgttctgcgtgtcctgtactcaacagtcatctcatgctgcagggtggctgcgtgtgctccgtacatcacacccatatttcaggtagggacggttcccggagggtgctcagcaccatgccgactactgctggctggcacgttcgcacgtggccatgtcagctccaaggaggatgctgacatcctgctggctggcacgttcgcacgtgtccatgttagctgcgagggccatgccgacatcctgctggctggcacttccacaggtagccatgttagctgagagggcgatgccaacatcttgctggctggcacgtttgcacgcggccatgttagctgcgaggacaatgcttctgcaacttttggtttcttccctttcatcctcccacccctgaccgtttttgcctgggagcaagtgcctaataaattacctgcactcaaatctttggctcagagactttccgagagaacccaagctgaggcagacaatgaaatcaacactaccagccacttagctgccagctgggtggagagtgggctgctcttccaagacgcttttcagcctctgaaggctcatttccagaaggtcctgtctatctgggctacttgcttccagagcagttgcatctggctggatagctaatgagcgataaggcctgcaaacctcaagccacatctttaaagatgagggccctgatgttccacagtgtgcgacgttactggggtccagccagttatgttctgggagctgcctgaatgaaaatcaatttgttattttagttggttggcttgtttaaaaaaaaattaaataacaagaaataagaaaaaacgtgcaatggctttgaggtagaacagaaaatccagtgagccctctctgtgcctctggcagaagaaactgtgaagatttgcatttagaaaaacgcctcctcaactttggcggcacctgatggttcatggttcctaaaattagaaaatgctagagccttggttcttttttttttttttttgacggagtctcactctgtcaccaggctggagtgcagtggtgtgatcttggctcactgcaacctccacctcctggattcaagtgattctcctgcctcagcctcccgagtagctgggactacaggcgcccgccaccatgcctggctgatttttgcatttttagtagagatggggtttcaccatgttggccaggatggtctcgatctcttgacctcgtgatccacccgccttggcctcccaaagtgctgggattacaggcgtgagccactgcgggagccttgcttctatgcgagtatttcggagacaattagacaaacatcccacagccccattttgaagcctggcattgtgttggctgcagtgaattctgggggtggaggtggctggagggaaagagttgggagtcttgttttgttttgtgtttcctggagagttttgggttctgcgggataatatgtgcttgcaggtgcagcaggagtagcattctcatttctcacggcagttcagtccctgagcagacgggagaggtgaaatagaaacacacattacagaagggacatgctttcttaagggcacggggaccgtgacacattgctttgatgaacggtgatggagtcacacatggggaaattcaacatggacacaccagtctcgctatggagacatctgtgttgtatgggagctaatggctttgaatgagcccatattcatttttctagcagttttgatactaacataaagagagaatgtgtgtggacagaggaggctgtcctgcacggactctgggtgtactttgtgccagtgacattttgttccagagtgattttgcttgttccagtttttctgaaaggaaagcttccccacagttttggggactgctgtttgtctcatgccacatgtgaggatttgtggggtccacagtctgcgactgtgctgtccagcatcgattccattcacactggttcttactttcaaagtctattctgttacagggagaagactgcacatataacacagctctgcatggaaaaccttccgcctggaggggtggcttcctagaggtgtggcgttgccctctgtcttgaacaggctgcactttccagggcacatcacgtgggtgtgcggtctggctgctgggtccacgcgggttctcaatcatgacctggcttgcaagctctttccacagttggataaatgaagccgttggggaagtatccgcaaactcttacagtgagtatgtgataatgacacacgcgtggcccttctaagacctccgctaggcattatcagtgactgtgctcgtgagcgctgacctccgctaggcgttatcagggactgtgctcgtgagcgccgacctccgctaggcgttatcagggactgtgctcgtgagcgcggacctccgctaggcgatatcagggactgtgctcatgagggcggactttcaccagccacgcttccgaggagtggagtctttctcagctctgcctctccaagatgaccatcttgtgaagacgatgcgttctttatacacaagttctgtgtgtgtgtgtgtgtgttccacacacaggaccaaagttgagataggcgcacattttcttggtcccacttgtggccccagtcggctgtcagaagtgggtgtgctccacatgtacccaccatgtcagggcacagtgctcacatttcacacctcagcaggtgccttgatgttgaccagaggccccaaaatcatctctttctatgacttctagatcttagattcccaggaactgggaaatgcagtcagtatcttttgggtccaagaaactttgtcagagcccttgtgggagaaccatagattctcaccagataaacagaagagcttcgtgttagagaaacccgcctgtctccccacattctcagttttctggagagcagctgaaagccatctgggtggagattaagagctccaaccgtgtagctttgatgtatcgggcaagttgcttaagctctttaatgctgtttcctcatttattgtgtgaggccaaaaatacccattccttaaagttgtgaggattaaaaacagtaatgaaaagtgagtggcaagtgccgagtacacagtcaagtacctgatactttttagtgtaaggtaagtagcaagaaagcatgaaatttattttcatttactcttactacatgtggtaaaccatctatgcacagagcactgcattgggtgccatgaatgacagaataagagtaccaggtgcatgaaaagcttaaaagacaaatgagacagagctaggctgcagaagacttaaaaagttgatgtatttaacttttaatggacacactgtacatgtttatggggtacgatttgttgtttccatgcatatctgtgttgtgtaatgatccaatcagggtagtgtgtgtgcccatttcctcaagggtggatcattatgtgtatcatcgtgcatcatcatgtatcatgcatgtaccatcatcatgcatcattgtgcatcatcatgcctgtatcattatgtatcacctcatgcatatattataatgtatcacctcatgcgtgtattatcatgtatcaccatgcatgtattgtgcatgtgccatcatcatgcatcattgtgcatcatcatgcctgtatcattaatcacctcatgcatatattataatgtgtcacctcatgcgtgttttatcatgtatcaccatgcatgtattgtgcatgtaccatcatcatgcatcattgtgcatcatcatgtctgtatcattaatcacctcatgcatatattataatgtgtcacctcatgcgtgtattatcatgtatcaccatgcatgtattgtgcatgtaccatcatcatgcatcattaggcatcattgtgcatgtatcatcacctcatgcatgtattatgtatcacctcatgcatgtatcatgcatgtaccatcatcatgtatcattatgcatcattgtgcatgtatcactgtgtatcatgcatgtgtcatcatgcatcgccccatgcgtgtatcatttctttgtggtgagaacactcagaagcctctcatctcgctatcttgtcatatatgctattttattgttaaccaaagtcagcctattgtgcagtagaacaatctctcctcatcccctgtcctcatcctcccctcccaagcttccataaccactgtttactctctgctcctaggagatcaacttaaaattttgtgttatttttggatttcacatacaagaaatccatacaagagctccatatgagatcgctcagtacctgtttctctgtacctggcttatttcgcttaacatgatgtccaagctcatccatattgtcacagatgctgggatatcatttttttcatgggagaatggtattccattgtgtatctacaccacattttctttattcattctccgttgttgggcaccaagggcgattccataccttggtgattatgaacagtgctgcgataagtgtgggggtgccgatgtctcctcaacccatggatttcctgtcacctgggtctttacccagcaatgggttgctgagtcccatggtagttctatttgtgtttttttgaggaacctctctgctgttttcctgagtggctgtagagagctatagaactttaggtctgtgagagataagtcctccagtacacatgccattttcagaagggcaaactgtagcccaggaaggtcaggtgccttgaccaaggcaggcacagtgagaaagaggcagtgttaggaccgcaactgattttcctctccagtctcttttgtgaagattggatgctaaggtcatataggaagcactatggaatatgtaggaggtgctcagtctgttttgtgaagattgtatgccaaggtcatatgggaagcactatgcattatgtagtaggtgctgtgtgccatacattaagattacattgtaaatagcaggcactatgtattgtatattagcatgatgcactgggtcctgttgtctgggagcctggcacctggcagcttcaaagaacttacaaggtccacaggaaggaacctgggacagcccagggagcatcactgaaagaattggcctggaacagaagccccacagctcacctggggggagcagggggaggataggggtgaggagggagaggaccaggggagcagcgggaggaccaggggtgcaggacgagcactgggggtgcacgggagagcagggtgcaaggaccttgctggctgagaagacagcgggaatggcgggtcctgggagaggggaggaggggaggcaggccaccagccaccctgacttcagccaggagacccatttcagaggctcaaagggtggagatggtgcagccatagtgggaagctgagccccatgctggatgctcagattgagggggctcctgaggggctgcgttcctctctccaggggccgtgggacggtggctgctcatctcacaggtatttattgggtttttcaccacctgccaggactttgctgcccacgtcacacatttcatgtaacctgtaggtgtagaggcctcattttcagacaaagatgaactaagaaagtgtcttctcggaggtcacggctggagccagatggtcaggctcaggctggggctggcttccctcgatgtgatgcacggctcccatgtcacgtttccctgactatcaggagctcccagaggccaaggatggggtggccgcctggacaattcagacctaaggaagggctcctggcctcttccctgagagcctctaagctgactgctctcttcctgctcagcagctcatgatccccggtggcttccttgagctgggacttgactgaaacccctgggactggccctccagccaccctgacttcagggggtcgaggtgctcactgggccagtgctcaggaggctccgtgccagctggaacaccgggaaaccctctatctgaatctttgacccagggaggagcctggagaggtgacgtcccggcaggcctctcccgcaaaacccagaatcagaagtggccacaccaggtccggcacccacggcagcagcaggagccatttctgggacaactttggggatatacttgtccttccaagtgaaaggagcttaaaaagacccctgagcaggagagaaaaagtatcttcaaagagaactcccttcatcttgaagaaagtgtctgcgctagcctcttggccattgcgccgcagtagaatcttaggctccgtcactcctgtgacttaattcaattggcatcggtattttgaaaataatgatttttcctaattgtaaatgtgaaatgtattatagaaacgtcgtccacaagcctctcactcagagagagacaccgataactgtttctttccatggagtacattccaccgtcccgttttcccaccacaccgcgtggcctgacgctttcctctgtcatgaacggctctgatacaacgtgagatgaaattccatctcagacatgcactgtgatcactcacccctcactcctcaatgcctgtgtgtcattgagcacctcacctgtgctatatatttctctttagggtcacaaaagaattgctctgtaatctctgtgggcaaggagatttctcccgagtttgattggtttttctgttttcttaggatagaaatttttctagcagtcattggtctattgaaaacacaaataagcttcacttcatacactagaaaacttcataatataaggtttatatttgccatgagaggaaacaaaatgttgtcttaaatgcattcacgtaccctaagaaaaatggtatgaaacggtcaaggaaaagttccttctgatagtaaaaaattcacccccttattaaaccaacaatgaagttgcactagattagagtttagttccgaaactctgtgcttttagatatttggtccgttaggatttcctggtggggggcacacgcgcgtaagtctcttgatggtggggctctggttctctggccgagaccacagatgtgtctccaggcaggtacttcctctgcaagtgtctgatgaccacagtgaggtgggtgtgttgataataatctactgtcatagacaccttaccttattaatactgctaaaccaggaagggcacaattgatattctcaggttttttaatcctttaagaagaaaagataattaaaaaaatcttttcactcaagaagcatacgatagaatatggtgatacagacaaagggtaggcccactgattcgaaaattacagattgaatccctgagacaaatatctcccctgctttcaggtagattactgtctacaggtgggataaccat

SEQ ID NO: 65 - DNA, 2542 bp, Homo Sapiens
ccctgtggtcaggttttctactctacacacagtgatatgctacccccggctctatccattgttgctgtataggaatgctggctcggtgtcacaagattttctgatttttcaagagaagatataaggcagatgctgcaaggacctggtaagtggggcacaaagccatgcaaatccatctgaagtcagttcatttcagagataccaccagcttctgatggtgttacaccctggaaatggcagtccagctctagcttctggaaggcaactggcaagaggtaaggaagagatggtgggaaggtagcccctctccttgttggggaggagctttcatcttattccagttctcagcagtagaagctatgcctggagacttccaggtgtctcctgtcctggttcctgccttgttctttctcttttccctcatcctcatttatgttttcactcctccttctccaatattccagaatattcattcatccattcaatgaataggcatttattgaccacctcctttgtgccaattgctgttcttgatgctgtggtaacagcaagaacaggactgaacccatcccaatttccatctgagctacttctagtagaggctggcaaataacaaacaagtaaataaaatgaaaagcataatttgggagagtgagaagtgctcccaagggcagacagaatggagaggggagcaaagaaagggaaggagggtggaggagaaagggcccagcctcttagtgcctgactagccctttgctgtgaaggctcacctttcacgcttggcttctccctgaagctgggagctacttcaggcaggagccatatttgattcagctgtgtccaaggtcagacgcaaagcttccccaaacgctgttgggcagcagattataccacagtgtcttgaaatacctgcatggtgtctatgtgagcaagacctgctgcctccaagtgtcctgtcggttgtgttaatcacgtgcatgggaggtgaggggtggtatgtacttggagggggagcccatagcgaagggcaggggagagagatattgaagggatatatgcacttcccttgataggccccttgcaattgagtaggggcaaatattaatacattctgagtgctcactgtgtgcctggctgagagccaaatgcattccttgcatcttcttatcatctcatagcaaccctatattgaagatgatgttcttattcctgtcttttaatgaggttactggatgataaatatattaattgaccacttagcagatggaaactattgaaagcctaacccaaactgccagggttaaaatcctggctgtttctcttatgagttgggtaaccttaggcaagatgcccttcttctctttggtgcttctattttctcctctgtaaaatggagacattgctatgaaggtgaaataagttaatagatagaaaatgctcagaactgtattttacagtatcccagcagtccagttcatttttttaatttattttattatttatttatttatttattttgagagtgtctcgctctgtcacccatgctggagtacagtggcccaatctcggctcactgtaacctctgcctcccgggttcaagcgattctcgtgtgcataaattgggactctctgaaatatgtgggtttgagatttaaaagcacatgactatgtttttaaatgttcaaagcatcataattgtagcgcttacaaaccattgagtctatttctctcattttaagcataagaaaacagccgaagattagattttgataatgagagagcccaacgatcctggacccctggccgggaggacaataggggaaacaggtgaaacactgtgtgagctggaccacccaggctctccaacaccaggacaccagagcatccttcctccttcttctcttctgctgcgacttcctggaggcatagcagagttacaactgctggccatgtggaacttctcttctcctataagtttgctctgagatggagagattgtgcctgtggttcattaggaagagctcttgggatcaatgcctgtaataaggaagggaaggaatcaggattggccagaaggagaagttgagctgtgttgaagcctcaatggagacctcagccaattctgagtcatgttggaggtaagccctggtgggaggtgttcgggtcgtgggagcagatccctcatgaatggcttgggccatcctcttggtgatgagggaacactcactctgagtgttcacaagatctggtggtttaaacgtgtatggcacctctccccacccccactctttcttgttcctgcttttgccatgggactcgcatgatccctttgccttctgccaggactaaaagctccctggagcctcctcagaagctgagcgatgttggcgccatgcttctggtacagcctgcagaaccatgagccaattcaacctcctttctttataaattacccagtctcaggtatttctttatggcaatacaagaacaccaggggtttgcaggtaacccgggcccctgtccttgaggacacagcagcaag

SEQ ID NO: 66 - DNA, 1947 bp, Homo Sapiens
cagagagacaacagatttacatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagaccccaggctccagaagcagatgaggagacaaacagaagagcagaagaatggcagaatggcacagcagagagaagaaaaggaacatctgaatgttgagaggaatttggctgggggcggttggagaggagattagccactggacagccaaactccaggggaagatcatcttcccactccatcccccttccagctccccatccatcctgctgagagccacctccaccactcagtgaaaccgctgcattcatccttcaagtttatgtgtgacctgattcttcctggacattggacaaagacctaggtccagtgaactgtctaacacttaagtcatccacggacagcaaggctaacagaacgctgtaacatgtgcccacttggactctgggagttgcagacacccacccataggtgctgccatgggtccggagcccaaaaagtgcttgccctggctcctgcacctgcccgtctgcatgctccccctccggtaaggggtttgaggatgtggcggctgaacataagagctatgcccctgtcacacatcatgggacaggggtcagggaactctcccatttcactttcaaatattccaggtcccctttttgttcgggagccagagtctaatggagacagagatagaaaccctgaaataggatccaggcaatataaacctacacgctgtaagccaagtcagagtgaggctgatgtgataacaaaagtctgaatacaaggtgggagacaattattctgactgaaagggaggcaagagttctgccataggcttgatgctgtgtgcccctggcttcctaactcatttgcaaatggaaaatactattccattgtaggaaccttctttttccatgtgtctggggaaggagaaagaatggctgggctgaatgaatttatcccttggtcctcttccaacaaagctcagctatgaaagataaatccagctctccccaccccctctcagtggagctggggagaaatcaaaagcccctctgccaataatgagaccaaagtttgcaagggcaggacgagcccgtgctaacagagaaagtgttgtttcctcaatttggttttagactgtcttgtcctatgggggagaaaagatctgcccttgggagaggtgccaactttatagatctattaataaaagaactggcaggcttacagttcttgccaatgaggaaacttgaatgagagaagccaggctcaaccttggccaacagactggagcccatcaccctaacttcaccccgcttctccttacccaaccgtcaaaggctaggcagcacccacccagcagcttccacctggctgaagcctgcacctgcttcagaccaagggttagatggaaatttggcatgggaagagagggctcacctgtgggcaggatagactctatccaagaaggagaactgaaaaatgaaaacctatgagacaaggggtgatcctgaaggcaggcaggagaaagggctggagggagaggcactggggaatttttcctggtgaatactgaagttactagatgttttgtcttgcaaaactcaagggaaaactctcaaactctaatgtttgtctattctgtgtccaaactgtccttttgaaacggacccacctttcagtaaagaaacttgcattggcctgccc

SEQ ID NO: 67 - DNA, 1096 bp, Homo Sapiens
ataaatatttgttgaaagaacatttgttcaagaatgcatcattagaatgcattcattttcagccaggcgccatggctcacgcctgtaatcccagcactttgggaggccagggctggtggatcacctgaggtcaggagctcaagaccagcctggccaacatggcaaaaccctgtctcttctaaaaatacaaaaattagccaagtgtggtggtgcacacccgtaatctcagctactcaggaagcagagggtgcagtgagccgagatcacaccactgcactccagactgggcaacagagtgagactccaactcaaaaaaaaaaaaaaaaagtcttcattttgaaaacacatgacatgactttaaaagtgaaagctaccgaaattctgactgggaaacaatgatatcaagctaaaggtggtcaaagaagagctgggacgagcccattgaaaaatactcctatttaaacaagaaagaaaggtacattttggacaggagaacagtatgacactgtaatgaaaagtaaaaataaagtatgcctaaaaaaactataattatatcagactggagacatgggctcagagaaatgtgcacagcggtaaacctgttacgttgaagccgtattaccaagatttccagagaacatgtcaagatgcaactgaaatatatcagactgagacagaagtgacatgacttccaatctgaagttgtgaattaggtaataaaatgatctaatttttccttttaaaagatcaccataggcggctctgtaaagcacagacaatgcagagcaagaatggaagctagatgactagttagaaggcaagaacagaaaacaaacagtggcttgatctatggtaactattctggaggtaagtggttagattgggatatattaacaaggcagagatttgctgaaatgaaggggaagaagcaaagataaatctcatttggccttgccaagtgaataaatggtcgtgtcaccactaaaaggaggatgggaacgcaagtagaaatgaaaagttccattcataacatccactgcacaactggctatacccttcatgtggaaacaataatgaacattttttcctgacttat

SEQ ID NO: 68 - DNA, 1984 bp, Homo Sapiens
actgccaccttgacgagttccacttaggaacagccagagcagcccctgtcagcatcaggaaaagcccagtgggggtatgtgccccccttttcctggagtgtctccaaagggaccccagctgaagtggaagggaggagggctggcttttctcgtggccttggcgagcagggcgtggtgcagtgtcgtgagaacactttcaggacctgccgcccagcttgggtctctccagctgtgatgcaaggaccctggagccctcagcccacatattcacagcttctccatgacctcaggcctcagttttcccgacccaccaggctcctgtgagggtggaagagccggaaggaggtgggatggccgctccacaaatctgagttggcctggggttgtcgtgagaacagggtatatggcccctactgacaccacccccagtaggtcaggcctggcactctcgacaccccagtggcccgggcctttcaccacactcttctgggggggattggggaggactctgctaccagtgactcacaccctgtggggcatggggtaattatgaccctgagaagcacccacactctttctggctaggccagagcctacagattctgtgggtacaccccagcaaggccagagcctggtagagaggagcaagggtggcaggaggaggggaacctgctcacccctctgcttcatgctctcagggctgcctgcaggcctggctgccttcctcatcctcgccgctgtcacgccctcccacctgccttctcccatcccctgcttctggccttctactgacccgcactggggtgggcaggacaccgcctgcatgtgtcctcatttatccacatccatcaaccgtagatgggggtgccttttacagatgaggacagggaggctgtgagaggggacttaactgtgcagggtcaccttcagcatgacagcgagtggagcagaggttcagactaccactgtccgcccagctcctgatgccaccctgtcctctgaaggcctggcctcttcctgccttttcgtcctctctccagctctccgacctccacactgactgtccctgtgactttggacaagccccatccccgctctgtgcctcagtttccttatttgcaaaatggagaagtgggaccaggaccagactggggatgtccacactgtttctgtagctgtggagagattcagtgtccaacagatcccagagccaaggcccctcctcagccctgacagctgctgggttcagtgtcctttgcattagtgcctggtcctgagaaggagagacagccggcaggtggaggcagcctggggccaggctcacctcagctgtctccagccctgtcgtcttgatgaggccctgggcttccacctcccaggatccttgggtcacggccaccctcatacttagtgcatgtgtggcctccagttacctgccattgttagaatgtttttagcaggataataaagcactgggaaaaagcccactgcaccatctaaacgaggacctgtctctgcatagtaatggcagcagcaatggtggccgggatgttgaggttgatggaggtggagggagctggtgatgatgacagtttctaacaactgtgcagggcaaatgttcacaaagtcatgccgagcctctcctcatttccattctcctgccaccattgatggaagcagcgggtgtgctgttcccattttgcagatgaggaaacagacagactgagttccattcaacaaagagttcccagctctggctcagtcccaggcccactctgggtggtgatgcagctcattaaaatttatctttttgtggatcctgaggatatttggaagtcagcagagagggagacaaggccacacacagccacagagtcacagaggacgggctgagatcggggcagaagggctcattctgggagcactgagatccgagtgcatccactggctttggggctggcaactgggcaaggcgaccgctcag

SEQ ID NO: 69 - DNA, 939 bp, Homo Sapiens
aacttggtccagttcaatcaagccatcaacagccaggtggctttagtggccactatgcatattaccccatgcctaaaggttctggtacaagagcttctctataagttgcacattgccatagtggaagacggcatgggagatttggtggcaaacacttacggtgcaataatagctgtttttcctatatcatgacaatatgtggcacacttctagactcatttcatgccaaagaagttcctcagaagggtaaggaaatggagaatcttacatggtccaatgcagtccccaagaagtaattttgaatggacagttacactggttactacaatgctgtctctgaccttctcaggatcgaagataatcatgagtatcaaggtggagatgggtctaggcgagagaaaaggaagtagtggttcttgagaagaattgtatggccaagataagcttgaactatctctcctcttccagttcctgcaacttcttattgcctgattgaggtcattaccctatggtggtaatgacatcagcaatgtaataaattctctcgtggctttgtatctggtttataacatgggaaatgtttcctcaagagtggtgatgccagtatggcttctgctctctggtggtgttggaatctgcattagtctgtgggtttggaggagagtgattcaggccatggggaagaatctgacactgtaacaccctctcgtgccttcggtactggactggctcctgccccctcactatggtgattgcatcaaatatcggcctccccatcagtacaacacgttgtaacatgggctcctttgtacctggctttaatccaagaaagttgttgacttgactctttcgtgatattgtatagcctggtttgtcacagtctttatttctggaattgtcagtgctgccatcttggctgtcttcaagtatgtcatcctc

SEQ ID NO: 70 - DNA, 1850 bp, Homo Sapiens
aaaccaaacaccacatgttctcactcataagtgggagttgaacaatgagaacacatggaaaagggaggggaacatcacataccggggcctgtccgggggtgggggctaggggagggataacattacatgtatacctatgtaacaaacccgcatgttctgcacatgtaccccagaacttaaagtataatttaaaaaaagaagtatttccagaatctcatataaaaaaagaaaattaaaaatgcagtttatttatgtaaaagatcagtggaacttaaagataatcactgagtgacttacagtaaaaattaaaaaatgaaaaagactagtgtactacaaaagagactatctgaaaaaaaagaaatatcacagaatatcaaaaacttgaatgggaacaagaactctgcagtttgagatttctgatagtcatgaaaaagaagaagacctgttgcataaaaaccatttgatgcaagatgaaattgccaggctcaggctggaaatacacacaataaaaaatcaaatcctggaaaagaaatacttaaaagacattgaaattataaaaagaaagcatgaagaccttcaaaaggctctaaaacagaatggggaaaaatcaacaaaaacgatagcccattatagtggacagcttactgctctgacagatgagaacacaatgctccgttctaaactggagaaggaaaaacaaagcaggcaaagactgacgaaatggaatcataccatcgtagactgaatgttgctctacatgatcatgatcaaagtcactcaacagaaagagaccaagagcttgatttccagggcacagtagataaattgcgtcatttacaggaaaatttgaattctcatgttctgattctttctcagcaactttctaaagctgagagtaagtccaggtgcctcaaaactgagctccataacacaagagaggctctgaaagaaaacgctttggtttttgaacacatacaaagagagctaaaccaaacggtgtcaaatgaaggacattgaaaaaatgtacacaagtggccaagataaagtagaaaaatgcacagaaaagcaagtaagattatgtcaactacgaagacaaaatatgttgcttcaacagcaactggatgatgttcacaacaaagctgacaatcaagaaaaaacagtaattgatagtcaagccaaatgtgatgctacagcacaaaatcttcaagctgagtgcataaagcaccgtcttttgctagaagaacaagaggatgatcaataaagttaatcatttgaaagaaaaacaatgtcaatatgaaagagagaaagcagaaagagaagtagttgtgagacaacttcaacaaaaacagggtgacgtcctaaacaatcaacaacaaaagctttgctggatgcttcattgcgtcactgcgtccattgagaaagtgagatgtaggattcaaggaagaaattaggtcagatgagaattcaatttcaagaaaaatggaatcaacttacagcgactataaaatgtactaaggagacgcaaggccacgtacaaaaacttgaaatagaaaattctagtgttaagaaatacaattaaaaagcaagatggccaaattgagcagcttcagaaaatcctgcgaagttcaagtttgatgcagcagttattgcaagaaaatgaaactacagaaatagatgaagcttcttctgaatttaaatctggatcctctgtagcagaggttcccaacctacaggccatggacaggtccatgacctgttaggaaccagctgcacagcaggagagttactgtggatcttctagatcatctgcatgccatgtgaatcttaaaaccagtttttaatttctacaa

SEQ ID NO: 71 - DNA, 5489 bp, Homo Sapiens
agaagcggactcaaaggccggagtctaagggcctacctaagggtaggggagtgggaagaagaccagggccgtcgttattaggccacacaggcctggcactgagggaaaaaggggaatttcccgaggggagtcctgtggggatggggaaatctttggaggaatccagttattcgagaaggacttccccaccccacctgcctccttcagccatcccaagcagcagctagaacttctgtagttcttcctctgagtgccccgagcctgctgtctgccagaaagactcctagactagaggattggacagtagggtcaaaaccctaacccttggttgaccaccggccttccctatcaggacgccccattacctcccttttcctcctgcttcccctgaaagaggagtctcagcagttatttacaaagatttattacagcacgggaggggttcaggcctggagtcagggaagaaggggaaaggggcagagcagctgggggacaaggaaaacctggcgccccccgctgtgtgccccaccggggacataaactaggcggcattcctggcatcaaagcacaaaacgcaacaaagaggtctctgccagtccatcttccaggcacccaggaggagcaagggtgattaagggaagattcccaaaatgttgaggctatggagaaaaacgccttagtcctggaccctggtagaagccggtgagagaagtggtgacttggaatcctccataggaaagtgggtagaaaaggatctaagggtacctcaaggttctcaggacctcctttccccagatcttagggtcctgccctgtgggtctcctgtgtccaggggagaggatctggggagtagaattgtgaagggcaaatccctgttcccggttttctggattttccaatgtgggctgtctcacatcccacctcccgctgggtgaatggaggaatgactggcaggggtgggcatcaggcagcaagtgcccaggttctctgggtatcagccaaaggtgggcaaacaagcaaacacagaccagccttagtcttctagaagtcagaagccgcagccctagcaggcgaggggaagagcacaaaacagggtgaggatagagtgggtttctggggaacagcgatgtcccctccacttcctcctgggagatgcaggctgggtgcctatgtgccaggctcagagggggaagggcgctgaggttcctccccaggctctgaaaggcaagcagagagggactcagggcctggccccacccaccaagatcccagcccctcctccccatttcacactcccaagccttaccacttagtgctgggtcttccacttggtcctcagagcctccatctctctcggactcatccagagggggtgggcgctcccagggcccttccagaccctggccacaggttgtcttttgcccagctggggatgggaaagaagagataagaacacaggctctgcgtatccatccggctgtcctggagtgtgagctaagtgtctgatggctgaggttaagctttccaggggcatcatggaagcatggagagagaactgggctagaacagctctcccagcaactagccatatggcttacgtaagtcagttagtacctttctgaaggaaatagaaagggggaaattgtgtagattaccttaaacaagatgtaatagtgaataccctgcccagcccagcgccagcacccaggagccactaggagtcgtggtggtttatattgctccatcataggactatcatttgacccggtgcccttctgcattttttgtttgtttgtttttttttgttgttttgttttggttttttgtttttgtttttgagatggagtctcactctgttgcccaggctggagtgcagtggtgcgatctcagctcactgcaacttccacctcccaggttcaggggattcttctgcctcagcctcccaagcagctgggattacaggtgtgtgccactgtgcctggctaatttttgtatttttattacagatggggtttcaccatgttggctggactggtcttgaactccagacctcaagtgatccgctagccttggcatcccaaagtgctggaattacaggcatgagccaccgcacccagccacctgctgcttttcctgagggaacagtctcctctcacccctcttccactgttttggaggggtctcagtgaggactgattcaggtcttccagctgtctcttgcccacaaagggactgaagcccagcaacagcttttgcccccatggccaatctcttcactgccagatatgcaggcaggaggcccaaggccttttgtttgtgtggaagagctgacagcttctagtaggggtggttgactcttcagtattcccataaataatgagactaaaaaggttaatgggccgggctggttcttgaattttaaattctacatctaaacactagagggcaccctcccactccatcctaggaaggaaaaagaggagaaacagacaacagtcctggagagggcaagtaaatgaggcagccctctgcaccccagcagagaccacatcctaggttcaaaaatgtaggtgaaatgcaggtgacaggggtgttggactctcctggtcctccatccctgaatgtcctcacgcccccttactgccataggtgggaagtcctcttttggctctagcctcaaaccccaaacggccttggccttaattctcagggaagagaggaattattagggaaaacctgattgggagagggactgagccaaggatggaggaaacccatgtctcaggtagggctgagttcggggcaccccatggagcgagaagacagggaggcccctgtggtgtcactacagtttgcgtgtatgagacactgaactagaaggggacgtcctcgtatactcaaggaggacccacagctaatccacatgtcacaggcccctcagcttaccagactgcctgatgaccttcaggacttcagcctggctgtcctcttcttcttcctcttcttcatcatcctcctcttcctcctcatcttcctctcttggataacccagctcccgaagctcccccagctcatcctcctcctctgaggcctggttctcattcaaattgctgatagactgcaggtgagactcagcaatgcgctgcacagctggcacagaggagaccgaggaaagcaagggtcagctagacacagcccatggatctggagatagcctgtggcctagcccccagcctccttcccgtaggcctggggcagagaataccccctcaggggcccaagttcaaaggccaaagttgacaggtcagcctgatgggtgtcagaccagggcagaggcagccaggggtagatttgatcatgtttggctcttaagctgtcctaagatgctagcccccaggcagctcccccacaccatagggcactaggctgggcaagaccaggcgggcacagcagcagcttaacattccctggctggagagcttgattttccaagtacccagtacgggagacagtgtctcccagcttcaagcccaggcagaaggcacagggcgtaggaaccagggcctggggatttgccactttccatttcttgggggtgcccagcctgctgagggctcactgcttaccctgatcctacctcccatgcgatgcatagtccccactccctggcactgcccagtcatagatgccaatccacatactcctgccccgggctccaagggacagaacaattccgaggctgaggacataatagtctgcagccagtgcagtctgtgccgggggatgcggcatgctcagatgcggcccccacaatcttgacccacatccccaggttcccagctccctctgcggtgacctagaaagcaacccccccagcctccaaagacctgctcagatagggctgggaagggaacagtgtgggcagctggagacaagtttccaaaagatggaaaggagcaaggggttagagaaaggggccaaggccaggggttctgggggatggcagaggttgaggggccactgaggagaggctgcaggagctggcaggatcttagaacatatgcgacacaaagttcacaggccacagacaagatgctgaggaggggctgggggtggggaatggggagttgctgcagttccttcttggtctgccagtggcccctcccctcagaaggcccagaggggtagggccaggctggaaacctccggcacagtgagcagggtgctatgctcctgccaactcggggacaggcacagagggtgctttgtatgtgcccgctgccccacccagcccccagctcccagcccagtacctcctgctggctctgggcaagctatccaggcaataaaagcacaataaatcaccctaccctgaccttggggacgcggcagagcttcatcttgagccaagtgtgagagctccagccttggagcacaacccctcaagctaagacttagtgctgtgcccctctctctagggccctcgattcttccctgacaagccccaaccctgccgggcaccttcccttgcccacaaaaggactgaagcctacaaaacagtgccctcctggtagagaaggatccatgagggctgtggggggaggtaaggcaggagagcaggtggcagcccaggcagcttccttctcccccagcgggggaggagagttcacttcgtgagccacagtgacaacagaaggtgtgtgcggtgcttgcgctggtgccccgtgagcctccctcgcttcccccacctccctcatgcctcctgggctctctggggtctccccatcactccttccaggctgtctccttctctgccccactctgtggggccccaaactccccccaccacaagtcttccttcttcagttggaaggtccccagccttgccccagactggccacccctctcctgatccctttcctcttccctgcctctactcacctggactctcctaagatgtggcctaaaggggcagttgagggggtgcacaattttgaccactgcacggtgcatggtagcaccctggccctaacatcttcatcctggcctgttcgcccatgcttgcagtcaagagccaggtcttcccctcacatccacccagcctctccctacccagcccaaggtgggagggagagggatttcttaaattctctcctgagaagatgacactctgtccctcatgcctgctttggggcccttccacacacccctctaggtggggaggtccttccaggtgctgagccacactgcccacttgctgcagctctgacccttcattttcctgtcctggggaaagcaaaataaccccttcccttctctcctcccttcccagcctctcctctctgttcccaaccctggcaagtgggctgacaggtatacctgttgaccttggctggtgctgggaacttattaaaccctcccccgaaccacttcccagcatactcttccggtagctctccctcccaacctccgcaggagcggagggggct

SEQ ID NO: 72 - DNA, 15399 bp, Homo Sapiens
gtaggttctttaagcattgacgagctaaagaccattttaaattctaagcctagggaagcttacaatggaactaatcagatgtttttatgtcggtttgttccgagacagtggaagactggaggtcatgtgcttgtgtctaatgtttagcaaaatcttagtgaaacgagggcgataggaatgggggctggggaagacttagatgggataaaaagaggtgcggctggaagaactaaatcactttaaaacttctgaaaataaatgttgaccattgtagtcagaggagtaaaatgttcagagaaatggggatgattaaacaagaacggcaagccagattgagtcagaaaattatcttcctgccagaaattctgtctcccacaacggcatcagggggtggttacttgcccagggtgtagtcagtttttaaaaagcttaagggttaccaacatattcctaaatttcctgaatttgctgtgattccaggattcatttaaactcttgagactgttttactttcggcacgaaatcagctcatgggctttataaatgtagaacctactgcattatagttcttctttttgtttattctaaaactgttagtagcagccagcgtattatatgatttggattgggccatgaacaaccgtaacgagtgataaagcaccctttcctgttccaatgcaaagaacaactatgaaaagaaagtactggcaaatttatcatcttgtagttagttcctggccaaagaaaatggtaaggccattcttttaagcagttaaaaaaaaatggggatgggctcttaaactttggcatgctaaggccattcttttaagcagtttaaaaaaatggggatgggctcctaaactttgacatactaaagcagtcgtcatttaggtaaaatctaagtcttaatggaaatcgtgatttcatatctactgcagcgttagcaatcacataatgataacttaaatcagtaaatcgttgaactcggttctctaatctttgaagaatagaaatactttttatcccaaaagatgttttgagaattaaatttgcagagaattttttaggtctttagttgtaatttatagagctaggtcttttaactttagtggaaaccatgccctccaaacccaagtgactggagtcagaatgtgaaataagacgacataaaatccctatttcttaaggggctgggcgaaagtaatggaacaaaatgtaacgttatgctattgtggcagagatagctaatggaatgtttcatttctaagtctgtaatttcagtaattgttagaggcagttttccatcaataagttagatcaaatggttaaacccaatatgaatttataaaagcttaatttaattttggattgatttaccagatgtttaaggtggttataatgggtagtgttgatggtggtgcttttggaaaaatgagtattatatgcctgctcatccctttacattatcttatcatataaacttcttgattactcgttatgatactcttaaatcgtacatttagaggaaaaatcttaaagtaatctgtaagaccatttctccttaaaatgatatattatgagatgaaaggaaagataaagataatttagaagagatccagaagtggactaaatttctggtaaggagggggctaaagatgttaaaagacatcttaggaaaagcatatgatttataacttttaaaagtgtcatttagatggttaaggatttgtgtttaatagttctcttgaaaatattgttttccaaaagtttaaaagccctagctacttttatacatttgcccttaaaaaatgtacagaatttattacatcaaactgctacaaagaaataagaattctgatttttgcaagtaagttggaaatcaacgtagaggacaaaaagtggcatagctatatctaaacaaaaaagtatgtaattcaaaagttggtccacaaagaattgaaagcctttcaataactaatttaaatgatagaaagcagtatgtatatgcaagtacatatgctccctgtatagagagtggttagtaagtaagatggtagcctaactcactggaataaagagatccttggagtcccaaacctcaagactaggagtcttaatgcagttaccaggctgcatgcctgtacccagagaccatactagaggctgtgggaatcctcgattactgctcttagagcccccaacttgactgtttcttctgtacctggtacttttttcaaatatttcaaattgcagtgatgcatgggagatacatttagaaaacataatgcaggggaataaaagcagttaaaaactaaggacagtttctactgatgaaaataaaaaactgctacagcaacatcttttcatcatctgtaaacatcatacccccaaattttcctaagttattatctaacctcatcagtagcagatggtgaattatttcatagaaaatcctggaatgtaaactctagatactcaagaaaacctcttttttttcaatgaaggtatattatatttaaaataataatgatgcattaaacattatgggataaagaaaatactttccatagaaattaagcaatggcctaggcaaagagaagtaaccctttagcattaatactatcagttagacagtgacatttattgaacattccctgtgttgtgtattaagaattggactacctatatcccagtcaacaattttttctggagtttagaaatagtttatgcttattttctgtgttttttattaccaaattgttattagtttggtgcaaaagtaattgtggtttttgtcacttacatgatggcaaaaactgcaattacttttgcaccaacctaatagaaaaatacaaaatggagaatagttttcaggttccacaaagcatttgctggaaataaatatcagttgtctaaataagtagtacttgatttattactatgattttcgtagggttccatttctggaacaatatcatattaataaaccctttcagtgagaccattgtgtggtattgcccaaaaaggaaaaaaaaatgtaatgagaaaggactaaggctaataaaattccataaatactattataaagaaaagtataatttgactgagatgcacaaatgcttacttgataatgaggtgtttttaaggaaacttctattaaatactctttttgagtttaatatactatgaaacaatgttgtcttttttttttttttaatgaagatttccttgacttccaaagacctttgatgttcaagcaaaatgtagcaatttggtaaaagtaaagggtgcatttcgaactgaaataaacataatgtcctattaagacctgtattatattttatggaatttaacttagaatgtaagatattagctctgcggttttacaagcttgtttaaattctgcaatgtagggcaacagaaaatccaaacaaaatccattaatgactatattacttctttatttttctttttaaatattatatgtggccagtcaggatgaagttttttttaaactacatttcctagttggacagatcaagagtaagctccagttttgctataatctcgttttgtgattgctgacaagtctattactccctcagttcccctatcactaaaaagaaataacattgtggtaaagaggtgttaaactaccaaatccactgaaaaagtatggaaaaaggtcacagatgtggcagctttggcatcttcagaagaaaagatagcaactcaatgtgatactattggcaataccatttgttaattgaaaaaagaagaagaaagcagttactagacatccatgattttatggagaagccatattctgtcatagatgagctatttacagacattcaatggcacattctttgacaaagtgaatcatcactgtctagtctttcttgtatatgaatttgaagtattgattaaagttgtagcatacctgtaattttaaactgtaaaactctaacactcacaaaagaacattgaaagactgcaaatttctagacttggaggttataattccttctgtatgttactactatcagcttataaaattttaaaaaatgtgagtgtagaaacttatataaactgtattcacacatgaaggatagcctaaatgctccggactgataatctgaaggtcattctcacctggctgattgaactacttttattcatagaagccaaagttttgaaaggtacagatagaatcttgactaccttgcattcgcagttacgttttaattgcaaaataacaagctctttagtcactggaaacaaaacacttttagcatttaactttataatacttgaaatcctaccttgaaagcattcatactcattaaaagctcaacacatgatccatgtttacataaggatttgggtgttgcttaaaatgatcatgtaatgagctgcttctctgcaaattaatattcactcccttccctcatccttaatgtgggatctttgaaggaaaaggaagtgaccaaactaaagacatagggaaatgcaaaatcaaggtgaaaagttacccagagggttgttttaattttggccatcaaccccctagtgaataatggtaacagtattgttttgagacccattttgtggcatttacctattgttaaactaaattgactagatgtaaatatattttcatcttcagatatttagaatttctatccttccccattgtttctggattttgatactaatcttttttctttgcatattgtatatatttactcaacaactaatctaattttagatttttagcttatccacatttcatttttgtttatttcattggtatttcatcaatacaatggctctacccttcaaggaaaaaaaacatcagcccgtcccacaaaaacacatatattcaagaaagataaattacattgtgatgattcaatcatagtaagtattcaccactgaatttctttaagaataactactgtgttcaaaataatttttgtactaatatttcatttgagatattttatttctgtggaataaaaagatttatcatagtaacatcaagcttgtatcttgaacaaacagctccaaatataataatacaagctctacttcatgcattcaacatgtatttagaaacctggctgggcacagtggcttacacctgtaatcccagcactttgggaggccgaggtgggcagatcacttgaggtcaggagtttgaaaccaccctggtcaacatggtgaaaccctgtctctactaaaaatacaaaaattagctgggcatgttggcaggcgcctgtaatctcagctacttgggggactgaggcacgaaaatcacttgaacctgggaggcagagattgcagtgagccaagatcacaccactgcactccagtctgggtgacagaacaagactctgtaagaaacctactgtgttgacctctttgttggacttggggaaaatagttgtgaaccagaaaagaaaagcaaagtccttgttcaaataggtcttatattttagtaggggaaacaaccaccaaagaaataagcaaaaaaatataatttcaaatattcataagtgttaagaaaaaaatgaaacaataatgcaaggtgggaaaggagacagtgtaccttactcagatgtactgtaggtaggcctgaggaaatgttctttgagctaaggacaagctcatcaggggagcatttgattaagggagacagatgaggcaatggctttgtgctggaaaccagtatgtggttggaagggagcagggggcatctgagtagtaggcaagggctagatcatatggacattgttggccacgtaaaggcacagatattttattttaaatgcattgagaagccacaggcaggttataagcagaggattaacatgatctgatttacatttacaaggaaacctttttaaaaaatcttaacctctaatagtttataatatattgtgtattatgtttagagagatttaaaaataacttatatgatcaaagacaagtttctttttgtagggctgtactatttgtgtgatatcaaaatggaagaaatatttaacaatctatatggcatttcttacagagacttaataactttgttgcaaaatgactaaatctttgtaagagagaaatctttttctccatgaaaccttaactttaatttaagggcagtgattttgatatttaagagaagcttgaaatgccccacttaaaaaaaaaacaactctggacaacagtgaaaaagaagtctttttgtttaaatgtaattattaaataagtgtgacaaaaatagagctaattttagggatgctcagggctgagactgcttttcttcagtggataaaaatatccataggcaaatctagggacactttaaataattcaagtagtcataaaagggtctcagaggaggggacctcttctggaagaggtaggtggaaaggccatgcattttgatattggtggattgcttttcatttagaaactactttgttttccttatccagtacaattgaacagtagatgatttctactctgtttcacgggctatttctttattagcaaggttacactcttgagcacctgtggggacaactggcctgggcactttcttcgtatctgcctttatcttctctcaactcaggcctgtatgtacaaaggttaaatttgttcctactcagttaaaatctaaaggaaggccaccataggccattactttctctagagcacgcaaaggtaatctgttttcctagttgaacatgggagaagaaacacctagatgttttataccataggctccaatgtaaatgtgaataggtgatataaattccaagcaaaaagaagaaagtttgcttatcttatccaatacttttgaaatatattactatttgatggcatttggcattttataagatatgataaaaacttaagactaaaaaaagaaggccagatgcggtggctcatgcctgtaatcccagcactttgggaggctgaggtaggcggatcacctgaggtcaggagttcgagaccagcctggccaacatggtgaaaccctgtctctgctaaaaataccaaaacttagctgggcatggtggcgggcacctgtaatctcaggtacatggcaggctgaggcagaagaatcgcttgaacttgggaggcagaggttgcagtgagacaagattgtgccattgcactccagcctgggcaacaagagagaaactccatctcaataaaaaaaaaaggatagcatgccaaagttattgcgtaaattctttaaaaggggtacacatgtgctcgtgttgcatttttgttaaatatcatcctaaaacttagattattttacaacttaattataaagcttacgaatcctgatcatattgctttaaaatagcaccttgttatgggtagaaaaatattacccaaactttatagcccaccttattaatgaactttgcttctagttgacttattttatttatttatttatttatttattttggtgacagagttttgctctgtctcccaggccggagtgcagtggcgcgatctcagctcactgcaacctctgccttctgggttcaagggattctcttgcctcagcctcccgagtagctgggattacaggcacatgccaccatacctgactaattttttgtatttttagtagagacagggtttcaccatttcggctagtctggtctcaaactcctgaccttctagttgacttctgttttcaaaagtcaaaatcattttgaagatgaacatttgtcatttgttgaaaatttttaaaaatgttaaatatgttagaatatcaagtaaaaaaaattaaaattatatcatgccttttaaaaattacatgtatgcatagtaaaagaatttgggagaaatacattggaactttaataatggctatctctaagggatgaggtaataggcttttttttttgctttatatatttttttcaaaatttctgcaatgatcacaaatcatttttatttaaatatattacttttatatatttaaaaaatgtacccacagactccagactaagccaaaaataactttgtaagggtgtattaacaacagccaagattatagttttagctgttgtgatagatgatagttcataaatgctatccaaagataaattgtcccttgggaatagtatatatttgaatgccctcaaagataatattagaaataattggtgccttttcagttgaatcaaactaatgcagagcaacttttaagagtcaatttatgaaatacaagaggattttagaacagaattacaaggacagaaaggacagaaaaataattaaaatattagaagcaaagttgaaagagagtgggacgtcaggaacttttgttctgttacagtctctgcagcattgtgtctagttgtgtgtccctgaacaggtcataatttcgatgggcctcagtttctttaactgtaaaataagagttgactgaacagatgactattttcagtgccaagactttatgaatctaaattccccaaacaaatttggattcttggttttacgtgcagcagtcaatatataaatgggtccagaagatgtctttgcttcagctttggtaacactcaagtgtgctggttattgcctgatttcctcttctctatcattttcctgctcttctctgcactcttgcattccaggaatgggatgttctggctctcattaccagggatccccttgtcttccctgggtttagccaatgagaactgctggcaggaggtcagagggtagtagaaaaaagaatttgggttatttctttccccctccctttgagctagcctgagattctggtggtgatggcattcctctacaactgcgtaccctgtcagatacccgcccatggctctaactttcactgggctgcttcagatccagctgtggtgatggcatcccaatgtactagcccctgaatgcctcagcattccttgtttggcctcttaactctgcccacatttctgtaattgttctttacattagtttgtactcaaaatctccttggaactgtgccttcagtttcctgctaggacaaggtgaatacatccaagtcatttctatttttctgattcctacaactttgctcaaattcattgtttcctgtcatactcagaataagagtcaagtcttaacaataacctacaagatttgtgctgtgctcaccctactccagccacaatgatctccttgctattcttatagcctaccaatgtaccctcctgcctcaggacttttgcacttactatagtttctccttattccctaagctgtttgcatggctaattcccttatcttcaggtcttggcccaaatgtcaccttttcagtgaggacttccctgactacactatttaaaacagcaagcctccacctcccatccctctttttgcttgatttttctctagcacacttataaccttctaatatactacattatttacttattttgtttgttgtctctcttcccatactgaagtggattattccaagagggagagggttttcatctgtcttgttcattcttatattctcagagtgaataatacagcctggcacatactggattctaagtaaatattatgtaaataaatgttccatttttacaacatgctacaacaattttattcaatatttatgaaagtaaagtaataaacatgctgaaaaacatggaacattggtaaagtgggaaattccctgcaatgacagatacttttggaacatgtcttttttttattgtttttgagatggagtttcgctcttgttgcccaggctggagtgcaatggtgtgatctcggctcaccacaacctccacctcccaggttcaagcgattctcctacctcagcctcccgagcagctgggattacaggcatgcaccaccacacctggctaatttttgtacttctggtagagatggggtttctccatgttggtcaggctggtctcgaactcccgacttcaggtgatctgcccacctccacctcccaaagtgctgggatcacaggtgtgagccaccgcgcctggccaaaacatgtcttttataaaggggataaaagagagatactattttacttacaagataaaagtttctttacctttttattgatgcattttatttgttgcaaaattttcagaaaatatgcaaggtatgtattggatcatatgttgaagtccttgagaaaataccttatttagtatttagaaagtataagattaaaatcttgatcaagagtacgcattactttgacactagctattcttaatcgtatttaattcaaggcacattgacatattttaaatatttggtataatggctaaaataacatttcctttgcatagaaaaatctaaaaaatatagacactgtaagggtaaaaacttcttatttagttttttaaatgtaggtctatagatatgtcactgtagtaacaaagtattaggaaaagctctattttgaattcatagagtctaaatgctattgattaataatgaatacttagattttttaaatgtcttttatagactcattgggctttgttttcttcatctgtttggtttggctgctctcatttacatacttgctctcattagggtttgaatttcagagctggcctcactctgcgatgagaacaaatgtcttgccatgtgatactaactttccattacatgctgaagcatttgcagtcccagaggcaaagaatttatggttggtacatgagagatagaaccatcacataaaagaagccaaatttgcaatcatatttttccttagtgctaatatagtttcgggataatgagaactcagaataatcagctaatgaccagaaatgaatcattattaaaacactgtttttctggcataaaatagctaatgtttctagttggttgataattttcttagcaaccatggtatttggcacgtcctaaaccacttttcactagaagccttcagaccccactgaagcagttcattatactctgaaacagttctgagaatcagggagaataatatacaagttttgctgatattctatagctgtatagccagtatcctgtagcaaatacttaaaatttcctacaagatttctcagtaattctccagccaagtaggaaattaagtagatgcagcagaagagattaaaaagtattggaagtcgatccccaagttagagtttggtcagaatttcaagcttgttttattgttttttaaaaagtaaataaacaagttgttttatactttaataatagggtcaccattaatataacatttacatggcatcatatttccaagggattctgtatatgtcccagcttcttgttattactgactatgctctgtgagattttttggcggcatgtattactttggttttggccagaaagtcaaaggaaaagagtattgagaatagcagccaataactatgaaaactcatcacagatttattcatatatctggtcataccctgcacacatatagcactgtatggttgtcaaactcttggcatgcatgatatcatttgatctttataaccctatatctgtgtgaccttgagcaaatcactcagcccatggctgtgactcctgtttggaagctgggtttaatagataccctctcctaagtctataggaatgcttcagaattaataatagagtagttcaatgcattgtgaactttgtaaaagaaaggtattattataaatgcaaaattattttattcacctagcttgggacactaaaatttagggagactaagtgagttggctctaagtgtttaaccacattggtcccaggaaacacacagaaccatggattaaaaggttgatgttttctagtttagataagaagcatgagattttatcataaagggcaaaatactgctcataagtagagaatattgttttctaaagaatataaccaaatattcattctgaaccatgaactcactaatttaatttaaatgtgtcaaacagtatgattttattagttattgatcaatattcaggctacatgtaacaatggatgacaaccagttttcttgaaaagatatccaatttggaggcaattaatcccagaattattatgaattacataaactgagaagataaattggtaatatttctgatcaaaataatattttccaaatacatatattttctgagtaatattgtataaacaataaagtggtcaaccttgtcactaatgtttcatatagctcacatattagaataaaacctacttaagaacatcagatatttgataagatgtgtcagtttcaattaagctaggttttgcaccagcctaataaataaagaacaataattcagaagctaggaaatgtaatttcattgaaagatggaaaggaataagtatctagcatgagccaggcagtgtggtaaatacattttaaatgtgactttatttaatctctacaacagctctgtaggataaacattattatctctaatttagagataaagaaatcgaaccttcaagagattgagggcttcctcaagagtttgtaaatcagagccatagttgacctggatctgagtgatacccaggtatatgttctctccattactccattttataatttaggaaccaccagatcagatgttcccaaatttgtgaagaggaactacattctggttttttgttttgttttgaaacctcatattggtggagggaggggccaggagaaagaggttgaacctgatgtggatgaatgtgaggataagggcccctgatagtgaggggctacaggcatgcgccagcagggccggctaattattttttttaaagctcttgtagagatgcagttcctcactttgttgtcccaggttggtctcaaactcctgggttcaagcaatcctcctgccttggctgcccaaaatgctgggattacaggtgtgaggttcttcacaggggaatgaagtgagcagaaagtagctgcttgccaagtgaaagaagcaatggaccaatataggctttgaggtgcacttgtaagctggtgtgttgggaactgccgacgtggttagatgatgctctctgatggtctttctgttatattaaggagtagagatttttaaatattagataattttatgtttctattgctaaattggggttgagggggatgttggtctgtcattctatttcacttcaaatgaagatgcatttttatctggaacgtatgtggaactgtcttggaatttgactctgccgggtcagattatgtccacacagcatacaagcaaattcccaggataccaggttgctgtttgaggttggctgctgctaattcctctcctagagaagaggacactctagttctagccccagctctgcaactggcagatcacctcagctctctgggcctctgttcttcctcctctgaaaaataaggaggctgaactagacaattcctaggcctcactttcagtccttctgttctgcagttccatgagaaacagaaagcacagcttatcctttaagccctctaaaaggcaaaaaaaaaaaaaaactaaaacaattatcttccatggtaaaactgtctgctatatacattttaatgttccaaaggattaaagtccatcaatcttgtagacttgttgggaaacaagtcggttggcattttcatagactttttatttcaccgtgttttagcattattagaaaatttttctgtagaggaaaattttgctaggagttaattcaatttttttttacatctgattttgaaatttaaagtaaatcacttgttttgagtatcttatgtagacgctttttaagccacaaataattttgtcaaacttcgcaaaagtacactctgccctcagaagttattttaggtacaaattacttgttatgttaaattgaatagatgaaaatttaaatgctgtaatatttaagttattccaacatatacactttgatgatgaatacatgctaactggaaacattttactgtagtcttactttatgcttttctactaataatgttcataaattcatgaatgggtggataatcttggcaagaaaatgaaaaggcttttaattgtgtaaaaatatggatttgtcttcttctggagttgttgcttgctcagcagacacgtgttgagtcctgctaacttgacaagcactgcaccacttgctgagattacaaagataagtaagatatgctctgtggctctggaaaatcaaaagctagtagaagatgcctgtagttcatctggaaaaagagagcttataaagttttttctacaatatgacctcatttgaacatatggggtgcagttattattttccttattttacacaggaaactgagtctcatggaggttaagttataatgctcaacttgttattacttgcccagtatctgttgtcccttaaacaaggactgggaccatgtctatctttttcattctgtagttccagtacctagcacagtacctggcacataataggtgttccatttgagcacctatttgatggattaataaatccatcaaacatatttgatggataatatctccaacaaatattggatcataggaaagcattactagcattagtcttcttactcttgaagtaagtactctttcactatgccttgctgcctctgtaattataaacctgtttagtattaacaggatgaatgcttgtggtatggaaaaagagctatatatgctgcctaattttttaaataaggaaagagattgcctttgaaaggtagaggctgaacacccttggaaaaacaataggataaatcccccagaactcagacatcttgatactcaaccacaaaacattcttttctttatgaagaaataatttggtcatatgtgtcaagctttctcattatttagtggtttggaatcattttaaattggccattagaagtaatggcagcaggtttgagggtctagaagtattatatattgtgtactttatcagtaatttttatgatatttatgaagctcagtatggctgatgttaagagacagggttattagcacttcagaacataagaatggaatttaaaatgaccttagaaaaattgagaggtgttgatcctaaataggaacacatgtggggagaaaagacaaatgcactgtaactgcagtatgcaactgtgtcagggaggaatttagaagaccaaattcagaatcacaaagtattaataattcttgtattacattcttcagactattactggaatactatggtcagtctcagtcccaccagtttaagagatttgtaacaaattgtatgagatttagagaatatagaaaataattaaaggttagaaatttaggaatgtgaaaacatagaaaataagttgaattttagtcatgtaaggtctcaaaatat

SEQ ID NO: 73 - DNA, 2027 bp, Homo Sapiens
atgtgcccaaaggctaggctgctttgtagctggagtagtgcccctgtggccagggcgggtaggcaggggcagcctcagagttgatacccatgtggaagggtcagcatctgctggtccctggtgggctccgccttcaatgtcagggctaccacttggacctgtttagtgagcactggggtctttttggatgtcctgagctcagcgctccagaaaaatttaatattgcccaataaaaagccttgagaaagacagaattgcttgtggaacatgcatgttccaccccacctggaccccagattgtgcgcatcttcgatgagctctcagattccttgttcagagtggctgacttggatgaacacaaatgtggaattatgtcaaagtttgcaaaaattactagctgattaaaaacaaaacaaaaactaggcaagtggcctaactgtttatgtttgattttgaaattagtggaatccatctagacaaagaaaagtgtaaaagagcagtggacctcaatgttaaaatcttggatttgagtagtacatgtcttacggcaaacaactttcccaacaagattgagaagcatctcttactagaacacattcaccataacttttatctgatggggatcgtatcataattgatggtctccatgcagaagcaccaggcgacttggtgtgagaagctgcttacaaaatttttcttcatccctatactggtcagttaaaatgtttagaagaattgctcagcaacagagatcctctgcaaaagttggtagggtattctgtgttttccagcagggctctccaaggaacaatagttaaaaattcagagactgtcatccagttccctgagaaactctctgacaaactttctgaaagaacttgaaaagattttgagatgatacgacagatgaaaagtgaaaaatgaaacagaattctcaaagttccaaagtaatgccttgggacccccactaccagagtggtgtgattcatgcacaaaggtataatattgaccctggcttatattgcctgtttttctcccttggagcatgcatggaaggcctgaatatttggcttaacaaactgttggagatttccttatatgcagagtagcctgcaaaaggagaggtatggtgtgaagatgtccgaaaactggccatcattcatgaatctgaaggactgttggggtgcatttactttgatttttttcagcaagcagacaaaccacatcaggattgccattttcgaatccacagaggcagattaaaggaagacagagactatcaactcccagtcatagttcttatgctgaatcttccccattcctcaaggagttcacaaactttgctaactcctggaatgatggaaaatcttgaccatgaaatgggacatgctatgcattcaatgctaggacgtacttcttaccaacacatcaccggaaccaggtgccccattgattttgcaggggttccttctattctaatagagtactttgcaaatgattattgagtaaccagtttgccagacaaaattagaatgggcagccactgccaaaaaaatatggtgtctcagctttctgaatctaaaaaagtttgtgctgcagctgatatgaaacttcaggtcttttatgcccctctggatcaaatctaccataggaagcatcccctgaggaattcaaccacagacattctcaaggaaacacaagagacattctgtggcttaccatatgttccaaatactgcctagaagctgcggatcacctacctcatgggctatagggccaaatattactcttacctcatgtctagggcagtcacttccatggtttggaaggaatgttttctacaaaatccttttaacagggccaccatggagtgctattgcagggagatgctggcccacagtggaggcaagaagcccatgctcatggttgaaggtgtgcttcaaaagtgcccttctattgattactttgtaagtgcccttgtttctgacttggatctggactttgaaacttttgtcatggattatgaa

SEQ ID NO: 74 - DNA, 1773 bp, Homo Sapiens
gaataaaggaaattatttgcaatatatttatcatataaagaacttgtattaatcaataaagacagacaatcccgtagcaaatgaacaagacacttcacgaaaatgatattccaatgtccaataaatgtatataaaagtactttatttccttatcagagaaatgcataccatttcaatgttattacaattacaatctcaccagaatggctagaattaaaaggattggcaacacaaatgcagaagatgccagcaactggaacttttttttttccccagatggagtcttgctctgttacccagactagagtgcagtggtgctatctcagctcactgcaacctccacctctcaggttcaagcaattctcctgcctcagcctcccaagtagctgagattacaggcactcgccaccacgcccggctaatttttgtatttttagtagagatggggtttcatcatgttggccaggctggtctcgaactgctgacctcatgatctgcccacctcagcctcccaaagtgctgggattacaggcatgagccacagctcccggcagcaactgtaacttttgatgcaggatttttcttctcggtcactttgcaaaccgggacctccggccagcgatgccccacccgcgccctgctcagccacgctggcatgccccagctcgcctgtgttatagcttctatccgcgttcggcggttcccaagctcttgtacccacgttcggcggttcccaagctcttgtacccgcgttcggcagttcccaagctcttgtaccacgcctgagaagaatgaggatacgttggacattgaagggtgaagagggcggagaagaattttattgagcaagggaacagcaattagcggagaagggactctggggggtggtcgcccacccccttagtcggatggttttttcctcccctcgtggctgggtcacgagctttttataggcttagaataggggaggggcaggtcataggtagtattggaaaaggcaacgcttgatcggttaaaacgcattatttagaaataattaatcaggaaagagcgggggcaaaaaggaacagaaatactcagcctgtgtcgcgggtttcatctgggaccagcagttcagtgtttttggctggaaggtggggtttcaccccatcctcctgggcatttagcagcctccagccgctctcactttcgtgtgccatggacgagatgataaactgagattgtagaggagttgcagttcttggcagtgaccaggtctagagaacgaccactgaggggttgcttgctctgatggaaacgttattcctaggcttcatttctgaatatggatgtcccactgccagctttgggaagccttcaccatctctgcctatacagatggacacactccctgcctgtgctgctgctagactgtgcttacacttccatcacagaatttatttgattgggttatcatggcttctctgctggaatggaagctacttgggagcctggggaaatgcttggctcaaagcacttctgcacttctgatggttggatgactccactgagacccaagacttaagactcacctggtcctatagcccccacccagaagtggactcagcacataagaaccattttctacatctctatgattgcacccctgaccaatcagcagcacccattccctagcccccagcccacctaactatcttgaaaaaactctagcctccaaattttcagggaatctgatttgagtaataaaatcaacccatctgttattattagtct

SEQ ID NO: 75 - DNA, 1093 bp, Homo Sapiens
acagagtctcactctgtctcccacactagagtacaggggcacaatctcggctcactgcaacttctgcctcctgggttccattgattctcccgcctcagcctcccggatagctgggattacaggcgtgcgccaccacacctggccctacagtttcaagatgatgggatgacagcatttctaccttactctctgcctgaaccaaaatgaggtggcaaagtcacaggaacagaagtcctgcttttggtgagactacaagacacctggaacctgaatcacagtgtagaagaacgtcagcagacagtggacgcaaacatgaccccacagagcggacagtctggagcagccagtggatccctccacatgacctgtgtgaaaggaaaggaaaatctcgagaccaaactcaccatgccaaagggaactgagtcatgcaatgcctgcctgccttctgtttccagacagctgtgatccccatgcctgcgttatcgcatgtcaaatgtagacctactgagcgtgagacagatgcatgactggctttcccctaactctgttctttttttttttttttttttgagatggagtctcactctgtcatctaggctggagtgcagtggggcgatcttggctcattgcaacctccgcctcctgggttcaaacgagcctcctgcctcagcctcccgagtagctgggattaccggcgcatgccaccatgcctggctaatttttttggtatttttagtagagatggggtttcggcatattggccaggctggtctcaaactcctggcctcaagtgatgtgcccatctcagcctcccaaagtgttgggattacaggcatgagccaccatgcccggccggctccattctttacacaggtgaaatgtagattctctgagtgctaatcagagcctcatgagaatgtggcctctcacctgtttgcctaccctctttgtttcccttttctcctttctcttgaaacactgaagtccttaaaaccctctttggtaaaagcacaggacacagattctattgtgccttgagtttctttttcccgggcacatgctcaacctcagcaaaataaatctctcagccgat

SEQ ID NO: 76 - DNA, 21562 bp, Homo Sapiens
gccgaggtcctcttccaggattggctacctcctcataaccataagataattaaaacttggcggggggggggggcagggttaaaaaaactttttttatcagtcagaggataatgcaagtgtttaacagatgcttcactattaaaatattttccccccaagtctcaaatattgaagaatctctaaccaggggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaaaaagaaaaaaaaaccaaatactacacttcaaaaagaaaatatgacaatgaatctctttttatggattctctctgcataagtggaaacaatatgatttaaatccccaacaccccatcccccttttcagacacagctgaagtgatacagatactgtcttctaacacataatctccctctctcgggagaggcacctgcctgtgctacattcgatttagtttgtaaggtttcaggcccctccccgacccatgtaatatgtaacaaggattatcaaataataaggtcttggatgtgaagtctgctttacacaagaattcaagaaagataggcaggacttgagtaattatgttacaacttcatattactttccaaatgaatacccattttcttctcatgtcaacttctagagatgggatgctgaggcagagaaatatttttatgagactctggagtacatactaaaatgtgcttccttattatttaagaatgtgtaaggtatggacctacatttgtttgctggtggtcataaaataaattcatagccattgtggccaataagcaatctccttcacgctttaaaagtttttggtttataatcccacctggattgtattttcactattctgtatcaccctcctattgcaatattttggttctcaatcttatgtaaagcaaacctcagaaatgatcgtttccataaaattgtgcaatggcaaagccacagaataatattttgagtccatatagccgtgcatgctcatctatatagctcttatacagttttctagctgattgctttggtatttcaagaaataggaagcagtagctacctattttaatgaaagggtaccatttcataagaattctattttcactgaaaaaattggtctggcacattattcaatgcaaaagattataatattactttcacgtgtgttaatctgtttagtataaaactgctagggtgtcttaaccattaacgcgttttgccacactactttcaaatggtgatctgagataattacgaagattttgatgttaatcccacgttaaatgaacaactatgaaaataatcttaaagcattattactcccatatacatgccagcaaacccaattgtggagagaacatgattactttttatctgacattatcctataaggatatggctacatttatttcttttaaaattggagcagttttcaattactttttaacagaattgttttcaacacagcattttgcagtgcccataaaccatagcaactttgtcctgatcgatacatatttttctgcattattattcattagcctctttgcaaactcactaaaatagaatagtattaaagtatgaatatatagagaacaattattaggttctacatatttatttaggtaaaccaatgttattaaaattaaaaacatgtgcctggcatataagtgcttcttcaggaattcttttttggatgcatagttattattttttaaacaaactcagattttcaaacactgattttcttctctgaacgggcattgcattgttttaaacagtagctcctggaataatgccacctttagtattttagactttcaaacaacaattggaattggataaatgctttcagctgggagcactttcctaatacctttgtaggtaatgggattctctatttgtgctgggtgacaaacggacagtgccctggacagactgcctaccctctgcagaatctaccaaaaagtagagttttcccatgagactgcttgtggtccatctaaaaatgaaaaaataatcagagaaaatgcgcaaagccttttctaactacagttatgaaatgatggcttaaagaggtatttagaaaataagagtggagtaatacagaaacaaaatctgaagaagaaagtttgcttaggagctgatgctctttgtctacaaacaagagggtaaggagctggatccaattgaattgaattgtttttgtttgcttgtttgttttcttccattcagtgcctttcaaactgttttttactggatgaagaaactcaaccaagaaaatatatgtcgattcttgtatatgggacaatattagctgctgtgatttttaatactagcataaaatataagaatctttttattactgtgatattgttttttcctaaatgaatgcatagtgtaacaattggtgtcaaaaagcattgaatttttttcagatggattaagctggaataataaagtatatctatgagatgatttctgtaaactctgacttgctgagaaaaaagtgaaaaagctttttctggaagaaacatggcaacttaaccgttattaatctggactaaataaaacaggaaactgcttctttacatttctagtaattttttctgcttttccaaacattgttaagttctatgcaacttgtgctattcaagtaaagatgatgtcagtaataaaattacagaatctaatcaagtgactatttttgctttattacaaaatttatgtatttaattgggatgtttaattgcttagtttttagaacactgaatttttctttttccagacaacagagtgatatttaatgaagtgcttataaagataaatacgatggttcatcaaagataaaatagtcataataacaagatggcatttgagtcaatgtggagtggactctgctttgtaaattatactgctttttaaaagcatgacctaggtatttacaatggggacatctgagaagagaaactcaagagtcctcaacttacacagccaagaatacacaatcatgtaggagaacttgccctcagaagcatttctctattgacattgccatttcttttcctccatctagtacttccatttgctctatttcactaaaaagtcacagaattaagagtggctgctgcaactcactgggctttctctgcttaaaaaaccttaatatcacatggtattaatacagctacattaataattgaaagattcactcagctgaccctatgatttttctaattattgttaactatctgaatatttggaaataattgtatttttccactgactttttctcattgccttgggtactagaaggttttttttttttttttttttttttttttagatggagtttcactcttgctgcccaggctggagtgcaatggcgcgatcttggctcgctgtaacctctgcctcccagttcaagtgattctcctgcttcagcctcccgagtagctgggattacaggtgcatgccaccatgcccggctaattttgtatttttagtagagacagggtttctccacgttggtcaggctggtcttgaactcctgacctcaggtgatccgcctgcctcggcctcccaaagtgctgggattacaggcataagccactgtgcccagccgggtgctagaagttttaacatataacttcagacacaactgagtaaatagttagctgtatatattttattgtattgttatttatattatgtcggctttgtgtcagaaaggatttaaagcacttgtttcaagaattggtatgctatatttttcaaaatctgtgtataaaaataattcccataagtaccactgtaatttacttttcatgtgtattacaaaatcagttatgtgttctggtaaacattttgatcccaagaggaagcaggattacatttagaatgtgacaaattttaaaaattaattttgttgtaaagaaatctttataatgatatgccataaagttattactatgcatgtaaggccgcataccatagtgattaagagcaggtccttggagttagaggcacagtctgaacttgactacaaaagttatcagctgtgtgatcttgggaaagtaaccattctcagctttagttaccacagctgtaaaaggtggataataattatagactctgtcctgttgttgtggtgaacatttagtgagacgactcacatgaggggctggcatagggtaagtacttactcaatatcagctgttctctttggcatagctctgttagagtggcatgccacagttaccttcttgagagccactaagcgtgggaacggtaacagtccacagaatttttggagattggtatgaggaggctgcattggctcccagccctcagggttgacagggtgaaggtaatggcttctggctgtctttagagctcccaaaagatatgagaagatggttctagtgatgacaacccactgttctgtcagtggaaatctagttttatgccatcttcatcattcgtggtgtagtctatcggtgcctgacacaaacgtctagagtggggaaaataacaccttaaagaaatagaatatcttaggtccatgatttgcctgctgtgtttattatgtaccccagcagtaaaatattttaagtatatttatttgcaaatcatacatctgtacatctttactgatatgtacatgataaacctgtgcaaaaaataacctaaaaaggggtaagattaaaatgaagaattagacaaaaggtttaaatgttttaaggtaagattcagcatcatcaacagtgggtataaatccatacttcaaatagccttggtggtttaaaaatcctctggttgatttacctttggattcatatcatcagtgtttccgtcttgttttgtggctgagaagaggaggagcagtgtcagttctgccattttcctgtcaatggtttatgtctgccttcttggaatcatatttaatgaaaggttctttgcaggaatatttttaaaccccttgttcatttggtgaagattagtttagttaaaactggattatataatatatttcaatctaactgagccagacaaattgtaacacatttcaggccatgtgtgcttctaagagggccactgttaacccctctgtggtcaagagctcccccttccctgaggttaccttgtgtgctcaaggcagctgagtaacataagaagaagcaagggtgttgatgccaatggttaccctattagtgaactcatttctgattgtttgtatgaaaacaaatatgatttctgttataatcttctgacaccccattccttggggcaccactgtcctagactctgaaatcactgtggttcctgccatttcttgaccttgacattctgtgacagaatgaaggagaccttaggttcagtggacttcattttctataactagctttactctattgatcacatagtggtatagctcttcagtgtttgcaaatcaatgttcacatatttctgtcatttgaactcagcatctttatagggcaggtagagaaggtctgattctgtccattgtaaagatggaagagatgaaaccaccagtgttgctgactgcagatggaagataattgcgtaagttcacacagcggtagacctgggtttgaatttgtttttgaaagcaatatcatcctgattcttttctatcatgttaacacaatttttaaatgatattcatattcatctgaatggagtagagacagacagttatatagtagttgcaagtttagcttttaaagaaactgccaaactgtcttccagaggctgtactattttacattcccattagcagtataggagtgatcctttttctccacatacttgccaacatttcttgttgttcttattaaaaccaaacaagtggtgctgggaatgcattaagagaaaacatatatattattaatagaataaataataatcaatagataatgtgcaggaaggggatttgcatttacgaaacatctattgtatcctatgttctttacacatattatccctttaatatagttctatacttgcagggacaggttttgcatgtaaagaaattgaggttcagagatgttaaataatttgtctaaagtacacagcatttaaattgtagagtttaaaccaaagggatctggtattaaaaaattccaggtaatgttaaaataaaacaatgcattaaatttgaaagtctttctgttactttttgttccaaattggatctctgtctttggctaaaaatcaaccatgacaacaagaaatgttggcaagtatgtggagaaacaggatcactcctatactgctaatgggaatgtaaaatagtacagcctctggaagacagtttggcagtttctttaaaagctaaacttgcaactactatataactcagttattgtactcgtcagcatttatctcagataaatgaagacttaagttcacacagaaatatgtgcatgaatgcttacagcagctttaataacagtgaaaaactggaaacatctcaaatatccttcaatggaaagacaaacttaaccattctgttaacagttaagcatgtatggttaatcgtggcacatggaatactacttggcaataaaaaggaacacattgttgataagtgcaacagcctgaatggatctccagggaattatgctgggtgaaaaaatccaaacccaaaaggtaacacactgtatggctccatttatatagaattcttgaaatgacaaaattatagaaatggagaaaagaaaagtgcttatcaggggttaaggagcagtggggtggaagagaggtgagtgtggccataaaaaggcaacaaaatggatgcttatgataatggaaattttctgtatcaatgtcagtatccttgttgtgatattgtactgtgtttttgtaagatgttactattgggagagactgggtaaagcgtgcatgggatctctattatttcttacaactgcatgaggatctacaattttctcaaaataaaaagcttaataaaaatgcctactgatcttcaggaagttcagttccctgttttccataactgatctgaaaataggggaaggacaattgagaatttaggagttgtaaactctgaggctgattttcagcgaactactcaaattattctgatttttccccttgattcttattatggattgtaggacattcttcctactattttggagaagaaaaaatgccacctctctatcataggacttctgttttacatatgatttaaaaatctattagctgactaatttacacactagaagatgaaacttggttacattagattccattgccacaatttattttaaaaatcagagttctcatctttcttgtttcttcttcctgccttactttattttcttttttccttattctatttgaacccatattttcctatattgtactgtttagtctaaaaactagtaagcatgcatattgttgattaaattagcaattgacgctcttaaaatgagaactataaagactcttgagcttccacacattatgctatgcttgccatatgcttgggtgttcttattttcggagagaagtaatggagattataaatgttatttttaaaatttactggtgatttgttgagaagataaagtaacaacactattacagagggttgctcttgatctcccaggccaccagtgcagtcaccgagccctctgcaaacacctgataatgctgaagagtgtgttagtcattgtagaggagctgctgtcatgacaaataggggttaaattgtgagaatttcaggatatattttggggaaggattaaataaatcaggggacttgctgacagcaaatagtatctttgatttgaaacacagaatcagagaattgagatgaatcccaggtggtggttgggagtttgaaaaagtcccagtgagttggctgactaagtgtagacttcatttcaacatcattaaatagtctttaagtggtgacttaataattgttgccccaagaaaagattttgctaaatacagaggtggaattaagtatattaatccaagaaacattttatttaaatgattttcctaacagtaaggttggaaggccctagaactgcttctaggagcttgaagtgcatttaatagttaactgtcagaatgaaaaatgaaattttaaatttcaacaatgcaattaagttcttattttcttatgatagtgaataataaatttcattcaaggacgccattggcagatgttgaaaagaaccattttcactccactagcttgcagtggactaagaggtagcaggaagggagattggtactacagatcctgaaaaaacaaaacaacacaaaacaaaatccacaccacaaatggacacttccagatgcttaccaacaggaagtgccttggaggacaagggctgtgagacaggtgaactctagggaacaagaattcctagttccatgtctgtttacaagaatttgtcatgactggttcacctcactttatagtttcctcagaccaaagagacaaagaaaaagcaaaaaacaaaaacaacaaaaattctgaaacgaatggacaatacaaccaaaactttaatatgaaccaaaacaaaaattgggctgattttatgaggttgacttaaagtcaggaaaagaatgataaacttttgagaggaagaaagaaatcatcaaagccacgaggagctcaaagtggtgtttaatagcagctatcacattgcgcccgagccttgaccacttctgacgcagctgtttcgttttaagatgttcccattcctgttccactcacacagtcctccacagtgacctgagtgcacgcacccaagccggcaggccactctagaaaaccgtaaacccctcagagagtcactgcaggaataggggaaatggaagtgatgaaattcaatatagcatttagctgaatcatcatctgaggttaagcccagtgaacaattagcagtatcgggagtctcctcgtacctgtcaaaatcgcaccgacgggattttgtgcaaagtatgtatgtgtgtggaagttgttttttatgtttaatagcaatggacctggggtagtaatttagatacaactttttaaaaaaaatactaaagggcaagtgtggtgagaagcttcttactcaggaggatcttttcaaacattgcaaaacatcaggccttgaaataattcattttattaagtagcgcactcttgtcttttcattcacaaaaggaggatgatttattatacagataaatgcttgcataggatgatgaacacctgtaggaatgcatgatattctggaagttgatcaaggtccactgtacaccagtaattagaggtcatgatgatgataataataataataataattaataatggcacatactatgtgtcagctcctgttctaacttcgtttctcatattaacttatttatttttcatgattagccactaagatacaattattatccctgttttgtagacaaggaactgagtgaagctcaaagaagtaactaggatcacactgtcacacaggcaggaatgaaacccatgcagattggctccttagtgtgctctctgatctattatcattcatcacatatttactgagcatctagtatatgaaaggtattaggctttatgcaggcaatactttagcgaagccagggagatgtctctgccttctttgagcttatagcttggtgggcaaaaagctaatggtttaactgtataaaaaacttgatgttgtgaaatgatatatgccaatgtttgcatggtatgatgattttgattaagcaccataataaaaatagggagcctgggtctcacacagccttgattgtcttcttccttctgctccccagtggagtgcgtaggaaggtcacaccctcaatgtcaggctccttcactgttctcagtgagtgtctcaggttgtaggctacatgagcaggtttgcacctggatatgattgtggcagtaacaatagatgtgactatacacagtggcagtggcagtaggggtgggagttgggtgatgggatgatcttagaatgcagtgttggtattaactcagttttgttttgttttgatgtacagccagccatacgactctggaatatgactctgggtttaccaacttggggatggcccggggatttaggagatggccccaatggctctcctcttttttagaaaggactgttcaagttccttttttttttctttttaaacaggatctcgttttgtcacccagatcgggggcagtggtgtaatctcagctcacttgaacctttgcctccctggctcaagtgatcctcctgcctcaggtgtgagccaccatgccaggctaatttttgtattttttgcagagacggggtttcaccatgttgcccaggctggtcttaagctcctgagctcaagtgatccatgtttctgcctcccaaagtgctgagattacggtttgagccaccacatctggtttaagctatttcttctaaagatatagtcacatctattatctttgacccctgcctaagcaattctgttcagatcttaagactatttcttcccgggattcaaactcagagttaagtagagtcaactatatgaggtatatgtgaggttaatttttgaaacttttatttttaatttcatctgggatctcctctagggaagaccactttatgattatgggttgcattcccaagttcagttgattgaatttattcatacattatttaataaatgtttattgagactgaaaataaacttgaaatcctagaattcattggttgtcttaaaaattctaaatatgaaatgctaactttagcttcatgagtatttagaatagaaaataaataattcaaaaattgttcaggaaaaaaatccatgatttattctactctggaggagcatattcaatttaaaacataccgattcgtataaacttattggtaatgaggcgatatactttttatgagaacatatcaaaccatagacattgagatccagcatctcctgagtgagtaaaatgtcagggttttattgatactaatgataatgggagtgacatatgtgcatagagtaagtccatggttgaaagcctggctgattaggcgctgcgttctgtggtttttgccacttgtgtgtgattaaaccctgcagaatagagtctgttgccatgtatttggttcgtgaagaaaactagtaaagtgatattgaatgaatgattcagtttctcaaaagggtagactattggcctaacaccttcctaacttggagctgtcaacgtgtttagtttggttctaatgggagctaggctggagaagagaaaagttttgtgagaaaggttatgtgatattaataagaaccacattccgtttgatgttttctcaaatgattttttttatcttcctaagaaattgaatgattcaaaaataataaatcttccttttctatggcccacaaatgatcaacattttggatgatcaaaacaattttgtctttaagatatcacaacttctagtgcctctttatttgccagtgctgatttacagcagaaagtatcacttcatattttttccaagcatcaaagtcatgtgttttacaaatattcacaagtgcttaaaatccatgaacctctctctgtattcctatttttttattcttctataagtatgtatttaaattggttaaacagatggctttctacttttgaaaaaaaaaaacccactaagaatattcacctcaagatggagaactcataggttaaatttcattctggaatgcacgtttacaaccaggtaattaacctttgaaaatgagggtactcgaaggaaacaaggaaaatcttaacaagatgatctcactaacgctggtgtgttagacttctcagaagtagagatgccccagaagtttaacaatgaaaaactttaaaatatttttaaaaacatagttaatctttgtagctttccagttttcgtcctttattacgataaccttaggaggtaaacgcttcaaggggtgtatccttataatcataggaattggtacacagattttggtggaaagatggaggtgtcaacattaaccagtcaacatatatttgttgactgcctaccacatgcacaagtctcttccatgcttgcgaagagatacagtgatgtgcaatgtgtagaatctgcccttcatgagcttttgatttagttagtctgagaaggaatagatcagtgaaaagttaaaaggaataatagatggagtgttgaggcagtccatgattgttatctgagacattgagtttacaatgctaagttaaaagaatgagagatcactatgggatagaatggacaggaagagttcctctccttgaagcttgcattaagccataaaagacaaagcaattttggaaatgcagaatttggagatatgaagaaagaataattcccagaaagggagaagagttttggagccagacagatctgggttcaaatcttggttctcttgttctctagctgtgtaatcttgggaagttacttagcttttatggacatcttctataaaaaggatatgatagcgactattttgttaattttttaggattaattgagataatatatataaagtgttttaagcacttgataaaaggtaatcctctcagttggagagaacatcctaaacaagtctggaggaaggagacagccagccatgttcatgggacaaaaagaagactattatgagtggagggaaagattaagagaagtagagtgagatcacatggaaagataaattaggattagcttcagccattcacttgtttcttcatttaatactttattgcactctttatgtgggaagctctctcatgtgggaaaccctctgctcggcatggatatgcagagacaaagaaaacttagccttggatttctcttgaatgtcaggttaaggagttggaacttcatgctgaggagaattatatctttcaaaagtggaggagcttgaaagtagcatttttggatagttaacatggaatgtgattcttgtgacccaagatatgcattaagttaccatctcctagtggttgatggttaatgttgtgcctggagatgtgacccagattctcttgtaggtcattcctgacagagggtccattccaatgagtgaggaggaggagcttctgggctgaacttaatctcatctcctgaaataaagcaatgacattgaaatttttcatattgcacttgtgtttacatttctcatctaatctgagatattccacgtttggtgagtcttgctttgggcctgcagtcttggtgacccttattagttgcactggaatagctgtctattcagggagaagtagaatcctgggaatctggtcttcagtgactttctccatgatcatgaatttcatgagaggaggtccccttcctgttagtagatctctatagcaagaggttctgaggcacacaagcacactggatactcacctacagttctagtttaactgatggaacataggtatttctttcatgaaactttgcctggataaacagcttctgtatcttctagtgacaaaattttgcctcctgttttcccctctagctctagtcttaatctctacttccttgttcagtccaaggctcaggagaacccagatcatataagatatggaacctattgcttcctaggatgtccttgtacacagtgactaactgctaatttcaaggatcaatttctttctggagttagaatcatattatattatgtttcagaactgaaataaaattcttttaaggtgattatattttggctctcagcttggaagatgccactggggcatggcatacaagacacataacttataggaggacctcctttaatgcccaagtgccagcttcatgcttgttgttatatatcattttattcctggctttgatgcccacacacagacatatatccacacaaagttcaatctatatattttttgtagctgtttagctcaggtgattagggcattgagctaatgagaacaaggtcacagtttcagtctttgtgtgggccagcaaggtttgctttgttcagaggccacagacctggtccagccagctgtccagcacatgtctgccccaagtcatgagaggacggggcaggagtgtgtggatggacaagagcaaatccatcaccacccttagaaaaagtcaagtcaagcacgtgtcctactaatgggggtcaataatgtctcatttaaatggggctgacattttattacctcttgctgagagggtcttttgagcaccaaatttaaacattgtcgcttttttgtgtgaatttatttctaataaatggaaggttgtacaagaccttagatgattacaggtttccaaatacagattaatgacttcaatatttaagaagttgatgtgatattaaaaaagaaagttcagtatggctattcagttatcttcccttattaaaatctgttttggctaatgaaataaaaagttcataagttcttccgagagtaagtgagaatcattgccttcattcaagaatgaaaacattattattaaactcattgataatgagaccattaaaagttagcatgaagcaggtacaatacaattctttattattgaagtcttcagatattacccagcctacacatcccacctttcatttttaggcaaacaaattccccaaactatattttttttaaatttagcattaggtcttgttaggcttcaaatgggatcaaaaccaatcctttccaaagtgttctaccccagctgtttccctcacctgggtggtagtgagtataaaggcatttgatacagaagggggtggtggggcagagaacagaaaggaaacttggtgagagaatgatgaagaatgatatattagagattcttttaaaattcattcattaaacaaatgtagcataatggaaatgtctattaaattttttggcataggtaatgcacttgcaagggtaaaaacagaaatatgagatggtattttatgaaaagttttgctcaccccgcatccatcatgaacccaattctactgcccttgtatagccatttttattagtttcttgtgtactctttcagaatttctttatgccaatatatcttaaactctttcctttttttcatacaaaaattaacaccctatcaattttgttcctggcagggtgaggtggctcacacctgtaatcctagcactttgggaggcccatgcgggagaattacttgagcccaggagtttgagaccagcctgggcagcttagggaaaccctgtctttataaaaaaataaaaaattagccaagcatggttggtgtgtgcctgtagtctcagataactcaggaggctgaggcaggaggatcacttgcaccagaaggttgaggctgcagtgagccatgattgcaccattgcactgcagtctgggtgacagagaaaaactctgtctcaaaaaaaaggtcttgagcttgctttttctacttaacaatatgttttgtaaatctttctgtatacgcaaagtagcctcatttttcatagttgtatatcattctattgatgtgccacactttatttatctacccccctattgatggaccttcatatagtttctaatattttctattacagacaacaatgtattgaattactttggaatgcattaggtagaaagcattcttctttctttaaacatttgcgtagcattccactgaatggctatatcataacttatttctctagccccctattgatcgtcattgagtttccaatcttttatttttaaagacaatgtcataatgaataactttatacatgtattatcttatatatgtggaattaaatttaccatgtctagataattttatttgaatgcaattaagtatgatatcaaaaattataaaatcaaaactgcagtgagaattcatcttaccccatgtaaaatgactcttatccaaaagagaggtgatcatgaatgctgatgagaatgtggagaaaggggaaccttcatacactgttggtgggaatgtaaattagtacagcactatggagaacagtagagattcctcaaaaaactaaaaatagaactaccatacaatctatcaatcccactgctgggtatatatccaaaagaaaagaaatcagtatattgaagagatatctgcactctcatgtttattacaacactattcacagtagccaagacatggaagcaacctaactgtccatcaacagatgagtgggtaaggaaaatatggtacatatacacagtagaatattattcagtcataaaaaagaataaaatattagttgggcatggtagcatgcacctgtagtcccagcaaccagggaggcctaggtgggaggattgcttcagtccagggaagtcgaggctgcagtgagccctgatcacaccactgcactccagcctgggcaatatagcgagaccctgtctccaaaagaaaaaaaaaaagaatacagaatgaaattctgtcatttgcaacaacatggataaaactggaggacattatgttaggtgaaataagccaggtaccgaacgacatatttcacatgttcccactcatatgtgggagctaaaaattaaaacaattgaactcatggggagagtagcatgatcattaccagaggctgggaagggtagtgggaggaaggaataaagtagggatggtcagtggatacaaaaacacagttagaaggaataagatctagtgttctgtagcacaacagggtgactatagttaacaataacttattgtatattttaaaataacgaaaagagtggaattggaatgtccctggcacaaagaaatgataaatgcttgaggcagtgaacaccctaattatcctaatttgatcgttacacattgtatgccttcatgaaaacatcacatgtgccccataaatgtatactgttatcatgtacccatcataattttaaaaaatagaaaagaattatcacaattattttaaatgaagaagcactaagtaggaaataaggtacaatttaattcagaatagctttccttagtagtgttcaacctactgtacacatcaacaacacgcccttgcagttaacattgttgctggatgtttactgttatgtgtgaccagctgacatgtccctctaaagaaagaggatttaaataagtcatgtatgaaagactgggtaaaggtgagacactgtaagacctagattattttggggctgtagcaatcagattagctattgagtattcattcataaattcattcacttcactgagtcatccacttcttgtcagattctgtatttattcatctcctagtaagctactcattgtgctaaaatgctggtaaacagaagtacaaagcaccagttataactcacagtcttgtagaggaattaagaaatggacaggaaacagtaagggtgcattgtaggtatctcaagaatgatataaagtgttatggcagatctaaggaggaagacatgactttccatagataatggatggtggcatctgttctggagtaccagaaaattagagtaacaaaaacacagcaggatagattttcttacaatgcagtgattcatacaaaggctaccttgactgttagtttgtgactggaaactctcagtcagggctgacggagggagtcctgcccctgccagctgttcacctttccctggtgctggggttgacacttcacatgctcacatagtctggttctgtgctgtctactagggttgagtgtgctgctgggcagagaattttggcatttctccagatgcacatgaggggcagaccgcctcagcagttgctaatgacccaaagaagccttctttcatgacttattttgtcccctcattttattttttgatgtattttggtgagctgagctactaccttctcaggcagtcccaacctcagaaaattaaccatgtagctttctcatatctgacattgcaaattgaggcaaggtcgcatgctttctgactacctgactgcctgggcatttctttcatgcaacttgtttaagccgcccatcctgatccctgttgctaagccaccatggctgcatttggacgcagttcttcccagctttgccgcagcataactgtggaaaggatcttgatgaatttggacctggggagggacgtgggaggaaagagaaatggtctaatggaagaaagtgaacaaacaaagacatgctcacagaaaactgccaagtgtgaggggtgggaaaacagagttcagcctggctgaacgtaggaatctggatgggaatggtagatcttaggctcctgtttttcagcttgccgctctagtgatgattcttgtagatatatttttccaagtaaaaggagcatttccaagtgactgttgtttaaaataaagtacatgttgcatttgtaatgtatgaattatgagtattaaaactgacaatgaaatgagagtaatatacttaattaaaattaattagatctgttggcacaccactagaaggacaaatatgatatttaatatatcactctactccagacctgtccaattaaacttttggccatgatagaaacgttccatatctgttgtccaaaaacagtaacccctagtcacatgtggctattgagaacttgaaatgaggctagtgcaactgaaaactgaattttaactttgtttaatttcagtgaaatttaatttgaatttaaatggccccctgtgagctagtagctaccgtattggacagggaagctctaaacagggttctaaacatgtggaattaacagcacttaagagctggagtagaccttaacctttaccaggtctcaaactttgatttacaaatggggaaatggcagccaagaaggtgaaacaccttgtccagaggcacactagtaggaattagcagaactggaacctggtgtttggatgtcctggctcccggcctgggggactcttgattccaacacgctctctcccagttatgacagagggctgtggctggacccaggtaaggatgctgggttggtagattgagaaaataaggccacgcgtagtctttcaaatcaaccaagcaagagatatttgctgtacatggtggcagacactgagatcaacagagaggttgttgtggtgtgggggagggcctgtaaaatggcataaggagtctactgggaaaaacaggatagtgatagattatatatctctatatttatctttctatataatctaccctgttttcccaaatggatttcccaaatgtgtgtcacttgtatatctggctgtcactggtacaaggtagtccaaatggacagggtacgcaaaccccagacagggctatggaaatttagggagatctgtgtgggtgagtggtcggggagagcttcagggataggacaggcttgacttatattagatagtgtaacacagaaggtaaaatacaactttaggatcattcaaatttaacagtggttgatatgaaacaaacttcttatccagagttggttttgtattcttgctttctgtattaattatatgtgtttactgattcaccacaatcagctatactgtccctagaattttaaaatgtgaaaagaatgtggtttgtttcaggactatttttctgtagaatggtgattgtatagaattaattaatattacagttgcattattagaccacagtaaggtaaatggtcacaaaagaccatacatttaaatcaggagaaaagtaatggctattgttatcctgtaggcatagctgggaaatcatatccttacttggcttgctaaagtcttaacctagtactacatgacagtatctccagagatttttttttcccattcgtaggcacaacaaatgagacccaagtgctcatagaacattccaaagagtcaacagagagaagtggaaagtattagaaacatgattgtgtttgcaaagggagacataaac

SEQ ID NO: 77 - DNA, 1473 bp, Homo Sapiens
cattaatttataatatatatttatttataatatatgtgtgtatatatacgcatatatacatatgtatgtatgtctatatctctatctttcgggttgttttgagaattaaatgacctaacccatgtaaagccctgtgtaccgtgcctggcatgtaggatacttcatcactgtcacctgtttttgttgttatgacctgagcatctccctgttcaccagcccttgttctttagccacaggttgaagatgacagtagatcctaaggaacctcagttctatcccgaaatgcgaaggcctttttactcaaccacaaagaagtggtcagcagaaaactggtcatcccggcctctggggccatgcacagcactcaggaggagctactattttccctgcctgtttacatgcggcctggggccttgtgggctatttgaaaattaggacacgagaagtccaagcagcacctggtaattaaactgagtcctctatcagagagaggcgtgaccttgaagggcatccatacaggagccaggggcaaagcagaaggtgggagggattctccaggcttgaccctctcagcacatctcagtcaggggtgcctggcagcctagattccagccctgcccagtgccacccagagacctgagggaggtggacagctgctcagctgggtgatgggagcctctagaaatagttgtcaacctcatcaaaccagagatgagcccttaggacagccagggtgttgatttccagccaggcagggcattggttctccagtgggatgtggacaaggttcactgcagcctctcagcagatgaactaggggagagacactaccccaaccatgctcccccgacccttcggtgttaagtgaaagtatcttccttttttctctctgctctctccgctttacaacaaaatattatctttagtctgcaaaaccagggccaggaagaatcttcacagctagacagggccatggaaagatgatgaggcatatcaggaactatgtaatcttgtaatacttctgctgcaaaacctcctgacgttctgaatgaacagtcacatgcagcctcttcagtgcaaaactgagctcataagaaagtaaagcaaatctgtaggggccaaatgaagagtgaactggaagtcagagcttcaagtacatgactgatgtggtgtatcccttggggatgggggtgtacacgctggttttgggaagcagggcacttgggtttgaaagttcatccaggacatttgtgtgactctcagtttttgaatattggtgaatagtgctgcttagaacattctggtatgtgagtttttgttgcacataaggtatttatgttgaacaaatatttaagagaaaaattattgaatttaggtatgtataacctcagatttggagaatactgctaaacagtttttcaaagttgctgttcattttaaataacagcatatgggccaggcactattgctcat

SEQ ID NO: 78 - DNA, 3267 bp, Homo Sapiens
agattcccagccatatgaagacaccctagctggacgatcagtccttgtcaaaagtctgacccctcaaactctacagcctcaatggaccagaccctacccggtcatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaacctacaacccttaagctcctggcagcgcccagccaaggccatgcttccttgcaacactccttccaaatggccatcccagcatgcttccaagcaggcttcatccgttcctctggaccctcatctcttaagacctgccgcctataaaaaggattatatcttgagaccctatcctctaaaattttttccacacccaaaacaaaaaatctctgggtcaaaagtctaaaacgcttaggctggcaaccatcagatccttgcccatggtgtcctcaagcctactctcatgaaatggacaacagtacacgcatatggggccagttccacatatttggcaaccagaccagcatccaggacaacacaaagtatgttgtttgttgttagagggcttgggacatttcactctttgccagcctcagcttaatccaggagacaaagattattttccttattatctcttctgcataggatctgcaatcagaactattgaacttctccattcagaccgccactcacacctatgggaaaagggtaatgtatcatcggcttagcaacagggaatactattcgtatgatggaaaatggggacaaaaggctttggtacataaaacattattccttccttggcctaaaaactcatcgccacctacattaaagctaatatgcctgattactgtttttagagaacttattttattagggcagttccaagctcaaaaatacgctaactggcaccttgttagctacataaaaatgcaccctagacccgaaacttactagactcattataaaattttctttaaggtgtccacgcagtccctggtcacacttgaagcagtccggagaaatatcagccctaccccagtaatccccagaaggaacttacacttttttttaatcttttcctacaacttcatattttataaataaaaagacaaaaatgtcaggcctgtgagctgaagcttagccattgtaacccctgtgacctgcacatatccgtccaggtggcctgcaggagccaagaagtctggagcagccgaaaaaccacaaagaagtgaaacagccagttcctgccttaactaattaacccaccttacgacattccaccattatgacttgtccaccattatgacttgttcctgccctgccccaactgatcaatcaaccctgtgacattcttctcctggacaatgagtcccatcatctctccaccatgcaccttgtgaccccctcctctgctgaggataaccacctttaactgtaactttccacgcctacccaagccctataaagctgcccctctcctatctcccttcactgactctcttttcggactcagcccacttgcacccaagtgaattaacagccttgttgctcacacaaagcctgattgggtgtcttctatacggacacgcgtgacaggaacctcaacccaaaggcagtctgatgaggtgtctaagataaaagtagcggcacaaaggcttttgtaaacagaggcgtttcatgtggttttcctttcctttccttatatgtgaaaaggtgacagaaaagaaatcttcctaaaagagtcagccactgctctgtggaacgatgatcatttaaatgccacgtcgatttgaaacgtacaacaaagggactaacagttgagaaccatgtggattgcagtggagacgctggcgttagagaatgcggggagggaaacgttcattacaagatttacggccagcccaagggggagcgaggctgggggaccgggtcgcggagacccggcttcgcacaccttttggaagactcagggagaagcgggggccgccttcggggggaaaggcgggactggggagcccacaggccatggctcctcccacaggatccccaggccggaggcgggatccccccatgatcctcccgtggcccccgcacaatctggggagatgcggagctgcccagagagggctctggggcgacagtcactgcgcagggacaggacaggactcccggagtcccagctgccggcccagccccaccctgcggccgagaggaccgagggccgagctgctccaggggaactcgggtcccagaccccggagtcgcagcggacaggcccgggtcccgccacagccagatccggctggttccaccagctcctcctccggtctcgggacgtccggccccgcacactcagcatttccggcttccgggtgtcccggcgtcctcccctgggcctgctcacgtcgcagaggggcggcgacggggattagaggggaggagggcctgcgcgagcagcaaagaccccaaaccccaaaaaacaaagaaaccgccagaaactgaagcttccacagcccgccacgtcccccggctacggctacgctcctgattggatagttagtacggcccctagtgcccctgattggataccgcttcaggtcccgccccctggggttagaaagacaggagacccgagaagacacttggctgcgtggagcccaaatgggcggttcctggcaactgggcttgttgtcttcctcgtgtcaggatgtaaaaagaaaagtagaggttcttcttcaaagacttccttcttcatctaattaagaataaatagtgtttgaaatgcttggtttttggtgccataaagaaatagcactttaacattaatttatttagcaaggccatttttactccctgcagaaagggtacactcgccagcagttttgccacgagcgtacaccgagcaaaggagacagggtcatttataacctgaggtgtccaccctactgctgtgtccagtttccattggctggaacgggacctcacattctgtgtttgtcctgattggctagcaacttagaacgttttaaaagaggcaaaggtggaggagaacaaaggaagaaggaagtaacttgtggaatgctgagaaaggtaaaaacaccttcaaataaggaagaggaagaggctatgacttaatgcttgcttggaccagtataagcataccagggcaaatatttgggctaaattgtggg

SEQ ID NO: 79 - DNA, 918 bp, Homo Sapiens
tctccttaaaatatggtcttgacttggtttccagggcaccagggtcttggttctctctcgctcacttttctgtatctctgatctctagtgctggagggcctcaggattcagtccttgtacatcacctccactctagttacagtcagattccaggtgatgtccccgcaattctcagctgaaattccttctacatactgatgactctgtatttccagcctgggcctctcccttgcatagccagctgcctactcaacactgctattgaggtatctgatagattgctcaacctcactatgcttaaaaaccaaatctctgatcaccctacccaaatgtgctttactcgtaaccgtctccatttcagaaaaaggcaattccatttttccagctcctcaggccaacatttcagattcattttttactccgccctcttttgcgtcatccaatcttgatcaaattctaccagcttcaccttcagaacacacacacactacaatcttccctctcctcactacctcccctacacccatcctgttgaagcatatgtcatcttttgcctggataatttcaataggctccaaactggtctccctgcttttgcctgtccttctgcagtcttgttcatacagtagtctgtagcagtccttttaacacaacagtcagtttgtttcattcctcttctcagaactctccggagtctttctcttccattcagaatataagaccccatgtcctgcaaccactgctgctctgtgccctccacttccccatggctcctaaaccctccacactcactccactcaaccacacttgcttcctggacacaccaaatactctcctgcgccaagccttgtcacttgctgctccctgtgtctggaatgcttttccatcaagtctctgttccttcatttcttcaagctt

SEQ ID NO: 80 - DNA, 4003 bp, Homo Sapiens
acttttcactcatgagattggcagaaacctaaaaagacgatgatattgttagagacagtgtagtgctgtggttcacatccctcctgctctggacttaccagctgtgggaacgtggacaaagtgtgtaatcctctgtgcctcagtttcctcacctaaaaaatgagtgtcaaacccagtactaccccacagagtcattgtgagggatcagtgtttagaacagtgccccatgcagagcacacataagtgtctgccgtgactattactatttagctgacgtacctgaggtgggtgcgcaggtgtagaggaaagacgttcacgcctggccaggagtgtgaaacgtagacagccatttcagagggctcttgatgtttcaaaactttcaaactacatacaagactccccccaaggtgccccctctaaccctgaaattccacctctaggaccctgaatcccttggggtcaaacatgtttcagattttcggaaggtaacttggcgcatatgccccatcctgtgttactcttccccggggtctggggctgccccatgctgtagaccctctggggtgttcagcccacctcaagtgcaactggggaattctggggagtgaaggcccttcgggtaaccctcagctggtagagcccaggggcaggtgggtaagcgcccagcagcctctagtccttcagagaagcaccccacattgctcaggaggtcctagagaagttgaccgccccctcctgcagtgccctctgcagtgacctccgtaacgacccttgtattatcttctcccaacccccgtctcactctccccggttgctccctcctggattctggtgtcaccttccaaaaaaacacctgcactcaagtcctgtctcaggctttgcttttggggaactcagcccaagacaaccccctgatgaaacacattatttcttcagcaagctgcacacatatcacagcaagtgggagaaacaaaagacgctgaacactctcacgtcaatttgggtcaggtttgctggcaaataggtagaagaaaagacgtatggttctgggagcatttgggtttcatggctgtggatatgggactggactgcactctgcggagcacaaaggcaacctctcttgctgagttcactcggtgtgagtggagaggctcccccggccacggactgcactcagaaggcctgagaccacagcagtcaccaggagttgggccctccaggagctgatacttgagtgtagaagatgtctgctggggctcctggcaacacttgggaagggagccctttgggtggggagacaaggccacaatcgatgggtgctcagggatggccccgctgcagaggtgaggtctgagaagggacttgacaatgagaggaagcctaggacgccagcaccacctccacctcgccaccacggcaggtgctcctgatgggtctcagggcgagcgcaccctctgccagtgacaggtcaggtgtgggctgtgaccagtctcagccaatgagacatcagggagggcccgcaggtggcctcgggcccggccagcctggatgctgaggccgacctatgaggctgactcgaggtggggaagagcagaacaggcaaacggccagtgctcaccctgctccctgccaggcagcactgtggatgggcttgtggcccacgtgagactgagcagggatttctgtcacttgcggcagaaaacctcccactggctagcaagcacctggtccatcccaagggacagactgacaggctatggcttgtccccatcatggaacacagcagagcgccgaaaagaaagagggggtatcctcccgtcctgaaaaggaaccagcgacgagagatgtcatctgttctcaaccaggggtaattttgctccctaggtaggttgccaggttaaggaaataaaaatgcagggcagccagttcaagctgaatttcagaccgtgcatgttaactagatgtcctgtatttactgtggcaaccttacccccaggggacatttggcaatgtctggaggcagttttggttgtcactggggatggttaggtgctaccagcatctggtgggaaggcaccgggggtgcttttaaacatttcacaatgcataggacagctgaggccaaaaaaaaaaaaaaaaattatccagcctaaaatgtcagttgtaacaagggtgagaacccctgtattaaatgaaagatagcaaaaaccccataagaaccccataagatatggtaggatctcatttgtacgtcctgtatttactctggcaaccctacccccaggggacatttggcaatgtctggggttgttactgcggatggggttgtgtgtgtgtgtgtttctttttttctttttacacacccaactaagccatagaatcgcatagaaaaaggtatggaaggtcacatacctaagtcatgtggggtagggagtggtcattccttttactctaaataccttctgcagtgttttattatttgtgaagttaattataactgaagtgaatatatacgtgtatacacacacacacagaaagcatgcctatcaaaacaatagatatttcacaaagtgaacacacccatggcatggcctcctgatgaagatgaagaacatggccactgctccatgaggccctttgcagtcctgccagcctctccctcgagggctgcgaggggaactgctgtcctgacttccaacctgctttgggctccacatgaaccgaattctgcccgacgtcctcgcttgagactggcgtctttccctcagcaacgtgtcatgattcattcatgtggatcggagcagcggttggatcattttcattgctgtgaaatacaccacaatggatttatgcattcaaccgttgatggacatttgggtcgtttcccgtttggcaagatgatgaagaaagctggtatgagcattctttcacacgtcttttcttgggcatatgtactcactcctgttgagtgtaaacctaggaatgaatcgctcagtcatagggcaaatgtgtgttcctctttcctagataccattcgagttcccaaagtgcttgcacgggtttacgctgccatccaccagagatgaaagttccgcctgggctgctgcctcctggccaagcctggctgggttgtagcttttgcgctttagtccctctggtgggtgtgtaaattgctaatcactgtgattttaattcgcatttccctgatgatgaagctgagcactttttcataactttatgggccatttgattgtcctcttttgtgaaatgcctattcgggccattggtccatttttccatgaggttatctccgtttctctcattgatttgtaattaagagtcctgttgcaaatctcttttcccgctgtgcggcttcttgccttttccttcgcttacaacgctccatgctgtcctggaccctagcatcacccaggcctaggtaatagaagggtggcttttgtaaagcgactcaaggctgagaagggaacagacactcttagcacaataagctacaggctgaaaaacagccggaggtgaatctttgcagcgtgaatggtctggctgtcttttataaaagtaactcgattggactagaccccatgagggactctgctcctccgctcccctttccctgaggacctaattccccactgggtcagccgcagaaccagatagagctggggactcacgacccgtgctgacgactggatgcaagaggaggaaggactttggtggagagaaggaatcaaaaggaaccaagaatgtgagacaagaggacttgctggtggggtcccctgctgtgtccccagagtcccagcatgtgcctgacacacagcaggtgcctgattgatagtgacggttccccaaaggctgctggagtcacctctgggattctgcacaggctccaccctctggggaggtgtgcttggtagaggacacgaaggctgcttgttggggttaccttagtacctgggtgaagagtaaaaagtaattaataataacg

SEQ ID NO: 81 - DNA, 987 bp, Homo Sapiens
ggcaacctactcgggttcccttccatggtgtggaagcttagttcttttgctattcacagtaaatcttgctgttcctcgctctttgggtccgcactacctttctgagctgtaacactcactgcgaaggtctgaggcttcactcctgaagttagcaagaccgcaaacccaccaggaggaacaaacgattctggacgtgccacctttaagagctgtaacactcactgccaaggtctgcggcttcactcctgaagtcaagtgagaccacgaacccaccggaaggaagaaactccagacacatctgaacatctgaaggaaaaaactctggacaaaccatctttaagaactgtaacactcactgcgaaggtctgaggcttcactcctgaagtcagcaagaccacgaacccaccaggagcaacaaatgactctggacgcaccaccttttaagagctgtaacactcactgccaaggtccctggcttcattcttgaagtcagtgagaccaagaacccactggaaggaactaattctagacatgctagttcccagatcctgtttctctggagaggcctaactaatacatagacaaagccaaatgactttttcccctctctgaactttgatattctttaaacatttccagctagttcttttaatatttcttgaggatttcctgggattttttttttggtaaatactgtatttcaccagctactccttcaagaacatagtcgtcatatgctttattatccatgaagattattagtgaacccacagttcgtttgtcaaaatgactctaaattcgtgatattcagatgatcacactccataatactgccaccagagccaagttattggagttactactttttatgatcagcacaattatttttctatgaaagaattgttggtattaaaagggccacagtagactatttgctattgaatgattgttggttagtacttaattaaaacaaaaatgttttttata

SEQ ID NO: 82 - DNA, 1916 bp, Homo Sapiens
aacactagccgccaggagcgttgcttctcaacctaggattcccgagggtctgtgccactctcatctggccaggagcgccctagcttgagatccacgagccgagagtagggcccacttccacccctacccctttttcccggggaaagggaaaagggaccataggcccgggtggggtagaagctgggggtcatcacctgtttaaagacgctgccatgtcttaccttgatgtaagacgacgtgtcggggactgtctgaaacatcgtgggtagctaagggtcgggaacgcccaagaaccagcctgggagggagaagcctcggttacccgcgagtggagcgagggagagacggtgggatggtgatgaagtggggatgcagatggagagactgtaggggtttgggaagctcagatccgcctagtccggcgagggagggtccgagtggttgggtgttgagcactctccctacgcctcagtcccgtccccgggcttcaggccaggggacggtgagaactgagagccacctcacaccattgggtctcctccctacagtccttttactctcccctgcccgaaatcagactgccgcctcccccagggcctgggcagtttcgaactggggatgcccgcagcttgttctggaaaccaggatgttctagttcttggtgcgtgttgaggagagaacgcgaccaggacagaggaggatatggccaactccctttgtcacctggagccttcaattcaccggaagaaaattgctgaaattggcaacagctgccatgaaacaggagcaagagagaggcagctgggggcagggaggactcattaaagccaacttacccctcaaaagggagaatggggtggggagggggttcttgccccacagttatgctccctcgccagcctataccaagctgcttccctgggccatagatttgcaatgcagagcctgggtagaaagagactctcgtgtggaggttacagcagcaagagattggaatccaagaagggcactccagtaggagagcaggagaagatatctgggcagtgcccctctgaatcatccatgcactccatcattctgagcaagacaattaggacttagcttccttctttggcaaatgagagggctacattatatcatcatgaaatactttcaaatttgaacatgctatacttctgtaagattatttagcccggggaaaggatatgaacataaggcaaattaatgttctaggattaggaactttgggttccagtcttggttgtgctcctgatgacgggcactatgggctgaattttatcacttccaaattcacaagttgaagccctaagctccaatacttcagaatgtgacgctgatgggatacagggccttagaaagggtgaacaaggtaaaatgagatcatagggtgggccattatccactatgactggtgtccttataagaagaggagattaggtcacagacatgtgcgattacagaggaaagcccgtgtgagcacacagtgcaaaagcagccaccgactagccaagaagggagacctcagaagacatcaacttgctgataacttgatcatggactttcagcctccagaacttcgaggaaatcaatttctgatgctccagccacgaaatctatggtactctgtatggcagctctagtaaaccaatacaactgtggaataatattttgccatgatttggtttctccaagtaagtaaaagggaataaacaatggtgactcgtttcactcaacccttctagaacctactctgatgatcagtatctattatgaacccacaatgtgttttgttttgtttgttttgctttgccatgtgtggctttgtgtataaagcaaagcagtgctcctgtctttatggttcttttcactccacataaaatccaaaaccaccctga

SEQ ID NO: 83 - DNA, 2165 bp, Homo Sapiens
agatggccacctcctccctgtgtctacacgtggtcttcactcctcctttgtcatcttaatctcttcttctgataaggacacccaccagtctgaccatattggagccccgccacgtgagctcagttaactgtacctctctagagaccctatttccgaacacagtcacgttctgaggtatgggtgagtaggacttcaacctatggttttaagggggacagaattcatccagtcatagtcaccaagcttccctgaagctctactagtctggcatagagaaatcagagtgaaccaagatcaaaatctgagggcaaccttggctttccccttctacacagaattggatgacagctaggagatggatctatgaattttctcccctgagaaaccagacgggaccacctagagtcggtctccttcccccaaacgccctggacctaccatgggcacaagctggggctcagggaatacctctgtgctccaccactcagcagctgcttttcaagagaaggaaaacactactacacgccatccacagccaccgcacaatactgtatccctttgtcagggataataaaacagacgggaagtcactctggaacttactatggccttgggtcaaaggcaggctgaccggggctggcagaagaaagctaaaacttacttctctgggattctaggaatttcaacaaatgagaccaacagcagatagtttcagattaaagaaaggcaatgtgttcccaaactttgacccctgtgcacaggctctgcagaaaagctgtcactttgcactcagtttccttataggtaaaatggggataataatattgtctgtctgcctaatttgtacaaggctcttacaagagggtatagcacaaagtaagtgcttaataaatgtgagcttttctttgtattcctgtttcatagtatttgtaactatttcacaagattcagaaaccttgtccctggactgtgatcatcgccttttcttcagtcttccattcacagacccagcctctggtgggcagtcacaacacagctggccatgtccagagaggtccaaaaacctgccccaggtgtcaaagcagctaagaaacagggccgggtgagactctgcctgactctttcattctgccaaatctaagctaagcagtgattcctatgcccacctgggaggggagaaacctgaggcccaccttgtaaatccctacaggctcagtgtgcctggcattgggatgggcagaggagacagagggaatgccaaaaaaagagcagttacaaaggacagaccacaggtccaggatgaggggactttcaacggcttgttcgtggttccgtttttgcccaaactctctcgatccacctttgagcaacagtaattatctctttgcctccatcaactccatttaccatccctgtccaattctttcccaataagccagagaataagagtgcagacattaaaggtcagattttcatggtgctgaacccatttaacccagctgtgtggctttgagtaagctacctaagctctctgagcctccatttcctcgtgtgcaaaccaaggaaaatactcacctacttattagaaggaaagaaaagactgagtacctgccatgtgacaggctttcaacaagggaccacctcttgtcataaacaagaggcacatgaacaagtgaccacgggtttaacttgtacacaggtattatgaaaacaacaagtctgcatttcaataaatatttgttatataaatgaacgggactgttcccagagcctgctgcttggaggaagctagggaataaggaactcaaaaacaaggtaagaatgtcagagcagggaagggaagggaggagggagggagtcgtgaccttgggtcaaaggtaggctgaccgatgctggcagaagaaaacttaaacttacttttctgggattctaggaattccaacaagtgacaccaacaacagatactttcaaattaaagaaaggcattgttcccaaactttggcccctgtgcacaagctctgcagaaaagctatcactttgtactcagtttccttgtagatcaaatggggataataatattgcctgtctgcctaatttgtatgaagctcttacaagagggtccagcacatatagtaggtgctcaataaatgtgagctcttctttgt

SEQ ID NO: 84 - DNA, 1357 bp, Homo Sapiens
catatgtataacaaggcttttgggctgatttccttttgtggtgactcagaacgtctcctcaatcattatattgagaataaaagtaaaaccttctaagattttgctcctcaagaacatttaggtcttagtataatgttcttgtagattgcaggccccccactggttaatgcttaccaacatgttcacacttagcttcactattttgcatttttctttcttccttccttcctttcattctttttacttgttctatgaagaggcctaacttgaaaatgtgacatatggcaaatagagaaaattattcttgcaaataaaaatcatccttttaaggaatccctgcatgtgagtatagggcagaagtggcaaacaaggagcccataaaccaaagtaagcttaaaggcagctgttatttgactattgccagaaaataaaaaataaaactatttaagttagttattgacagttaaaaattcaagagattttatatgaacatcagtatttctggcctcttttggaagattctgaatatctggcagccctaggtctgcgttcacgcatgtcaacacctgttggagctctgtagtggctgctgctgttagggcaagcttcgcactttgccacagtcaccactcctccttattacttatacccagcctgctatcctcatttctattctctcctggcccctcctgtagtctttgagtttgccaccgttgaaatagaattttttttttcattttaccttaattcctttttgcaaacctcagcctttggatctctaatactttccttatctgattcatgaagtcagcctactgattgggattaaaagatgtggtgtagaaactgatagtgcatttcacgttctaaaggtgtttgaggaaattggtagtgataatgagttggaatggtgtaatagccaaaatatacacctaagaagaaaaaaagtaaaaactgcttggtgtttttaatttcataactgatttcctattgttttagacctccttggaaggtaccttgaagtattctgtgaatcaccaaagtggtaatgatttatcaggatacctaactcggataaaacccacaagtcttctttttagtgttccaaatggatttagtagcactatctactggaacttagaaaagaaattggtatgattaataaataactcctattgctgtttaattaaaaagataacatctcaataaggttaaaaattaataatcaatgttaacaacaataactgttttcatttttgtatgactggtttttgtttacatgaatatatactttatattgttatcattacattgtttaagccatgaacattatatcacaagcttttccatgttgcta

SEQ ID NO: 85 - DNA, 3054 bp, Homo Sapiens
caccatgtcattaagctaattgaacaggccaacttttctcaggaaggcggtgatggcaggggagcaggtaataataactttggatttggcaattgtcattcacatcctgaccgacctctgccaccgttcttttctggaactactagatccaccagcccctgccaagggcagggatgataaatgctatgcatggggaagaattattcttgctaatgatctccgccttagaaaacctcagcccctgatgagaccctcagttcatctttctacatttgttgaggcttcaaccaacagaggcaacaagaaagccatttccagcaacaagggcctgcctgtgtcgacagcaatcatgtagaaaccaaggctcagatgggataaccgacttttccaagtccaacagacagtaaggaaaggaatggcgagatcaactcagatcttctcttagccatgctgagggtaatcgccttgcaattacctcttcaatggatattccttgcaagaattaaaactctattaggctttttccaagatagctccttccagaactcagttcatccaggtcaaaaaagcactggaaggtaaattggcaaccactcatcatatcacatgatgttttccaaaatgtaagactgtcccaatcaaaggagctggtagcaaacataatgaacgtcagctgagactctataaaccaaaaaagccctgggttgactgtgttcatgtgacttcaaaagagggtaatctgcagggggtgttcctgcagggcctactttgcaccctttgctaccctttagataccatttgacctcattttcctctctgtgtgatggccaaaccacaggctccctcttctatctggccccatgagcattaatcaacttcaaccttccccaagacctggcaggagagatgcagtacctacttcttaataaactcaaactgtcattgaagatgaaagatgagactgcaaaacttcgagcatcccaactccccagcttgccaagtgctgggaatccggaggggagtgccctcgaggacaggtctctgtggatggtgcagaaaagtcagctagctgccttctcttttttcccttctctttcttcccctaaatgctccctcagtgataccactgtgtctgcagtaaagagagactgtctagctgtttctttttcagcaagacaatttggtgtgtggtctgtggtgcccacacattcttctttgcaatgagtggtgggtgaacagtgttttccaagttggatgttacagtaccataagtagaaacagatctcccggagctccgaacactttttctgcctgagttgggaggatcagcaggctcctgtgtagatggcccagcagattccttgggagcagctttgcagcatttccccactcactggccctcaccaatcataatgaaagctcaattaggtggtggacttccacttttgtaactgccaggttagttatagcattacacgttcatgcaagatgaagctgagatatttggaatcggtacatgtaactatttaaatgaccgggatgctaactgctctctacacattcccacccccaaacccctttcaccaagcagctggtactaagtactgtttacagagagttttcaaaaggcaagtcactgtgctaagcattttacagatattatttcatttcaccttcacaacaatcctatttgatagatttttttttatcaagaaggagaaatttgaagcctagagagactgaatgatttgcataaagtcatgcagttaatgagtggcaacgtcaaacttgaattcaggtctgcagattctgaatatcactcttcccacaactacaaccttaccttttaggcaaattaataaataagcaagcatttcctgagcacctactatacaagaggttctgtgctaggaactttcacatccacctaacaacaatcttgatttttaggggaggaaactgaaggcctagcttgttagcactgtcagggccaacccaggatttgatgtctatttaactgtaagatcattccctcccttccttccttccttcttccttccttccttccttccttcctccttccttccttccttccttcctccttcctccctccctcattctgtctctctctgtttcttttcaattaatcatgtatcaattcagctaaggttagaatcttatctttgcattcataagagataatttatacattatgcctacctcagtatttggcacactgtatttggaggcagttgaatcatgttaatctctgcccccaaatcacctagataagttttttattgctacttccctccctggtaaatagaaaagagatgctctttccagctacctggtgagaagaaagtctgtccaacttggctcgtgtttcctctacttggggagctgtgccctgcaaatggtatagcccagccccttcagggacacttggaagaactgatggcatcatgtcaggactgaggtctcctttcttgtagtttctgaagaattaatgaaaaggtaaactttgcaggatctcaacacacaggctttgtttttcccttacttcttgttttgcaaagaaaggcccctgctggccttttaagcccaaggaaaacttaacaaacacttgctgcaaaacaccttgctttttaccctgcatcaaataacctcccccactccagagatttgcgttccaatctctgcaaaggagcagcgagaggaagcaggatattgagtctcattaagtttctttgctgtgtcagtcatctttcccagagggggatgtaatattctcttcataatattcagcccctctcacaagttggcagctcctttctctcaacttatattcttagctaagaatgtgttcacagggattttttaaaagcctccccaaatacctgtttactgactttctcagagcgtttctgagatggcacaaggatgtgtggtctctgaagtcagcttcttcttgctaatgaggctcagctcagcacctctccccagcactccaggcaggggttgggggagcccgctctgcccctcttcctgtcc

SEQ ID NO: 86 - DNA, 2918 bp, Homo Sapiens
aggaaacacatttctactgtttaagccacttggctgggagtacttggttatggcagcctgagcagactaaaccagcacctcaaagagttgttatagggtatgcttagtggtaactggttcctaaaggccttgctttctaaggctgactcctcaccctgcaaggatgcattctccccactggcagatatgcaaccaggaacaggcattaacacgctttattcccagagttttaatattttccattgcataaaatatttgttcatgaaaatgacaaaattgctattagattctatcaccacatctctgttgattttactttctgcaaacacatacaagtaatgtaggcatacagttaaaaatgaaaccttatcctgtagttccagctactagggaggctgaagcaagagaatggcatgaacctgggaggcggagcttgtcgtgagcccagatcaggccactacactccagccggggcaacagagcgcaactccgtctcaaaacaaacaaacaaaacaaaacaaaaaaaacttatagacaagtacaaaatgagaagaaaaagtccctttcccttcatgcctctacttcctgctgtattctcaaaggtaagcactgattacagtttacttatggatctttccaggaaaatattttatgcatttatcagaaaatgtaagtatatgcatcctttaaaattctgcataaatcaaactctgcagggtactatcttcccatcctcatttgatattttgtagatcttttcctattggctgtacagatcacctcattctgtctcctgggtcatacaatatagctcacataattctaagtctgaaggttggtccaaatggttccaagaatgcaggtaccaaaaagtagtctcttgaagaggccatcagagacctggctgtttgtatcttcctcctctgccatccacagtgtcatcttcacccaaggtggctggagaagctgttaggaatatgtggttttttaaaaattacattcataggaaaaggggagggaagagaagaagaaaacctctccccctaagctcatggctctttttagtcaggctgagccaactaaagtcatgtacttcccttagataggtaactgttgccaggaaaatgccctgtgtggattggcctggactaagcaggatcctcctctaaagagagagatgagatgaatgcctgacccaagtctgggatcttgggtgggaagcgtgtggatagtaggtcagaggtcagcagtgtctgtggtgtaggatgtaatcccatctccacagagctgcatacaagtgtgtttaagtgtgtgcaagtgattaactttgattagtagtttcaactctttacaatgaacatatttatcttttttaaaaaataaagccattttaaaagatcttgccataaaacaatcattccttaagtcaccacttaggatagacctagaatatttgtcctttctcaagagcaccagagagttttctggtaatccacgcaataaacagttataaaaggtaattgttgagatcaggggaagatggcagataggaggcagtgctaatgtgtagctcccacatggatggacaaaacaccatgtggagactcacactgtgaccctgttgtgctccaagaactatcataggaacatactgggaaaaccaaaagaattcacggatcctttgaaagaagacgcacaccactgtaaattctgtggaacaggagaaaaactgtcttggaggaaggcatccttctattctactgatcagaaagctggacaaagtcccactgccaggctacacagttggtgccatttgcggaggtgacctttgacctttaacccacgcggccacccgcccgagctcttacccctgctgcccctcgcgcgtcccactccccgtccctgccggatccgcttccctgcgctgggcccagcgcgccgccagggaaggggccggagcctgggagcccgccccgccgtcgcccgtcctccgcccgcaggcccacccgcagcggtcacgtgaaggaccgagcgccgcgcgcccaggcggggcctccggcctgcacgaggagggcagagtccgttgcggctgccgccccgacgcccgcgcatccccgctcgccgcgcccgccgccgcgatgtccggggccggcctagccgcggtggtgagctgcctgcgcccgcagcccggcgaggagccgcagacccatgaggaccttctcctggcagctgcctatgttttggatgcccagtacaacagaaatgttccatttgaaactcacctcaggccatcagacgttactatttttataaccactagacaacgcaggttgccgcatacttctttatttgtgtagacctcgctcttgccctgtttgaagagcctgagttgcttcccctgcctttcttggccacctcaatagcagaagtactctgcctgactgcatactttggcagactggtacattttgcaaaagtcactcctcaaatggttttctggaaggatacaaaagacatctgcaccatggtaaccacagtggcgagtgttcattgtagtacctgtaagagtttatgaccgaaggcaggagccatgaagaaaaaagactcaatagatttgcttttgatgaaacaacaacacttccatacagtgaacgccataagcacaactgcaagcaaaccgcaaactgaagaacaaatagggcaaaatgtggcagtgcagacatttcagcatatcaagagcacttccaaattacaggaaaaaaaagatatctcaatagataattttgctgaagataagtgaaggcaactcataaggaaaaaatatgtaaaatggccgataggaaagatgtttaacgtcactaattaaaaattatagaataaaacgacaataaaataccatgtgtttgcctataaaacaa

SEQ ID NO: 87 - DNA, 1398 bp, Homo Sapiens
ctatggtctgaatgtctgtgttcccttaaattcatacactgacgcctaatgcccattgtgacagtattagaaagtagggcctttgggaggcaattgggaggacctcctttgggaggtcatgaaggccctaccctcataactggtattacgaagagacatctgaagagctagttagctccttccaccatgtaagaacacagcaagaaggcaccatgtatgaaccagagagcaaaagctctcaccacacaccgaaactgccggtgacttgatcgtgaacttcccagcctccagaactctacagagcagcatctgaagagccacggggcccccaccttcatccctgagaattttaggagccagcctgcctttccaggtgacactggacactttcatctgagaaccctgtcacatgacagttgtttcctttcttcctcctctcctgggaatgctgctgcttcgatgacccaagagcctaagaagggtagctgtttctcaatacactgagagagagttctttctccgtcctgaccatcttgggacccgatggcaagactggaaggatttatatctccttttgtacagaaaactgcctccccatgttggtttgtgaagtgaaatgcatataaaacagaggattccagactctcagaagtcaatacataaataaataaaaataaaactgagaagatacctcaaaatggtcagactcattagcatcatccaggtgtattttctcttcaaacagtgtcagtgggtctctaataaagagatgagcaacatgctgggccaggagatgatcaatgcctgcaaaaagagatcacatgggaactcactgcaaagcgagagataccacttcctcttagtccagaaagacgacaggatagctcaggaagtttgaagaaagggtgtctagaagcttgaaatagctggtttgattagtatcctcacctcacccagtattttatcctgcggacactgcgggagtgtcagcgttttattcactacttacacaatgcctgctggggcactggtgtggacctagacacagacctccaaagtaagctccttttgctaaaaatcaagaaaatctcacaagtatttggaacctgaaactttaggaacaagtagcctcatgagagaagttaaagactttgcactaaaaatagaaaccagaccaggagtcagcaaaaaagtgtaaaagagctttgaagaactaaaggcgtacattcaaacccagaaagatggagtagaaacccaccttcctgcaacagctgttcgtagatctctttatctatcgtcaagtcgatgtcattatatttctcaccacacttagataaatagctgtctattgagtcatatcgggatttactgatcctatagttattgttcttcaatggc

SEQ ID NO: 88 - DNA, 4422 bp, Homo Sapiens
gttttcaggcggcctcctgagaaatgtttgcaattgtaaggcgtctctctcatccaggtttacccagattcgcaaactatggcgacaaacaaccatagcagaagcatgtccggattatttcacatatatcacaaaatcctgcaaagggtctgtccccattggatcacctcccatcacgccacacacgacgtgaatgacttcgtgcttctccatacctgcattgatctctgggtccattgccagttataaacctccaagggcaatagccatgaggtgatgtacagtcaagcatcacttaataaccaggatacattctgagaaatttgtcgttaggcaattttttcattgcacgaacctcacagagtgtacttacactaacctagatagtagcatccagtaaacacctgggctatatggtctagcctattgctcctaggctacaaacctgtatagcatgttactgtactgaatatgtaggcacttgtaacacaatggtaagtgtttttgtatctaaacatatctaaacataggagaggtaatgcattgtgctacagcattacaatggctatgacagacactaggcaataggaattttccagctccattataatcttaagggaccaccatggcacatgcagcccattgttgaccaaaagttgttatgtggtgaatgactataattggcttttcagagcaaccactcacaagggggtgtagtatagcttactagacaaaactgcagccgctgctctgttttttgctcttagaaaactgagtacctgatttggacaaaatcataataaaatttagatagagccaacatttgtcctctggaagtttctgacaagatacaagtcaccgttataatagtcaaatgtcaaagtggtatatctaacaaaattaaaacagacagctaggagtgagaagatttaagaaaattcaggtggcccaaaggaaagccaagacaagacattctctcccggcctttgggcctggattttcatttcagcaggtaacgaggagaccaaaggcctagttatttatggagatctggggccacagcagagctcctcatggcaggataaggcagtggaaagcagactcaacggttaacccacagtcctcctcagcaagctgggagaagcaactgatgccacttagatgcttagaccgggccttctgggagagatctggcccaaggagcagccggcagcttgacacagtgaccaattggaagcacagcagccacacgccatgaaacaaggtgatcatcttcactcatttcctgaggccagagccttccttacgcaggacatggataccccagtcccagctgtgctgaagcgtcaggaagcctcccccgaccccaccctgaacaacagtgaggggggttaggtgtcctcaaaagatctactctgtcaactggagttgttgagaaactcaggaaagggaactaaaaaggataagaaagtggtgcattccagtgtcttcctgttctctgttgcagagagccagctggtggaccgcagagacagacttccagccagggccaagcccttcaggaagggagtcatgcaccaaactcagctaacagaccaccagggcaccactgggtctcctgctggggaacagcacacctatgggtgggctctaggggtggggtggcctggttgctggttctgctctgccacttcttagctggacttgagcaatttgtaacatttcttggctcagtttctccacctgcacaatcaaaatatcactaccttcctccaagattgcattaagtgtgacaatttatgtaaagcacttagtccagtgcctggcacctagtaagtactgaatagtgaaaacaatttaagtctaacaaatccacacaccatgacgtcagacaaattaggcatctttcattgctgttgtgaaaattgcgctaactctaaactctaacgtacatctggctcactgtctttctgtaagaccagtcagagcagcagctccttccttggtaaaatactttaaaaaactcccattcctggctgggcaccggggctcacgcctgtaatcccagtagattgggaggctgaggcgggtgaatcacttgaggtcaggagttcgagactagcctggccaacatggtgaaaccccatctctactaaaaatacaaaattagctgagggtggtggcagacacctgtaatcccagctactctggaggctgaggcagaagaatcgcctggaggcggaggatgccatgagccgagatcgtgccactgcactccagcctgtgcaacagagtgagactctgtctcaaaaagcaaacaaacaagaaaccccaaaaactcccattcctgggcacccattctgattttcttcctcatttacttccctgcccaatcgttgtctctatgttgcaatttgtgggggtcagtcagaactgcttttcttcagaagccactcttacccgttcagtgacctcattcagctcatgctagggcagaatccacagctctttctctgacgtttccacagtgtgaagactcacacatctaactgcctgcagaacatctccacttggatcttgttagattgtgtgggtttcccagaaacagacaccaagacagagtttggggcacaagataatctattagggattaacacctgtgaaaggaaggggctggaggcctatttggcagggggaagaggtgaactgtgatataggcctgtgggaaccttagacaatccagcagggagcagggggaagggagcagggagctctgcagcgaatactgcccaggacatagttcctgggctatatggcctagcctattgctcctaggctacaaacctgtatagcatgttactgtactgaatatgcaggcacttgtaacacaatgttaagtatttcatcagaggtgccccgcatcaggccaaagtggcccagcctttgtgccccgacttgctcagtcatggatgcaagctgccttaagaagggtgtgacctcagacaaagtggctttctgcaggccagttgtggccaggtggaagccatctaccaacttcactccccacagctgagcaagtccctccttgaaggggatctgggtggggtgtctccaagtttgctagattatctcccagccatttcaaattcaacaagtccataaccaaacccttgattttacctggctccccagtgtccccttcccactctttcttctcttaccactttgctcaggccaaaaccaaagtcccagcctctcttccacaaatgccccttggtcaatctatctacacatatccttccatcgctcccttcagaatacgtccagaacccaaccacttctcatctcctccatggttcgacccatactcagccacaccccagcaccaaccccacggataatcgcagtagctccatagcttcctacctaagcgttacccctgcccacttttcttgctctattttctgcacatgcattggcgtgaaatattttttattttattttattaaatagagacagggtgttgctatgttgggcctgattatatttttaaaaaataaaaaagggccaggtgcagtggctcacacctgtagtcccagcactttgggaggccaaggcagtaggatcacttgaggccaggaatttgagaccagtctgggcaacataatgagatgctgtgtctctgtttaaaagatacatataagtttaaaaaatattttcatttatatacaatcagatcgcctcatatgtctgctcaaagccatttggtggctcccattcatactcagaattaaacccagattccttactgtggcctatcagccctgcatcattctgtccctctcctcaacatgatcaactattgctcttccccacatgacatcctactccctcatcactctctaaaccagagctgcccaatacaggagccaccagtctcatatggctactgagcaggtgaaacctgtggctagtccaaattgagatgctgcctgtatcaaatacattgtttcagacttagttcagaaaagagaatgtaaaatttcttttctgtttttttgagacaatcttcctctgttgcccaggctggattgcagtggcacgatcttggctcactgcaacctccgcctcctaggttcaagtgattcttatgcctcagcctcctgagtaactgggattataggcatgtgccaccacacctggctaatttttgtatttttagtagaaatggggtttctccatgttggtcaggctgctctcgaactccttacctcaagtgatccactcaccttggcctctcaaagtgctgggattacaggcatgagccactgtgcccagtccaagaatctaaaatttcccattaataatttttaaatattgtttgtaaattgaaataatatatttaatatattgggttaaatg

SEQ ID NO: 89 - DNA, 1875 bp, Homo Sapiens
atctcttcagaatggcactggggaaacaaaaagattggttggccgggaccttcaacagtatcagagtcaggctaagtaactctttcgaaagttgaatgaacagtcccctaccagatgtaccttggaagcaggagccatgacttttcagtacattattgagcagggggtgtgtgatttggttttatgtgaagctgccttccctaagacgttggcttttgcctacctagaagatttgcactcagaatttgatgaacagcatggaaagaaggtgcccactgtgtcccgaccctattcctttattgaatttggtactatcctgattcctggtaaggaaaaatatattatttccttataacaaggcaaggagaaatgctattttattcctgataatttatatagctagaataatttttttcctttcttttatggacctaaatctgccaattgggaattttgtgcatgaaatatgaagttactttttatagataatcagtgcttttaagtccctaaaaggctcctgctgaagtaatgatgaagttcataataaaagcctttgaaaggctgaaaacctacatagtggtaccatagtatttggagcttctataggagtggagaggggcagctcattgttgagagttgcatgctgcaacctaatggtcagcaatgaaagaaatacttgtagaatgttcacttcagtgtgaagttttgttatctagttaatttatatacatatatcctttgtagatacatttctatctaatcttgttgagctaattaagaaataaggggtggggtaattgtcaacaaagggagaagaaagtggtttaagatcagggcagcagaaaaattagagaacaagaatatcataatatggctcctggttttctttataagaggcagtgggaagatctgactagatgaaatgtatcatcaaccaaactggcatctaaaatagaatgggataaatactgtatggggttattggaggcatattaagaaaggacacctaatttattttgggaagaagtatgttaagagaagactttctagagaaggagaatggggcattctaggaagagtcaatggcatgtgcaaaggcatgaataaagacagtgaggcatgttttggaaatgtaacagcttgattcagcttagcccatagggtaagcatagacaacagaggagacttgaggaatgagaactagatgggtacactatcataaagggacttgtctatcatgctgaggagtttagaccatcttaatggtagtggccaaggatggcatcagatttatagtttcaagtgatcataatattggcataaaagatatattagggaggaagcctgaagtagggagatgaaaataaggagccatcaaaggcagaatgaaacttaggcagatttcaagtgattttcaaaaatgatgtgatcagaggtaccagataataactattacataacactttctttgttaggagcttatttctcacactgaccaaagcttttgaagtaagtactctttacaccactatataaataaaccttacaaaggattctgctttgaggcatgagagagttaagtcatttgcccaaagtcacagagttagaaagtaatagagctaagatttgaacctaggcagtttggctccagagtctgtgctcttacactatattaccaccaagaggtcaaataaataccaaagaatgtattttcgaatttaacaatgaggaacttaatcatacaggcagaagtaattccagagcaccggagacagaagccagattgccatatgggttaaagagtgtgtaaaccactaggaagtaaagacatagaactactctcacaagtgcttttctggttattgtgacgctgaa

SEQ ID NO: 90 - DNA, 1477 bp, Homo Sapiens
gagctattactaacttctccatttgattttttatggatgtgaaaaatgctgctacttgtctatgttattatgtggtatttgttctcttggattgaaatttatgcccacagatttttcttttcatttgaaaatgaatgtgaagatactgtttacagcttttgttaattgcacttttcatcactctgatcaatttcttgtaaagtgctatgggaattatttttcctgtgaatattaatgattttactactgcctccgaagttttaaaaaaggttctgtagacagaaaacagttgttgcaaccaaaaacaaccaaaaaaagaaaaaaagggaaaactggcttacctttctcagatgaattaaatgattttaataacttcccaattaccagggttataacattgctttcttcagttattaatacagtcaaattaattttaacaatataggcacaattcatttacaaattcagtacagtagtccagggctacatgtaagtggtctctttattttattctttacatcagaaaaatcatgaatgtcagttttgccagtattttacaatgaggcttatcgtttaaaattttatagtgtatgacatgtaaataaaccagtatttattgtaggttgtttgattcaggcatttcaaatggatataggttaatggcaatggaatcctatttatttggtagttggttttgtttgtttttgtttatttacttttgctatttgttttgtattgtctaaactttgcttcaactgaagacagtgtaaggagttgaaaatacaatcaacatagcaatggaaagcaatgcaaagagggtaaatcttgttttaatttttttaactttttttttttgtaaataaatagtactgtgatactttaggtgtgacctctattccacatgatagttagaaccagaaaaacacttttgctttctagttatactattggttcattgtaaatgcattaccaaaagacaatatgaaaaagagcaagattaagtttttctaacattgtccacttcaggggcaagcatgcttggtatagagctctagcttgtgtataccttaaactgtaacttgcaggtgtttttcagttgctgcactttttatttaatcttgctcagtcccagtaactatctcaaaggtaattgctggaatatgcattttgaaatacggtttaaaaaaaatctgtgtattgtttcatctaaaaagaaaagcactattggaaacactaaaaacgtgttaaactttgtagttattttgcattcctgtactttacaaactgtcatcacagcaaaaagtttaaaattaggtaatgaaatatttttgtaaataaataccgttaagctggtattttaaaaaatgtattataaattaattaatgtttctggaaaatgttcatatatatgtatatgaatgtctctttatgctgaagggctctgattgggcaaaataaaatactctaatctctcctg

SEQ ID NO: 91 - DNA, 5834 bp, Homo Sapiens
actccgcactcttaggctgcgtgtgaggcctgcgagtgctcgggagctgccgcggtcacaagagaaagcctagctgtcaatgacagccccagagcatctgggcgccttgcgatacccgggtgtctgtaggcagccaggagacacttccaagctgatctggaatctttcctcgcccagctctgtccctcgcagggatggcaaaggacattacgacctacatcccttcccggatctgatggcttcagattggcagattgtgttaaagtggaaggctcgtggtgcccctttgctgagtttttatggacttagttttcccaagtagttctaattatcgctgggggggtggggtggggcgggaacgtaatttctgcgtctgcccttaaatacctttaaaccttggctgcattgccgcttttatggaatttcacccatagtctgtcttttttagtttccctgatacgcatctttcttaataataataataataaataaataaatagcactttgggaggccgaggcgggcggattacctgaggtcgggagttcaagagcagccaggctaacatggtgaaacctacctctctactaaaaatacaaaaattagcggggtgcagtggcgcgcgcctgcaatcccagctactccggaggctgaggaagaattgcttgaacctgggaggcagaggttgtggtgagcctagatcacgccaccgcactcgcactccagcctgggctacagagcgagacttcgtcttaaaaaaaaaaaaaaaaaaaaaaaaaaaaaaaaaaaacaaggcatgtggccagtattccctgcctatacttgttttctttagaaaaatgtaacttttaaacataatttgacttgaaacggtttctttccaggatttatcattttttataggtgattccagttcaaactatttattacattaatatgttgacaaattgtcgttgctgaacaaattttttatgtgcaatcatacggaacattttatatttaaggatgtttatatatcaagtatataatcattggcagaaactgggcagggcgcggtggctcacgcctgtaattccagcactttgagaggctgaggcaggtggatcatctgaggtcaagacttcaagaccagcctggccaacatagtgaatccctgtctctactaaaaatacaaaaaatagcgagcgtggtagcacgcacctgtaatctcagctactcgggagaatgaggtgggagaatcgcttgaaccccaggcggcggaggttgcagtaagccaagattgcgccactgcactccagcctgggtgacagatccagattctgtctccagaaaaaaaaaaagagaaagaaacctaagaaagctatattgtttatactctaacatttctaacatttaactacatttatccattctcaaaggaagttggtcatcacaagattggaaaatctgtacttccctggcttatatgacttaatcataaatgtctaaatttgacagatgtcccaggaaagaaaacttataaaactactctgttgcattctatgtgtttatgtgacatttgagatctgcatattatacatagcaatctggtttttaatataatgtagagagactgaaaaagttttagcagtttagctgccactttagctgcttaaagtaatatatgcatcatctgccccctttggtggtagggatgtcagattccattctctgtagggtatttcatacaaatctgttagtcgctggaggaatcagaaactagacacacaactggtccacctggctgtctggtggcagcagaggaactgggatttccagggcaactgacggggcgataggacagggcagcagggaggaaatctggggacgtacataagatttaggtccaatacaagcactgtgctttaaataccattctgattctcatttatgtttaaccacctttatatttaagatctatccacattgccttcttccattttattccttcagatttctacattgtattacataatatatgctgtcttttactaactgattcattttgtgataagcatagtttgcctacaaccttttactaacttaatgcattgtctctcaccccaactccattccttaaccaagtctgactggtcaagaaatatccaacacctggtatcaacctgcatcaacctgcatgctagcaaattagcaaataataaatgcttttggaactaactggtttatggaggtcctcaaaaactgggtggtgtgtttatttaatgctaggtcaatttggcaaaaataaatgtacagaaagccatttccagaacaaaaaatgtcagaatacaatttgccaaacaaattttctaaattactaatttgatgaattgttgaggcttgttaaaaaagtttaagccctactaatgcctcagccttgtctgaggcaagcccaggagcaggggcagagcgtgagtatacaaaaagtggggaactgcaaactccacttcagaaaaacttcacctatttgtgtatcaaaaggctggggtaaatgcaaaactaaagctctgaaaaactctatttgacaaactagctttcaactgctagtaaaaagcctagatattggccaggcacggtggcttatgcctgtaatccaagcacattgggaagccgaggtgggaggatcacctgaggtcaggagttcaagaccagcctggccaaaatggtgacaccctgtctctactaaaaaacacaaaaattagccaggcatggtggcgggcgcctgtaatctcagctacttgggaggctgaggcaggagaatcgcttgaacttgggaggcggaggttgcagtgagcggaggttgcaccattgcactctagcccgggcgacagagcaagactccgtctatttaaaaaaaaagcctagaaattaaacaaaactggttttatttcataagatgtttagagacaggcaatggctggtgttgggtcagcagctcaacaatgtggcaactggcatcttcgtggttctcttggcccttcgtcgtggttcaaataactcctccagctccagtcatcactttggtgtttatggcagtaagggggggaggaggtggcctagctgcatatgtatctttaatcaggaagtaaaagttttcccagaattcccaaggccaaagctgtgtcctgaggccactgagagttgttagttgcaacagaggctgaaaggggagcaattagcttttctgggttctttagtgaaggcaggtaagggagaagggggttgggaatggctggcaaattggagcaccaacattacctttatggataatttctttttcaaaatgggcagctgatatgtgaagaaatatctaacaacaattttaaggttgtaatttgaaactcagttctgctttcaatcatgacatttttaacagatgcatttcagctatactattttttcttgtgccccactccccaacattctagaatggaactaaaataaaattacttaatctttcaagaaaaagtgggaaaaaaaaatcaaaaggccaacagtggcaagatactttcaactactcttgatgtcattgtccttctacaccaaagaacatctggaaaacatccccacatcctttggtgtttaagaactgatagagctgaccaaagtccatgtggtttcccctggctccattaacactgaacactttttcttcaaaaatggaaaatttcctttgtctttccgtttcatcatttgtaccatcaaaaggaatgtcttctcgatggcgaattaaaattctcttccagtttaattttctgagtctgaaaagaaatttccaaagtaaacattttcaaaatgtatattctagagcatttaaaacagaagttataaaacagatttatcaatgccttttcctagaagtagtctactttttaaaatgtttataacttttacttattgatttagtagaggcaggtcttgctatgttgctcatgctggtttcaaactcctggctgcaagtgatactctggcctcagcctcccaaagtgctgggattacaggtgtgagtcatacacaccccgtccaagaagtctacttttatctcacagggatttattttaatcaaatatgattctggtcataatctcatctctgaactcatttgttgcccttactacagccatgtatcagtagtttagaaatgtaggaattactgaatcccaaactactatggaccttctcagaaattcatttagtatatcagtagagaaatgagactagtggcaattctaatgcttctagaaagctccttacttcacagggtatacagtttgcagcatcactaaaatgagggaaggaccagatccatggaagtggatggggtcatagtgtctggggcaggagctcaattcattcagtgcatatttacagaatgtctcctacatgcacttgtcaggtgacggggaaaatgctgactacatgtgatttctgccatatccatcaacttgagattgaatccccataaagacacaacccctgggacatacttatctccacatctctaatagtcatgtgttgcttaacaacggggatacattctgagaaatgtatctttaggctattttgttgttgtaccaccacgacagagtgtacttacacaaacctagatggtactttttttgcatttatattttttcatatagaaaaccaaatgtcccagcaccattactgaatatcattctgatattcaatagtgggaagatcaagtgccatatatcaggtttctatatgtgctccattataatcttatggcatcactgttttatgtgttgtccactgttgaccaaaacgtcactaggcagcacatgactgtatcttgtttagtattaacattattgacatgacttcatatacatatgtaaaagcaaaccttgaccagaattcttcacaggcactttgtgggccttccacacaaacaacaccaggttttccaggcatgctaaacccagacagggaaagctcctttgcccactctagaatattctttcttttgcatttgttatagatatgatggctgtagatccagagtctcgtgaagatgaggtcaactgactggactgtgcttcctgtggtgggtgaagatgaagtatctctgctgacatagccagaggcgtgttctctaacccactctgtggcattcagtatacaaacatctccatgacaatgtttttgcaggaatgcagtcagatctgtgttcagctgagtctgctgggatctactcaataatactgatctaatagaaaagatacaagaaaaatattgtcttggaacagaaaacaaattcgagaattgcttttattctcagattaattttgacctccaaagttggccagagcttctgtaacgtacctgacagtaatttcaggcagaactgccgggtatttaaagggaagaatacaggccagagaaaacatcgcctgattaaagagaagaagaaaaagtgcactaaccaatgttttaagtctcaacatgtttcaatccctctaaaagcaaaactgaattaccattttttcgtcagatacatccaggttcatattgatagtaaagtagacttttgaagatcgcccctccattgtcttcttttcaatacaatctttcagttctgctacagccagctggtcattcactatgagctcattctcaccagggaacatactggctagcaggtctaactcagcaagctgggcctccgcctgctccatctcaatcatttttggacatgtgtaagtttctaaggaggtaaagataagagagacaatttacatatgcaatcttggaagaaatgaatacatcaaca

SEQ ID NO: 92 - DNA, 1077 bp, Homo Sapiens
aggaaacattagttaaaatttaagcagaacattcagaatcaggtcagctcgtgggtgtggacctgaacacaggtgagcccgtggtagcagcagaagcaggcattatgggataacgattgtgtaaagaaacagcttcttcattcctgcactgattgccaccaacattctcttggttgatgagatcatgcgagctggaatgtcttctctgaaaggttgaattgaagcttcctctgtatctgagtcttgaagactctgcaaagtgatcctgaagaatacagctgtggaatttttgtccaagcttcaaatgagtttcaagggaattttcccatgtgaaaaaaggagagaacactggcatctgtggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaatttctgagtaaatttattgatcagttggacttttcacgcttttgaaatagctttgctaaaatgctccccctacaaagttgtaggaaatgggaagaggagtaaactagaggcaagggagttgagagagctggaaggcatggtggctaagggctacggttatcaggtgaaatttgagatttgtaggctgactatattttcaagcttctgaacttttgcttatgcaaaatattcatcccaaagcctctagcgtcatagtttcctcacccaaattactatgtttccacaagatttatatagttggtctatctctgcggtccttgaaagtgaagttggtgttactaggctgtgggttttgggggctcagcagtgacctggagtgtgcaaataaatgttaagttgaa

SEQ ID NO: 93 - DNA, 5177 bp, Homo Sapiens
gtctgtttcctcagaacaccggtcttcaccaaaggcgtgggaaagggcagagagcacaggacatattctggaattcaggtcaccttttacatctgcctggagttgggtgagcgcctcacgaatgactcggcaggactgactgccactgctaaccaggcggatgcaagcaatgaggaggacctgcccaggccgggtgggtgtctgctccctccctctggtccctggcacatctctggaccccctgccctgctgtcggagagagatgacgggcaacggcgtattctcagagacagggcctgcctgcaaatcctttaaagtcaatgggatgaaatgtatacccattgttagaaaaaaataggacttagcaagttgagtgcaaataactgatgcaagactgggatggagatgggaggggtttggggcaaaagcagaagtctttctgggtccgcaccagctgtgaaatacctggcttgttgttctgtgcctgtctccagcacccaggcagggctacctgaccactctgctctctcagccccgccctggctctggagcgagcctgtggaaagggggacacttagccaaggccccagccacatagcagcagcagctgcgccctctgtcagctccttgcacctcctcactgggcctcctgcaaggcacctgctccactccaccactatcacctgggtcctcctggccttggcctggcttgcttaccttgttatcaagtcctgaatgggggaagcaatattccttctccactacaaatcaccacagtattcacaaagaattccagagaaataagaacagagacatcagaccacactgagcactcaataaagagaaaattcttcaaaggtagctgattgatgagagtttccacatgcagatgggacaggcactgatttgtgcacaagaagatcaacttgattgaatccaaaataaaggaatgtgtgtgtgctgcatgcacgcacacacatatccccatggcaaactcttgctatcccaggagcgcagaccgcatgtgaggatcctggctccttatctcccctccccgtatctcccttccctgattacctttgcgatctgcacacaccagttgagcaggtactgggagccaatattgtctttgtgttcccggacatagtccaggaggcagccgaagggcatgagctgcgtgatgagctgcacggtggaggtgaggcagatgcccagcaggcggcacacgtgggggttgtccacgctggccatcacgtaggcttcctggagggagggagaggcacgtcagtgtggcttcgcatggtggccagaaggaggggcacatggaccccttccaggtgaagacgcatgaatgcgatcttgagtttcaaaatacgtactcatggaggaaaagctgtgcctgcaaaagacctagcacagggacgtttacgcagggctgtgaagtgacagatgcagtgggagagggcccctcctgggtgcatctggggattccccatgacagagaggcccaggcaacagtggccatgaggagcacattggataaaggaggagtcggagtcacctgatctctgagtttgggaactgatagtatctttgttatgaagacctccgcctcaaggttgaggatgctgtgttttaaaatatcatgagggcctgtaggaatctgtgtggggtccggaacaccctgggtaatgactgaccctgcacatcaggaacgctggctgtgggtgctgcagaggacaagcgatggagaaggcatccggggagcaccgagccagcagggagaaaggcctcccttccccacaggccaggcttggccctgactgtgctctgggaaatgggtgggcatttgggctggggaccctgcccacagcacctctgcaaagagtagctggataagctctttcaatagaccagtcccaggttttgaaatggacagagcattcaatctacagtgactaaaggctgcctggctgcccgggacccatttctaaagagaagtggtctctctgtgctgtgcccccaggctccctatgggaaatccatgctgcactgagtcaggcatctgctgccctgctaattccggctggctgccaaggcaggggccttcctttgacagagccataaatacagactttattttaacccttctgctattcttgggctgaggaagctaaatttatttgcaatcaggcacacaatggggccctcttttctgtctgactgagaatgagggaatccccaatttccacccataaattctctttctctttaaaatacaaatggtggtgaccttttattcagatatggaaaagaacacacagactgtagcagaaagcatccacagctgcttttcacatctcagcaatgcctatgttttgagtgtggacttgggcaagttagtttctctgcagaagtgaacacactgagccaggctctgagatagggtgctgctccagggtgcccgggcaggtcaggagcaacaggctggcgggaggcagggtggagataggagacaggagacaaaggcaaggtggggcgaggggacacagacagtggaccctcagtatctggggaattggttccaggacctcccttaaatatcaaaatgtgaggatgctcaagcccctgatataaagtggcacagcatttgtgtgtaacctacagacatcctcccatctacagcatctcctgattacctatagtacctaatacagtgcaaatgctatgtgaataattgttatgctgtattgtttagggaataatgacaagaaaaaaagtccgtatatgttcagtaccgatgcaatttttttccccaacgtttttcattgtggttgattgaatccatggatatgaaactgcagacatggagggcaaactgtaaatatttactaaaatacaaatatgctcacacgctttccttgccctaaaccctgccctggccgtccctgttcctgggaagccccgaggctgactgccctcctccctccagcctctggtcctcctgcccaccttctccccaggagagcttccctccacccttacccacgggagaacctctgtccccagaacccacctcctccttccttagcagactctttctcagaggagccttcctcgactcttcaatctaaatgaaactctcctggtatcttgcagtttttccttcagaaagcagcctcagcattgcctgggaaccttttagagccacacattcttgggtcccgcccccaggccaagagggtgaaatgcaggagacaggcctagccttccatatgaacaaaccctctggactctgaagcttgatgaagctgaagagccactgctttgaggcagtcatcataatctgtacttaaatatttgtgtgattttaaaaataccctccccaccaagtttttgaggaaagaacggcttggtcagcccctagcacacgcttagggtctagctggcgctctgcagtgtcggatcacccggcacacacttgctcttacgttgactcaagtctccgccccgtatctgttggcaagtacgtggcaagtgctctgagggcctggacctttgcttcttcaacattccagcagggactagggcagatctaggcacatacctacttcaaaactgtcagggttgaactgtactgaagtcatgaaggtcaaagactcaaagcaagtcaaagtccaggccacttgcattcaagacaaacaaacaaaaactatagctttaaatatttcctgcagagtgtttaggctctctattttcaaggagagtgtgtgttattttccttttatattctaaagataatgccacaattttaaagaagagaggagatatttaatatctgtggactcagtagatattgaaaatatccctttaacttggataagtgcttgtttataaaaagtcagaactggacagggccaggaagcgtattttgtctgaggtcactgtagtcagagggtaagctgaggctgacgaggtgaacggcccacctgaggccaccctgagcagggtcaggtcaggcccacaaccaggtctcctgaccctggctccctccatggcccactgctcaccccaatgggtcggaggcgccccaggtcctctgtgtgaaggcagcctgtggggcctgttgggtgctccagttaacagactttagacgtgggagacacacacacagtacacctagaaatctgttttgcgttcccttccattgcctaccctaaatttaaactggaaagcctatgaaaatttaatacgccatgggattgccagaaagcacaaatcacatctctcccccggagtctgggaagctgtacaaccataacaccaaagaaaccctctggctcttcctattttctcaagatctggttgagacttgaaaacatattgtattcatttgagagggaagaaaaatctgcaaaccagagcagtttgagcagcccatctgctgcagggcctcgcagggctgacctggggctgggaatggggagcagagcggggggcgtgggtgtcggccacacagagcctggagccccgccaggccccatcctactaacatctgatagacccactgggccatcacttcctccccacccagcaggcacaatgggaacgctgttcagtcgtgtgtcccgttcggtgtacgcagaagctaaagcgagctttgttctcggctgtttgtcttggaagtagtaaacgtgcaccgtgacctacagcaagcatgcttggtattccacaacaatcttcgtggagccccagcacccacaggctggcaggcagagcgcacagttggagcccccatggctcctagcccagtcccaccgcaggagtgtccctgaggctttgtgaccttgaaagcctgttattttgtcctaactgctgacatgacttttggttccttccttctggcttgtctctctcatctgtgaatggctctaccgtatgaattgggattccactagctcttgaactccttaaggagaggtgtacgtccagccttatgaatgaagggcaggtgtcccctgcattttaagaactttactcattcactaagccactgctagcaacatggaactggggctgcagtgtgtgtgccggctgtgggggcctggtgtctgcaggggaacggctttgctctggcaaactggccagagctgatgttgaaggaagcccttttgcct

SEQ ID NO: 94 - DNA, 21719 bp, Homo Sapiens
acacaacctggtgcaaacaaccttgaagcgggacgcagccaaagaacacgagatgccatttctcagcccaattggaaagaggccgggagcaccagttccctgaccccctcagccccaccgcctgccgccccctggtactgaccagctccttcttcctcttctcctctttcacgtcggtcttcttgatctctgccttgaaggcctccgcctcgccattctggtcgtccttggccagcaggtccatgagtggaagtgactctgaccgttcccttaagaatctttaatgctcttacatgagatgagcctcagaacaagctaagaaccatcgaaagaacatcaagcctggaaggtgacagaaggagcaatgtgttcttgaagatgtcacctcagcccacctgctccaaggacagtgcttcttgcgacactctgatagctctgcattcttttctgtaccaggaaggcacagatcattcatggggatgtataaccgaaaccagtcctctccaccgcctggggatcttcactttcgcagtctacgactgcctgtgactccagaaagacaaactgcagattggccaagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaaaaagaaaaaaaaaccaaatactacacttcaaaaagaaaatatgacaatgaatctctttttatggattctctctgcataagtggaaacaatatgatttaaatccccaacaccccatcccccttttcagacacagctgaagtgatacagatactgtcttctaacacataatctccctctctcgggagaggcacctgcctgtgctacattcgatttagtttgtaaggtttcaggcccctccccgacccatgtaatatgtaacaaggattatcaaataataaggtcttggatgtgaagtctgctttacacaagaattcaagaaagataggcaggacttgagtaattatgttacaacttcatattactttccaaatgaatacccattttcttctcatgtcaacttctagagatgggatgctgaggcagagaaatatttttatgagactctggagtacatactaaaatgtgcttccttattatttaagaatgtgtaaggtatggacctacatttgtttgctggtggtcataaaataaattcatagccattgtggccaataagcaatctccttcacgctttaaaagtttttggtttataatcccacctggattgtattttcactattctgtatcaccctcctattgcaatattttggttctcaatcttatgtaaagcaaacctcagaaatgatcgtttccataaaattgtgcaatggcaaagccacagaataatattttgagtccatatagccgtgcatgctcatctatatagctcttatacagttttctagctgattgctttggtatttcaagaaataggaagcagtagctacctattttaatgaaagggtaccatttcataagaattctattttcactgaaaaaattggtctggcacattattcaatgcaaaagattataatattactttcacgtgtgttaatctgtttagtataaaactgctagggtgtcttaaccattaacgcgttttgccacactactttcaaatggtgatctgagataattacgaagattttgatgttaatcccacgttaaatgaacaactatgaaaataatcttaaagcattattactcccatatacatgccagcaaacccaattgtggagagaacatgattactttttatctgacattatcctataaggatatggctacatttatttcttttaaaattggagcagttttcaattactttttaacagaattgttttcaacacagcattttgcagtgcccataaaccatagcaactttgtcctgatcgatacatatttttctgcattattattcattagcctctttgcaaactcactaaaatagaatagtattaaagtatgaatatatagagaacaattattaggttctacatatttatttaggtaaaccaatgttattaaaattaaaaacatgtgcctggcatataagtgcttcttcaggaattcttttttggatgcatagttattattttttaaacaaactcagattttcaaacactgattttcttctctgaacgggcattgcattgttttaaacagtagctcctggaataatgccacctttagtattttagactttcaaacaacaattggaattggataaatgctttcagctgggagcactttcctaatacctttgtaggtaatgggattctctatttgtgctgggtgacaaacggacagtgccctggacagactgcctaccctctgcagaatctaccaaaaagtagagttttcccatgagactgcttgtggtccatctaaaaatgaaaaaataatcagagaaaatgcgcaaagccttttctaactacagttatgaaatgatggcttaaagaggtatttagaaaataagagtggagtaatacagaaacaaaatctgaagaagaaagtttgcttaggagctgatgctctttgtctacaaacaagagggtaaggagctggatccaattgaattgaattgtttttgtttgcttgtttgttttcttccattcagtgcctttcaaactgttttttactggatgaagaaactcaaccaagaaaatatatgtcgattcttgtatatgggacaatattagctgctgtgatttttaatactagcataaaatataagaatctttttattactgtgatattgttttttcctaaatgaatgcatagtgtaacaattggtgtcaaaaagcattgaatttttttcagatggattaagctggaataataaagtatatctatgagatgatttctgtaaactctgacttgctgagaaaaaagtgaaaaagctttttctggaagaaacatggcaacttaaccgttattaatctggactaaataaaacaggaaactgcttctttacatttctagtaattttttctgcttttccaaacattgttaagttctatgcaacttgtgctattcaagtaaagatgatgtcagtaataaaattacagaatctaatcaagtgactatttttgctttattacaaaatttatgtatttaattgggatgtttaattgcttagtttttagaacactgaatttttctttttccagacaacagagtgatatttaatgaagtgcttataaagataaatacgatggttcatcaaagataaaatagtcataataacaagatggcatttgagtcaatgtggagtggactctgctttgtaaattatactgctttttaaaagcatgacctaggtatttacaatggggacatctgagaagagaaactcaagagtcctcaacttacacagccaagaatacacaatcatgtaggagaacttgccctcagaagcatttctctattgacattgccatttcttttcctccatctagtacttccatttgctctatttcactaaaaagtcacagaattaagagtggctgctgcaactcactgggctttctctgcttaaaaaaccttaatatcacatggtattaatacagctacattaataattgaaagattcactcagctgaccctatgatttttctaattattgttaactatctgaatatttggaaataattgtatttttccactgactttttctcattgccttgggtactagaaggttttttttttttttttttttttttttttagatggagtttcactcttgctgcccaggctggagtgcaatggcgcgatcttggctcgctgtaacctctgcctcccagttcaagtgattctcctgcttcagcctcccgagtagctgggattacaggtgcatgccaccatgcccggctaattttgtatttttagtagagacagggtttctccacgttggtcaggctggtcttgaactcctgacctcaggtgatccgcctgcctcggcctcccaaagtgctgggattacaggcataagccactgtgcccagccgggtgctagaagttttaacatataacttcagacacaactgagtaaatagttagctgtatatattttattgtattgttatttatattatgtcggctttgtgtcagaaaggatttaaagcacttgtttcaagaattggtatgctatatttttcaaaatctgtgtataaaaataattcccataagtaccactgtaatttacttttcatgtgtattacaaaatcagttatgtgttctggtaaacattttgatcccaagaggaagcaggattacatttagaatgtgacaaattttaaaaattaattttgttgtaaagaaatctttataatgatatgccataaagttattactatgcatgtaaggccgcataccatagtgattaagagcaggtccttggagttagaggcacagtctgaacttgactacaaaagttatcagctgtgtgatcttgggaaagtaaccattctcagctttagttaccacagctgtaaaaggtggataataattatagactctgtcctgttgttgtggtgaacatttagtgagacgactcacatgaggggctggcatagggtaagtacttactcaatatcagctgttctctttggcatagctctgttagagtggcatgccacagttaccttcttgagagccactaagcgtgggaacggtaacagtccacagaatttttggagattggtatgaggaggctgcattggctcccagccctcagggttgacagggtgaaggtaatggcttctggctgtctttagagctcccaaaagatatgagaagatggttctagtgatgacaacccactgttctgtcagtggaaatctagttttatgccatcttcatcattcgtggtgtagtctatcggtgcctgacacaaacgtctagagtggggaaaataacaccttaaagaaatagaatatcttaggtccatgatttgcctgctgtgtttattatgtaccccagcagtaaaatattttaagtatatttatttgcaaatcatacatctgtacatctttactgatatgtacatgataaacctgtgcaaaaaataacctaaaaaggggtaagattaaaatgaagaattagacaaaaggtttaaatgttttaaggtaagattcagcatcatcaacagtgggtataaatccatacttcaaatagccttggtggtttaaaaatcctctggttgatttacctttggattcatatcatcagtgtttccgtcttgttttgtggctgagaagaggaggagcagtgtcagttctgccattttcctgtcaatggtttatgtctgccttcttggaatcatatttaatgaaaggttctttgcaggaatatttttaaaccccttgttcatttggtgaagattagtttagttaaaactggattatataatatatttcaatctaactgagccagacaaattgtaacacatttcaggccatgtgtgcttctaagagggccactgttaacccctctgtggtcaagagctcccccttccctgaggttaccttgtgtgctcaaggcagctgagtaacataagaagaagcaagggtgttgatgccaatggttaccctattagtgaactcatttctgattgtttgtatgaaaacaaatatgatttctgttataatcttctgacaccccattccttggggcaccactgtcctagactctgaaatcactgtggttcctgccatttcttgaccttgacattctgtgacagaatgaaggagaccttaggttcagtggacttcattttctataactagctttactctattgatcacatagtggtatagctcttcagtgtttgcaaatcaatgttcacatatttctgtcatttgaactcagcatctttatagggcaggtagagaaggtctgattctgtccattgtaaagatggaagagatgaaaccaccagtgttgctgactgcagatggaagataattgcgtaagttcacacagcggtagacctgggtttgaatttgtttttgaaagcaatatcatcctgattcttttctatcatgttaacacaatttttaaatgatattcatattcatctgaatggagtagagacagacagttatatagtagttgcaagtttagcttttaaagaaactgccaaactgtcttccagaggctgtactattttacattcccattagcagtataggagtgatcctttttctccacatacttgccaacatttcttgttgttcttattaaaaccaaacaagtggtgctgggaatgcattaagagaaaacatatatattattaatagaataaataataatcaatagataatgtgcaggaaggggatttgcatttacgaaacatctattgtatcctatgttctttacacatattatccctttaatatagttctatacttgcagggacaggttttgcatgtaaagaaattgaggttcagagatgttaaataatttgtctaaagtacacagcatttaaattgtagagtttaaaccaaagggatctggtattaaaaaattccaggtaatgttaaaataaaacaatgcattaaatttgaaagtctttctgttactttttgttccaaattggatctctgtctttggctaaaaatcaaccatgacaacaagaaatgttggcaagtatgtggagaaacaggatcactcctatactgctaatgggaatgtaaaatagtacagcctctggaagacagtttggcagtttctttaaaagctaaacttgcaactactatataactcagttattgtactcgtcagcatttatctcagataaatgaagacttaagttcacacagaaatatgtgcatgaatgcttacagcagctttaataacagtgaaaaactggaaacatctcaaatatccttcaatggaaagacaaacttaaccattctgttaacagttaagcatgtatggttaatcgtggcacatggaatactacttggcaataaaaaggaacacattgttgataagtgcaacagcctgaatggatctccagggaattatgctgggtgaaaaaatccaaacccaaaaggtaacacactgtatggctccatttatatagaattcttgaaatgacaaaattatagaaatggagaaaagaaaagtgcttatcaggggttaaggagcagtggggtggaagagaggtgagtgtggccataaaaaggcaacaaaatggatgcttatgataatggaaattttctgtatcaatgtcagtatccttgttgtgatattgtactgtgtttttgtaagatgttactattgggagagactgggtaaagcgtgcatgggatctctattatttcttacaactgcatgaggatctacaattttctcaaaataaaaagcttaataaaaatgcctactgatcttcaggaagttcagttccctgttttccataactgatctgaaaataggggaaggacaattgagaatttaggagttgtaaactctgaggctgattttcagcgaactactcaaattattctgatttttccccttgattcttattatggattgtaggacattcttcctactattttggagaagaaaaaatgccacctctctatcataggacttctgttttacatatgatttaaaaatctattagctgactaatttacacactagaagatgaaacttggttacattagattccattgccacaatttattttaaaaatcagagttctcatctttcttgtttcttcttcctgccttactttattttcttttttccttattctatttgaacccatattttcctatattgtactgtttagtctaaaaactagtaagcatgcatattgttgattaaattagcaattgacgctcttaaaatgagaactataaagactcttgagcttccacacattatgctatgcttgccatatgcttgggtgttcttattttcggagagaagtaatggagattataaatgttatttttaaaatttactggtgatttgttgagaagataaagtaacaacactattacagagggttgctcttgatctcccaggccaccagtgcagtcaccgagccctctgcaaacacctgataatgctgaagagtgtgttagtcattgtagaggagctgctgtcatgacaaataggggttaaattgtgagaatttcaggatatattttggggaaggattaaataaatcaggggacttgctgacagcaaatagtatctttgatttgaaacacagaatcagagaattgagatgaatcccaggtggtggttgggagtttgaaaaagtcccagtgagttggctgactaagtgtagacttcatttcaacatcattaaatagtctttaagtggtgacttaataattgttgccccaagaaaagattttgctaaatacagaggtggaattaagtatattaatccaagaaacattttatttaaatgattttcctaacagtaaggttggaaggccctagaactgcttctaggagcttgaagtgcatttaatagttaactgtcagaatgaaaaatgaaattttaaatttcaacaatgcaattaagttcttattttcttatgatagtgaataataaatttcattcaaggacgccattggcagatgttgaaaagaaccattttcactccactagcttgcagtggactaagaggtagcaggaagggagattggtactacagatcctgaaaaaacaaaacaacacaaaacaaaatccacaccacaaatggacacttccagatgcttaccaacaggaagtgccttggaggacaagggctgtgagacaggtgaactctagggaacaagaattcctagttccatgtctgtttacaagaatttgtcatgactggttcacctcactttatagtttcctcagaccaaagagacaaagaaaaagcaaaaaacaaaaacaacaaaaattctgaaacgaatggacaatacaaccaaaactttaatatgaaccaaaacaaaaattgggctgattttatgaggttgacttaaagtcaggaaaagaatgataaacttttgagaggaagaaagaaatcatcaaagccacgaggagctcaaagtggtgtttaatagcagctatcacattgcgcccgagccttgaccacttctgacgcagctgtttcgttttaagatgttcccattcctgttccactcacacagtcctccacagtgacctgagtgcacgcacccaagccggcaggccactctagaaaaccgtaaacccctcagagagtcactgcaggaataggggaaatggaagtgatgaaattcaatatagcatttagctgaatcatcatctgaggttaagcccagtgaacaattagcagtatcgggagtctcctcgtacctgtcaaaatcgcaccgacgggattttgtgcaaagtatgtatgtgtgtggaagttgttttttatgtttaatagcaatggacctggggtagtaatttagatacaactttttaaaaaaaatactaaagggcaagtgtggtgagaagcttcttactcaggaggatcttttcaaacattgcaaaacatcaggccttgaaataattcattttattaagtagcgcactcttgtcttttcattcacaaaaggaggatgatttattatacagataaatgcttgcataggatgatgaacacctgtaggaatgcatgatattctggaagttgatcaaggtccactgtacaccagtaattagaggtcatgatgatgataataataataataataattaataatggcacatactatgtgtcagctcctgttctaacttcgtttctcatattaacttatttatttttcatgattagccactaagatacaattattatccctgttttgtagacaaggaactgagtgaagctcaaagaagtaactaggatcacactgtcacacaggcaggaatgaaacccatgcagattggctccttagtgtgctctctgatctattatcattcatcacatatttactgagcatctagtatatgaaaggtattaggctttatgcaggcaatactttagcgaagccagggagatgtctctgccttctttgagcttatagcttggtgggcaaaaagctaatggtttaactgtataaaaaacttgatgttgtgaaatgatatatgccaatgtttgcatggtatgatgattttgattaagcaccataataaaaatagggagcctgggtctcacacagccttgattgtcttcttccttctgctccccagtggagtgcgtaggaaggtcacaccctcaatgtcaggctccttcactgttctcagtgagtgtctcaggttgtaggctacatgagcaggtttgcacctggatatgattgtggcagtaacaatagatgtgactatacacagtggcagtggcagtaggggtgggagttgggtgatgggatgatcttagaatgcagtgttggtattaactcagttttgttttgttttgatgtacagccagccatacgactctggaatatgactctgggtttaccaacttggggatggcccggggatttaggagatggccccaatggctctcctcttttttagaaaggactgttcaagttccttttttttttctttttaaacaggatctcgttttgtcacccagatcgggggcagtggtgtaatctcagctcacttgaacctttgcctccctggctcaagtgatcctcctgcctcaggtgtgagccaccatgccaggctaatttttgtattttttgcagagacggggtttcaccatgttgcccaggctggtcttaagctcctgagctcaagtgatccatgtttctgcctcccaaagtgctgagattacggtttgagccaccacatctggtttaagctatttcttctaaagatatagtcacatctattatctttgacccctgcctaagcaattctgttcagatcttaagactatttcttcccgggattcaaactcagagttaagtagagtcaactatatgaggtatatgtgaggttaatttttgaaacttttatttttaatttcatctgggatctcctctagggaagaccactttatgattatgggttgcattcccaagttcagttgattgaatttattcatacattatttaataaatgtttattgagactgaaaataaacttgaaatcctagaattcattggttgtcttaaaaattctaaatatgaaatgctaactttagcttcatgagtatttagaatagaaaataaataattcaaaaattgttcaggaaaaaaatccatgatttattctactctggaggagcatattcaatttaaaacataccgattcgtataaacttattggtaatgaggcgatatactttttatgagaacatatcaaaccatagacattgagatccagcatctcctgagtgagtaaaatgtcagggttttattgatactaatgataatgggagtgacatatgtgcatagagtaagtccatggttgaaagcctggctgattaggcgctgcgttctgtggtttttgccacttgtgtgtgattaaaccctgcagaatagagtctgttgccatgtatttggttcgtgaagaaaactagtaaagtgatattgaatgaatgattcagtttctcaaaagggtagactattggcctaacaccttcctaacttggagctgtcaacgtgtttagtttggttctaatgggagctaggctggagaagagaaaagttttgtgagaaaggttatgtgatattaataagaaccacattccgtttgatgttttctcaaatgattttttttatcttcctaagaaattgaatgattcaaaaataataaatcttccttttctatggcccacaaatgatcaacattttggatgatcaaaacaattttgtctttaagatatcacaacttctagtgcctctttatttgccagtgctgatttacagcagaaagtatcacttcatattttttccaagcatcaaagtcatgtgttttacaaatattcacaagtgcttaaaatccatgaacctctctctgtattcctatttttttattcttctataagtatgtatttaaattggttaaacagatggctttctacttttgaaaaaaaaaaacccactaagaatattcacctcaagatggagaactcataggttaaatttcattctggaatgcacgtttacaaccaggtaattaacctttgaaaatgagggtactcgaaggaaacaaggaaaatcttaacaagatgatctcactaacgctggtgtgttagacttctcagaagtagagatgccccagaagtttaacaatgaaaaactttaaaatatttttaaaaacatagttaatctttgtagctttccagttttcgtcctttattacgataaccttaggaggtaaacgcttcaaggggtgtatccttataatcataggaattggtacacagattttggtggaaagatggaggtgtcaacattaaccagtcaacatatatttgttgactgcctaccacatgcacaagtctcttccatgcttgcgaagagatacagtgatgtgcaatgtgtagaatctgcccttcatgagcttttgatttagttagtctgagaaggaatagatcagtgaaaagttaaaaggaataatagatggagtgttgaggcagtccatgattgttatctgagacattgagtttacaatgctaagttaaaagaatgagagatcactatgggatagaatggacaggaagagttcctctccttgaagcttgcattaagccataaaagacaaagcaattttggaaatgcagaatttggagatatgaagaaagaataattcccagaaagggagaagagttttggagccagacagatctgggttcaaatcttggttctcttgttctctagctgtgtaatcttgggaagttacttagcttttatggacatcttctataaaaaggatatgatagcgactattttgttaattttttaggattaattgagataatatatataaagtgttttaagcacttgataaaaggtaatcctctcagttggagagaacatcctaaacaagtctggaggaaggagacagccagccatgttcatgggacaaaaagaagactattatgagtggagggaaagattaagagaagtagagtgagatcacatggaaagataaattaggattagcttcagccattcacttgtttcttcatttaatactttattgcactctttatgtgggaagctctctcatgtgggaaaccctctgctcggcatggatatgcagagacaaagaaaacttagccttggatttctcttgaatgtcaggttaaggagttggaacttcatgctgaggagaattatatctttcaaaagtggaggagcttgaaagtagcatttttggatagttaacatggaatgtgattcttgtgacccaagatatgcattaagttaccatctcctagtggttgatggttaatgttgtgcctggagatgtgacccagattctcttgtaggtcattcctgacagagggtccattccaatgagtgaggaggaggagcttctgggctgaacttaatctcatctcctgaaataaagcaatgacattgaaatttttcatattgcacttgtgtttacatttctcatctaatctgagatattccacgtttggtgagtcttgctttgggcctgcagtcttggtgacccttattagttgcactggaatagctgtctattcagggagaagtagaatcctgggaatctggtcttcagtgactttctccatgatcatgaatttcatgagaggaggtccccttcctgttagtagatctctatagcaagaggttctgaggcacacaagcacactggatactcacctacagttctagtttaactgatggaacataggtatttctttcatgaaactttgcctggataaacagcttctgtatcttctagtgacaaaattttgcctcctgttttcccctctagctctagtcttaatctctacttccttgttcagtccaaggctcaggagaacccagatcatataagatatggaacctattgcttcctaggatgtccttgtacacagtgactaactgctaatttcaaggatcaatttctttctggagttagaatcatattatattatgtttcagaactgaaataaaattcttttaaggtgattatattttggctctcagcttggaagatgccactggggcatggcatacaagacacataacttataggaggacctcctttaatgcccaagtgccagcttcatgcttgttgttatatatcattttattcctggctttgatgcccacacacagacatatatccacacaaagttcaatctatatattttttgtagctgtttagctcaggtgattagggcattgagctaatgagaacaaggtcacagtttcagtctttgtgtgggccagcaaggtttgctttgttcagaggccacagacctggtccagccagctgtccagcacatgtctgccccaagtcatgagaggacggggcaggagtgtgtggatggacaagagcaaatccatcaccacccttagaaaaagtcaagtcaagcacgtgtcctactaatgggggtcaataatgtctcatttaaatggggctgacattttattacctcttgctgagagggtcttttgagcaccaaatttaaacattgtcgcttttttgtgtgaatttatttctaataaatggaaggttgtacaagaccttagatgattacaggtttccaaatacagattaatgacttcaatatttaagaagttgatgtgatattaaaaaagaaagttcagtatggctattcagttatcttcccttattaaaatctgttttggctaatgaaataaaaagttcataagttcttccgagagtaagtgagaatcattgccttcattcaagaatgaaaacattattattaaactcattgataatgagaccattaaaagttagcatgaagcaggtacaatacaattctttattattgaagtcttcagatattacccagcctacacatcccacctttcatttttaggcaaacaaattccccaaactatattttttttaaatttagcattaggtcttgttaggcttcaaatgggatcaaaaccaatcctttccaaagtgttctaccccagctgtttccctcacctgggtggtagtgagtataaaggcatttgatacagaagggggtggtggggcagagaacagaaaggaaacttggtgagagaatgatgaagaatgatatattagagattcttttaaaattcattcattaaacaaatgtagcataatggaaatgtctattaaattttttggcataggtaatgcacttgcaagggtaaaaacagaaatatgagatggtattttatgaaaagttttgctcaccccgcatccatcatgaacccaattctactgcccttgtatagccatttttattagtttcttgtgtactctttcagaatttctttatgccaatatatcttaaactctttcctttttttcatacaaaaattaacaccctatcaattttgttcctggcagggtgaggtggctcacacctgtaatcctagcactttgggaggcccatgcgggagaattacttgagcccaggagtttgagaccagcctgggcagcttagggaaaccctgtctttataaaaaaataaaaaattagccaagcatggttggtgtgtgcctgtagtctcagataactcaggaggctgaggcaggaggatcacttgcaccagaaggttgaggctgcagtgagccatgattgcaccattgcactgcagtctgggtgacagagaaaaactctgtctcaaaaaaaaggtcttgagcttgctttttctacttaacaatatgttttgtaaatctttctgtatacgcaaagtagcctcatttttcatagttgtatatcattctattgatgtgccacactttatttatctacccccctattgatggaccttcatatagtttctaatattttctattacagacaacaatgtattgaattactttggaatgcattaggtagaaagcattcttctttctttaaacatttgcgtagcattccactgaatggctatatcataacttatttctctagccccctattgatcgtcattgagtttccaatcttttatttttaaagacaatgtcataatgaataactttatacatgtattatcttatatatgtggaattaaatttaccatgtctagataattttatttgaatgcaattaagtatgatatcaaaaattataaaatcaaaactgcagtgagaattcatcttaccccatgtaaaatgactcttatccaaaagagaggtgatcatgaatgctgatgagaatgtggagaaaggggaaccttcatacactgttggtgggaatgtaaattagtacagcactatggagaacagtagagattcctcaaaaaactaaaaatagaactaccatacaatctatcaatcccactgctgggtatatatccaaaagaaaagaaatcagtatattgaagagatatctgcactctcatgtttattacaacactattcacagtagccaagacatggaagcaacctaactgtccatcaacagatgagtgggtaaggaaaatatggtacatatacacagtagaatattattcagtcataaaaaagaataaaatattagttgggcatggtagcatgcacctgtagtcccagcaaccagggaggcctaggtgggaggattgcttcagtccagggaagtcgaggctgcagtgagccctgatcacaccactgcactccagcctgggcaatatagcgagaccctgtctccaaaagaaaaaaaaaaagaatacagaatgaaattctgtcatttgcaacaacatggataaaactggaggacattatgttaggtgaaataagccaggtaccgaacgacatatttcacatgttcccactcatatgtgggagctaaaaattaaaacaattgaactcatggggagagtagcatgatcattaccagaggctgggaagggtagtgggaggaaggaataaagtagggatggtcagtggatacaaaaacacagttagaaggaataagatctagtgttctgtagcacaacagggtgactatagttaacaataacttattgtatattttaaaataacgaaaagagtggaattggaatgtccctggcacaaagaaatgataaatgcttgaggcagtgaacaccctaattatcctaatttgatcgttacacattgtatgccttcatgaaaacatcacatgtgccccataaatgtatactgttatcatgtacccatcataattttaaaaaatagaaaagaattatcacaattattttaaatgaagaagcactaagtaggaaataaggtacaatttaattcagaatagctttccttagtagtgttcaacctactgtacacatcaacaacacgcccttgcagttaacattgttgctggatgtttactgttatgtgtgaccagctgacatgtccctctaaagaaagaggatttaaataagtcatgtatgaaagactgggtaaaggtgagacactgtaagacctagattattttggggctgtagcaatcagattagctattgagtattcattcataaattcattcacttcactgagtcatccacttcttgtcagattctgtatttattcatctcctagtaagctactcattgtgctaaaatgctggtaaacagaagtacaaagcaccagttataactcacagtcttgtagaggaattaagaaatggacaggaaacagtaagggtgcattgtaggtatctcaagaatgatataaagtgttatggcagatctaaggaggaagacatgactttccatagataatggatggtggcatctgttctggagtaccagaaaattagagtaacaaaaacacagcaggatagattttcttacaatgcagtgattcatacaaaggctaccttgactgttagtttgtgactggaaactctcagtcagggctgacggagggagtcctgcccctgccagctgttcacctttccctggtgctggggttgacacttcacatgctcacatagtctggttctgtgctgtctactagggttgagtgtgctgctgggcagagaattttggcatttctccagatgcacatgaggggcagaccgcctcagcagttgctaatgacccaaagaagccttctttcatgacttattttgtcccctcattttattttttgatgtattttggtgagctgagctactaccttctcaggcagtcccaacctcagaaaattaaccatgtagctttctcatatctgacattgcaaattgaggcaaggtcgcatgctttctgactacctgactgcctgggcatttctttcatgcaacttgtttaagccgcccatcctgatccctgttgctaagccaccatggctgcatttggacgcagttcttcccagctttgccgcagcataactgtggaaaggatcttgatgaatttggacctggggagggacgtgggaggaaagagaaatggtctaatggaagaaagtgaacaaacaaagacatgctcacagaaaactgccaagtgtgaggggtgggaaaacagagttcagcctggctgaacgtaggaatctggatgggaatggtagatcttaggctcctgtttttcagcttgccgctctagtgatgattcttgtagatatatttttccaagtaaaaggagcatttccaagtgactgttgtttaaaataaagtacatgttgcatttgtaatgtatgaattatgagtattaaaactgacaatgaaatgagagtaatatacttaattaaaattaattagatctgttggcacaccactagaaggacaaatatgatatttaatatatcactctactccagacctgtccaattaaacttttggccatgatagaaacgttccatatctgttgtccaaaaacagtaacccctagtcacatgtggctattgagaacttgaaatgaggctagtgcaactgaaaactgaattttaactttgtttaatttcagtgaaatttaatttgaatttaaatggccccctgtgagctagtagctaccgtattggacagggaagctctaaacagggttctaaacatgtggaattaacagcacttaagagctggagtagaccttaacctttaccaggtctcaaactttgatttacaaatggggaaatggcagccaagaaggtgaaacaccttgtccagaggcacactagtaggaattagcagaactggaacctggtgtttggatgtcctggctcccggcctgggggactcttgattccaacacgctctctcccagttatgacagagggctgtggctggacccaggtaaggatgctgggttggtagattgagaaaataaggccacgcgtagtctttcaaatcaaccaagcaagagatatttgctgtacatggtggcagacactgagatcaacagagaggttgttgtggtgtgggggagggcctgtaaaatggcataaggagtctactgggaaaaacaggatagtgatagattatatatctctatatttatctttctatataatctaccctgttttcccaaatggatttcccaaatgtgtgtcacttgtatatctggctgtcactggtacaaggtagtccaaatggacagggtacgcaaaccccagacagggctatggaaatttagggagatctgtgtgggtgagtggtcggggagagcttcagggataggacaggcttgacttatattagatagtgtaacacagaaggtaaaatacaactttaggatcattcaaatttaacagtggttgatatgaaacaaacttcttatccagagttggttttgtattcttgctttctgtattaattatatgtgtttactgattcaccacaatcagctatactgtccctagaattttaaaatgtgaaaagaatgtggtttgtttcaggactatttttctgtagaatggtgattgtatagaattaattaatattacagttgcattattagaccacagtaaggtaaatggtcacaaaagaccatacatttaaatcaggagaaaagtaatggctattgttatcctgtaggcatagctgggaaatcatatccttacttggcttgctaaagtcttaacctagtactacatgacagtatctccagagatttttttttcccattcgtaggcacaacaaatgagacccaagtgctcatagaacattccaaagagtcaacagagagaagtggaaagtattagaaacatgattgtgtttgcaaagggagacataaac

SEQ ID NO: 95 - DNA, 2430 bp, Homo Sapiens
aaaaatgtaaataccacgagccctatctgagaagggtgagggaagcccgaatgagataatgtgtgcgaatggctaccatgttggagggcttgggttcttcgcactcggtcctatctccacttccaggcagtcgactttcctgagacctgggtgccttggccgcccaggctaggagacttgaagctcttctctcctcaaacctgggccgatttgcttgttatcttctcaaagggtagagtgagggctgctgacgcgctcctggaacagtcaccgtgatgactcggggctccgctggcaccctgggcacacaggccgtgctgttgcctcccctcccacaccctccggagattgccattttctatttccaaaccaaacaagacaccctgaaggacgctcctcctgcggccccatcatctgcttcaggccagatttggaaagtcagcgtgattgaggaaatgctggaagagcaccagcctgcacgctgcagaggcctctttagaaacttctgctggaagggacgtccccatgctttaggtcgcaggacagagcttgcagatgccttggaaaccggtaggagccaagctgcgtcctgggagacccccgagctctgcacaccttccctccgccctcccggctgtggcaacgctcgggggtcgtttaggggtccgcgtgccttttgctccgcggcccccggcctcggatcccctctcccatcatgattctgaggcctccccagccatgtggaactgtaagtctaattaaacctcttttttcccccagtcttgggcatgtctttatcagcagtgtgaaaatggactaatacagtaatatataaaaagtttgctgctatattgctccatttactctcctctcctttgtcctgttattgttatacaaatgacatctttgtatgttgtatgcccatcagcacagatttatggctattgctttatggagtgcatttaaaattaagtaggcaaaaaaagagagttgcaaacaaaatatgcaattatactctcttttataatttcctatgtattgagctttactagtacttttattttttcttgtggatttgagttactatctagtgtccttttattttagcccaaagggcttcttgtaatttttattgtagggcaggtctgctagctatagattcttgcagtttttgtttatcttaatgcctgcttcgtgtttgaataatagttttgctggatgtagaattcttggttgacagtcttttccattcagcatttcaaatgtgtcattccattaccttatggcctccattatttttgatgagaaatcagctgttaatgttatttatgagttcatgtatatgatgagttgcttctttcttgctgtttttaagatgctgtcttggtctttgtcttttgacagtttgtttgcaatgtatcttggtctcagtttctttgtgttgatcctccttggagttcgctgagttttcttggatgtgtagattaatgttttgcatcaaatttttagctatttggtcattatttcatcaaatatgctttttatatttttctctactctacattttggactcccattatgcatgtagtttatatgcctcattatgtcctagaagtttctgagaatctgttcatttttttgtcattctttttcttttctgttcctcatactggatcacctctattaatgtatattttagaatcttgatttttaatttggcctgctcaaatctgctgttgagttcctccagtgaatcttcatttcagtttttataatttttgtattctagaactgctatttgctgtttttttaaaaaaaatttctatctttttattgatattctgtatttggtaagaaatcattttcagactttactttttaagatatggttgcctttagttttctggagatatttaaaattgctgatttaagtgtttctctggtaaatataaagtctaggcttcctcaagtatagtttcttttgattgcttttttccttgtgtttaggccataacttattgtttctttacatgtattatagttttttcttaagaactggacattttaaattatgtaatgtggcagctctataaatcaacttttctctccctcttcacccagggtttgttgttgtttgtttgtttgtttagtggcttttcagaattaattgtgtcaagtccagattctttgtcatgtgtggctgctgaaatctctgctcagttagtttggagatcagctaatgattgggtagcaaatcccttaactatctggaaccaataagttttctagtttctgccaaggggctctgtgtgttttggggcatgcctttattagtcagttgtgtggttttcgtgtccaccttagccatcacttgctgcttgcacagagcctcaaggtcagccagagacaagaatttgggaacttctcagg

SEQ ID NO: 96 - DNA, 6857 bp, Homo Sapiens
tagacttctggcaagtttatacttttgtgaaaattagaaagatttttttccattacattttttacctggttattgctggattggaagagtcacaaaattccacgcacacaacttggatgtaaacaaaaaatacagcacacataatctggtctttttctgaattccacgtccaaaatttggcagaaaaaaaaaagtgttcaatctcctgtgaatctactctgatctgctatactaaaaaatacttagtctttttgtgctgcatttttccccccttccccattatctcctcctaagccttgcctgggaattgcaagcccaccagagatcctattctgtcactaagcaaaatctgatttacaattttggctgaggagagggaacatattaaaacatatcaacaattttagaatcaatattattaaatttcatgtaggttttagaaatgttttacttgtatactttagacttcattttataaaattacatttttaaaactttttacatttttaggaaatacatgttagctaaaaaactgtgttttgctccctgctacgtttgcttatcctatccttcattactccttggattttagtctaactggtcttgggacatgcctcttccccacaaacacccccaccaccataccacattgctgtgacacatttagcttgttaatgtggtaagagtggagctcacttacagaatttttgcagactagaccttaggctacaggtctttaccatggagcagaaaagtggtatctcaaacctcatccacaaaggttgatctagtccaagcccctctccaggttcatgtccatgtacagctttgttcttattgtaacaacctacattttagaataggcaacgaagaccattaccaagagcagtaggaggggcaaccttcggctgtttgtttttcaggatctcaacttgtgaacttactcttctcttcacagaatgggataactgcctggcactcaccaagctacacttgaagaggatcaatccatgtcatcatgtccccaatttcatagcaccaagtattttgtttattcacaaatgccctattatggacatctagcaaacaatgatacatcagaaaaggagatgtgcataaattttcatggaataaggtataaagcccaactctcaatacatactaatcataacaggagtctaagaaatattctgaaataaatgggaatgcagaatgtgtcaggcctctgagcccaagctaagccatcatatcccctgtgaccagcacgtacacatccagatggccggttcctgcctggatgcgcatgaaagaatgtgccacagaaaatgagacacatcaatgaggcctagacaggcaacttatgccattgtgagatacaaaatagttcatataacatagcaaggggatatcattctagaattaaactcatgttacagaaatttcatcacgaagacagtgtaccaacagtatacccccctgccccctgctgacatagtgaagacttgtgggaagtatcagaaagagaactggaattaaggaggaaaatcaagatttatgtttcttatcgccaatttttaattttcatttgtaggttgtggaaaatgcactagaatcaacaaacatggggactaattcaactcggatatcatgtcttcagagaagtttctcctgccctcctctccctgtagaattaagtattcttccactgtgccaccctctaacttgtgctcatatcttcctctattgtagttatgtgttcacatccctgttgtttttgtaccggcttctcccaaagggagacatttagtcttattcttcttggtaactttagcacagacctggcagattgttgacactcaacaaatgtttattgactcaaatgcattcagttgaacattgacctttgatcaactctgggaaaagtctgcaaagctagttaggacattcagaaattcatttcatttcaatcctaactaaataaattattgaagtctcagaacttctcagtacttgatttagacacatagaaacttgggtaaataacacctatattgttatattcctcaagaaaaagtttatcttttcatgaaatgaatctactgaggatatttatagaaactgaatgtaagtgagcagaataaagtggtgtgtgtgtgtgtgtgtgtgtgtgtgtatgtaatttgaagagtaggtgggagaaggttgtgataggatagcagatcttgtttatgatagtcaccagctataacagacactgcctgatgcctttccaatatccacttcccttttcttttttttctttttggaacagagtctcactctgtcccccaggctggagtgcaacagcacgatctcggcttactgcatcctctgcctcctgggttcaagcaattctcatgcctcagcctccctagtagctgggattacaggctctcgccaccacgcccagctaatttttgtgtttttagtagagacggggtttcgccatgttggccaggctagtcttgaactcctgacctcaggtgatccacctgcctcagcctctctaagtgctgggattacaggcgtgagccaccgtgcctggctctcttttcttacttaatgtctgtgtcaattaaatagaaatgtatcaagttaaaaaccttgcctcggtagcttccagtgcaaataaaggtacccatgccaccccattctggccagcagtaaaattgatggaagcctctggttggggcttcaaggaaagctttatcaaaagataaactcactggctttgtcccttagttcagtggtccccaacctttttggcaccaagagaccagttttgtggaagacaattttttccatggaccaggagggttccgggggatggttttgggatgaaaatgtttcaccttagatatcatcgggcattcaattctcataaggagcctgcaacctagacctctcacatgtgcagttcacaatagggttcatgctcctatgagaatctaatgccactgctgatctgacaggaggcagagctcaggcagtaatgctcactagttccgttgctcgcctcctgctgtgcagcccagttcctaacaggacacagaccagtactggttcgcaacccagggtttgggggcccctgtcttagttcctttgccttccttccagatggatgcctggaggaacaatcatcccgcaattgtgaaaattgaagccatattttaaagttggtttcaattgtaatacagaagaaatctggaccttgatgacatttgagctagagtactaatcttgatcttcctattcatgagcttgttgcaagagacaagacttttactgatttaactcattgttgggatttcttggaactaaacacagtcataatacattttttccttcccaggaaaatggtagagcatgacttttcaaatctaataaaactcatgtgtagctaaaaccactctactgaaacaattccatctcagcccatggtacaagggattttcctgaatgaaaaatggtgtctgatcattttgttggtttctttgttggtttttcctgaaacttagggttaaagaatccaggaaagttgtcttagatagagttataatttccgtggacatcaactgataaatgcaattacagtttgtatgcctaggtttggcaaaaatcatataagcaacatccctcacataatattgttttaattaaattttatttctttcttggtatgaaacatactgcagaagcacaatcaatgaacattggatagtttccttaaatcttgctctttgtcctatttatataatttattgtgtcagtggttctcaagtggtatgctcctgcaactcatcatctgaaaatccttcccagatgtgctgaaaaattttcattaatttgtatattctattttatttttataactaagtacacatgcttgtgactggaagagaagacacccctcatttaatcccagaggaatatttggccttgattcatgccctgctcactccaccccattattaagatagagatcgctgaagaaatccctgctctataaatgtagctgatccaaaaacaaaatggaaattcattattttaaatatttctacaagatctttgtacaactctatttttttttcctattaagaattacatgattctagaataagttccaaccctaagtatcaacactggaacacaattttaaaacaggaggcgattatctctatagtgagatttaactacagaggtgatagctctggttagtgaatttcaggactagaaatcaggcctgctgtctcttagcttagaggaggtataataagaagaggattagaactactgtgtatattaacaagaagaactctattatgttcagctatcattatatatgatattatgtttctttttatgaactatagttcactgtctttaagcataatgtttgcccaaggtgggggtgttggtgtgtgtctgtgtgtatatgcatgtgtgcacatgtgtgtatgtatagttgattcattcattctgacctactgaatttactgaaggaataagaagaaataccttgaactgagggacctggcttagctcaacatctgtaccatctacctttgagtatccattcctttactatgaagcatggatgctaaaactaaaattgcatttgctaaactactttgtagctagattcctgggtgagattagatttggtcaattagatgttcttgtgtaacatttagaaggtgatagtaaggcaaaggtcatgtgactggctgattttatttatgttcaatgatctttattggggtacactttatatataataataaataatgcacacattttaagtgtacaatttgatgagttctgacaaatttatatgcatgtataaccagcatcaatatcaagatatataatgatcccctcattccagaatagtctcttgtgttctttccagccaatgccccacccctggattctggcaacaattgatctgctttttattaccatggattatatttgtctttcctagagatacaaataaatgaaataatgtagtgtgtcctctttaactttggcttatttctctcggcacactatttctgaaatttgtccatactgttgatatggcagacagaattttaagatggttcctaaaattcttgcctcctggtatgtataattttctctcggttttccgctgaacactaacctaggtgctattgtaaagggatttctcaagtgtaattaaagtccctaataagtttattttaagttagaaaaattttcccaggtgagcttgagctaagtgagtgacctaagcaggtgagttgttagaaaaaaattaagagatatttgaagcgtagacaaaattctgttggcttttaaaagaaaacttccatgtgatagagaaagccagatgatagggaacacaaggttacctctaaattgacaaccagcaaaaaagctgagacttcagtcttatcatcataaggaattgaattctgtcaacagccacgtgaccttagaggaggcccctgagccgcagatgagatcatggccctggccaataccttaaattcatcctggtgagatatgagcagagaactcagctatgccatgctcagatttctcacctgtagagcagtaaattaataagtgagcattatttgaagctgctaagtttgtggtgatttgttacacatcaagagaaaacatatgctgtatatattattagatttttcctttatattggtgggtgtatttgttatctattacttcctaacaaatcgacaataattaagtgtcttaagacaacacatatttattacctcatagtttctgtgggtcagaaatctgggcatggtttatgtgagttctttgatttaaagttgttggcaaatctgtaaacaaggaagcagtcaggaccgaggtctcatctgaaagtcaacttgggatgggtctgcttccagcctcacttaacataacagctggcaggattcagttgctcttgggtagttggattgatggcctcagataactaggtagctattagctagatttcaccctcagtttgttgccgtgtgggcctccctaaggtggcaatttacttcatcaaaaccagcaagggagagagttggctacaatctctagtaatgtagctacagaaatgacatccccttagcaatgagatattttattaattagaaagaaattactcaacaggaggggattacacaatgtagtgaataccaggaggctgagatcagaaggagctagtgtagaagctgcctaccacagtgagtagtattctattacatgaatataccagaatgtctgaatccacccaactgggcatagacgtttgtgttcattcaagatacagactattattattttaaaaataaaagttactatgaacatttaagtataagcttttgtgtgggcgtgtttcatttgttttgaatgaaattgcagggtcgcatagaaaatgcatatttaatcttataagaagctgcttaaaatgctttgcaatgtgattttaccattttacactcccaacaatgtatagcaatatatcatagatctagtggtttcatatctccacaaacacttgatattgtcactcagtttaattgtagctacttaaataggcttataatggtactcgttatgattttaatatgcatttccctaatgcctattagggactaattatgttaagcatcttttcatgtatttggaggccatttgtgtaccttcatttgtaaaatatctgtttaagtagcttgcccatttggattgctttacattttattatagagtcataagcatcctttatatattctgaatataactctttt

SEQ ID NO: 97 - DNA, 7156 bp, Homo Sapiens
aaaggctatgtattctgagctcatctggatcagaggagtcagcactgtcatttgtgtttggcagagactgaaaggcagatgttcgtctgaagatttcaaagcccactgctgatttaaggtcattcacattcagccatgaagctgctctgaagacacaggaactgcatagctccctactgggaatgtcaagggctgtgaaaggtctaaggttttatcctacttgcaaccaacaagctatgcagccacagttttatggatgctgtcaaaagacatgacactcctgggtaagagacgaaagactttaccacttgtggtgtagtagccagctggagcatcttgtgttttgagttagtgccagttgtcccctaagtcccacagcatgcagtttaggctgctaacaacagcatgagggcaacctgctgtggtgacctaagctatgacaccccaccccaagtccgggatgcagctaactgagcaaactgcatgaactgggaggcggccgaccattgttcacgcctctccttcgcgtatgtgttttctactgttcttgcactgtaaaggcagaggttgcatcgggcccttatgcaaagccccaaataattactggctgactcttctcagggaacatttgctaaccctgtcacaagccataaggttccaccacagattgccctgtggctctctcgttacgtttctgtgtggacgtttccacatggtctgaggcattcatccaagaagagcaggatgtattagtgactgcacagattctgccttggcccacaaagaggacatccagggcagtcctggtcatctgtaataacattgcccagtgagttgaggctgacctgagtactgacttgggttgagttggtgtcactgatcacttcagccaaagatgggacatttcttagcacctgttctgattggctgacttctatggtcaggataacggctctcaggatgcgtataactgccaagtctctccgggaagcttccctgggttaccaaggaatcctcatgtctgagagagctccaccatcatccaagggccacacggagtttcttgcaatgcttcaaggtctcctgtaataactcctatgatagaagtcactgtgttttggggaggtagactgcagcatgcagttttgacagcatgaccaaggtcattgttcaggtctgattattcaaattcaaaaaactgcaacctcaggcataaaagattaaggatggagcccaagtctctgggtccccaagggggactgaagcacatactcacccatctgaatatgctggagaacaggaaggagagactcaagcttgtctgggtctgttggatacagactctcccatctccaccccatcaggtcctatggaggcccaagttcagctgatgaagttaagggagtgctcagtgcagaagggtgggagggcacttggggcattttggggtcctgtttttgttgcttctgcatctgatacagcaggaattgaagtattgcacacttgtccttcccatttccaagtgctgccttcccatcagtaagagccacagttagagagggaccaacaggaggataactcccacatgcttagcattccaataatggaacactaggcataaattgataagatgctttcaatgcaatcagtactctgccaggattcactaagtagagaatgactaaatatttacccatctcctaacaaaaatgcacaactgaggacagatgttttgcacttttatgtgtctacggactgtgtaagaggatttggctgggtcatcatcttcttcttcttcttagactggttgatggtgaccgttcattgatccaatatggtaaagtcatgtcctggtctgtgttcttcggggtccacaaccctctttaacagcctgttgtaaggttctcgaccacgtcactgtctagctaaaccattctgcatttcagtaggtaaaccagcaggagggcttaaaaaccacattgccctgtccacatccctatttctgattcttttctggcctgcgatcctacatctctatcctcactttaaactgttttcctcttttcttctcctttttcctgacctcctttatgtttttcatttctcctccatctgaatataccaaaccatccttttgcttcctcttttctcttcattaattattctaggggctattttttttattaggaagatgtattattttaacatgctttataaagttagtggcattaaggaattaatgtccttggaaactcatacatgttcagcttctagaaacccctgattccaaggagcaaaaacatgccatctctgacagtgtccacaagaacaataccagatcagacgataaagccaacacacagcatagccaatggccacacatccagaaaacactctcaacaaatttaacccttcagtattcactgtagccaatatatattcaatatatatagctgactttgtttttatatttgatgaagtcctgctatttgaaataaaataatcaaaccaacaacaacaacaacaaaaaccccatacatggtgatagcatatgtgaggcagtagcaatttctccatcttttctgtcctgtctttcctgttcttcgttcccatgctaagaagggatggatatatctcggagattacacaggttctagtcaaagacttcattgtgaacgtttgtttcacattttccctggataaggactaattaaaagtttggaaaagtatacctttttttttttttttttttgcaaacttacccatattatgtgctttttcttgatacagctgctaatctttgctgtatatgtagtgttaggaagtctactttaatacacacacacacgtttaatgaggtaaaatatgcataacataattaccattttaacaatttttaagtgtagagttcaggggcaagtacgttcatgttcttgtgcaactatcaccaccattttttctccagaaccctttttatcatctcaaactgaaactctgcacccactgaacaataactccccgttctctcctcctcctagaccctggtaacccctcatctattttctgtctctgtgtatttgactattctaggtaccacattaacgtggacttacacagtattcgtccttttgtgactggcttagtttatttagcataagatccccaaggttcagccgggtgccgtggctcatgcctgaaatccaagcactttgggaggccaaggtgggtggatcacctgaggtcaggagattgagaccagcctggccaacacggtgaaacctcatctctactaaaatacaaaaattagctgggcctggtggcgggcgcctgtaatcctagctactaggtaggctgaggcaggagattagcttgaacctgggaggcggaggttgcagtgagcagagatgggaccactccactccagcttgggcaacagagcaagaccctgtctcaaaaaaaaaaaattcaaggttcatccatgctgtggcatgtgtcataatttcatttcttcatattcctgaaatacatttctaaatataaatttttcattactgttttcatttcaagttaagtttatcagatcctgtagtccagggacttcagtctctttgaattatgtctttcttggacaatttgggagctcttttgagaaactgaatacaatttgaatacactaaaatctgaatcacaccatagataacgacatagtgtcttagtgagaagaaatttgattctgctgactaggatactaaagtttgacctttatggtcatctcttaataaaataaaaggagagcactgggctattaaatagtttattcatggatcatagggtgaataagacctagatcctagaggaaatcctccccacaaagacactcagacttttattcctgtcaatgttcttgtggatttcagggagcaatgatggctataaatctgcaactcatagcatttcaggctaaacacattcagcctttattaccattgttcatttgacctctttatccaatttttttcccacccacttgccaatatcaccttgttcttatgtaggctgtgtttcagccagcttaagccttactaacaaatgaggtgaaatccatctgaggaggaagccggggcatggtggattgaaatagcttgcctcaggagcagaaaatttggtgtggatcaagaaatagaactccaaagtatacctttccagtcattggctttagctggagccagcatccttcaatgaatcagtcaacatttacctatctgttccccacagcagttttgcaaatcgctttcagaaatcattgaaccactaacagtttatccactctgcaaaatatacacagctcttcccatatccaggagggttatcccttctcagctgcgttcaacactttttacaacccctgatttcaataagcagaatacatccacctgcttagggaaattactcttaccatataattgcctcttatgttgaaatgtccatgagaccctctcatgaaataggggacaagataaagcacagattttcccccaactcaaacatgcctgtctcatacatgtcatgcccttggaaatggccaacactgctctctgcctcctgtttagggttaaggctttcactatctcttgccacctctgatgaaattactaacaaatatattatccttaccctttgtcttctattccagcacttcaaatgcatcaaaggtccagagagaagcttcttctggtcaccttgatcttgtgatgcaaggcaggtgggagcaagggctccacctctgcagacacagagatgacggggtcgccatgccggcgttttagtcccggtttcctctgctcgagtagttggtggcctcctgcctgttccctaacataacttcactttccttacctgcaaaacgaaattagtatttcctccctcacaaggttatttgcaacttacctggctaagctgaactccagaatttggactagaggcttcaggatgctggtgcagttcaagtctggtccacatgtctcctcctccttcgagggtcattgactactttgtgtatcttcttttcatgacagttcatatgagtgcaagatggctcgatagacttgcacacaagtttaaagatttttgtatacacctcattccattgttaaagcaagttgcatggtcaaatctaacatctctggacaaggacatgcattcataccactctactgcactgcaagctcacgcagaggagcagatcataaaacgtgattgatgcatgatgatgataatgaccaacctaccatcatggacatgaccgtatgttgatactaagcctcttagtaaaatgagctaaagaaaccagaactatctgccttcagctcagctgtctgatcaaaaacttgaaatctggaaacagtggtatctggaaaacctactaaaagtggctttgggaaaatatcaattaatgtcaatttcattaattattcagggaaatccaatccaaaatatcagagatgcttacgtagaatttggaaaactttaattttcaccaaatactcatgtgctttgggcttacagcatatgaattttggcagaagagaagtgaaccagaatagaaggaggaggggatatttaataagagattacaaaaatgctttctctgggtaagagatgtggtcttcatttaatgttcaacttaaaaaaataaaaattataccatggaaaatgtgtgatttacaagatatgttaacaagtaataaaacctaataagtggatttgtatttttttaagagcataaaaatatcagtttggctattcaaatgcattaggctgttatttaggtcctctttttctttatgtgcccagtactttcatctttagaccttactaatgctagatgtcttcttgtcttacttgatagttttatattatattttattcagcctagtgatgggaagaatacgtttacaatatgtttacattgcacattagtttcttgtcatatttccagagattggataataactgataacaagagacagggaggttttcaggattttaagtccttttttctaggacttgcttctttttgataaagcagtctctacactgggtctttatatagagtacttttctctctgtccataaatagacttggttataggagaaatggcggaacagtttgagagtatggagtttcaaagcagagctcattattgatgttaataatttattaatttattaaacgtggcatgtggagtgctgttctaaatgctttcatgcatcgatgcatgagggtgctgtgtgcagtgatgccgggtcacattgccaggatcatcctcaaggactgaatgacccatttgcaggagtgtcaggacagtggatgctgactgatcacagcaaagtctgtctccaggaataacccctggccgagcaagcagcctcactcccactggaggcatccttgaagggtcacgggccagcacagttccagaagtccccctacattagtatttatattgtgtgattaattcagctacttatgttgcatttatatttatgttttttgattattgctgtgtctatgtgtttatgttttttgactataatatttatgctgtttgtttaattctgtatcaattaaaaaaaggaatgaattaatggcattcgcagcaacctggatgagattggaggctattataaatgaagtaactcatgaaaagaaaaccaaacatcatatattctcactcataagtgggagctaagctatgagatgcaaaggcatatgactgacacaatgggctttgaggactcaagggaaaagagtaggaagggagtgagggataaaatactacaaattgtgtgcagtgtatactgctcaggtgatgggtgcaccaaaatctcacaaaccaccactaaagaacttgctcatgtaaccaaacaccagctgtttcccaataacctatggaaataaaaaaattaaaagatttaatgaaaaataagtctagaagaagttcttaacccttagagtcttgtggtcacagacatttagatccatatttttatatcagcaaaataatatggtgatgagcaaagcactttgaagcatagaaacatttacattaacataaaattatatggaagaaatggaataatgtttatattcaag

SEQ ID NO: 98 - DNA, 13201 bp, Homo Sapiens
actccgctcactcccccgccccggccaatcagaggccgccgctccccgcctcccgcgccctcccgcgccggcccgcaccctccagccccgccggcctcttcctaaatcccgagcgaaagcccaagctgaacatgaactctgcccggaggcgacgggctgcggcggagggggagagagaggaggacaggctgcgaccccgggctggggacgccagggcagggacagcgagcatcaggaaggagagcgtccggggaactcgagtggccgcgccctgggtcctgcaccgtgaggctggggggaccaggaccggcgggcgcccaccttggtcctgagcccagctgccgacgctgggccagcaccctctccaccgccgccctccagtgagcagagctgggctcaggcagcagcccctgggcgcgggaaggtagcgggagctgcatttaggggaggggggaggtagcaggagctccgccagtgggaaccttggagtgaattcgtcggcgggtgccaagtcgaagcgccgacctcctgtctctggactggggcccggacccctgcgtccccaaactgcgtccccgccttgctcgtcgcccggtgccttccttaggcgcagcagaccctcggtaaacagcggttaattcgatggaatcggatcacagggccctcggtgaagcagaaaggcggaggaaatccaggaggcagaagtgaggaccctggcgcctggcgccgctgcgttgttcgtataagaagaggcatcccggaaggggcttcaaaccacttaggaccgactgctgaaacgaatccaagcttgtggtgtctgcagaatttaactgtccgcctcaaccccagtttttgtttctaagattatcgaaaactgtgcggtttgagtgatgtgctacaaagtgtttaaaacagattgtttcccaaattaggggtttccacacaagaaatcgctgctgtcggcaaacacaggaactatctatggttaagacaaggtggtgttcgtaaccaaactataaacctacatatacgaggtggtaagagaaccagaccaatgaacagtttcaggctggcgtggtgtgcccgtgaacaaagaattgtaatactggcaaaaatctaaattgctttctttccctttattttctcatcactaaaattaggaaaatgaacagatatgtcaaatctcttctaacacccatgttctgtaactctcctcgtatgtaccttataataagacaaaggtaaagacatttccatgtgcagcgaggaaaagtaataataaaaattaaaacaactagcaagtatgaagccctctttttatacggtatgtgctgtataagcacttccctcatccacctctatgttttcacagcacctctcaagggcttggacacgtgcaaatgcaaactggcaaagccaggagtcaagccaggctgctcagtggcctttgtgcttcaccccagtttaatgcacccgtcttcagaagggacatcgtgtattaggtgcttcaacacaagatccacgaatatctcgtacatccctaaaatcaagcaaatgtcatctgaacccaattactgggacagccccctcattactcccacttacttttagccgtatcttccccaatccaatctcaagtgtgagccccaaaatacttctgatttttcacgcctccacttaaaaatcttttgattatgtcatattgccgttagggtaaagttcaaacaactcagctgattttgagggctacattggtgggtggtggagtactgcccgctttcccttcatactgtcatgacagtgaggttctgaactgttctttgtgcaaaccccacacgctctctgctctctccattcccatttttgcacgtgtgagtctgctgtctcctcttctttgcttctccttttcctaagatttgccaagccaactactctacacctccatcggattttagtttacatgtctctccccatgtttctccccactagaagcctccgttgatgatccctttctagactgtgatggacgtacctcccatagctcccattgcaccattgtactaaacttggaccactgcaactgtcatgtgtctatttatcccacatgtatataaacgctatatgttgtttatcactatatcttcagtaataataaacaggtaacataattgcataagtgtgtatatcatagaccatcatgaagtgtttattgactgagaaaagaaatatacatcgttgtgaacataatgaaagacgtcatttttcagaacaaacagtttgataatagatggtattgatgagggggtatgaaaacaaatgcttcctcaaatttttgatatactttaactagtaaaatctctctgatggtaaattttacaatatctatccatgtttgaaatgcatgacctaattaactaagcaatttcacttctaaaaattcgtcctctgatatacttgtaggtatacacaaggatttaagattgaaaacaacctaaattgttattcatccaaacaatggaattctctggaactgtcaagatacataaggcaagttaacattcattaatataaaacaatctcaaatatataatgttaacaaaaaaagaaaaacaatgctcagagtatttagtagtatgctatcatttatggagaaaagaagatctatagagatataatatttctggaaggatacataagaaaatggtcacagtgaagcggagttgaatggctctagctagagtcttgaggttttgcctgattcaataagtacatgccaacagaatgtctcccagcctatcagaaaagccagctggacctctcaagtgtgtatttatatgtttaaatagtgtattaatgggttgctaatcagaggaatattgggtttttaaaaaaacagtcattgaacattaactctaacttaagacagagcgacatttgggaagcacaaataattccagcaaaagacaaatgaattctgttgtggggtgatctcctgagaagttacttaaaatattagtcattctcttagacaatttattttcctttctatttttcaacgatcaccaagtaaccttgtaattattcatcctgcttcttagtttccttgacactaaaaagtggaatccttgaaaatgggtcaaaagcattctaatcacaaaaataaattgacattctgctttgaaactgcattgcatgtgattttgagtaacataagtacataaccaagaaaatgagcatctctgggtatattgaaacatccagtgtctggacctggaagtataatctcagacctcagatggacaatatttccatgactgggcccaaagccatgccccatttggtgagcttcctaactcacctttctattattaattactgttcaatctaaaacaggtgtcatcctagtcttaaataccaaccttgagtctcctaaatgccgagcttgataaaagggcttcaatgtgaagtttgaaagaaagaagaaaaaaaatttaagtctagataagactgcaagaccagataataatgagaacattatatttaacatttttaaatgtatgtagttttcaggaatttcaggaattttccagaaataacacagaatgtttttttaaaaagtgacacatttaaacatgcatatgcacacattggagacctcagttatgtataaaaccaggaaaagataatagagcttttgaaaatgttgtcactgaggaaaaaaagaaaaagaagtttccaggattaagtttccaggatgtatcatgttgtacagaaatgataactgagctctcttgtcaaagcctacaaggccccacttggtctctcctgtgcctcctccatccctgcagtccctcaccttctgactcagctctcctaacatcccatttctcatacatgctgtattagtccattttcacactgctataaagaactccccgagactgggtaatttacaaaggaaagaggcttaactgactcacagttctgcatggctggggaacccttaggaaatttacaatcatggcagaagatgaagggaaagaaaagaccttcttcacatggccgtaggagaggcagagcagagagtgaagggggaagagcccctcataaaaccatcagatctcgtgagaactcactcactatcttgaaaacagcatggggaaccacctccatgatccaatcacctcccaccaggtccctccctcgacatatggggattccagttcgagatgagatttgggtggggacacagagccaaaccacatcacatgctgagcttattcctgcctgcccgtaaagctctacctcagaggttcccagactttctcagttcacaccaccctttactgaatgtctcagtaattatttttcctggcacttctaggctgagatttatgaagatgaacctaacacttatgtttattaagtattcagatgctaacaattcaataaacatttacttcttgacaacattagtagctatttgaaaaaaacataaattgaaagaaaaaatgtttgtacttcatttgtaagcagccacaatcacttaccaatgggatagtaatgggcatgacacaacctctcaaatcttaggatcatattagacaccaccaccttcatttcctgttccacactaattttcatgtggtattgctccttaataccacatgaaattgcaaccaccaaaacccagctttgcaaacataatgatgtcactgaaagaatgtagtgtaatctagtgttgaaactatcaactacattgagtcagtagtatgcatggtgtctaacaaatgtcaagtatctctgagtttctttcaaaattttaatatatcctgcggtgcccctgtgaatatacggcagaaacctgagcacctccatgaacctgagcacaattcctgaactatggttcatatttttgtattgtgtttgtttttgtctgagttttctagaaaacagatcctgaggcaaaacttacaagccaagactttatgtgaagttgtaattccaggactcaagaatgaaggaaaaagagaatcaaggctgaaaaggaggggaaagtaaattcaaggtggcgagttatgaatgactacagcatcacaaaacaacatacctgctttcttggtcaccagcacttcttccagacaggacctacatcattatatccagaaacattctgtccacaggagagagtggagattctctgccaatgtcttcttgtctcctgttgaaactggttgaagtttgtcccttagagaactaattaattcaccctcacctccaggttctgttactggctctttatggcaactgctagggaacccagatcccccagtgattggaggaacctctgaggatacagactgattgcacctgagcaccaaacttgtgagtctccttctaatgcaatctcagtggaatccagtcactgggagaggctgaggtcactggcacagttgggatatgaggcactggcaatggcaatggtggcttgggctggccactgagcaagcaaagacacaaaggtgtgagagaatagatggaagccagccattctggggacataaattgtgtcttatgtgctccaattcttcttatcattcaggtcttacttctcatgttatctcatcagagaagcctctcgctccctaaactgcccttctcagccattagctaacatagaactgtgtctgtgttaaactgttcccgtgttcaacctagagttgaagattgtcagacttatatcatggccataaaaaatatgaagctacagtgggagcttgctgaattagtatggagaaaaatattttaggttctattgataggaattgatttcaacaggcagtgtctaagctagatttaactaaaaatagaactattatattgcaaggagggaagaggtctttagattacccagtccagccccctctcatgcatggtgctcccacagcatctcttcatgtgatttttttttttagacttaaacaattgaagttacagaggagtcactactttctaagacaacctagtcattttcaacaggctctgtcataaagtgctttccattttttttttttatcattattcctcattcgaactgctggtgtaccaaaaaaacctatgtataatttacaatgactgtacttgagcagctagtttgcggggggcaaattgaggaattagcttgcattcccactcaatttcctcttgctgtgttctgactctcactctctcaggcaaaagtctttgggatccagagtctgacattcattgcattcactatttttcttggttacttatcaagagcaggcctgatctgcagcaaactcaatgaagtcaccaataaatttcctcccaaaaaggataaggttggcctcagaatgtgcaatgcactcctggaaaccttaattcattctgacagtcatttgttttacaggcagttggtaaatgtctacttgtaattataatgtactgttcaaggtaccagtaattcagtgaggaaaaactaaagaccctgctcttttggtgctaaacattccaatgttccactaattaataacttctgtgtatagttattaaaatccatattaaaacattcagctggactctcattcaatctgcattcctgtatttgtgtgcaaagtttggttggtaaactatgcctaatattctttttattgcatttccctaaggtatcaaacaagaaatgctatcaaggaaaatgatgctaatctaatatgactttttaattaatccatttagatttgcagggaacatatatttactgtttcagcatattacaaagactttttgagcctcttcgtgtatgaacattctgctaatgctaaggattcaaagatggatacaattagataacttccctggaagagactaccatttaattgtaataaatgaaaaccatttcctttcgtcttcacttctttttacgtagagtaatgaaagtcaagtggcaaacaccttgaccttttaacttaaaagccattcacattccctttctccatcttcctagaatatagagatgtacaagatgaaatgctttcttttccactgcccttaagtgaagtgtgactatgtgacctggttctgaacaaggagatcaaagccaaaataatcaaatggagcttcttctggagatgtgttttattagtacagaaagataatatgccctctcagtcctttgcccttttccttcttcatgcttagagaggagctcaatgcccacaagtataataaccgtcttgcaaccatgaaaatgaaaaccattcactaagcatggaagagtcagaaaatgtaataggccttagtccttgatgacttctttgagcagttgccagccgactacagtccacctactgctagactttttattatgtaaggaaattaaactctgatctgtataagccactgttaagtggatttatttttttctttacttgcagccaaatgcattcttataacatggcacaaataaattcagaaaaatacttgatatattgattgaaatattcataataatccatataaaataagatatttggactatcttgtccctaaaattatacttttatggataatttccaaacttaactataaaattagcaatattactctttaatcaaataatctcacttctagaaatgcatcttaagaaaaaaatcccaaatgaagattccaagtaaagaaagatatttgttatagaattgtttataatgttaaattaaagaaagtgacttagctggtcaacaataggaaaataattaagtaaatttttcaatgtccagtggaggaaccttatgcagacctccaaaataatagttgtgggtctaagtagaaataatacaaattgctgatgatgtgctaaatgaaaacactaggatataaaattaagtgataccatccttgaaactatatagaatatgaataaacaaagaaaaggaacacaaaacaggaaattagttgactttaaagataactcttaatttttaaattatttatagtgttacacttgtaagacattttaaatgataaatattattttattaaatactgtattattttaaaatatatcttctcttgtgcctctaccagggacagaggtattataaacctatggtttagaacactggaaaaatataaacagagctatagatttaaacaaacaacataaaacattttaattcagtatatagaggtaaaattgggaatgctcataaagattagaatggttccactcaagaatgaacatgaaatgtaaagtcaaataaggtaaagaaatttggttatggttttgttttccttgagtgtcatgcacaatgaagttattttaataattaaggttgtcttttgcacaaatgaaaatggcaataataagatgtcagagctgtaagggatgttggagattatctgtcatcatctttcactcacaaattaagaaacagaccttgagaagataaatgactcacccaaggtcacataagtagtcagtggagaaggagcaatgaagttcaggtctttttcaatgttattcatcccccagaataaacacgcattaaataagcattcattaagtagctagctattctgtgctagctgtatttggacactgtgaatatacgggacactgtgtttcacactctacacaaagataagttgtggacatatcctacccttaaaggatcagagttttgtggggtgaacattagggtaataattataagacatattgatataagtacttgcattctactaagttccatgtgccttggggcatgaccttgaaggacataacataacatttggtgtctgagaagtctcaggaaagaaatgacttttgccttatctctaaaggtttgagtgaaattttaccacccagaaacagcacattgcaaaagcacagaaaaatgaaaaacttgggtgttctacagaatgcagaatacattgatatggcacaaatttggaatgggggtaggtggcaaggaagaaggggaggcagatgaggctagagtggggcaagttacagacacttggagagattcttctattctgaggattttgaaatttgtggaataggaagataaaatacatggattattcctaggcaggaaaaatggtataatcatataatgtaagtttcagaaatgtatcaaggtgtggaggacaaagctggacaggaagaagcaggaagacaagttatgaggctattgaggtagtctgtgcaagatatactaaggacctgatatgaggaagtgacagtgggctaggaaagggaataaatacttgaaagatatttctgaggtataatttttaaaattttaacaaattggttgtaaatagggaaatggtggaataagagttaaatccaaccatcctgaagtagtttaatcaataagtagctctagaaattttaggcaaatttaaataacacaaaaaccctaaaagaatttaatttgctcctatctgtacgtcacaaagtgatgctcaaaacttccataattagcacatcaaatctcttggtaatcaaatgcaagttttgcaagggagatcttgaattaagaatatatatcacacttaccaagactgaatcaggaagacatagaaatatgaatcagatctataactagtaatgagattgaattattaatcaactatcaaacaaaggaaagtccaggaccaaatgggtgtcactggtggattctgctaaacgtttaaagaagaattaacactaattatcctcagactcttccagaaaattaaagagttccaaactcattctataaggccagcattaatcttataccaaacccagacaaaaacacttcaggaaaactatagactaatatccctgatgaatattgacacaaaatcctcaacaaaatgctaccaaacagaattcaacagcatatttaaaagattctacacaatgactatgtgagatttatttctggaatgtgaggatgattcaacagatgaaaatcaatcaatgtaatatatcacattaacaaatcaatcaatgtagtatatcacatttacaaaacgaagggtaaaaaaaactcagtcgtctcaattgatataaaaaagaacctgacaaaattcaacaaccttgaataatacaataaaataactcaataaactaaggatagagggtaactaccctaacataataaaagccatatatgaaaaattcacagctcacgtcatattcaatggtgaaagactgaaagctctgtctccaatatcagaaacaagacaattatgcccacttttgccatttctattcaacacagtcctggaagcttaagccagcactattaggcaagaaaaatcagtaaaaggctacacactgaaagaaagaggtaaaattatctccgtctgcagacataatcttaagtgtagaatgctttaaagatttcaccaattattattttttaaactactagaactaacaaattcagcaaagttgcaggatacaaactcaacacaaaagaagcaggtgtgtttctatacactaacaatgagcaatccaaaaaaataagaagcagcagccaattccatttacagtagcaccaaaaataataaaatacttcggagtaacttaaccaaggtggtcaaaaaattgtatattgaaaactacaaaacaatgtttaagcaaataagacacaaataaatggaaatatatttttgtttattagttaaaagacttaatattgttaacatatcagtactacccaaagcaatctatagatttatgcaattcctgtcaaaataccagtagcattttttgcagaaatagaaaaatccattttcagattcatatgaaatcacaggggaccccaaatagccaaaacaatcttctaaaaaaagaacaaagatggaggttttacatttcctgatttcaaaacttattaaaatgctatattaatcaaaactatgtggtactggcataaagacatgcatatagaccaatggaatagaataagagagctcagaaattagctctcatacatagggtcaaatgatttttggcaagagtgtcaagactgttcaatggggaaacagtgtctcctcaacaaatgatgctgggaaaattggacatccatatgcaaaagaatgaatttggacctctatcttacaccatatacaaaaattacgtcaaaatggatcaaagatctaaactgaagacctaaaactataaaatgcttaccagaaaatatagaggaaaagctttatgatattaaatttggcaaagatttcctggacatgacaccaaaaacacaggcaagaaaagtaaaagtagacaaattgaaatatatcaaaatataaaacttctgtgcatcagaggacacaagcaacagagtaaaaaggcaaactatggaattaaagagaatatttgtaaatacatctgataaggaattaatatccagaatatattaagaactcctacaactgaacaacaacaaaaaaataacctgatttaaaaatggaaaaaaatctgaacagacatttttcaaaagtgatatataaacggatataaatggccaacaagcatatgaaaagatattcaacattgttaatcattagggaaatgcaaatcaaaaccaacaatgagatatcactcacacccattagaatgaagaagaaagaaaaaaaagatggaaggaaggaagaaaaaaaaagaaagaaagaaggaaagaaagacagggaaagaagagttgataaagataaggagaaattggaactttagtgcacgattgggaatgtaaaatggtgcagacacaaggaaaagagtgtagcagtttctatatgatccaacaattccactgttgcacatatatatgcaaaataattgaaggcaagatttcaaagagatagttacatactcatattcatagcagcactattcacaatagccaagaggtaaaaccaacgcaagtgtccattaatggatgaacagataagcaaaatgagatctattcatacaatgcaatattaattagccttcaaaaggaagaaaactctgacacagtcaacaacttggatgaattttgaaaacattatgctaagtgaaataagccagtcacaaagagacaaatactgtatgattccacttaataagagatatctagagtcgtcagattcttagaaatggaaagtagaatggtgattgccaggcaccagggcaaggtgaaagaaacagttgttatttaatgggtacagagtttctgttttgcaaatgaaaaagttctggagattggttgtacagcaatgtgcatatacttaatactcctgaattatacaattagaaattgttacaatggtaaattttatatatattcttaaccacaatcgaatttttgaaaaaagaatactagtggtggaaaacctctgaaagaagggtaaaaaactatgttatgggcaacaatgaaaataaatttacactgaggccacaaattattgaaattcatctctgactttaagtctcagaccatgagcaaggaaaataaattctcttaagaagataggcccaaatgactaagagtcaggtagaagcaatttgcaaagcaaggaaagaaataatttcttgatggagtcatctacactgtgatgccaatccctgcaccagttttcgttggagcgtgccctcccctcttcattaatcaaaggtaatgcagaattacagaatggaattacttgccaaagagttttccattttctgtccctgagatgatgctgattggagcgagaaaagttttctgaggacaaatgctcacgctcttagcaccagagtttgcttgtagcaaaaacagaatgcttagaggtgtgcttttgttattattctcagtggctctggtgagcccagtgcaatcagcgatactcatccaggccaattcaccattagggagccgcacatgaaaccatttacatttcccattttgtttcaagcaagtcaggtctttaactggattgtggtaattgaaccttcctgttacaacactgcttttgctgcccaacggattcaaaagctgctctcgttacatttatttgaacttttatttcattcatactttatacctctggttctcaatcttcagtcctgtagcgaactctataaaaggaaaaagaaattcttacagactctcacagattcatttaaattctttttttgttttattttattattattatt

SEQ ID NO: 99 - DNA, 3564 bp, Homo Sapiens
tgaaattccacatcctcgggctgacaccgattctaaatgatcaaaggcagaagatttataccagataaagccatatggattgctggtctaaaattcaaggcaggttagttgacttaattctttggtgctggtgactgttagtttgtaaaagttcaataagtcagatgaaggaagggatggtgccgggagctgtcaagctgtactggtggggtctgtaattagagctaactggagggatcatgatgtctactgtccagtttggtgttgagccatggctctcggtagaagttgccggctggggcctggtcaggactggaaggagagtggtgggatgtgctgtgcctatggtgggctagctgcagccagtggggtgcctgccccacactgctgcccaccccttcatcagctgattctgctcccacataaagaaaggtgttggcttagtgtcacttcttcctagagccatgggagttttctgtcagcatgtttttgagctgtcctggtaacttggacgggaagcagtctggaggtgggtgccttccaaatctctgccacagaatctgaacttgcactttgcagcctgttagtcagagctgctaagtttgctctacctggtgtgcctcttggcaccacctgagagatgtatgtagagaggctgctaagaaatgagtgcccctggcatgaagacgtcatatcccagatgtttaacttctggctggagggagggaacttaatttggttcattatctactgggtacctttcctgtgcggaggggaggaccagtgactttccataataagctttctcctttaaaaaaacttcagactcttacttactcttttggttcacactaattagcattcattttccagagaaagctgcttgactttgaggaaataaagacaggtgtccttaaaaatggactgcaaatctggatcagtgtcaggtctgctttagggtccatgaaatcacccaagagtgttggtactaaaagtggtgtaggctgggcgcggtggctcgcgcctgtaatcccagcactttgggaggccaaggcgggtggatcacctgaggtcagacattcgagaccagcctggccaacatggtgaaaccctgtctctactaaaaatacaaaattagccaggcatggtggctggtgcttgtaatcccagctacttgagaggtcgaggcagaatcgcttgaaccaggaaggtggaggttgcagtgagccaagattgcaccactgcactccagcccggttgacaagagaaactccatctcaaaaaaaaaaaaaagaaaagtgcataggggtttgttcccccaccctctgaaagaccccaaggaaattctagaagcaaaaatttgacctcttggagcacagagactaagtataagtggaagaagcagacctaaccctcctcccaggcagtcagtcctatgagttttaggctgaggtttcattttagcctctgatcgatgtatctgtaaagctgatctaaactcccagtttcctagaagccactgctgtgagcctgggggttgtactgaatggctctgctggcacccaagagcagctgactccactgtcactgcccccgtttctgagcctccagacaggttctgggaggagccagccccctatgaattgtatcacttgtatagatagagatttgacttcaggacctccctggatggtggagattgtgtgtgcccatgtgtgcaaggagatagatagattctcaatccagtgaagcagtagccagctagaacagaacactgattgtgggctattaaaggagtttctcattagttatggcaccagattcccagcttccattttggctcaaaaaaggagcctaaaacccacttgtgggataatttaataagccattagatgcttggagggcaccaagccagccttgttgctgaaggatttactagaaagggcctaggagtccttcttccctttttgcttgctcttcccctagccccagttaatttaactatcactgtaaagctgctgtaaaccagaatccagttttttattcgtaaggcaccaggatagaactgttcttgccaccctcctatttcagtaattgcctgaatttccctgaaagggtgacatacttcacttcttgacatttaggaaggacagtggccactcagtggcaggtgactgtcccgaggatgcagtagacaagccagcatgctggctcagactgtaaattaggtagggtttgcatagctgtttctgactacaaaaatagcatgggtgttagttgaaacagtgcactgaaataagcagtggttaagttttgaacctgaatcctttaaagaaattagtctgaggtaaaatgttttaaatcatttttgaccttcagcttgtgcctctgacagagcttttgtcctaaagctgagagtagaagcaggattagatgtggtcatctgtggtgtggacacagcagacctgccatgtggactgacggtagatgggagaaccgcttgttagtgttctgggcttcctgatgatccccccctcctccccgtagaaagtctgtcatccgctgtgacagtgtcagtgaaaaagagaacaagtttccactgccagctctggccctcaccccaactcctttctctaagagtaacggggactgggcatagggaccccgggcaggagctagcggcatcctctaacaagaactacatctgtaaacaataaggagaaagccaggtggatagatgaaacctacaggagggcccttcaacaggcctaatagaagggtcacttccaaactggcacgagcagttaacagtgtcccttaaatctttctctggaaggaaggaaagatcaattacattcacaagttcacacttctgcctgtgctcctcaagggcagctgttgaggcctggaattcctcactggtcagagaggtgtgtactgattgtctatggcccgcaggtggctccgggaggatgagtccatttcgtagtccgagtcccgggctcgattcacaggctcatgctccaggtgctgcaggctgttggccagttcttcgggcgaaggcaccaggtggaagatctgctcggggggtgaggatcgccctgggagaccctctgggctgagcccccggggacagccagaagaactaaggtggggaaggcccaactctgaaccccagtgaggaagggactctgaatcccagtgaggaagggagaaagggaagaggaccgtgttgcaggaacctaggacaagtgaccaagagagaccacaccatcagtcttgaggcaagtgctgacaggacacagaacaagatacctgtacccctgggtctgcagcaagcctctaccctctacccagtgtcagccacccccttcagcaaagggcagtagggtcagacctggtggttgggagacgactaccacgtagctggagagccggacatcacaggcggcgccgcactcgagtgggatgggcgagcgctggaagtggtggagcatgtccacgaccgagggaaagtggaggtgctgcacacggcactggccccgctctgtcagcgacaggcgc

SEQ ID NO: 100 - DNA, 2986 bp, Homo Sapiens
aacttggcctgtgattcattaaaatgtttcgtgaatattgccaatcttccccacttcgttagacttttcccctgcttctactctctgtgtctggctcagtcttgtcctggcctctaaatgtgtttattctatacagtttgtgtgtttgttcatttattaattcaataaatatttattaagtatctgcttatcttaagcacttatagtcacagatgttcataccattaagcatgccatccaagataaacttgaaaagtttttgggacttgatacattgcagaaacatcaaacttatttaagttcaatgtacacttgaagaatctgcattattttttcctatctagaaattttatactttaagaccctgagttactctttacatccaaaagaaccaaagtcatgagattaaattaaaaaagggtttggtagatccagagaattattagctgtcagtgttagggagaatagcattaacattttatggggtatttctactttatgcctatcacctcatatactataatctcatttcaccttaatatatataggtatgaagtatatatttatatatgtaatatatttatacaagtaatatattaatcccataaaaaggtataaaataaaaaataacgtatcttcactccatcatctctcttccctttgtatatatatccagaaaaaaggttttatgcatatacctgtatgtttagaaatacaatggatatgtgcatatatgtatatactttttattatatatgtataactttaattaacacaaatagagtcatatgatccacaccactgcctatgtagcttttaaaacataaatacatatgggagctgtttcctcaaaagcacatacagaccaagctcattactgtatttgactgtgtggcattccgtagtatgagcgtaccagagtatattacctggttcctattggtggacatttagattgtttcttgtttttataattataagtagttataagaatgtattaatatctgtgtcttggcagatatttttgactatacatctccatagaaaactttctaacatgaaatgactgggttaaagtatattggtatttagaaatttgatagacatagctgacttgctatcaaaaaatattatgtaaatgtacacttttccatcaataatagaagttgaaaacaaaattttagtttctttttccacacactatcgccaatattggttattttggcaaaatgatatttcatttttttatgtttctttaaattttagaagttgagcatattttcatgtttacaggacctttttattagttttcctaaaagcttcctgttcacagcctttgactattttctattgcaccatattttaaaaatggatttatattaggtcttttaaaattaagaaattggctttttgcatccacattgcacatagttttctaagtattttgtcttttgactttatgcatttttatgtacaaaatgttatatttctgtgtagacaatttatcattcttttaaaattgcatctaggttttatgtcctgtttacaaaagcccttccaattccaagattgtaaataaatttgcctgggccttattctagtgtttttataggtttattttgaaaaactttgattcatctggaattaaaactttttcgtggcataagaagcaatataatgatccatcctctttccagcccttcaccctttcttcttccctctctctctccctttgtcattggctagctacatgtcctaattctggttactgcatactccattcttacccctgctttgaaatgcctcttttatcatgttagtatctccagctcacatatgagaagctacactaacaaagatagtggcagagccagaatttgattccttgttaatttaaagctaaggtctgaccttttctcacttcagtgttttggattgatactgaggagaggcatgtttatcatcttttcaaatttgctttttttttttttttttttttttagtttttgtgggtacatagtaggtgtatatatttatggggtacatgagacgtcttgatacaggcatgtggtctgaaatagcacattatggggaatgaggtatctatcccttcaagcatttacactttaagttacaaacaattcaattacactctttaagttattttaaaatgtgtcatcttaatttagatttggattttatttattactttgaaactcagatcctcaattcatgccatactctcctcgttggtccaggcatgacttttaagttaattatttatttttaatataaataaacagccatatgcccaccactcaacctggaaatgaacattgatgaatatggtttttttcctttctagttccttgtctttcctacttgagtttccctattctaaatcttgtattgatttatctctttttttaaatatgggaaatacgttacttctggtatgttattataagaaaaataatgctatccttcctaaaaataatgtaatttagtgttagttatttttaactttataaaagaggcaagaagttgtatgtaacattttgggacttagtttttagctttttttttttttaactcaatgtcatatttctaaaattcatccatattcttattacagttaaattgttactgataatttggaaaaccgtcagcattatcttatacagttgagtctacacattctttacaactgataaatttcactctcatttatatatcccacagagactcttgcaatgcctaccagagataagtacaagaatgttaatagcagcatgtttgtaatagcaaaactctagaaataatccaaatccccatcaataggagaaaagataaataaataatgggatattcacatcaaataacattttgtactattaaaaattttaatgtaattaggctcatttaaatatttatcataacaaattcaacataatggagacaaccaatgtttcactaatttatgatg

SEQ ID NO: 101 - DNA, 1146 bp, Homo Sapiens
ttctgacaggaggagtcacatgcctaggaagtatcctaacaggatgatgcagcatgaaggcccccctcagatgctggtgcaatgatcttggacttcccaacctccagaaccatgagccaaacaaatttctattgtttataaattaccccgtctcaagtattctgttatagcaacacaactggactaagacagagggttacacgtatctttcacaggaattccttggggcttaatacaaatccttgagagttctagcccagatgcagcctagaaatgtgaagatgaaggaggtaggtagtagggttgttattaatcctaggggaaaccctccactatgggattctgaaatcagcagataaatgctgcagcccccagacttgtgaagaaatttttgagattcatcttctctggttcttcagcacatcaccaaggcatggacctgcagttggctccagctataactagctcaatgatgcatccttcactgtttttctttctttccccatttttctctgtatgtttccttactttagcttcctgggatcaactcccaaataagctacctgaagccaactgtttgcccaatacactttcttcaggaaacccagtctgagacataagaaaacaaatcaaatgctaattcagtggttcagttggtaaaaataacagagactcagcctagttggcactagtggagataaagaaaagaggacaactttgttatgcattttatagacagtcatgaggcatgcaaattggtgtaatgtatgcagaaaaagaaagggaaattttcagtgtgatactacagttagtccactgtatacctagaattgtctttttcagagaaagatggtggcctttggaaaaggtacagatttgggaggaagatcgttaattcaatttgggcatgttatgtccaaactacattaaatacttgagaactatttctttaataatggatgagtgaagtcagttcatttccaagcttcttatttgtcttatctgtgaaagaaaaattgtgatgtctagtacccagatatgtaaaaagtaaatgtaatctaccacattaaagctcaaaatgctcgatgtttttgcaaatataaaataatgtgacttactttaaagataataaattaaatattaaac

SEQ ID NO: 102 - DNA, 2196 bp, Homo Sapiens
ggcaacctgctggggtctccttccgcattgtggctgctttgttctttcgctctttgcagtaaatcttgctactgctcagtctttgggtccacgctgcttttatgagctgtaacactcaccgcgaagatctgcagtttcactcctgaacccagcaagaccacgagcccaccgggagaaacaaacaactccagacgtgctaccttaagagctgtaacactcaccgtgaaggtctgcagcttcactcctggagccagtgagcccacgagcccaccgggaggaacgaaagactccagacgcgctgccttaagggctgtaacactaaccgtgaaggtctgtagcttcactcctcagccagcgagaccacgaacccaccagaaggaagaaactccaaacacatctgaacatcagaaggggcagactccagacgcgccaccttaagagctgtaacactcaccgcgagggtccgtggcttcattcttgaagtcagtgagagcaagaacccaccaattccggacacacttccacatcttcaggtttgtcaggaagacctgcttgggacccctctctgcagcagagagcttttctctttctttcgcctattaaacctccgctcttggccaggcacagtggctcatgcctgtaatcccagcactttgggaggccaaggagggcagatcatgaggttaggagttcgagaccaggttggccaatatggtgagaccctgtctctactaaaaaaacaaaacttaccctggcgtgggggtgtgcgcctgtaatcccagctactcgggagcctgaggcaggagaatcactggaacctgggaggcagaggttgcagtgagccaagatcgtgccactgcactccagcccgggtgacagagcaagactctgtcaaaaagaaaaaaaaggccaagcgcagtggctcacgcctgtaatcccagcactttgggaggctgagttgggtggatcacctgaggtcaggagttcaagaccagcctggccaacatgatgcaacaccacctctactaaaaatacaaaaattagctgagcgtagtggcgtgcgcctgtagtcccagctacttgggaagctgaggcaggggaatcgcttgaacccgggaggtggaggttgcagtgagccgatcacgcctctggactccagcctgggagacagagcaagactccgtcacagaaaaaaaataaagaaaaagaaaagaaaacctcactgttaacctcaaaaaagatttgtctttcattatgtccctaaatacacacatcagttacttgtagcatgcatattcccatttcaatgctctattcacaaataaacgtcttttcctttagaaagcatgtttctgttttttatttaagttgacatatatggtgtcggaagtgagatctgaacagtatcactacaggaaggaatcagcaatctttggaactggtgtgcagtatatatttgaactctttgagatctctgcttcaatagctcaccttttctaccctggcaggatacagttggaaacattggttatattactaaggctttgactgaaatgttatatttaagaatatgcatacaatgcctagcttcaagagttcctggccctacactaagtgagtcaaacttgacatctttcagccaggtgtggtggctcatgcctgtaatcccagcactttgggaggccgaggcgggcggatcacctgaggtcgggagttcgagaccagcctggccaacatggtgaaaccccatctctactaaaaatacaaaaagtagccaggtgaggtggtgcgtgcctgtaatcctagctactcgggaggctgaagcagaagaatcactggaacctgggaggcggaggctgcagtgagccgagactgagccactgcactccagtctgggggacagagtgagactctgtctcaaaaaaaacaaaaaaacaaacaacaacaacaacaacaaaaaggacatctttcacatttgtcccttttgatcaagatctggcagatccaagaacctttaaactctctgcaggcaggaacaatccagcaggaagatcactgagccaggactgaggtgatttctcatcccaggtttaccactgacgtgtcatgggtcttgaggtaaacaacttaatttatagggtcttatccacagtccactgcagtcctgctagtccctggactgctcagtctggcatg

SEQ ID NO: 103 - DNA, 3914 bp, Homo Sapiens
aggctgtcaaaggcaattgccacaagaggtcaacgccaaggctgctctgcagatatgaccagggctcattttttccatgatcttagagaaactggataagcccggggcaaatcgggcccagagatgagatggtaggacattatggcaggccctgaaaccccagcgtgccccagcagaggcctgtggtggcctctggggaggtgggcggtggtggaggtccgtgtgagagggcagcagcagcagcagattaggccctgtggaagcccacttccttccagagacagtgccaggggaggaagggtccagactgagggcaggacgggccagggggtgtggcaggcggatgcccccctgggcaggtgacctcatccacccctcccgtgtcgcctcctctgatctgctccctctggagatggggaaatccagagtaggggcaacaggaagtatattcccaagaagactgtagacccccgcacagggaaacgatggagctcaggaggggcgctgatctcgggagcctggatccaccagttatgcaagtgatgaagtgagtacgcacggtcctcgaggccagggccggcgcagtaagaacgaacaggttgttctggaaaattgtctggcagcctccccgcggcctgcctgcaggaactggcatctgtggagtactttgccttgcttgttgatccacagcacttaccacatcctggagaaacaggtcaatacaggtggccctcaggagccatgggccccatgtttggaactctgacccacacaggggcaacctgaactcctgagccatagccaacccctcccacccggggcctctgatgagctgggcccccctgcaaataacgttcctgtctgtttccatctgtgagctcctgctcgcgatctaaggcccagctgaaagtgcttcttccttcctgggccaccttcctttcattctcagcttttctaaattatgaacatttcaaacattcccaaaggagagagagtgcacgatgcacctgaaccatatgtcgcccagaatccatggctatcaagatcttaccacagttgcttcatggatccctgcctctacttatttctttctgagttgctttaatgtttcacgccactttatatctatgtactagattttgcatctctaaaatagaggggcatttttatacgtaatgatgttatggtcgtctggcctaaaaattgccaacacttccttgctatctatcattcaatacccagtccatattgaaatttcccttctgaaaattaatttttggaatcaagtctaccatcggatttggttgaatttctgaaggaagggggtccattgctctgccgaatgtccccacatggcttctgtctccatccaccacgtatgtccagcttgcggccctgactctaggtgccctcaattatgcccactgtggaaacggcctttctgccacatctgaagcttgagccttggaggcaggcatgacgtctcatctctgtgttctttgtggttcccaaggcaatgcgtggtgtatccgaagtgctccactgagtctcgaaaacgtccctgcattggagggatcatggagtgaattttgtctttgccactccacttacaacttcaagtctggagattttgaaacaccccatgactgggagtgaccgctggctcggagaggtttgtacacagagcagagggtagactagatgacccttaagatccaccatgactctgcaattcaggcatgcggaacctggctgatgacagacatcgactttgtcctccaacctttttccgggacttatcaatattctcgtggttaaattccacaagctggcatgatctgaggagggaaattaggacatggtttcttgccattactttttacagcttggcaaggggcaggaggctgccatccccttctgtggttgctgtgtcattctgtggggttgctggagccggggcctgaggtgtcagggcggtggaagctcctgaccctgccctgctttctgacccacctctcatctcacaacctctgaccttgtttatttctagaggcataatctgtgtgccatattgtgagtaaatgagaaaatgtggcttggattatggaattcagctttatgattcatttgttcagcaagctctttttgagaatctatcttgtgccaggccctagattctgggggtttaaaaattgccaagacccaggcgtggtggctcacgccgctaatcccagcattttgggaggccgaggtgggcgaatcacaaggtcaggagttcgagaccagcctggccaacatggtgaaaacccgtctttactaaaaatacaaaaaaaattagctaggcatggtggtgggtgcctgtaatcccagctactcgggaggctgaggcaggagaatcgcttgaacccaggaggcgcaggttgcagtgaggcgagatctcaccactgcactctagcctggatgacagtgcaagactccatctgaaaaaaaaaaaaaaaaaaacaacaaaacaagaacggccaagacccaccttgctagcaagaagttcactgtctaatgacagagacagaccaaagtggcataagagagcaagcctgaatgctatgagagagacccatttcagactgctggggtataggagggcttcctggaggaggcagcttctaagttgagtcttaaagggtgaagtacagacatgaaagaagcaatgcctgggaaggtactcaagaaaaagcatgatgtggtggggaagggctgcagcccagccctgtgcctgcatcccacgcatttctacttgattccttagctccctaaaccttgcttgtctcatctgtaaggtggagataaaaataacagtcttcttttattatgtgagttgcaaatgacagagtgcatgtgaaggctcctggtgccaaaaatgttagcagaattgagtggaagcagagtgaacactcactgagggccgggagacttaggagggagctggaccccccgggatgctttgctggatgaccacagcttggggagggggctactgcctttggagaatggcaacactatcatgcagctcagaaggctggagtctaataccctgctcagcaaccaggcatagtccattccatcacagagcctgggttcaccttgaggacagtgagaactcagccctggccatgtggaagtcaaagcgtgcagcacctacgtacatggacctcacctgtcatccaagtctccaaaccacactgcaatacaaacatcgccaaagtagcaggcttctctcctctgggtgacatccacagggcagatctgagcaacacttagtgtctcctgggaccttcccagcctcggacagaatggttgttagaggaacaaggcaccaggggcgtgatgagagcttagctgaaaggagagaagactcagcaagcacatcaccttgaagctgacctgtcagccagatttcgcagcacctgcctgttccagcctgaggggctgcgattcattccttgggaaagagagctgcaaattcccgctctaggccacagtccaaatccttgctcttctctctcaggttctggaagacagaatggaggcatctacagagcaaggacatgttttctacctgaattagcttttctgacaccttcaaaccatctctaagaaattgattttttaacatacacatatacaggtaaacatttaaatctgtgccataatgtatttgcacttcgagtccccctgaagtcctaagtcacatgcttctcttcctaggggttctgtctgaagcagagacccctggattggagcagtgggaagaatcctgatgaatcaggtgttcctgcctgtttacattaactgggcaccctgcctgcccaccccacatgctgaatactgctggggagaagagaagaaacatttat

SEQ ID NO: 104 - DNA, 1948 bp, Homo Sapiens
atccattttcaaaattctctaggcaaacaacacattcagtacagtgcagcatatcagcaggccaagttaaccaatcaggttccatatcttcattagtgttatatgatccatatgacctccccttcctttcacatgggctggtctgacaatatttattggcacatgaacaagcctcagcatcacagtgacttgctgttcctggagaattgtgaagtacgctttgcttatcttcaaatacttccttctcactactcaaagtgtctgtgttctcactttccgagtcattttcagtatcttgagacccctccgacatttcctcttcagactggactccaagacatttaaatcgccacattgagactatacgtaacatggacctggaaaagcttaaaaatatgaagaggattgaactggctgccatctgtgcatcttcatttatgaaaacactcctcatagacttaaaacaaatgacagagaacaaattagtcagcttcttctaaaatacagtggtctccccttaccctcagtttcactttctgcagtcaactgcagtccgaaaatactacatacaattagatattcggagagagagacaccacatttacataaatgttatttcagtatactgttataattgttctatttttattagttgttgttgttactgtgcctaacttacacattaaactttatcacaggtatgtatgtataggaaaaaacatagactatataggatttggtactatccacggtttcaggcatccactgggggtcttggaacgcatccccctcagataaggggggactactgtaaacagaaaataacaacaattcaaattgttaaaaacaattcttgaaagttatcctttacaatagattaatatatatgatctgagctgaaagaatggcaagcaatggagacaatatttctcttctgtttctagtagatattttcaattttaagcatagttttaaaaagtacaaccctcttttaagggcttaaaccaaggtggctgtgctgattggcttagctggctagttcacagtgccaaggacagggtttcaatctcattcttctcagttgtcctgccagagattgttctttcagaccaggccagccatttgacagatgtaagccactggcctcaaggaacacaagccagacagtggtggtcaatgcaaaccttgagcatcactggaaaaattaagcaggtgtcctactgcattatttccatacatagaaaaaccacagaaatacattctatttttaaagagttgtttttcaactattaatacctataaggtttaaaaatattttcagagaaaaaaaatttagcaactagaatttataatgctaccatttactatcattatttgtccttcacttcatttgtcaccttaccagagaattccttgccactctcatctccttaatctgcttatttttcttcttactactttccactaactgatgttatattaaatatttatttatttggtgtctgcctctcccaactagaatgtgagctgcctgacagagcaaggccttagcttggtgtgtgtttctggtatatcttcagggcccagaacagggcctggcacacccacaactgaataaacttttgatgaattctgtcacatatttattacaggagcttaattcatggatatctttaacaggacatcaaaaacagtagatcatttacaagccaagaacatactgctaactattgaaccagaatgtatttgttgtctataggcagcagcctatatagcaaaagaactcaagacttttgacatagcccttccaagtttcaaaggtgtgcaacatcttcaccatttatttccatgggatcattcaatgtgggtgacatttagacactgaaagcagggcagtgggactggctattcaattcatcctcagtaataaaatctaaaattatcaaaa

SEQ ID NO: 105 - DNA, 4758 bp, Homo Sapiens
gggaatggggcctgcttgccctccaagcttcttgatcggtttcagtgtatcagcatctgggcctctctcagcaaagtccacctgtgagcctgggcactgcaggttgcaggctggagtttctaagaaagttttggcacccagtttggataatggggccactgttgagggaactgatgttcgtgagctgacaaccccccgcccgccggcctgaggatggggttccctctctaaacccccatgtcggcagccgctgaccttcatgttcactcaaggcccttgactgaaggcccccatctgccacttggttgcccaagttctatgttccgtatgcgctggcccatgcatggctccccttccctcaggcagaccctggtgctaccatcctggccttggcgagcacctgccctcctccgcatgacctgtcccacttgtaacgtcattaccaagctccgtgatagctgctgtctgcccagactgcgcctctgctcttttctcccagcctctatccaagtagccccctctgcctggaacagtgctactcaaagtgtggtccccaaaccagcagtgtcaaggttgctgggaactggggagacatacatattcccaggccccacctcacactgactgaatcagaaccgctgggggtgggggctcaaggatgtatttcaagcgctccagatgactcttctagacactaaggtttcagagccactgtccccagacagggtgcccctcctgctctgcctggtgactatctgtctgcctctctctatctctctgtttgtaggagctcagatcatgccctggagaagcaggtgacatcgcggaattttcctgttccagatgccagaagtctgaaatgaaggtgtaaagcagggtggttccttctggaggctctgagagaatcaccccaggcctctctccagcttctggtgctggtattctcaggcttgtaggcgcatcacccatgtctgcctccatcttcacatggccttctcctctgtgtctgcctgaagtctcccttcatttctcttgtaaggacatcagtcattggatttagagcccaccctaaacccagaatgatctcatctcaagattacatctgcacagacgctatttccagataaggtcacagtcaaaggtaccaggggttaggatatgaacatatctttttgaaagacacgatttaacctacagcaggtgctcagggcagttgggtgggggcctgtgctaggggcccaacagccaaggcttaaagccgcactccacacctaggcctgtgacacctcccacaagcttcttcacctctcaagcctcaacttctacttctgcaaacagggaacaataaaagtatctccctgcccccaccttgcagggtttccagttccaatgtctacacactcacctgggagttatctgaaattgttgttcacctgcttaaaccttttgagtttccagcaccccccagaagtccccaccctctagtcccttagcaagatactggccctgcgtgagcttcccaccttccttgacagctgcatctctcatcattaggacctgggcaacactgcagaatatggcaggtcttccctcatctctgtgctttgcctccattccctgacttctctcccatcctcctcctgtcacctggcctctccccatcctactggccttaaagctcagctcctgaagcctccctgatgctcctcccttcatagcccctcccagcctggccacgtgggctcgggcagcccagagcctgggcctcctggtcacactctgagcacacagcccattttctctccagtgctggcttgtgtttgacaccatgcctgacacattgggggtgctcagtagacctgtgtgagatggacagcctcccgtacagatggacggacagatgtacaggtaggtgaatgaactttcgttgcccctaaagcaggagagactctgagtttctgagacaacggccaagaactttctgataagatctctgcatttaaggttcagaaaaactcgatgaggacaatatttttctcccgattttgcagataagaaaatagaggcatagagaagtcacttgctagtaaatgttagaggcagctttctaacccaggtccatgtgaacccagaaaaagaggcagtgagcacctgttcacccaggagcagctctcagaagataagataatacgaggaggaggcagcagacccctatgccacgcgtccacctggggctgtccatcacttcctgcaagatcttgctggtagccagattctcagagacccccagtgagccccgcctcctggttttcacaccctgtgtagtttcctttccccagggatggtccaagtgaccagcagcccgtggcagaagtgatggaatagcacttccaagcttaggttatgaaagattgcagcttcaatctcctgccccacaccccgtctctctctctaaccccactccctccctccctctctcatctctgactctgggggaagcacactgcagccccgtggagatgccctgtgtaagccactgaagcctctggccaacagcagtgggaacctgagacgtgtccacaagcatgcatgggagcttggaagtggatccttcagccccagccaagccttcagacgatgcagcctcagggacagtatgactgcagcctcatgagaccctgagccagaaacacccctccaagccactcccagatgcctggccctcagaacctgggaggtaataaatatttatggctgtttgaagctgctgtatcgggggacaatttgttacacagtaatagctaactggtgcagtcctgggactcttagcagtttggagtatcagttattttgccaaggcggggaagttaacagtggtcattgcagcagctgcacttggggaccacaataaagaagctttctcagactggtttgaacaaagtggtgaattctctgcaaggacacagaggtgtctctcaaaacccaaggatgggacagcaggcctcaagaagaactggaacctctgtcccttctgtgcttctttttactcctgtgttctctgcttcttggagcacttggcagttgggaagtggccatttcaattctcgtggtcaagaaaccagctcagaaataacccaaccaacacaggtggggtcaggtgtccatcctggctccatttgtcatggcgggagatggtgatgaagagaaacatccaggaccattggtagggcacccgaatgagattccaggagaggccagttctaagagaagggtactagaaagatacccattgaagtcaataccacatgtggcacatcctcctttcaggtggcaagtgtgtagccaaagcaaggttcagggtccatatttgaaagtcagaaactgaataaactgttttctcccaccccgagcactgtggggaactctgctcacaaatccaccatccaccatcaccagccgtgctcatctgaccattcatgcaggctcacacttgacctgatgtgggttctgtctcctttgcttgagaattgaaaggcctgggagatgcaaaagctttaggctccagccatctccccatgtcaggtaggccttttgcctagtgtatccagttggtaatgctgcagagatgcatgaagctggagtcagaggccacctgtagtgctgccctgacttcagacctgagcccagcccagcagcagagagggggctgggagccagaggaggcctcacagtaacagcacagacaggtgggggcccacaacaggccacatgtgttcaaactcgagtgtgggcagaggagcatgggaagctcagagccctgagctcaccccacacccaacacgagtggggtcacccaaaatcagcctgtcagcactgtcccagcagccagtcgcatgctacattaacaaattttgcacaggccagcaagcaggatcgctcaccagccaccctcctgaactggcctatggggccccaggatgatgccatagccacaagtctggagttcctcaaagtacctggtcagcacaactcagttaaacaatgggcaaaagacctgaacagacacttcgccagagaagatgtacagatgcaagtaagcatttgaaaaggtgccccacatcgtatgtcgttagggaatggtccaatccagaacactgatggcaccaaaggctgctgagcatgtggagcagcagaactctcattcactgctggtgagaaaaatggcgcagccccaatagggaaccctaatgcagactctggacttcactggaaatgacgtgtcagtgtagctgcgtcagttgtaacaaatgcaccagtctggtgggcgtgttgataaccggggctgcgcacgtggggagagaggacctgtgggaatgctctactttccactcatttttgctgtgaacttaaaactgctcttacaaaataacattgtttgttgttgttgttgttgttgttgttgttgttgtttttaagtatctagtcagctccacacatgacccgggcagagtgggaagttgtagagtgccccaaggagagaaatggaaccaggtctcatgtggggccaagtgtgggctccctgtcctctcagctggtcccaggaactgaagggaaatttagacaacttggagaaagacactctagggctcggggcaaagggtggtgttgatgagaaccatatttttttattgctggtgtaagcacttgtatttttctgattttccactggttcgataataagggtaaaagacaataaag

SEQ ID NO: 106 - DNA, 4608 bp, Homo Sapiens
gcttgcatgtggagcccactaaggcccgaaggggctggcctgcccaagttcacggctctgccgcaagcttgctgcagatcaccatctcctccattcctggccccaactccccttgcatatggagcaaggaaagatcttttgaatgctgaacgggcctgagacaccttcctgaaggaaagctgtccttggatccaggcattgtgaccttgttacttcatttggccttcatgaccacctgtctagggccttcatcaacctcttttacagatgagccctcttggatgataagtaaatggcagcatttggatgtgaccctggtctctctgagcttagctctggactcccctccctcgtgcccctctcaaacaagcaagaagaaggcaggagagtaagttctaatcctggctgtgccactgactccctatgtggtcacaatgaagtcttttccctctcagcacctctgttgctatacctgcacaacgaggagctttgcttggccaggaagagggcacaataggtacagagtgcaggtatttctgggcccatagacaaggaagggtgggaggaggggagcaatggtggaccctcttggttgacaaatctaaacaataatatggagcctgagaaagccaaataccagctccccagcttcctctgcagccaggcatggccatctgactgagttcaaactgatgggacattttgtaaaagtcttatgagaggttctagagatgcttttgctttcttgataaagagccatttgcagctggcacttcccctgtcccctccagtcttgaacatggatgcgatgcctggagctatggcagccatcttgcagctgtgaggctcagagagtcccagagataacatttggaacagtgttgagcccctggaccaatacagcagctgcctagctccaggcttcctgttgagtgaggaaaaacaagcaccatgttttcaatgagtagttctgaatgatacaagcagggctggtagacatccccacagttataccaatttttttgccataaacaatattaccatattttgtctatttcccctggatacaggggaccaataacaacacaagaggggccaggggcccagggggaaggaaccagatggggaggggtgaggactcacgaagttagaagctggggaaggaggctctgcaatagtggaaacaagcgggagccgtaccgtccagtcttaggggtcccgagagtgggcaagggtgtagccaatggagaaggagctggagaagaccattcatggggggggcaggacaaactggtgggatggaggaaggagactgcaaagactgaggctgcaaagcctccccttcgccctcagtggacccactcccacagcccagctgacctccgatgtaggccacagagaagcccctgcgggtggtgctgcggtctgtgtgcagcagaagcagaagctggttgtggcttgaggtcacgggtggtggcaggtggtgtccacaccaattccccagcaggggtgcctcctcgctggccccatcgaaggccgccagatggtcaaagtcacaggtcttggtcaggctgttgggctcctccaggtccaggtccaggaagaacaccttgacctggtagcccgggggcaggcggatggtccagtggcagcggatgttgttggggtaggagctggggtactgtgggctggagaagttgccccgcatggccatgtatacctcctggcattctcctggatgggggatggggaggtggaaggagcaacagtgaggggagaggagaagtcactctctgcagttacagcttaggcagcaggtgccacagtggtccaaaaaccaccagcaggttgtgggcaccatggctagcacaccagacaattgatcccaactatctgaaagttgggatgcttgatcccaaagcttgttttaaactgcaactagctgaaagctgggacttgcattccagttgacagtccccttcacaggtgtaggccctgttaggaattcaataataatacacaatacctgtcctcagagttacctctgaactccctggcttgacagatgatgtggttcatgcctggcctttccccttttctcactgccccatttggtatgtactatgagcataccaaacactctctgccctccaggcctttgcacatgctgttcctcctgcttggaatgcccttcccttctgcttccgtctaactccttcagggtactgctcaattctcttctccacgaagtcatccatgattcttactgatggatagcacagatcataatggcttgcgctgtctgtttccttataatctctctaactagactgtaaagttcccacgacttcatccattcatttgtacgaaaattgagtacctactatgtgccaggtacaaagataagcccataagggactcagtcagacaggggagattgacatgcaaaccacacacagaagtgacaaatgttagatcatagtgtaaaaaacttatataaggagttgaaaaaaggattaattctggtaaaacagtaagtcttcgcagaggtgacatgcttatgtcttggcataggccaagggtatgctagagcattccaggcagagagagtgcagaaagctcaaggctgcggggggcagaaaggtgtgacccctgcaagtgtaatggggagacaggagcccagtaggcacaggaggattcagggtggagcgccagcccctcctacctgagaagtagtaggccttgaagccacggcctccgatgttgaagtcggacttgaagaccacctgcagttcgtggcccagagacacgagggtggggggcctggtgctgccacagtagtggtgcccacgggtggggccaggccccccaagcacagccacgtagtcataggtgcactcttcattgccctccacctggaagtccacgaacaccagcttgacgtgggcagggccagcggcccggatcacccagtggcactccatgctgttcgggtagttgttgggatactcaggactggtgaggacccctgacaggccagtcaggacgccgccacacacatctgcaagggagcccacttgagctgacctttctttctccttgtggctcccagtttcctcccttgggaacaagacactccaacatgctgcccccacaggtatctcattagggcctcattaccatccagcaagcacctgctacccaagtagcaagtgtagcacgtgctcaggcccagcatttggcacctatgctgcctgttcaaatcctcagagtagccgcacaaggactgtgctgcagtttctctgattttataattaagaaaagggaggcaaagacaagttcagtagcttacttgagtttgagttcacccaggcagaccttgagataaggatttgagtgcaaggagtttacttgggagatccaggggcccccaggtggggagggagggagaggacagagaaggggaggtgtgttcaagtcagctgctgaccttggggggaactctggggacggggtaaagcacatacttcagagttctgtcaatctaggagcaagggagctgcggcatttacatgccaactccccagagtgcaggcagagggctgctgtgggctgggagtgccctactgagacttcagaaaaaagccctccagcatagaactgtggaggttggcagaagcacatcgacgtggcagggcccagggaatgtggtcagggccctgagagcaggtcacccgactggtaactgggaaagtgggatttgaacccaggaagactaactatggatcctgtgcacttgacccttgtgaccttcactgtccactcctacgaggccagtggggcacagaggctgaggtgcctgagctcaggaatgtgatcaaacctccctaatggatgaggaaaccaagacttagagagaggacctgatgaagtagagcttggtttgacatctgaagacaagtagtctcccatctctgccttttattagctgtgtgactctagggaagtaacccagcctctctgagcctcattggaacattagaaatcataagactgaaccagcttgatccactgggctcagacttgagcacagtctgaaaatatgctgctggaaactctcaggaagccagcttggccagtacaactacacggcaagtgtgggtgaatgctgcgacttgctggaggtcaccagcagggaggacatacgtgggatgtgtttcctgagactccagcatctcgccctatggcacggctgtgtgaccagggctctggatggggcatctaaggacttggcgtcttttcccagtgctggcccagccatgtaactttaggaaggccctctcagggactcagattttgtgaaatgagagggcaggtttagatagcctgtgagatcccttccaacactaacaaccttcgcggagacttcccaactgtgccctggggctccccagcagccccctggagcacctgctggcacctggtgcaaatttcattcttatgctgtatttcaagctctcttttaatgtaatgaaaagatagcacccacagactttaatatctttaacaagatattaaaatttaaatattctacatttaaaaatttaa

SEQ ID NO: 107 - DNA, 2769 bp, Homo Sapiens
ctcttcctcgctccccagtccgcgcctcgctgggctcagcaccccggcccccggcgggacggaggctcgggtccaaagcagtggctgcaccgacacgaacccgtctgcgtttctccacctgtcttccctcgccacctgcatctactatggtctctaaatgcctcgctttgtactttgtggctttctggcagccctttaaagcagcggtgaaagaaaggagagagtcaagacacgggagaaaatgtttcatcccgggttcttctagtggtgcccggtaagtgactccggactgacgagcagaaaaatcccagggccatcaatagagggccttcggtgtagaatgcggtttgctcagctgtcagcaaagagggacgcaaaacctaaatttgagatatcagaaataactaaataaaatagaccttggctgattacaactaatggttctgaaacctagcaaaagggtcagattctgatcttgaatatactctcgagagaaccgtttcagtacgggggtgtagctcagtggtagagcgcgtgcttagcatgcacgaggccccgggttcaatccccggcacctccattccttttgcttttaatttttttcccattgctttactttattttccttgcttaaacagaaagtaaccctatttcacaacggttttgccattaatattagtgctgttccatttctactcctcagccttgacacgactcgggggactgcctaagcaaaaggtggaaaagatggagctggaagacaaagacggctccggattccaaaacttcaatggcgtcgccaaattgacgagctcattaacctttggagtattgttatttaaaaagtaggaaataaaagataaatgtggaaatatttaataaaagaaaaacgtaagctctcaattttctttattacttttttttttttgagacggagtctctcgctctgtcgcccagtggcacgatcttggctcactgcaagctccgcctcccgggtttacgccattcttctgcctcagcctcccgagtagccgggactacaggcgcccgtcaccacgcccggctaattttttctatttttttggtagagacagggtttcaccgtgttagccaggatggtcgcgatctcctgacctcgtgatcctcccgcctcggcctcccacagtgctgggattacaggagtaagccaccaccgctcccagccgatttcctttattttttttctggtccttgtttagccatgatccatcgcaggctgagccctgacaaacgcaaagccttccaaactgggaaattgagaaagttattttcatcaatgaatgtagaggcgtcacacttctgccgaaatagctccactgggaagcatgctctgctgaagatctcaaagttcacggactgatttccagttttattctgtcttcactcctgccggataatttgacttcccttagatgacgttacagaagtaattttacctaagacaggtgcgccctctatcgtaaggatatctttcagactcttggtccacacaagagttggtggcaccggagagcttgttagaagagcgaaatctcagcttcacctcagacgtactgaaccagaagtagcaatttaacaagatccacaagagattcttttgcacatttaagaagcaatatgacgtgctttgacgtggatggagtaagggtgtatagtataaatacgcggctgtgttttttcccccaattttctattctaacagaaaacataattgcaaaaaatatatatttctattgctgaatcatttttgtgttctaatcattgactctgttccttgcctctctggcaatattgtacttagtaatattttttgaatcactattcatgattgaatatgatgtgaagttttcattttcttttttttttttcttgagacggagtctcactctgtcgtccaggttggagtgcagtggcgcgatctcgactcactgcaacctccgcctcccgggttcaagcgattctcctgcctcagcatcccgagtaactgggacaacaagcgcgcgccaccgcgcccggctaattttttatattttttttagggacggggtttcaccatattggccaggctggtctcgaactcctgacctcatgatccgcccgcctcgcaaagtgctgggattacaggcatgagccaccactcccggcctttattttctttttcgcaagttttgcaataaaggctgtgctaacttctaatgtaaactgggaagtttgtatccttgctctgaaacattttaaatagaataagaccttgtaatcattccagaatacacagccctcttctcatcagctaccaccaaatcttcaagaacttttgtattaacaccactttgtattctaagccctgtgatagattttaaagatccaaaaccctttgctaaccctaatgaaagtgtgagctgaaggatatctcaagaattgggaaatccttggtttccgatataatatcaggccacctctgtccctgtgaagtgattaggaaattttcaatggagaaaataagttccaaaagtcattctttctcagattaagatgtcttgggtttcagtttacttctttaaagaaagattcagagttagtactgaggacccagactttcttgatgtgggaaatagataattttctgttctgttgacattttttctctctcttctctcattttcaaagtacagttccacaatgtctctttgccacttatactcactgtggcagaaaaaaattattcacagg

SEQ ID NO: 108 - DNA, 1407 bp, Homo Sapiens
cggggcctttgtctctcactgcacctggagctccaggtctcatcttcactactctgtgtcctctgctgctggaggcccagccctgtgacctgacggttttgggagatccacagctaagacgccaggacctcctggaagcctagaaatgagttttcgctctgttgccagactggagtgaggtcctacagttgtgcagccgcgcgatctgggctcactgcaacctccacctcccgggttcaagcaattatcctgcctcagcctcctgagtagctggaactacagtcatgtgccaccatgcccagctagagaggtttcaccatgttggccaggatggcctggatctcttgacctcgtgatccgcccgcctctgcgttccaaagtgctgggattacaggtgtgagccaccgtgtctggcgcctctttttcttttatttttccagagaacttaccggaatgtttttgggtcaagattaccctttggaaactttgtaggatgatgtgtcctcagccaaccttcagtttttttctggtcctgggttttagtactttctgggaataaaccaacatacccactatggctatgtctgctagagtgtctagtgactattatctcttgggtcattttctcccataggaccacctgaagcatggagtgtagactttcaagggagcaggtggcagccttggggctgaaaggcatcttctggtgcacttttttttttttgaaaagctaaccccttgagacatgaagattgtcttcactcaacctggctttcatttctaggagacacattgctggtcagtcaatcagatgctggtattgaggggaaaacaaataatttctgtcttctggattatcttgtgggaggggcagaaaaatagtgaaaaaacactccaaaagacaaaaaactgaccccagtgagatggcataaataacttacaaagtaaaatgcacctggggcactcactggggcatagtgcagtgtctcctgggagggtggttattgcgcatgtaagtgaacaggatggggtgggtgattggatctgtaccttgaaaagatttgtttacttattttgacctcagtttttttttagacagtctccctctgttgcataggctggaatgcagtggcttgatctcagctcactgcaacctctacctcctgggttcaagtgattctcctgcctcagcctcccgtgcagctgggattacaagcatgcaacaccaagcctgggtaggtttttgtatttttagtagagatggggtctcaccatgttggccagcttgatcttgacctcaggtgatccacctgcctcactcttccaaagtactgggattacaggcatgagccataaacactgtattctacaatcctatgaatattaagccacaatacttactttgaa

SEQ ID NO: 109 - DNA, 3367 bp, Homo Sapiens
agatggagacacccaggagaaagaagagggcgaattggaagaggccacccagaaaggacggtgtgtgacactagggagccaagcatggagagccgaggactaacgcttggaaggaaatgtggaccagaaggttccggatgagggaaggactggcggctacactctgccttccgagacaacgaggaataatctcacttcagtcagttcaacccttgtaaaacagctactgtgtgcaagacacggagggaaagctgaagtagagaaaccacagacgctgtcttcaaagggtttaatctaatattagtgatgagaaaaatagggtgcagagcttaaggcatcctggaaaaacgtatgtagcgccacatcgcgaaaatctctcttctgggacccctctcccaaaaacgtttcttcgccctcttctcccccttctgcctccactctttctggacttcaggtacaaatagttgaaataattatactccttggttcatgaaatgtgtaagactcctctctggttttattttccccctttatccccatccctactcccaacccctatcctcaaccccataggcattcatgctgctgtgcttccatatgtatttttgggaaatgtacaaaatttttatcagtgtattttttaaaaatgtttaaataatgctactggactttggagattatcttattttctacttttttcactcaacattctttttaaggatctgtcctcgttgcgattggcaagcatatagttcattgcttctgagtactgcacagcgtttcataaggggcatctaccacacttcacttccattccccaggtgttaggtaacaaggccgcctctaattctccaatacatcaagtaatacagccatgatcgtctttgtccgtggtcccttaaggacctctgtgcaaattcctctgaaatatatgccaaggagtaagattgttaaagttatagggatgcacagggacatttgcttatgcagctgcgtcctgcacaaacacatccagccatggggcaatggaggctgaaaaactgtctctactctctttcccgtgccatgtgccctactggagaaaggtgtgcactttttattctcacaaaatctctgtacgccagccaagtcatgaacctagaaggctgtaactatctagagggtgtgatattttcaaactcatctggccagatgaacagttttccaagagcacaacgatgcccagtagcctagtacaagccctgggtacttaccaagcactttaagattgtgtaccagagttactgccctacgctgcactccagtgtggggtttccatccaacacttccatccatcccttccagaaggtgataggtcttttttattaaacactcataaagtgtttagtaaataccagatactattctaagtgctttgcaaatattgactcatctaattagctaattttctaatttctgtcaatatgatgaaagtagtgtaagctcattttttgctttcattttcacttctctaactactagtgaattttttgaccatttctttatacattcataggctacttgagattcccttctgtgaactgccttttcagtgtctgtgtctatttttctattgatcttttttctttttcttttgatttacagatatctttgagaagcctggacatcaatctgctttagaagactagaaactctgcctttatgtctttaagggaacaatagtccttaactttgatactgtggctctttagctctttttttccctatattttttatatagttttttggtattatttagacctccttaaccccacggtcataaaggtattctcccatcatttttttctatccattagcttcatagttttacttttttacattcagttatctaatccatctggagttctccttcccatatggtgtgagatagggatctaactatatttttctccatggggtgagcaaattttccaacaacccatgtcaaacaatccattctttccaaattggtttggggaagtttccaaatagacatgagtatgttctgagctctctggtttgttcatgtgtcagtaccacaaggttttgtcactgtgggtttttagttagtcatcatgcttgaagggcaagttccccattccaaattcttctgtgttaagattgctttgtctatccacgggcctttatcctcccttataatgtttagagtaagtttgtcaagtttatgagaactgtgttgggttgatgaataaatgcaaggaaaactggcaactgtgcagtgacatctcattcatgacctgacactgtatatctggtggacaaaaagagggaaatgtggctgagtcataatgtgcatggaggttgctggagaggtggcagatgaactggagaggcaggctgaaccacactgtaagccaagctaatagaaatgagcttgaaatgggacaggcaacccagctcaggctgctttgtgtgttcacaggaaacctgattacacattgggaccatcggtttgtaggattgccatgatccagagaaactccataacatttctgaaagtatataacaaaaataaagacctagagggccctggtcacccatacgttgcactgatgtcaagtgcagggctgtgtgtcttcccatgtccaagggatctcctaaaagagctttcataagtaggtgccctgcataggtgacagcagttcaatccagtaaacaattttttaaggaacgtactgcatggtaggcacaaggctgcccacaggaagcaccaaggtgactatggcagagtcactgccctttgcattcacaatctgtattaggggaaagacagaagggaacatctacagttaattctaatgcaataagatggtatcatttagtatatgccattttaacagaaagcacaatgggagctcagagaatctagatactggtatctgagaccttacttataggaggacaaaaagacccaaatatgactgagcaatcaaagaaccacaaggaggtagaaaggcgcgtgacatgttcagctcataggaaagagatgcagggggcatcaacacagatggatgaatggatgaaaggatgggtggtcggacatatcaatttatgctgatgaaacaaaatgtttgatttccaattttctggattacagaagactagtcaccaccctgctcccctgtgttgttgtaataacaagaatcactaggtggcattatagtatcaaagtcctcacctttcagagcctctaggagaaacacacccaacaagatcgcgtcagcccctaatttagacaaatgagtgcttctattcatctcatttctcattatatccacttaatttatttcttgagcacctactatat

SEQ ID NO: 110 - DNA, 49725 bp, Homo Sapiens
agacaaactaactgaagccacagccggaagcaggctgaccacaagtgctaaggttctggttagttcttttctaggttcaaaagaagaggctgttctaagaaagactaccgagtaatcaatcacctcctcagagaaagtctgctcagggaccagctctgtgaacacggcaagtaacaacagagagaaaacgtgaggagaaaagagagaccgggattttgaaatcctgtttcctgaatgccatctcaccaggcacacgaaagaataaaattaaggaatcaagagccaagaattttcttattttctttcaaaagctaaagtcgtctggggcaactgttttcatcgctaacccccgctaatttctccagctatggtagtattgctctccctctgtgggatctaaaacatgccctgtccttttcaggttttaaaccccagacccagccgcaaacagtcttttcatgtcagatgagttgcttcgcaactctgagtcacaggcctcttgtctctcagatgagggttatgccacaggacacaggttcctcactgggaatggtgtgaggactatatccagggatatttcacggcagggcctctggatcaactgctttacattggaggctgttcattctcactggtttatgcagtaagagccatgccttgctgtgtgcctcattcctttctccagctgcagagggtcttgctaaaacacagatttcatcactcatcttccaacaacccctgaccatcctctggacgaagtttaacctcctacgcctgacatagaagatccttcatgatctagccctttgtttgtatctgtggcttcatttcttgccactctccttccttataatcattatctccccaaacttgctgtttttttctttttacctttaaagcctttagatgtactattccctctccttggaatatcaagagtctccttttatagtttggatatcactttcttgatgatacgcttagcccagtagtaggccgggtgcctaacttctgtattccatccttattcccagcattgggcaactctctagcaatcaccatttggcctgcccgcaccctccactacattactgtctcttagagtacaccacagtccctggcaaatggcgggcactcagtataaatcggctgaatcacatcagatcttttcttcaggtgtaaccttcttttcccttcatctccctcctctttctcagcctttcccctttgctatagccttactcctgagcagtaaatttaatcttcttccaacatcacctgcatcagctaagcctctggaggagtccgatattaacatggggcttacagttaggaggtcctaccttctctgggtgcaggagaggagcagttctccccactctccaccctacacacatcggagaacaggaactcgcttgccaaactctcgccggtttctgggagagagaaggaaattttatgatgaacaatctggcagcatatggttaaaatgtttgaagtccccaattcacggctgattaaacaattctttacataaataacaccctagaatcttgcatataaattcaaagcagaaatgcaatttacactttcatttggtgatctggatgggaaaaaagccaaaaatgtcaattcctgtaggcttactagaaatatcgcacttaaatagcacctctccaactttaaagacaaacagctgaaactcttagacagatactactgaacgtacagactctggcaagatttataccaagtctgcacgagaagcattagcaggcattaatagaaatccaaggtccaggccagtttagtccacaactctaagatggctggcagtaaatgtcacttagtgtcaacttgggaggctggagatacatgccaagaacacagcatttgggagggagagcacaaaggctggctggctcagtcagccacaacgattctagtctgtttcttagactcgggatgaaaaaccagtagtatttcactaagtcgggccaactattgtaactgagagaagagggcacttgggtaccattcaagtattatggtcattttttttcactctcagaattggaaatctcttctgttcttgctatgtgtaaaaataacatgagctcactgtaaaacctgcatatagtaaaaaagccccagagagagctactgctagcagtctggaggtacagtcatccatgttttaatatatgtatatgggctttttaatttttaagaaaacataagaccaggcatagtggcccacacctgtaatcccagcactttgggaagctaaagctgggggatcgcctgagcccaggagttcgagaccagcctgggcaacatggcaagaacctatctctacaaaaaatacaattagccacatgcagtggcaggcgcctgcagtttcagctactggggaggctgaggtgggaggattgcttgagctcgggaggttggaggttgcagtgaggtgaaatcataccactgcacatcagcctgggagacagagtgagatcctgtctcgaaaaaaaaaaaaaaaaagacatacatgtgatcctactatagttatccttctgccatttccaactacatcttgtgggtatttttccatggaggtttctaaagatgtacctatgtgcaaggcaccccacctcatggatgtaccatgatctgatgaaacacccccgaacatttacactgcttccaactgtacactgcagcgaacgttctcccatatatgtctgtttctacgtgcacagtcggcagcctttttttctttaagtattgatcctagaagtagatttactcagttaaagggatgcatactccaacgctctcaatatgtatggtcactgctttacaaaaaagttgcactagtttaaaagatgatgttagtgaataaataaatgtcagatctggtcacccactcttagcatttgatatgccacattgccacattcattgtgagaatgaagacctgtatttgaaattcacactctgcgtgttagggagatacaatggggagatatctgcattactaaagtcgttattttctttagttcagttataatcaggaaataatcttttagcattaaaaagatcagaagatcccaaacccacctggaacagctgtttcattgggcagcctatctacttccaagataaagtcatccttgaagaaaagatagcccactattgagaacaggtaaacgaggatcagagccagaactgctgtcaggatgatggaccgtccattgcgagtgacacttttaatgacattaagcaaagtctcttctctgtacactaaatcaaaaagctttgaaaacaaacaaaaagaattttaagaagccttgatgttagatgtacatcactatcccataatgcaaacttggtttatagagagtttgccctcttagacactcaaaagcactacatatgatcttaacactgaacatcttccctggcttcacagtgaaacggagatggtaaaaatgaggaaaaataaacacagaagaggaagcaggaaacaatagcaacttcaagtagtatccagagccatttagagggactggaaatagagaaaatacatgcttgtgccaatgagtttcagagacaaagggagaggaaagtgatgagggtcttggcatccattcatttagaaggtactgaattgagtttatgaagagccagccaccctggtccctgccctcctgcagcccagtgtctggtgggaaggcagacgtactacaagccagcgtcagtggcaagaactctggacttagatgtaaattcaaatctcagctcagctactgtccaccgtatgatctcgggctaggcactttcctcatcccctctgagtctccatttcctcatttgcagactggaggatgtagagttgttatgaagaataagtaaaccacgtacgcacagtgcttagcacactggcatccatatgctcagtaagtacagtaaatagtaattatcatcaatttcctgatcaagagactggggcagggtcacatagctggtgtatcgcagggacattagtgacgttaacattgcgagggtaagacccctgcaggtcacagtgccttcacaatccaggcttgccctctgctaaggaacctgctctttgcaagaagttggcttcctgaggaatggaggatccttgtaggtacatataggtatgggaggatgatggctagttttccaagagctacagtcacagatacttgactgggagaatggtggggagtgtggggagagagctctctgaagttactcttagacctgaggctagtttttagcatggcctctggctgctgtctaatcctgtacagaaggtttggtctccactgtggctttggggtgtgactgcaccatgaagtgagtcaggggacagggttgaatcctgactgcttttaatttgttgcaagatgtcggccaagccatctaagctctctggatctgtttcctcatctgtaaaataagtggactgagacagctgatctctgagtcccttccaatttagaatttttcatctgaggtcattttccggtcgattggcttttctgcctccttgacaccaatctgtgttctgagactagttctgtgaagggcattgggtagagtaggatacttaaagggaagcaaggaagagggattttagtcaatacaatatgacagaaggcaaagtgttgctgttaatgttggttaaatgttttccagcagctcaatataaagtggcaagtaagcgcaacttcagacaacaaacaaatggcacttgttttctgtggttaaggaccgcagagattacacaggctccaaatcatagaaatgacaagcgattttttccttttcactcatctatagtttctgattttaaaacaatcaataagtattatttatataaaagaaaagctttcttctaattggaaaattatacatgttcaatggagaaaacttggaaaacaaaaaaaagcacaaaggaaaaaaagtcactaataattcaccatctagagacattcgctcaatagcttaattccttctggccttaaaaaatgcaatttatagatatatattgtttacaaaaatattagaccataatactggcacataaccagcctttcaccaagccatcaggaacattttcctgtcaaaaatgatcacctggtatttcactatatgggaaaaacatgattaacataaccaatatgttttttaaaaacagtcaagatgtttccaattatatgtcataacaaataatgctgtgaggaacacttctatacatgcctccatacgtgctcgtctagttattccttttcggcgaatttttggaaatggagtatttgagtcaaatggtataagagaaacattttgcctgctgctttcagaaaggcaggatcagtttacattcaccactagtaaagaatcatgcccattttaccccactctcactagtactgggcaccatcaggctttttaacctttactaatgtcacaggtaaaacacaggattgcgctgttttaattagcatgtctttgtttagcaccaaggatgaacatttttccatgtttactgaccatctggatttctgcttttgttaactgcctgcttatgaactttgcacattttcatctccaggtgttaatatttttctaaggacacagctttaatgcaggctcacgaccaggtccggccagtctttgtgggggagggggggcagcagtttaattaggccaccagatcaccctccctaccttccggcctgctggcatggagggagctctcccaactctggaacacatgggtgttccctgctcaggtctctctccttttacaggcagcccgatttcttttggttgcaggctttccttattagtagaataatttgaagtgtcagtgttttctggttcttaccagacacattgagtactgctttgataccaaaaggagcacatcacttgaagacacaaacaagtcaaggtccacacagcttagaaaatccccccgcaaagcacaggagaggcagccaaccataatctggtttgatcctattgcgtttcctaaaagtgaactgaggtagcatgatcagaagctgagagttactcttatctttctgtgataggttggagacttgaaagcacagatgcaaactggaacgtgaaatgccagtttcactgatgcaaggactttttcacatgcttgaataaaaggcagtgtcaacttgggaatcaacagagttgtgaggctctcctgcctccaccagttactgacagtgtgactctgagcaagttacctaacctcaccaagcctcagtttcctcaggtgtaattggaagataccatctacctcaaaggtggtagtgagagtgtgtagagaagagtgcagggtgaccactcacaaaacggctgtccctgtaatgtgctcctgactgtgaggcctatgagggtagggactgtgttcctctcaccattatgtgccctgcgtcaggcactggcactggcctgcattgcaagtgatgaagagaagaggactcaaatgaacagaaaagaagccaagccaactggaggcagattggaggaaaggtcgaagtgtctactggggcaaggtggcgttgaccaaaggggcatctcctgtctcttgggagagagcccttggcagggatgagagagaccaccaactgaactctgccgccctcccaagggaggacaggaatttgttgtccagggacatgatggcatgagacaaaaagttccagaaacagacgtaagtctctaaaggtttctgatacaaagtgaccaaaataggcgacataatgggaatcacaaggatatcctgagacctctttgcctaaaacctcaaaatatagccagacctattttaagatgagggaaaagaatccattccctttagcctgccaaaatccacccctaatggtatgagctaatcctagtgatctgaacggtgaattccttatggtgttttggacgggggaaggaatatagaatgacaaagacaataaaatagctggcaatcattcggcagtgctattctaagaccctgacctgaacagctgcatgtaatccctgtgacggccctgtgagggagatacactgttctcattttgtagatgaggaaactgtggcacaaggcagtcaagtacgttaagcgaagggagcatctcacacagttgcattttgtactttcaaatctctaacctattgcagaaagataagagtaactcccagcttctgatgctgaactgctcctcagttcactttaagaaaacgcaataggatcaaactagatcgtggctggatgcctctcatacgcgcttcgggggggttttctaagcatctccctgaagagcttcccttgctctgccttttgtaagcccccctctctttgtaagcccccctctctttgtaagtcccccctctctttgtaagcccccctctctttgtaagcccccctctctttgtaagcccccctctctttgtaagtccccctctttgtaagccaacccttaggccttgatcatttttgtcctcacaaatattttaatattcctaggctgtttatggtgttgcttgcagataggtcagttttatgcttcctgtcattttatgtaggcacaagaaaatggtttcttatctacaacgccacaggtctagattccctccaactacaggaaagtaagtagttccttgatttgtcatttaaaaacctgctcaggaggaaggtgatggaaccagcttgtcttacagactgtcaagacattaagcacttggctcatatcggaggaaaatgagctactgaaagggtctcctagaccaataaatctactgagctcatgatcatgaatcccggggcttcaaaactagctcctactcttatggtcgctacacgtgttcacaagaaatggactccctgagagctgttggatgacagcctcaaaaacactcctcttggtgtaagtgcggctgagtctaagaagtaaagaaaaacaaaggtgcatggaaaggaaacatctcctgaacctactacaggcatgttccattactgagaagtaacagatcgggagtgcccagtacacagtgcggttgtgtgactcttgaattcctgggctgacccaattcctgtggagctttcctctcagatcccccaaaggctgccaactgtggagcttcaatcttggtggaccaggcacaccaatcaccattaaaaggaagggtctgtgatgagagagaggacataggacactctcctagtttccccacacataaaatatttccacaccaggtactcaccagcagactgtagaagaattcatggacaaagagccccatggcacagatcaccagatacaacaaatgatagaggaactcaacatccagaaccatggctcggtagcctcttgtgaatgtcccacagttgcccacaaagctcattagaaagatgattttattgcatacctgagaacaatgacaggaacagtcagatggcacggactgtgccaaactcttcatgagagcaacgagagcatctcacacaaatgtatttcagtcaccgtgcccaaacaaacgcttccttttccacccggtgcccaccaaacccgccaagacccatttgcagatctaagtcatttcattactttgcttttcaggcatattacaaattacatggtagtcaaataacttcatgcgcaacagtaatcaagtagcatttctctatggcaaaaacaaaattaacacatactgagattatgattttcaaaatgagatatgaatcatttctaacattcttgtatgagttagtcaaacacagaagtcacctcaatccacgaaccctgtgatcagcatgatcaaaagcattttctgaatttgttacattctaggcactgtaaggtggcaatttaatgagcagtgatcagttcttgcctttcaatgctcctaagttcacagggaaaacaacaattttcttgggggaaaaaaaatataagggacttcaggatgagttctattcccctgccctctcttctgggaataacttctaattttcctttggggaccattcctctctgagtagcagtctttgaggtctgggtggggctccaacctggccatcacaatattgtattcccctgggtacaatgactggtttagagatagacacaggaccaaatggagccaatgatgtccactgagctctttcttgggattgcagccaaagataattttgttctttcccactgaccttgaacctgagcagctgtgaactctggagctgccacattaccaacactgaaggcaccaccagcactggggacacagagccaaaagatggcaaggaggaactgggccctgaggacactgtgtgagcccctgtatcagctgtgcctgaagcgaggctgttggtttcttggtcaaaatgaaccaatacatattctcctttgctgaggctagcatggattaggttttctgacatctgcaactgaaggagtcctaactgaactactgtgcaatatagtctcacctttgatagaaaccccaatgcctggaagtccatctctagcaatatgttgacagaaaaacttggctcaggaggaggccagagagggacctctctggatgcacttggtaaaaccatcttctgctactctagctcccttggccacaggtgcgggggaaatactgccagttaatctggtaggtcggtgtaagtgagcttctcggcaatcagataagcgaggaagccgacacccacagatcgctgctggctttctcagacaggctaagcattcaatctgccaattttttccaaaattctcacctttgctagtggaggggatttcagagggtgggaaagtatcactgattctggatgatccatgatgatgtggtttcagggagaggcagatggtgccctgggtgacatcacacattacagcacctcaaacacaccccagatcctgccaacttaacaacagggtgatccacttcacctgagtccattctcccctctaacttctgccctagttttctccattgcttccccaggaaatagctgctatttgtggtctcagcctgcggctggactctgcttgttagtcttagatctggcttccatccccacctctcaacagagacagctcatgtgaagtctccaaggattctgcgcacccagcagtcttcccgtctgctcttagcatctttcccagctccctgcggcgtgacaagtctcccagcgcaccctgctcaccactctcccagctgggctttaggaccccaccttctcctcctccagctctcagaactccaatattctctctctgtctccgtccacaggtactttccctctcccatacattccatgtgggtgtttctctcttttaaaattcactctaggcggggcatggtggctcacgcctataatcccagcactttgggaggccgaggcgggtggattgcctgagctcaggagttcgcgaccagcctgggcaacacggtgaaacctcgtctctactaaaatacaaaaaattagccaggcatggcggcacacacctgtagtcccagctacctgggaggctgagggaggagaattgcttgaacccaggaggcggaggttgcagtgagccgagattgtaccactgtactccagcctgggtgacagatcgagactctgtctcaaaaaaaatgtaaaataaaatttactctaaataattatttattatagctgtttgccccctaccagcttatgttgttgtaaatggtaattaattatctcagttgagtctttcccccaactgatttgtgttaaagaagtgataactgtggaatgattatcagagaaggccagagaagaaaagaactagacagcccatagaagacagcctctgaaatactgaacattttttctacctagttgtttatgtaattcttttgtatttctttcttaaatggtttcctctcactgcaggcaatccctacattcccctccccacactgatctctctctgtagttctggtcatgtatttccaaatgccgcagctcacgttaacagcgtgtctttccacctgaagcccagtaggtcaacgatgtaaatgcattttcaccctgaaaaactaaatctttgcatgacttcattttagatggccacattattcttctcccaatcatttgtgactgaaaatttggagtcatatttgcctccttcattacccaatcaagacagtgataccctctttgtctgaaaaagggacccagagtggcagtatggtttggttctgtgtcccccccaaatctgttaacttgtaatctccagtgtcagaggtggggcctggggggaggtgactggatcataaatagtttagcgccacctgtcccggatacagtatagtgatagagagctggttgtttaaaagcgtgtagcgcctccccatccgcttcctcctgttccagctccaactttgctgcttttactccgccatgagtgaaagctccctgaggcctccccagaagcagatgctgccatgcttcctgtacagctgcaaaacctcaagccaattaaacctcttttcttataaattaccgagtctcaggcattttatagcaatgtgagaacgaactaatagaagcacattgctttctgggtggggtaaggctctgactctgtgcccaccatgtgttactatttcctcatctctctttctctctttctttctttctctttctttctttctttttttttttaatcagtctcattctgtcacccaggctggagtgaagtggcaccatctcagcccactgcaacctctgcctcccaggttcaagagattctcgtgcctcagcctcccaagtagctgggattacaagcatgcattactatgccaggctaatttttgtatttttttttagtagagaggggtttcacatgcatactggccaggctggtcttgaactcctggcctcaagcaattttcccgccttggcctcccaaagtgctgggattacaggcttgagccacggtgcccagcctgtttccttcccatttctgacgtccataccttccttctttcttctacactatgtccaagactcaggcttctcaaacctaatcaaagcgtcgctacagcccctaaaaagcctccttgcctctagtccctcctgatgaatccacataacaagccatactgaatgcattttctcaagaatacttctttgtatggaccatttcttggctcaaaaacaccacaggcactttccactactgggaacagagtttccaacatacattctatacaacactaatctcaagtgatacttacaaaaaactgcaggaaaataagtttgggaaacagaaagacactgttttccttggaggttcctaatccatattagtacattaaagtctgtgaggaagcctgcagtaatgaaacctttcattgtgtttacctcagcatttttcatgcggattcaatcacggaacccttttttcacctcatatttatcaacgtggaatatgctctgggaatgctgacctgggggatgaagtccagttgctttatcctaaaattcagtgctgcaagtgacttacacaggatcagttcctactgatcactactgaaccacgaatgaggtgaaactctttatttattgtctgttgataacatcccgagctttcccactgttctgctctggcctatggggcccacgaaaccaaagaactcttctcaatccccgcttcatggccagatcctctccattcccttttttttaaaaattatttatttatttgttcatttatttatttttgagatggagtctccctttgtcacccaggctggagtgcagtggtgccatcttagctcactacaacctccacctctcaggttcaagtgattctcctgcctcagtctcccgagtagctaggattataggcgcatgctaccaaacccagctaatttttgtatttttagtagagatagggttctgccatgttagccaggctggtctcaaattcctgatctcaagtgatctgctcaccctggcctcccaaagtgctgggattatagatgtgagccaccgagcctggccctccattccttaagccctaacttccatcctgcctcctccccgctgtaagcttttcagcttgacatgacctgttctctaaagtccttgctgcctgtgccatttgaatactccctttggggcttttgctgttgcactgaattactatattattttgcgatatcacttccagttttgcatgggacctcagcttccttatatactcagggcagaaacccctggaaggcatttttagatcctccagtgcctcacatgtccaaattttctccttcccttcacaaggaaacctctccaatgtatggttttatatcagtttgtcctaagaattctcccagagatgaaattggcttctatctttcaatggtagtgaaacagcatttctaaatgtcaccactgacttttaaagaattgtctctgcttctcctcttccctctccacctgccctgtctctgtatttggccaggccctcttacctatcccctcttttctatgtggccctttccagaagtgggtacggtgttaatatttgatcatttcacttattgtctaaaatcttctgtcccaacaaacctttgaccagattggcaaaactaacttaaatctcaaagcactaccactttttctgcctatctcctgacagggatagtccctaaaagtgaaagtgctgatgcccaagggatccattacaaggctcactgcaccacgcggaggtcaagagggagacgtccacctgcagccatcccctgcttctggctatttaaacagttgccccaaacaataattttctggactgaaagcacaggccaggattctagaaaccagagtgcaaggcattcctattaatctgcaaacaaaacagtggcaaggaaggtattcacacttacattgaaagcgcccagaagaaacaacgtgggttgtaacccgactgaaaatatcagtcgtagaattgtggaggcaattaaggcccggatgccatggggcttggggagggcaatgacgatggccagagagatgagcatggctgtccacaggagtcccgaccagtggggctccagggttcctgcaaggacaaaacagggttctctcacaaatctgtgccttcactgagtacaggggacagacctaaaacatgcactgttacagattcctcaataacttttttggcttaccagtcccaactctcacctcaaattctctgccccatccataaccagtcccatcagcattttttgacctccaagcctccacacatgctccttctgctgggaagttcttcccttctcattcatctcaggtcttagctttgacattacttcttccaggaagcctcccccaatccccttcctccccacaaaaacatgtcaggagttccctcctcctccgtactccctgcttccagtcatccctacaggacactatttcctaatggtcagtttacttgtctctctctcaccagattgcacattccccaggggaagtacctggtgcctggcaggtactcacgaaaagctcgttcgagaaataaaactcatgcatgtgtcacacttcactcaaagaaggcgacgtggaagcctaaacttaatttctattaaaagtatgcaaaggaaaactgcaggtcccctgcctgaatcagatttctccaagggaaggagaaaggcaacttccgtgtcatgagcatcatgctacaattagattatccctgcagtcaaagagcttataccaatttttgtcatctcttgctactgcaagttctatttagagtgtcccacgagacggcttggttatataacatgagccaacacggctaaaaatatagttctgtaaaacactcattaaaaaaaaaacacccctatttcaaatgctgtcacattttgagtctccttcagatgtaaacaagcagcactacatgattaaggccacttatataaaggagcttcacttcttcagagatgcttggattgtggcaccactggggaggagacacctttgcagggcacagctcttccaccagctgctggctgccctagttcattgagtccacgcctgcggagattcagcctcactttaacaactgttccccccagcccagccacttacctcttcccttttgaaatccttcaaaaggcaaagctgattgggaatggggacaaagaggcagaggtttctcagaaattcaagaagtgcacattgaggcacatgtgccgctttctacgcatttaacaattgttagacatcgtgtcaagcccttgatgttgatgatcatttattcatcctactgtccccggtctactctaaaggaaactgagtctcaggttacatttcttgcccaaagtgatgcagcaaatggctgcagaccatttgcctctgaagtcgatggtccttaatcaatattttaaaaaatccatgcattttaagtgtaaaatttggtgaatcttggcagtttatatagtcatgtgaccaccgcatgtaattgtcaccacagtcaagatacagaacatttttatcactctaaaagtctccttgtgcctctttgcaggtgatgccttgccccatccctacccccagctaccactgatctaatagtgtcagtccctatagctttgcactttctagaatttcataaaaatgggaaaataatcctatcaggtagtcctttgtgcttgacttctttcactgagcaagtttttaagatgcatccaggttaccatgtatgtattgatactttgtactttttattgctgactatattatagtatggatatattacaatttatttgtccagttaacaatcaatgagtttccagtttggagtgattacaaataatgctactagaaacattcatgttcaattcttggagtggacatattttcatttcacttggacaaacatagagaagtagaatgttggatcctacagatatgtttaactttaaaagacaataccaaactgttttccaaggtgaatgtatcacactgccttcccaccagccgtgtatgacagttccatctgatccacagcatcaccaatacttggcagtgcccatctttttcatttagtcattctagtaggtttgcagtggtatggtgtggtgattttaatttacatttccctgataactagtgatgctcaacatcgtttcatgtgcttactggccattcatacatcttcttctgtgaagtgtctgatcaaatgctttgcccactgttttaattgaatagtttttttattgttgagttgtaagagttctttacatattctggacataagctttttatcagatatatattttgcaactattttctcccagtctgtggcttatcattttctgaaatgcttaatgccattttaaatggactcttaagatgatctcagtatcatcaatgtgaccagtacaatgtatgtcccaaatcctgaagaggccaatgtaaaaatgctgtctcctcactataacggcagtgttaaaaaacatagtgctagattccaaaaaatcaactctagaaagacatctttgagacagttggagaaatctgaatttgggcaggctattacaggatttgctgttagttttgttagatatgataatggcatggtgattatacatattttaaaatgtcctcataagttatacactgaaatatttatggacaaaaaatccaagatgtctagacttctttaaaatgtttcagaaaatatagtatggggatagatgaaacaagataggcaaaattgttaaagctggctgatagatatatggtagctcattatactgttctttctacttgtgtgtatatttgacaatttcaataataaaaacatttaaaaagtagtactacatttgctttagccatcacggcatgctcacaaattcagtaagcaatctgaagctgcctgagttgcacgcttttgaaagactgtaacttgtcagttctaaaacaaaggtggaggggcggtgatacttttgaaaaggagcttttaaggccactggttcttggcagttgcaaaccttgtaagccacagaaccacacaaaatcagcacacataatacggccattatacacattcaagagggacattatgaaatcttgcctttaggatgcaacaaatcctaacacatattagctcaaagaaatactttcaggtcaacaaaccagatcttgtttctaggcagggttaatacaactcttctactgaggatggttagcagtgagtataggaaatgccctcaatgcatcttacaaaaggaaaaaagaatccctctgagagtgaactgatgcacttaaggcagtatcagctactagataatggaaaaggcttccttgggtcatatcagcctcaggtcaaatctcctcggagctctgaattatgctctcagtttagtccctcagcatgaagttctaaagcccatgattccaaaccatgcatccttgcctcctgcagaccagcctgagttggtggctcattcagaatgcaccattttagagttggaaggaccctcgatagtcataccatccaggggatctcaagcttggatgggcaagaaacacatgctctggagatcttgactagtttgccaactgttcttccccgggttctacaggattttctgaagccatatcaaagttttctaaccatgggcttaatgtaaacatctcttcacataaaggatgacaaggacttgctgaagtggcttgcccagagtggcttggcaaatgggcggcaggagccaggcagagaccttaagtctctggacttcctaagtctaagaaaggcactgcaggaggcttgtcaatgaagggtggggggctgttaactccctgtccccagaactggcctgaatgctgccacaaatgaccggtgaagaaaacagacgtggcgaataataaaatctgtttgaaatatttttaaggcaatggagagtaaatgaaaacacagacaaggtaagggttgaataatctgccgtgaggaacatgacaacttccctgaggcgaaaggagacctgggcctcctccgccgccgccagctgagctcctcactagccctctgccacgcactcctctgctgtctggcagcagggttaaggtggacatccccaaagagaaaaccttgcagctctgggttctagtcaaatctttttagacatagacacgggcattcatgtttcctgacatgacattaaaaaaaaaatcccccctggacttgtgtttagattgtacttttcggagcgggggcattcagatggtgccttccacgtaacttaaggtcaaacagaaaagctaactcctcaaaagggtaacttaggcatataagcattacataacatcgctttcaagttggtccttaaactgactcattacccatacatgtctgcttccgttgatgtctgcatgattaagctaaagagtggagcctgaaacttactcctgtgtggtttttgggctctttatcccattctctgtcacataaggtggttcctggcaggttgttctatgcgtatgtgaggtgatctgccaaaaagctctgatgaaaaatttagccgggaggtggacctcccaggtggctgctgtggatgtcagaaaaggggccatgaatgtatcacagaagaggagctttgaatgcttgtcgaggggccccaaatagcaaaatgcccacctccaaattgtctgccttttctcagcaaaatgtgtagcctggaaggaggtaggctggggggaacccagaaagaccataatcatcatgttttgttatgtgaataatggcaggtacctcttaatagactaaacattgtacagtctgcagtcattcaagtcctgcctcccctctgacccctggcaaaaaaaatattccagagatttcttacaaattctttagtctgaaatcaattccagaagtgcggtgtggaaacacatatactggactgagcatcaagacgtctacgttttagggttagctctgccattagttagctatgtgactttggcctgatttcttaactgctctgagacatagtttcctcatatataaaagaaggggctgattaagagactttctcacaggtttaatagtatctagctgcttctctttctttcctggttaaaaaaaatggataaaaaagttaaattattttaagttagatttaaaactaaatctatggtaacagctacaatctcctcttgtctgaatgtggataactgggatccccagtactgcaccaatacatccaggaaccacaactgagatgcaagtcctagccttcctgctgcttctaataggatttttgaagttaaagatatgggtacctcctcggactcccttaaacgggtagaaaaacgccaccagcaggttcatcaggacggccaggttaaacgaaatgctgctccagaaagacatgttgcgggcacaccagtacaacacgggctgggctgcagagacaaaggcaaagccgcgtgaggctggagaccccaagccggaacgccaggaatgcaatgtggcccttccgccagctctgccccacaagtccacttttgttcccggtttttaccacaagagtaaaaatgatcatttgtttggaacttggtacataatgacatcagattggtttatttctgtgtggagtacttactggaacagaagatgtattgggggtggagtaaggagagagcaaaaagagaaaagttggagcatctataaaccctgcataccccagccgcagccatcagttgcggaatctgggggttatccagagttcacacattgagtcctcggttccccctagggctctgggaccagatgagatgcccggagagacccaaaaattcaattagctttttagaagtgtggggcactggggaggggtgggggagatacagcattcagagtcagccccgctgggccccagactagggctggtatcatttccacattcctctctggctcaacatgctccactaacacgccagtgcctaaaagcaagacaatgattcctttcccggcattgagtcatctgccatttccctgaagttggatgatcattcttgaggacagggaagcgaggggtacaagttgctgacctcgtggtcagcagcagagttcccatctccagggctgtggcagagagaggatgtggcagcaaagccatcacaaaggggcaagagacagagacgctttggacattgctgccaccttaatccaccgctgcccacaggttatcccacgctggccgggcattctcagtcttagaacaacaaacacttggttacaggggtgcctttttccctgaactctttttcagtggtgctttacacttagggtgatgctccaaaatagacatggtaggcataatttcagtgtccatgtcacaggcaaagtttccaaaagacagtctcattccacatcatccccctccagagaaaagcatggagtacgtgagaatggatctcgatcgtatatttctttttcccaatgaagtcatcatgtaactttgcgacagcagccaatgacaaatccaacggccttataataatgcttgtagcagcagccaagcctttgggagcttccaaccaaaataaaattatggtacaattaaatagagccctgggtaatttattaatcgcccatatcatgtttgcacttggtaacaggcaatgtttccaaactgtagagttttagagccatgagcaatcatctagtttaaaatccctcattgtataaatgagggaaactgaggcccagcacagggcagaagcagtggagatcttgttatccaggttagtgatcctctggggtcagcggcagggataaaaataaatgacccatgtgacaattgaatggggggccagccaggacccagtcaaccactacgtagcaatgtactttctttggtaagttgattgctgaagcaaatttaagctgagacatttatctgctctagaaacaacagctattgtgtttcttctgggactgaagcccatttccgatctggatatgtaaactccagaagaggacagaagagatgaatggcaaagagttgataaccgctgaagctgagtgatggatatgtgggaatctgaaatatcctctccacactagtgtgtgtataaaaagctcataaaacaaagttggggggaagaaaaggatctggcaaagctcagtgatggtctgtgtaagccagcattcgtttcagagggagtgctccgtatcaaatgtgagtgcgtgtactgcaggatacgctaatatgattgtaataaatggtcttcaactatggcatatagttcatgaaatgaatcttatttttataaggctaacattctacttaagttgtaatgttgttttcaatctggacaaacattcagtccttcaaatcaactaggtatttatccaggtgcaagaagatacttagagaccaatcttgacatgcaatgtcttttatttcctgtggcacatggaactatgtccctatctacctttccagacacttctcccactccccttccccatatactctgcctttgtatcccaatctagtggtggttcccgaacacaccccgcactctccagcctctgcacactcgctttgtgtcaatttaaaaatatgttcatgaattatttgatcctcctcccttcaagtggtacatcttaatttcccttccacttgagtatgggctggacttaacaacctgttactaataaataagagtagagtgaaactgctggttcatgccttctgagactaggtgatattaataaaaacactgtggcttccttctcctcccctctctctccctctccctctgtctcatcaataatttgctctgaggaaatcatctgccatgtcatgaggatgctgaagcagacctatggagaggtccgtgtggaggggacctgaggcctcctgccgacagccacgtaagagcaccaaggagcggaccctgtaggtccacttaagccttcaaatgatggcagccctggctgacatcctggctacaaccccatgagagacctgagccagaaccatccagaggagccactcccaagttcctgaccccaagaaactaagaaaatactaagccccatcagtctcagacggatctcactacgtgtctgagtcctagctgcagatttactgaagaacagatgatcctctgcaatacattcaggaaaagagagatgccacgtgggagagcatggaagagtcagtatgccccccaccaccatgatgataaacccatggacttggtgtatggcaatggccctcaacaatgcaacctgctctccaaggtctcaggatccatccatcctgcctgtgctccctggttcgttttccctccagccactgccaaatgccaggacacaagtcaccacctcccctatgcttagccttgtcatcctccatgtcattgaggccttcacgactcccactctggaaccaagcaatcaaggcctctgaattgcactgttgcactgaccgttcacctccttactgtctgccttatgcagagtgcaagctctgtgaaggcagatgcctcgcctgagtggtttccagctgcccccagagcacctagaagaggcccagcaaatagaaggcactccatgattatttgataaaagaatgaatataacccaacactttatggctccccataactggatgcccccctccccatggtcagatcctttttatatttggtggacatgacagaaataaatctccaaaataaatgaattctagaaaattgctcaaatatgagaaagcaactttcagttgttcacttctttgagagctcttgaaccctcaggtcaataaaggagacaaaaaaatcatgggggcaaagaatgcaacctgaagccacctaattatggtgactgaatttctcaccaagacagaccatccaacatctcacccatgcgggcttacagaggactgcccgctaaagctggggtgcaccagaaggtggccgtgcagggccattcgcttcagctgctatcccagctgtgttctcatggcatggaagcagctttaaaagcattttgggacaatctggtcattcaaggaaacaaaagcccttcaagtaagtaagtaaatgaataaataaagcccgccatctgttatctgacagcagcgccacgcgacacacacagatagcctgccacggaccgcgctgtctgacggccaatcgggtgacccaatggctgtcaaccgctagggtcagggtaagggaagctcttatgagatgagacagggccaggcgctgagaacgccacattgctgtgtgtgtttccgccacggtcactaggtttgtttcgcattactgattccagtcctcagtcgctcaagggttcgaagcagctttattgatagaatgtgctcaataaaataataaaatggataataaggtctagaagacacaagtaagcacagaaaatcaaaaagagaataggttgggaactggagaatggggaatgaggattcagaggagtcccaggctgggctctgaggtcaagatgaaatgagaggtgtgctcagttacactactcttggtatcaaaaggagatatacaaccagtgcctcaacggaaggaagacatttcttttttttttattctgttcaagtaatttttagaaactttttaaatttgttaagttctggggtacctatgcaggacgtgcaggtttgtcacaaaggtaaatatatggtggtttgctgcacctgtcaacccacccatcacatacatattaagcccagcatgcattagctctttttcctaatgctctcccccaactcctgcctcccccaacaggacccagtgtgtgttgttcccctccctgtgtccatgtgttctcattgttcagctcatacttgtaaatgagaacatgtggtgtttggttttctattcttgcattagtttgctgaggataatggcttctggcttcatccatgtccctgcaaaggacacgatctcattcctttttatggctgcatagtattccacattttatggctgcatagtttatgtactataatttctttatccagtctatcattgatgggcgtttgggttgattccatgtctttgctattatgaagagtgctgcaataaacatatgcatgcatgtaactttataatagaatgatttatgttcctttgggtatgtacccagcaatgggattgctgggtcaaatggtatttctggttctaaatctttgaggaattgccacactgggaaggtgtttcttaacagaggaattagcagggcaggttttgcagtcagactgcctgggtgtgagtcccaggtccttgacccactggctctgtggacttgggcacactgcccagcctctctgaatccacatagaagggctgccatgatgcatgccaagtgcttagtacagtgcaaactgatggtgttaattttgtttttctactaccattacattagtagaatgtgaaaactccaaggtgaaggtgatcctgtgagcagctaggacaggagagcaaagtgagagctctgtttccagagtcagaaaggcctggatctcagctccaccgcttactagcgagtgtcaccttagaaagtgacaatgtctctgaaactcgaatcttctcatctgcaaaatgggcaataatcgtacttcatggatggttgtgaaggttcaatgagatcactacagtaacacgatagctaacactcactgactgctttcaagctaccaggagctcaggcaaaccttcacatgttatctcacccaaaaacccatggagctagttacaaggcctacctgggcaacatagtgagacttctgtctcaatgaaataaaaaaaattaaaaaggtacccccgaagaaagaagtggggtttctagaacagaagcagtggtatctattgcaagagtagaagtgaaacatgatggtagtgtgggtaaagaactaacatacttcttcttagaaggggcgtgcccttggagcgaagggaggcagagggccctcagggagggccttctggaattgctggctgtggctgctggaggcattcacctgccccctctgctacctggtgtgacctagacttagagagacaagagccctccacacagtcacagacctgttcattaagcctctttctgtaatgatgcgtttgcagggcttgggtggggaatggaatgttctcctcaggactgtctccctatggctggtgggagctgagagcagagaaggtgggtgcacagcctccccgccccaggctcctgaagcacggcccctctacccgctacactgcctccctctctccctcccggaacctctttcaattcatcactcttcacccagaccaagagcaaatcatcagagattttacttttccaaacttttcactccaccccacctggcaggtgtgaggtagcccttcaacataaacctggcccagactgggaaacatcaggtgatggtgagagaaatcaaaatggtggttgctaggtacccatcaacagtgggctgcgtaaagaaaacgtggtacatataaaacatggaatactacacagccataaaagagactgagatcaggtcctctgcagcaaaatggatgcagctgggggtcattttcctaagcaaattgatgcaggagcagaaaaccaaatactacattttctcacttgtcagtgagagataaacattgggtactcatggacataaagaggggaacaacagacagtggggagtgcctgggcgggggcaagggctgcaaaactcttgggtacaatgttcaccacctgggtgaacccccccaaacctcagcatcgcacaatatacccaggtaacaaacctgcacatttacctcctgaatctaaaataaaagttgaaaaaaacaccaaaatggtggttgcctctggagggtggggggttgtgagtagaaaaggactataaatgggaatgagacaactttctagaagaaaataaatgtcttgattaggttggcagtttcacaggtgtggtagacagaatggtccccgcagacatgtccatgttctagttcctggaacctgtgaaaatgctgtcttatgtggcgaaggggaattaaaggtgcagatggaacaaaagctgctaatcaccgaccttaaagtagacagatgagcttggattacccgggtgggcccaacataattacaaggagccttcgctgtggaggcaggaggcaggagaggagggtggcgagaggcaatgtgagaaggactccattcaccattgctaaacctgaagatggaggaaggagccacaagccaagggatgtgggtggcctctggaaactggaaaaggcaaggaagccttctcccctagagcctccagaaaggagcgctggcctgccaacacttgctttagtctagtctagtaagactcatgttgaacttataaaacaatacatttggttcctttaagccactcagtttgtaggaatttgttacagcagccacagaaaactggtacaatgggtatagaaacatttgtcatatcgaatcaaagtctacatttaaaatctgtgcctatgattatatgtcaattatatcacaataataataattaaaaaaagataacagaaagtctgctttgttcccagaaagctggggaactctgtagaggggccaccttctgaggctgcctctccaccagagggaacggcatctgcccccgccaggccgacctctcctcaccctccagtcgtctccaaatcacatttgattccagagccctttccatataagctgtctcaccagagtcttaggagattgccaaggcagatatcatcattcataaatctgtcacattatagatgagagagctggggttaggagaggtcagtgacttgtggcagagccacaaccaactctcctcccatctgcacgttgaaccgacacagacaaccagccccagcagtgaggccggagtcaaaggctgggaaagcagaagacacaaagctggtctgcgggcagatcctcagcaccagtcccagacatccctgatgacagatctgatcagatacgctttaaggaaaaggccagggcaggggcaggggcagggtgaggcagtgaccccggcagtggctgtttccatcctgaatccactggacagggggaaagggaagtgggcatggctgctgtcagccaaccttcaaccacaacaaaagagcaagagaacacagatcacagaactctgcagctggaagcactggaatccagcagtttccaaatgcctttttcagcagggtaacgtgctcctctccggtcccaaaacaccatcttaggataaagacgccgctagataaaagacaaaaggcaaaacagctccatatgaagcagagcaaagagggtcccctccctcttgccattgaaactccttggaacttcaggagagcagcacttgaaaaccacccatgtcgtccatccttccacatttcacagatgaggaaactgaagcccagaaagggaaagagacttgccagggccacacagaacctccctcccctgactgcccaagacagttacttttgaccacactggggtgtggctggttgaaactacaacccgagtttacattcttaccttctgataattgtcaagtagacagttttccctccttgggttgactgagctgtagaggggccaatgaatccgggtcttagattaaaagaataacaaaactaccttttcagatcagccttgaaaataatataatattgcttaattagcctggctcccccatcctcccccagccctgcaagtccttgcaaagccatggagcgtggttatgacgagcctgccttgcttcaggaacaagagccaccccgaggttaggggctagtggacagtgacggccacctcggtgacagcagggagacagagggcctggaattatcactggatgcaagttggacaccagtctttggccatttacataacacccacctcctttctggatccacctatcttacccttccctggaaaggggtattattgttagacaactgtagcactttgcatctgagtagctcttggtagtaatcaaagtgtttttgacacctaacgtttcataacaaccttgctggaccccagcttccatgtgatgctgacatggcagatggtaagaccctcatttttcagctaacgaacccagggcacaaatgaggttaagtaaattgcccacgatcacatggctggatagcaaggagccaaggccataatttaggtttcccgacttccagttctccaggcacgctctgcctagccaggtgtgttttattacctagttcaaagggggacactcctttctttaggtgcaagaggtcacagtcctaatcaaactgtgtaaacaagtggtcctggggaggagaataggagagacaaatcttctccatgacctagacatatacccatgaagccatctttcccagaattcaggaagttcaggggaaaagacaggccttgcagtccaaggatcatggtgctccctggaatgtgagccagcctacctgtccgtttctgggccaccagaccattctaggggaggagcccctttgtggcatcttagctgcaagacagggcagtggcggggagcatagatgtatgtgtcccagggtggagcctggtgggagcgggcatggcttgcgggggagcagtccagcacagagtgacggctgcaggactcagatccttcctcaaagaaaagcatttccatcagcttctaaaagttggtccacctttcagaagccctcgctctgggccttgagagaatccagagaatgggattttccacctcactgcctcataagacatggccctgacccatctagcccatgacactcaccacggctgctcacttacctgctgcagaatgatttaagttctcaggttaaggccaagaatttgaaaaatgtggctgccaaacagtgagccaaagcttgagtttccacaggctgaggaaaattctctgtgggcatctttgatttttctcttttcacatcaactctgggagtctcagggacttcagaggacatctcccaccagactaacccactcctgcccagcttgaacagatactctgtgggtgacagagcaacgccagtggctaccaagaggtggggcttaccttggctgtcttcctacacctgtggtgaactgagaactccccactccctggggaccctctctctgcaagttttattatagtgaacggcaactgaacgtttccgatttgccgggcgctaagcgctttatatgcattatctcatttcatcctcagaagcaccccatggggtaggtgccattatcatccccagtttacagatgaagaaactgaggccccaagaagtaacccgctgagtcatccacctaataagtgccctggcacccaagccccacctgtccgacgcctcagccctgttcccaaccacatgctctgttaaacacctctcccctgagcaagagtctgtcctgttctgaacaccttttggcattttataatccaccccacccctacccctacccaccaggtctttcagaggcataaacaggctcctctcacagtaaagaatagtggcagaaggtacacatgcattcgaatgcctcaactttcccatgacgtttaatacatttgttaatatgggttcccaaacaatccccttctgcaagctgaagggctgccagggctggggtaataaattattaacaaaaccattgtcacacaatgactgctgtgggtctggagtccttttttagaaaccaatgattacaatcaaaactcaaagaccaggaaccatgaactaggtaataaaacacacctgggtaggcagagagtgcctggagaactggaactcgggaaacctacattttggccttggctccttgctatccagccatgtgattgtgggcaatttacttaacttcatttgtgccctgggttctttagctaaaaaatgagggtcttaccacctgccatgtcagcatcacatggaagctggggcccacccagcaaggttgttatgaaacagtaggtgtgaaaaacactttgattactaccaagaactactcagatggaaggtgctacagttgtctaacaataatacccctttccagggaaggtgtaagataggtggatccagaaaagagctgggtgttacataaatggccaaagactagtgtccaacttgcatccagtgataattctagttggttctggtaggttgaatggcctctaaattgacagcaaaaacacaatgaatggcaattcccattaagtgtcacaatgtagaatttttttttttaagtttggacggcatgaaaaagaacgagatcatatcttttgtgggaacgtggatggagctggaggctattatcctcagcaaacgaatgcaggaacaggaaaccaaatactgcacgttctggcgtataagtgggagctagatgatgagaactcatgaacacaaagaaggaaacaatagacactgaggtctacttgagggtggagggtgggaggagggagaggagcagaaaaaataactattgggtactgggcttagtacctgggtgatgaaataatctgtacaacaaaccccagtgacatgagtttacctgtataacacaccttcacatgtaccctcaaacctaaagtaaaagttaaaaaaaaatttggctgaaatttcactagctataaaagccattcaaatttctgcacgtgcagagataaacatcgttgcttccgcttgtcaaagtttaatacacccaaaggcagaatacaagcttgtgtcagaccctcctctcaagtaatccccagcctttccacataaagcatttcccaacattttaaaccagtctcgacttcagcaaaagtctgacctatgaaaagggcctaatagtgagtacaatgggcattcagaattggaccctcccttggcataaattatcactcaccctaacaagaaacttttttgcaaggtctgatggctttcaaccagccaacatctgcagctctcagtttaccagcctctctcaggatgtttccagctttaatgagttcagaaataacatagacttccaagtagaaaggaagcgatgaagtgaagcaagtctgtattggagaggtgtcaacatttcaatttcatttgtctgaaataaggtcctccctcatccacactgtacagtcaccttttaacaagtgagagacaaaccagtttcaactaccctgccaggcaagggtggggcagacgcccttcgctatgcctgacacctgagagaaaaggtggaggacaaagaacccttccttcactcttattaatctggtcactgggctctggggaacggcctaagctccagggtcaaggccaaggcaggggatcttcatgatgattttcaaggtgaattcagtcttcttcaagcagcaaagtccaacctgttctattaaaaacacttttcagggtccagtatggtggcttacagctgtaatcacagcacttccggaggccaaggtggaaggactgcttgagcccaggatttcaagaccagcctgggcaacatagcaagaccccatgtctaaaaaaaaaaaaaaaaatgtttttaattgggggaaaaaacacctttcttctgagacagaaagctcaacagctctcctttcctgtctcccagtgcccacgggaactgggacttactgggaaagctctgccctatctggtaagcagcgtggtccccctccaccctgtgtggatcagaacgctaacagtttcacacatattcaacaacaactcaaccaacaaacagtaattcctaaaaaaaaaaaaaaaaaaaaattaaaggtattatcgtaggaagcccctgatggtgtaggcaggctactggcaaccactgtttccagcaattttcaacagtaaaaccagatttcagagaagcaggtcagccaccaccctggaggaccctgtggctctgacccaggaacaagaagttaaggagactccaaattttctctgggttcaatagtcaaacagatgccaaaggccagtatcttttgtggggatacacggcacagccgtctgtctcttccagccaagtcatgaagattggaaagcctccagacaaaacaaagatgaccagtggagtgtcaaatcaacgatacccttgaaaacagatgtaaaatagatgcaacatcaaaatttgcctgaagtggaaggggactgtggtaggaagctccttggtaatcctccaagagggcaagaaggtgttctggtggctcttcaagccaatatgaggcttattaaaaaggtactctaaagcaaaggagagtttggttagatctcaggaaggacttttgtccaaggaatcagagggctttaaaatctcagtccataaagaaggaatgaacaatgtgaactgcatgtctgggctgcaggagacacatgctagcctctgagggtggcttccagggctggttctatgattcaatgacaagtatcctctggtggctcttgtgaaactctcaggtcctgtctcagctcacccacatgatcactgtgggaactgtggccaggaggacatgaagactttctcatcagacctccaccttgtctcatgaaccctgaaaagacagatgcaagaggtgcttggaaaattctatcatcaagtcctcttcccgggaggagggtccagtgctgaggacctggcagtgacttgggtgctgttcctccatgggggtggcaatctgcatcgtggagagcgagggctgaagcaggagttgcagggtcaggggagtcgatctctggaaacaactccccaggtcttatttccattctgtgtacctgagggacaatgaatcaacaccaaccaacatttcctgtcctcaatgctccgaggttcccagggaattcaacttgaaatttatacagatgccaagaataatccttgccaccccccccccattttctgtgtttgtgcagtcacacggctcagtgaaagcgatctctatcctgcatctttagcaaggtagaaacatacgcataggggtgacttaggaactgggtgggtttggacagctcatttattaacttccatcctcagttccctcatctgcaatggagaaagaggaggagaaccacttgagattctattgcaaggagtgcaggagagaaaacaggtgagagcccgcacagtaccggcagggtgtctacaccagccacgttcccttcgctgctctccacacaaactgtgacaaggacacttggccatagaagccgaaaaaaataaatccactcaggccggatggaggcaaggacactggcttaggtggcaaagcatcaagcaaagcaagtgcctccttgatgaagactgcagtcacccccagtcaaccctagtccttcccaactcaactgactctcgggtacagccgagtctggtccccagcagaatgctctgggactcttcatgtctccccaccctgcatccccatcttgctgtgtgctggcccaccaggtaacttccacacggccacagagagcatccctggcagctgacagtaagatgtacagatggccaagcggttagagcagggcagggtgaaatcacacagcactcatctgggtaaagctgctttgtatattagggctttggcggcggcagcgcatatccaagcaggggacaggcccaagccaacttggtgccctttagaagcaccgactagggatcggcgggaaccacagagatcacctcatccagccccgacttgatgacaagcccatcaccctggtggagcagatactttccgcagctctgcccctgaccgaccaccatggggtagaccgcgttagcttccttcactcagctcctccaacatcccaagcacaagccaaccctcttctgaaatactcttgccctctgctactcttcacacagctccttctcttcgcatctgttgggtctcagcttgaacggtatctccccagagaagccctccctggccacgcttcgtggcgcctgtttgcttccccatcacacttctctgaagctctgatttagctgatgatgagctgatttcctagctctgtctcccacaagactgtaagctcctggagggcaggggctatgttggtctcatccctgactgtattgacgccaatgtgtatagcacctgacacccagggagtgctcagtaagtaaacatctgctatattaagccggctgtggtgacacaagccagtagttctagctactccggaggctgagacagaaagatctcttcagcccaggagttcaaggccagcttggtcaacacagtaaggcctcttctctctttttaaaaaatttactatattaatgaatgaacaataatcctgaaggaggtgcaattccgaaacactcaagccaagctttgcatccatggcagctgaagtataactttatggccagaagaagcctgcatgtgaaagctcaaagtcctgctaagtgggaatatgcagcacaccgcagaccagccaaaggcagctgatgtggtgttgtcacctctacgggcttatccggtttttgcacgtaactctgtgatgggctcagcctggctgaggatccttaatccatcgagttaactgttaactaccccggccccagtgacacagcagcttgcatgattaactacagcccgggagggatgatcatttgtgcaccttccgtctccaaacctggctccctccccagacttgatagctacaagctctgggctcaacagtttgtgggtttgtgttgcaaggaggctaataaaaacatatttctcaaataccatatggtgagggcaactgcaacacatcctcctcgaagagcaataaaatatatatatttttaaagtcctgaattccaggggaaaaacgaggcttgaagacttcagagggtttacaggactatccccttcagtgtcagagccatcttgatcaaaagtctaaaacccaggaataggaaattggtagaaactttgagagagcctctgacagtttcaaagaggaactcagaggacctcaggaaatgtgagcgggcatagatttctccgtgaaaaggagggtcaaggcagaagaaccagaggcaactgtgaacatcaagtcagttctcagggaagcaggggatccaagtgtgtacatgaggcgccttcactgtccctgcatcaggaatctagctgttggcaccttataatgagaaaacagtctcaaccatgaagttaactctgctggaagatttccaaagggaaagtccctcccgttactcagaggggaaaaaaaaattacctacttggtctggaatccggggatattttatgcagatgtctctaacagaagttaataaagggaagtcagcttgcctctgattattcaaacaggctactgctattaaggattgcacaacttctgggcaaggcagagggcaagaggacaaaggaggatgcatggaaatacaaacagcccttctcctccaggccataccgactgtccaactagcaacagacttcacctggttttggagcaatctgaatttggaatatgccagagaaaacttctatcaggcaagatggaagactcctaggataggtctctctcatggagggattggcacgatggtaagagtccagtggatggaaaaggcctcctccttaaagatggtgatggaaacgagcactgcacagggaaacacaaatcaggtcccctgaaatccagcccaacctggccagaccctccagtgcccatcagggcttatgaacagggtgcttcagtgtctttgttaggggtggttaaaaaggagcacgtgcttataggggatgctgctgagctccatgattttgacttcctgtctaacctgttgatgctacaaaactcttttaaaaacagttaccatgggaacttttccctagcaagcattcttcaagaaacgttacaggtgctggtgaattcaatgcccttggtgtcaataagcttttgctgagtcttagaatgtgtggcttgaactgagaggactttcaaacagataatgcgaagtttccaatgcaaatgtcttcggggttaagtgtcagtgaagtgcagtggaaggtagggggataaaatgatctcagtgtatatggaggccccacttaagcattcaaaaaattctatatacagtgttttcaatgtattatgtatcagcaaaacaaaataccccatagggctataatcagctcagggggtcacctcagcaagagatgctctggctatcactcctactacgggatttcctctctcatcagaaccagtaggtggtcaaaaccacaataatgcataaatgaaggcagggaattgggtatccaatgtgagcaactgaaaaggtgccatgtattagctatttgccattatggttctgcaagtgctcagatgactcataaaatgaccagaacaaaagtttgttcttttgtttttactttgagaagataaagaatcacgaattagtattcaaggttacctaatactaacccttgtctaccacgtgaccttgcattacagggagctgttgttgggacaggacaagagtccacatcccctgcccagtgcctggttctgggtcatgtcaccgaagcgcatcagcccatctgtcagccaaaccccactagccttgtgccttctcttctaaatccccgcggaggaaaacaacttctgccttctacagtacgaacagcgagggtctgctgggaaccaatacaacttcgcgtcccagtgcagcaatgttgccaggtaacaaatgtagaaacatactccaaaaactgtatgtgacaatatacaacctccgctctgcagctgataaccgagggagtgttaaaacaccgcgttctcttaacacttgggtttttggtgtgaaagtaaaattaaacgggatacttcctcttgtaaatataagacaggcatacaactcacacacgtatccactaatcggaaatagtagaggggtttgcaatagctatctgcagtgcatcccagccttcactcttaccctcaagatgaattccagaaaacctacagaaacgataactgaggaagagcctttcttctgtcggggacaagctctcctctaacaattgtgaggaagctacccacaagaaagacaccagcagaaattaaggaaaagctcatgcattgttattaaaaaaaaatgtgcttccattccactccattttaaaggtctacctttaaaactcattggctaaccaagcagtgactacttgcttctcagatcaaataaccagtgcagcctgttcccaccccaaacgaaaacaagatagacactgctctctagtaggcagagctccaaagtgggtacagggcactgaatagctccctcacattgtactcatgtaacttaaaggctggctagcatgggagaaagctgagagacttctgagggccttgtgttcaaatcccagctctgccaactgggtgactttgggtaagacacatggcttttttcagactcagtttcctcatctgcaattgggactattccatgtagcccagatagagtacctactggctccacgcacagtgctgggcactttataaaatgagaagaccttcctccctttcccttcgcccaaacatgaatattcttcaaccagtaaagactcagatgtggggagtatctggtgcatttagcttctctgagcaaaacgggcaaaagctgagatctaataaccatcacatgatgccaaagaacatatgcttctttagacgcaagcgaaaaacaaaaatcgctattaatccaacttttcataacggccctaattagatgagctgctgtcaatctcttccacagtgaggaagttctgtaggacagtcttcctgtcattaactttcctaagacctgggaacctggaacttgctggaagtacatgtatgtagcacacataattgtcatttggcaaatgagatgcccagtctgaaaggaaaagtctttcatgatttcctcctccagaattcatgggcagaccttataaacaaagcaaatacactgaccactcgagctgccttctgattatcaggagggcacagtgtctcccacaaagactccactaccaaagaaaacaaaatgtggaggcacaacttccaatctgcctggcaaacagacgcaaagtccttgaagcggccatgtctgtgcctggaaaattggtggagtaaggaggcggcatggtagagaggttacaaactcacgttctggcagaaaacaaaccctggaacaactaccagctggctctgtgactctgagcatataacctgacctctcggatcctctatttcctcattagcagaaagggatcaaaacagtacctactacataggcgccccaggaagatggatgagaccatgcagtgagggcgcctggctagcccgtggtacatgagcacttgttaccactactgtccatcattattacaaagaagaagaaaagaggactgctgccatcataaggctatttctccaagttgacatgtatttcccatgggctcagatcaattccctcccacacctaaagaaggtcccctttaaaatggcaataatcatcaacaacacaagttcacatttcacatcctcatgtttctattcaaaaatggtaagaaggctaaagtaacacggtggccacactgggtcagaacttctatctctacatttacagtctgagtgctggggagtcagatggagacttgaccccggaagaaagtgcacccttgggcgagttagtgggtgagggaagataaacaaccaaaaagtaagcagagttgctttggatgagctgttacgatgtgttaaaagctccatgctgagctgagtgccttccacatattatctcagtgaattcccagaatagtttatacagtaggagtatccacactgattcatcatgtacacactgaggacctttcatccagcacgtgtggaggctcctcgaggggactcggagtgaagacagacttggtctctgccccctcgggtcttacagtcaagctccagttgaagtgtggtcattactacagtaaatgaagcacaacccattatctctgcctcaggggatcaagaggaagtttctagagtaggagacatttcaatcagggcttggggagcctgccaaagggaatgagggcacgtcccacatgaagcaaaggcatctgagttcatggccccgctggggattggcaggcatgagttgcagctgcaggacaataagcgtaggggagtgagtggagaaacccaggtggggccagaccacgtgaggcactgatgggttccatcagggtggccatgggctccatactccacagaaggctgttcagatggggaagcaggtagtgagggttccatttggggggcatcactgacaaccgcgtggaagagagaaatgcccagaggcaggaggccactaaaaggctatctcagttatccaggcaaaaaggctgacaggtgcagatctcagcagccctatgctggcaggcggtcgagcctggtggtcaagaatatgaatcctgaagtaacagtgcctagtttcaaaccgctgctcctccattcccagctgggccactctgaattcacagtgccaactatctggctcattataagtcctaacaatggttaaactcccaggaggtagagtgggcacagattagttcctggagaaaagcaagagaaaaagaagtctgatgactgcaaagcttctagcttgggtatccttggctggtggtgagtccactgagaaagctatggaacacgagagggcaaatagaatggaggaagggagatgacagtgtcatggggtcctgctaacttatagctaacacaagtggagatgcccatcagggatttgagcagaaatctagaaatcggcagagaggtgggaccgagagctgtatctttgggaggtgttggcataaatggctgctggaggcctgggcagtagatgagattacccaaggggatcggtagaaaaagaaggcaaacaggctggagatggggcctcaaaacatttcagatgttttaaggtcaaccgtatatgccctgagaagtccctgtgtttaccactaggaaaacgtttgtaggaggcacagaaatagcacagcattaagccataagggagtgactaacctgaaaccatgatgctttggggtaggacggtcagagggggctcacagatccaaagtctgtaatcgcaggtgtctggactctcaggctacatatacaatttcctaaggaatgtcctgctttgtctgcgtcccgaatctgtgttgaaagatagtaaactggggtgatggagtacatcctggcagaggctatgtggggagagcagagatgactctagggaagaaaacgtcttttaaaaaacaaccctgtctgctcccaccaaaaggaagaaagaaaagaaagaaaaaaatgaaggaaaaggggaaaggaagggaaggaaagaagggagggaggaagagagggagggagggaaggagggaaagaaaaaaaaaagacagtgagaaagagagagaaagaaagaaaacacagaaagagaaaggaaaagaaagagataaagaagaaaagaaagggaaggaggaaggaaggaaagagaaggagagaaggagggaaagaggggaacgaaggaaggaaggagggagggagggaaggaaggaaggaaggaaggaaggaaggaaggaaggaaggaaggaaggagggagggagacagagagggaggaagggagggagggaggccccagcctgtttccctgaattcccatttattagctgagtaagtggccaacatatcttgggacttaggatattgctcatctggtgaatatttacttaaaaattgccataccaggggatgaggagcacagaacaaaggggaaatactgtggttctttcccttaggcagtttaacatctacatagtaaagattaaacaaaccctagggtcagcaaacatttttccaaagggccaaatggtaaacatttcacacgctgagggtcattgcagctatctgtcacaactactcaactctgcccctgaagcaggaaagcagttaggacaatcccaaaggaaaaactgcagctatgcaccaataaaactttatctacaaacacaggcagctgtctggatttttcccgtgggctaccatttactaatccctgaacctccagaggaagactgaccaatcctctgcctggcagttcccaagaggcatctcacactcggaagtcactaaagaaagttaggaagagcacagacctcttgctagaccagaaggaagagaaagaaataaggaatatctggacctgttgaggattcagtgggataaaatgaattgatgcctcactttacaaaaatttccaggtcttctctgtcatttttctctgcacttttagtaaaattttggagactgtggaaaacctgaggttctctctgaagacatctcctcttagaaacaaattcctagccagcgtggtggctcacgcctgtaatcccagcactttgggaggctgaggcgggcggatcacttgacgtctggagctcaagaccagcctggccaacatgtagaaaccccgtctctactaaaaatacaaaaaattagctgggcgtgggggtgggcacctgtagtcccagctactcaggaggctgagacaggagaattgcttgaacccatgaggcggaggttgcagtgagctgagatcgcgccactgcactccagcttgggtgacatagtgagactccgtctcaaacaaacaaacaaacagacaaacgaacaagaaacaaattcctgcttctaggtttcgcagaaaggaaggagattaacattctgcttccaaagttcttcccctcccccttccccctcaacaactgtagtcctctcatggaaggccagacaagcagatgtatgtaactgtccacttctgcccatattgttggctctgctactcaggaaataagaaaaatcacgctgggtctccagctcctctggaagcatgaaccaggatgcacattctcccctgggaccacctcaaagggattgtgcctcttatcaccaacctggagggactcacagatgaatgatgctgacaagtcttgcagtaatttcttgccccgaactgggaaactgaatgccagtaggtgcatgcattacctactgtctgccgtcactcagagagctgcgctaaggatgaccagggcagagttgtgggaactgccatcttcttctgcaggagggctcactcaagtctgatatgcctaagaatgtaacgacttttgaattttgagcttcctccttaagacctggatttagaccaataatcctcaaggactcctgttcaataacagtccagtttcctgggaatggtgaagaagggtgtgaggtgttcaggtcaaaggcagataaagtaggaggaaaggaagagaaggagggaaagaaaggaaaggaaaaaaggacagacaagacaatggcctgggccagggagcacttcaaaccacaaagaagtgactagattgctgtttttctttctgcttcatcccagaatgtctctcattactattagtggcaaaaaccgcaattacttttgcaccaacctaaataacctgtactcaaggcaatgaaatttcccaatgtcctggagttctaaaatcatttttaatatacagtcagaaggacttgggtcaattgagtgtgaaaataacataagacagagcgtcccccaggcctgctggatgataaaccactatgcaaaaatagaaaatatcagaagtaggattttagacagaaaacacatttcacaaaatacagcatgtatttaaaataaataaaaatattattaattagaaccgagcatggtggtccgcacctatagtcccagctactcaggaggctgagggaggaggaatgcttgagcccaggagttcaagtctagcctcagcaacatagcaagaccctatctcttaaaaatatatatgaacaaataaaaataagaaccacatcatcttgagatctttgtattggccagatgccacgtgaggtgctttctataaatagtctgtgaaaacatctcaggagttctctgaggtgggaaccgtcaccatcctattctccaagtcaggaaccagtgggatgagtgaggtggacttcgccaggagtcctgaggtgggcatataggaggcagggcttgagcccaggctgtacccacaccacagaatcagcagccctggcagcagctccacttgtctaccggaccacacactttaccctcatgttcttcgtaactccataaggaagggactaggcttttccaaccctcattttgcagatgaggaaactgagtttcaaagtggccctgacaaaccccaaggtcactgaaggctggcaggggcagagctggaattccagcacaaatattgtggtctggaggcccgcagttgataggctctctccttccagggggtcctccctgagtccctaacctttacgccaccatttctcaaaggagccaagctggtccttgagccaacctggggtggctttgctgacccctcacagcttccgcagaagggcagtgtctctggggacgcctgctggggacaagtcactgcctccctctttctttaatgccaacagctctcgaacccccacgtgcaggaggagagctgccctgactccactgctggcttcactcctttcccacatggataaaacctgaggttagaaaacaccgctcagaagtgactcattcctgacttccctgccaaaaacaacacccatttacgtaacttgctcacacaccaatcttttcctcctcctcagggtgactgccctgtcaaaccaaggctgatcttcctcacaaactggccttccatttccagcagaggcaaatcaaattgccctttccgccctcatctctttgctaactggggtcagagatagcccaaccaacgtgtccctcccacactgtgttggtgacttccggaagggatgtgagatttcctatctaacacttgttcttgggctgatttcttaagccaacctcaaaaaaaaaaaaagagtgtggtgtaggaaaggcctcatgaaccagggatcactctctctgctgaatttgcaggccagtttcctgacggagcacttctcacattttccatctctagctgcttacgtgcagaaaagaaaacccttttcgggtgtgtctgtagactagactttggcataggaatagacgtgggcagccatttgatacatgaaattcccagtgcttctgaaaccagaagcaattagtccaaaaaaatgtttaactatctatccccataatgtgctaggaggttctctatggtcatgtcagcatatatatcccaaaacatctgtattggcttaaaaaaaacaaaaataaaaaacgaggtatgtccaaagatagcctgtcctcctcttcattccaggtaaggacagcccctgtccttctgtaaggaagaggaagcgaagggaacttcccccaggcgctggtgggaacatcttaggaggaaggaacatagaaattggcaaggactcgaaggacggatatgaaagtgccgtgagccctgctgagccccatgtgtgccaaaaattaattcataagcaaatgcttattttatagtttcccacttgctacaaaacatcaagccacaaggaaatatttcttctgggggctgacaggaagcgggtggcaccagagtggggagaaagaaagccggaagttctcttcaagacaagcgtgatcctatcacctgacaacgtgtcacccgtttctggaaaatccacgggctgtggtactgtctccttgttcccataagcggagggttcaatgtgaagcctgctctgatggcagccaggtaggagaagtctgggagtcacgatctaccctcagatgttatcaccattgcaggagccggggcaggaagaaaagatgctgggagacctggggacaccacccctgggagtccattatgccagactgggaagtaacctgtatttggcttccaggcatttcagggctttaggtgatgatgtgatggatgacagggtttcataataagggagcaaaccctccatgagagtgcctagcaagcactgtatgtcattatttgtggattcccataaattgaatcctctagggtctggacaatgaaatctagaatttctggagtgctgtgattcccagtgagcttatcctaaggcaggactgaattttcttacaacatccaaaaggagaaagacaagagtcaacacttttgcaaagaagggatttagtatccagggagatccaaactcctcaactgcagagacaatggtgtctccctttcctgcagctgtagcatccagcttgggggcctggctgacccatggtaggtgctcaatcgattataatgggggtggtggtgaggaagccagtccccaaaggtggtccccaacaattctctctttttatacatgtaccctcctcacaataagaggtggagtttttctccccgcctttgaaatggggctggcctcatgtctggctttgaccaatagaatgtgatagaagtgatattctaggaattctaaacccaggctttgaaaaggctagtagcttccacttcctgcttcttgaaacactgtttctcagaacccagtcaccatgttctaagaagcccaaaccacacagagaaccaaggcactccaggcagtacccccagctgagctctcagcaaaggaccagcaccaatggccacagtcatatgagtgaccacgtaagctgttctaagaccagtcaaccccctgatggttgcagacccagccaagatcacacagagcaaaagaaccacccagctgagcccaagctcacagaatcatgctaggcaccaaaatggccattgctttaggctattaaatttttaggtggttattcagtgacagataactacaggtggaggtgggacggacaagaggtacaggatattttatcatgggttttgtccagctctggaactctgagtaagtcataacctccttgagtttctgtttccttgagccactgtgcccagcgttccctaaatattttaaatctgcagttggttgaatccacagatgcagaaccgacaaacacagagggcagactgtatacatttctggaactgtgtaggcctgcctgcttccctgcaactcccctttctaccacctgtcatcaggaaacatggatctcaagaaggccagctgaccacagacccatttcccttcctgagaccctccatggtgcaccgaacaggaagtgaccgtgctccaccagctccggcaagaacccaccatgtcttcagtggagcaaagcatctcagcaatcattaattgccacactgtggtcttagcccaagtcaggctcacttcccagctggccacttactactctgaaccaacttctcaacagcaagacgaaactctgaatcactccccctggggcttcaaggttcctgtccttaactggccccagacacaaccctagttccacatcattttctccagagaaagagaagcttggggccaaggggctctgacaagtcaagtctaggctagaaggcattttcctggaaccatcggcctcctgtgagacactgggttagactgggccccccaggggtcacagaagcggggaggagaaaacagcatgtgcgtgcggccacacccgcacccttccatcctggcatggatccacaggcccccacaccacccctgcgttcccccaagagaaaacatccctgctccacacgtggctgaactgcggtaactccatcatggcatttcatctacagcctgggtgtatgagtaataaatgtgtgaaaccatgaaactaatattcataatgaccttacaagataaagaacttgaaggaaaaacagcttctgtgtgcctggccgtcaccatcagggtgctccgtgaaaaacatggcatctcaccagagccacagacatcgtctccccaggagcctcagtgctggcggccctcagccccaccagccactatacttcattgttagtccttaattaatggtgcctttgtgcacctggtcatcccgatgccaagcccagaaccgaatggggcctctgacttctcttccacgtctaatcagacgccatttcagccaacatttaccaagtatcagcaggtccaggcctgggcctggtgcaaggagtgacagggtctctgtttgtgacatcctgtccctcacccccacccctttagtcccagcaaggttcagagtctcattccctgccctcatttcttttatttgttgattgacatataacataggtacagtaaagcacactaattttaagcatatggcttactgagttgttgttttttttcttttttaaacttttattttaaattcagggttgcaattgcaggttacataggtaagcttgtgtcactggggtttatcacatagattgcttcaccactctggtattaaacctagtacccattagttatttttccatcctctccctccttccgacctccaccttccgaaaagccccagtgggcgtcgttccccctataagtgtccatgtgttcctgtcacttagctcccacttataactgagaacatgcggtatttgattttctgttcctgtgttattttgctaaggataatggtctccagctccatccgtgtcccagcaaaggatacgatcacggagttttaaacatgtgcacagtcatgtaaccaccacccaaacaaagaggtcgaatatgtttccagcacccagagagctctcttgtgccattatgagaaaatatcctctcccaagatatgaactcttttatcagagatttaagttcaggttctcatcagctcttccacaaattactgcccattaactttttaattcttagactgcctccttgggaccctgctttcctcagtttacctgtcctctactgccaggtgtatagtcctccgttacagctccaaagccccttggagggctgcactgctcctatatatgaaccccaacccccatccaaggcccttcacttctacatagcactcctcggtctgaaagacccaaccgctgttctggaaacccaactgctgctctcacacctctgggccctctctaccatggaatatgacaaagattccttatgccccaggtccatgcccaatttccccctttcagtcccatgtccatccttgaaagcccatttcatccacagaccgtctgcaggctccccagagagatgctggtccttcttccttggtggttccccggcatcacttctacttcttggagggcactaaatgtcatccttgagacatagcatcgtatgtgcacatccacgtatccttgttagaggttcaatttcttgaggactgagattctgggatttctcaaactggtaaagctttgaaatttggggaagggaaggaataacaacctagggtttccaacttctaatttggccaacagaaaaaaaaaatctatcatccataatcaacaccatttcattaaagaagacactgtggctaaggataaagattggagagatataatctcagaaaaaaatggccaggtcttcaacctgaatccattggtttatgaaaagttcaccacattgtcctcattttccacacttgactatgcctggagaaaatcctcacagacgaactggctcccatgtctggaaaccactgccccatcatcgcccctggtatagcagcacatacgcagaaagggctcaatgactattcagttcaactgctctaatcacaggaaatcatgtggttctaagacaaggagcatttcagctctgcttcctcccaacacaggagcccagaacacagcagtggctgggcaacattccattgatgagaaggactgcaggacccacccacacacacatgacaaaataaaaagcaatcccaacgtgtacgactcgtgcccacgtgacaacttagacaagcagtgggccttgccactggcccaggtgcctcactcattgtcccaaatcccaacctggtgcaacacgtgacaatgaacttcaaaagtgtacgttgggggaagcggggattggaaggcgaaagaaaagggccaccgcagttggctgcacaggttgtgccaaggcacaagggtgctggctggaggagcaggcagggactgaaatctcacctgtgctgcacctgccaagccaggcaccctggccgggggcacactgactcacaggaagaaacgccctttacaaagttgcacaaagaaccaagacttcattaaccgagactccgaatttcagttcaaggccaagaatatgtcaggtcaaatatatacatcagggtgaattttacagtatgtggattatatctcaataaagcttttatcaaaacatatgtgtgtgtgtatgtgtacacgagtctgtacatagatacacgtccaaaaaaaaaactcttattcagagagctaacaaagaaggaagagtgcataaaggaggtattaaaaatatttaaagggatcatatataaaagttatgttatttatgtattattaaaattcatgttctaagatgactgttgtggaagaaaaaatcatgaaaattgttttttaag

SEQ ID NO: 111 - DNA, 21509 bp, Homo Sapiens
acacaacctggtgcaaacaaccttgaagcgggacgcagccaaagaacacgagatgccatttctcagcccaattggaaagaggccgggagcaccagttccctgaccccctcagccccaccgcctgccgccccctggtactgaccagctccttcttcctcttctcctctttcacgtcggtcttcttgatctctgccttgaaggcctccgcctcgccattctggtcgtccttggccagcaggtccatgagaaggcacagatcattcatggggatgtataaccgaaaccagtcctctccaccgcctggggatcttcactttcgcagtctacgactgcctgtgactccagaaagacaaactgcagattggccaagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaaaaagaaaaaaaaaccaaatactacacttcaaaaagaaaatatgacaatgaatctctttttatggattctctctgcataagtggaaacaatatgatttaaatccccaacaccccatcccccttttcagacacagctgaagtgatacagatactgtcttctaacacataatctccctctctcgggagaggcacctgcctgtgctacattcgatttagtttgtaaggtttcaggcccctccccgacccatgtaatatgtaacaaggattatcaaataataaggtcttggatgtgaagtctgctttacacaagaattcaagaaagataggcaggacttgagtaattatgttacaacttcatattactttccaaatgaatacccattttcttctcatgtcaacttctagagatgggatgctgaggcagagaaatatttttatgagactctggagtacatactaaaatgtgcttccttattatttaagaatgtgtaaggtatggacctacatttgtttgctggtggtcataaaataaattcatagccattgtggccaataagcaatctccttcacgctttaaaagtttttggtttataatcccacctggattgtattttcactattctgtatcaccctcctattgcaatattttggttctcaatcttatgtaaagcaaacctcagaaatgatcgtttccataaaattgtgcaatggcaaagccacagaataatattttgagtccatatagccgtgcatgctcatctatatagctcttatacagttttctagctgattgctttggtatttcaagaaataggaagcagtagctacctattttaatgaaagggtaccatttcataagaattctattttcactgaaaaaattggtctggcacattattcaatgcaaaagattataatattactttcacgtgtgttaatctgtttagtataaaactgctagggtgtcttaaccattaacgcgttttgccacactactttcaaatggtgatctgagataattacgaagattttgatgttaatcccacgttaaatgaacaactatgaaaataatcttaaagcattattactcccatatacatgccagcaaacccaattgtggagagaacatgattactttttatctgacattatcctataaggatatggctacatttatttcttttaaaattggagcagttttcaattactttttaacagaattgttttcaacacagcattttgcagtgcccataaaccatagcaactttgtcctgatcgatacatatttttctgcattattattcattagcctctttgcaaactcactaaaatagaatagtattaaagtatgaatatatagagaacaattattaggttctacatatttatttaggtaaaccaatgttattaaaattaaaaacatgtgcctggcatataagtgcttcttcaggaattcttttttggatgcatagttattattttttaaacaaactcagattttcaaacactgattttcttctctgaacgggcattgcattgttttaaacagtagctcctggaataatgccacctttagtattttagactttcaaacaacaattggaattggataaatgctttcagctgggagcactttcctaatacctttgtaggtaatgggattctctatttgtgctgggtgacaaacggacagtgccctggacagactgcctaccctctgcagaatctaccaaaaagtagagttttcccatgagactgcttgtggtccatctaaaaatgaaaaaataatcagagaaaatgcgcaaagccttttctaactacagttatgaaatgatggcttaaagaggtatttagaaaataagagtggagtaatacagaaacaaaatctgaagaagaaagtttgcttaggagctgatgctctttgtctacaaacaagagggtaaggagctggatccaattgaattgaattgtttttgtttgcttgtttgttttcttccattcagtgcctttcaaactgttttttactggatgaagaaactcaaccaagaaaatatatgtcgattcttgtatatgggacaatattagctgctgtgatttttaatactagcataaaatataagaatctttttattactgtgatattgttttttcctaaatgaatgcatagtgtaacaattggtgtcaaaaagcattgaatttttttcagatggattaagctggaataataaagtatatctatgagatgatttctgtaaactctgacttgctgagaaaaaagtgaaaaagctttttctggaagaaacatggcaacttaaccgttattaatctggactaaataaaacaggaaactgcttctttacatttctagtaattttttctgcttttccaaacattgttaagttctatgcaacttgtgctattcaagtaaagatgatgtcagtaataaaattacagaatctaatcaagtgactatttttgctttattacaaaatttatgtatttaattgggatgtttaattgcttagtttttagaacactgaatttttctttttccagacaacagagtgatatttaatgaagtgcttataaagataaatacgatggttcatcaaagataaaatagtcataataacaagatggcatttgagtcaatgtggagtggactctgctttgtaaattatactgctttttaaaagcatgacctaggtatttacaatggggacatctgagaagagaaactcaagagtcctcaacttacacagccaagaatacacaatcatgtaggagaacttgccctcagaagcatttctctattgacattgccatttcttttcctccatctagtacttccatttgctctatttcactaaaaagtcacagaattaagagtggctgctgcaactcactgggctttctctgcttaaaaaaccttaatatcacatggtattaatacagctacattaataattgaaagattcactcagctgaccctatgatttttctaattattgttaactatctgaatatttggaaataattgtatttttccactgactttttctcattgccttgggtactagaaggttttttttttttttttttttttttttttagatggagtttcactcttgctgcccaggctggagtgcaatggcgcgatcttggctcgctgtaacctctgcctcccagttcaagtgattctcctgcttcagcctcccgagtagctgggattacaggtgcatgccaccatgcccggctaattttgtatttttagtagagacagggtttctccacgttggtcaggctggtcttgaactcctgacctcaggtgatccgcctgcctcggcctcccaaagtgctgggattacaggcataagccactgtgcccagccgggtgctagaagttttaacatataacttcagacacaactgagtaaatagttagctgtatatattttattgtattgttatttatattatgtcggctttgtgtcagaaaggatttaaagcacttgtttcaagaattggtatgctatatttttcaaaatctgtgtataaaaataattcccataagtaccactgtaatttacttttcatgtgtattacaaaatcagttatgtgttctggtaaacattttgatcccaagaggaagcaggattacatttagaatgtgacaaattttaaaaattaattttgttgtaaagaaatctttataatgatatgccataaagttattactatgcatgtaaggccgcataccatagtgattaagagcaggtccttggagttagaggcacagtctgaacttgactacaaaagttatcagctgtgtgatcttgggaaagtaaccattctcagctttagttaccacagctgtaaaaggtggataataattatagactctgtcctgttgttgtggtgaacatttagtgagacgactcacatgaggggctggcatagggtaagtacttactcaatatcagctgttctctttggcatagctctgttagagtggcatgccacagttaccttcttgagagccactaagcgtgggaacggtaacagtccacagaatttttggagattggtatgaggaggctgcattggctcccagccctcagggttgacagggtgaaggtaatggcttctggctgtctttagagctcccaaaagatatgagaagatggttctagtgatgacaacccactgttctgtcagtggaaatctagttttatgccatcttcatcattcgtggtgtagtctatcggtgcctgacacaaacgtctagagtggggaaaataacaccttaaagaaatagaatatcttaggtccatgatttgcctgctgtgtttattatgtaccccagcagtaaaatattttaagtatatttatttgcaaatcatacatctgtacatctttactgatatgtacatgataaacctgtgcaaaaaataacctaaaaaggggtaagattaaaatgaagaattagacaaaaggtttaaatgttttaaggtaagattcagcatcatcaacagtgggtataaatccatacttcaaatagccttggtggtttaaaaatcctctggttgatttacctttggattcatatcatcagtgtttccgtcttgttttgtggctgagaagaggaggagcagtgtcagttctgccattttcctgtcaatggtttatgtctgccttcttggaatcatatttaatgaaaggttctttgcaggaatatttttaaaccccttgttcatttggtgaagattagtttagttaaaactggattatataatatatttcaatctaactgagccagacaaattgtaacacatttcaggccatgtgtgcttctaagagggccactgttaacccctctgtggtcaagagctcccccttccctgaggttaccttgtgtgctcaaggcagctgagtaacataagaagaagcaagggtgttgatgccaatggttaccctattagtgaactcatttctgattgtttgtatgaaaacaaatatgatttctgttataatcttctgacaccccattccttggggcaccactgtcctagactctgaaatcactgtggttcctgccatttcttgaccttgacattctgtgacagaatgaaggagaccttaggttcagtggacttcattttctataactagctttactctattgatcacatagtggtatagctcttcagtgtttgcaaatcaatgttcacatatttctgtcatttgaactcagcatctttatagggcaggtagagaaggtctgattctgtccattgtaaagatggaagagatgaaaccaccagtgttgctgactgcagatggaagataattgcgtaagttcacacagcggtagacctgggtttgaatttgtttttgaaagcaatatcatcctgattcttttctatcatgttaacacaatttttaaatgatattcatattcatctgaatggagtagagacagacagttatatagtagttgcaagtttagcttttaaagaaactgccaaactgtcttccagaggctgtactattttacattcccattagcagtataggagtgatcctttttctccacatacttgccaacatttcttgttgttcttattaaaaccaaacaagtggtgctgggaatgcattaagagaaaacatatatattattaatagaataaataataatcaatagataatgtgcaggaaggggatttgcatttacgaaacatctattgtatcctatgttctttacacatattatccctttaatatagttctatacttgcagggacaggttttgcatgtaaagaaattgaggttcagagatgttaaataatttgtctaaagtacacagcatttaaattgtagagtttaaaccaaagggatctggtattaaaaaattccaggtaatgttaaaataaaacaatgcattaaatttgaaagtctttctgttactttttgttccaaattggatctctgtctttggctaaaaatcaaccatgacaacaagaaatgttggcaagtatgtggagaaacaggatcactcctatactgctaatgggaatgtaaaatagtacagcctctggaagacagtttggcagtttctttaaaagctaaacttgcaactactatataactcagttattgtactcgtcagcatttatctcagataaatgaagacttaagttcacacagaaatatgtgcatgaatgcttacagcagctttaataacagtgaaaaactggaaacatctcaaatatccttcaatggaaagacaaacttaaccattctgttaacagttaagcatgtatggttaatcgtggcacatggaatactacttggcaataaaaaggaacacattgttgataagtgcaacagcctgaatggatctccagggaattatgctgggtgaaaaaatccaaacccaaaaggtaacacactgtatggctccatttatatagaattcttgaaatgacaaaattatagaaatggagaaaagaaaagtgcttatcaggggttaaggagcagtggggtggaagagaggtgagtgtggccataaaaaggcaacaaaatggatgcttatgataatggaaattttctgtatcaatgtcagtatccttgttgtgatattgtactgtgtttttgtaagatgttactattgggagagactgggtaaagcgtgcatgggatctctattatttcttacaactgcatgaggatctacaattttctcaaaataaaaagcttaataaaaatgcctactgatcttcaggaagttcagttccctgttttccataactgatctgaaaataggggaaggacaattgagaatttaggagttgtaaactctgaggctgattttcagcgaactactcaaattattctgatttttccccttgattcttattatggattgtaggacattcttcctactattttggagaagaaaaaatgccacctctctatcataggacttctgttttacatatgatttaaaaatctattagctgactaatttacacactagaagatgaaacttggttacattagattccattgccacaatttattttaaaaatcagagttctcatctttcttgtttcttcttcctgccttactttattttcttttttccttattctatttgaacccatattttcctatattgtactgtttagtctaaaaactagtaagcatgcatattgttgattaaattagcaattgacgctcttaaaatgagaactataaagactcttgagcttccacacattatgctatgcttgccatatgcttgggtgttcttattttcggagagaagtaatggagattataaatgttatttttaaaatttactggtgatttgttgagaagataaagtaacaacactattacagagggttgctcttgatctcccaggccaccagtgcagtcaccgagccctctgcaaacacctgataatgctgaagagtgtgttagtcattgtagaggagctgctgtcatgacaaataggggttaaattgtgagaatttcaggatatattttggggaaggattaaataaatcaggggacttgctgacagcaaatagtatctttgatttgaaacacagaatcagagaattgagatgaatcccaggtggtggttgggagtttgaaaaagtcccagtgagttggctgactaagtgtagacttcatttcaacatcattaaatagtctttaagtggtgacttaataattgttgccccaagaaaagattttgctaaatacagaggtggaattaagtatattaatccaagaaacattttatttaaatgattttcctaacagtaaggttggaaggccctagaactgcttctaggagcttgaagtgcatttaatagttaactgtcagaatgaaaaatgaaattttaaatttcaacaatgcaattaagttcttattttcttatgatagtgaataataaatttcattcaaggacgccattggcagatgttgaaaagaaccattttcactccactagcttgcagtggactaagaggtagcaggaagggagattggtactacagatcctgaaaaaacaaaacaacacaaaacaaaatccacaccacaaatggacacttccagatgcttaccaacaggaagtgccttggaggacaagggctgtgagacaggtgaactctagggaacaagaattcctagttccatgtctgtttacaagaatttgtcatgactggttcacctcactttatagtttcctcagaccaaagagacaaagaaaaagcaaaaaacaaaaacaacaaaaattctgaaacgaatggacaatacaaccaaaactttaatatgaaccaaaacaaaaattgggctgattttatgaggttgacttaaagtcaggaaaagaatgataaacttttgagaggaagaaagaaatcatcaaagccacgaggagctcaaagtggtgtttaatagcagctatcacattgcgcccgagccttgaccacttctgacgcagctgtttcgttttaagatgttcccattcctgttccactcacacagtcctccacagtgacctgagtgcacgcacccaagccggcaggccactctagaaaaccgtaaacccctcagagagtcactgcaggaataggggaaatggaagtgatgaaattcaatatagcatttagctgaatcatcatctgaggttaagcccagtgaacaattagcagtatcgggagtctcctcgtacctgtcaaaatcgcaccgacgggattttgtgcaaagtatgtatgtgtgtggaagttgttttttatgtttaatagcaatggacctggggtagtaatttagatacaactttttaaaaaaaatactaaagggcaagtgtggtgagaagcttcttactcaggaggatcttttcaaacattgcaaaacatcaggccttgaaataattcattttattaagtagcgcactcttgtcttttcattcacaaaaggaggatgatttattatacagataaatgcttgcataggatgatgaacacctgtaggaatgcatgatattctggaagttgatcaaggtccactgtacaccagtaattagaggtcatgatgatgataataataataataataattaataatggcacatactatgtgtcagctcctgttctaacttcgtttctcatattaacttatttatttttcatgattagccactaagatacaattattatccctgttttgtagacaaggaactgagtgaagctcaaagaagtaactaggatcacactgtcacacaggcaggaatgaaacccatgcagattggctccttagtgtgctctctgatctattatcattcatcacatatttactgagcatctagtatatgaaaggtattaggctttatgcaggcaatactttagcgaagccagggagatgtctctgccttctttgagcttatagcttggtgggcaaaaagctaatggtttaactgtataaaaaacttgatgttgtgaaatgatatatgccaatgtttgcatggtatgatgattttgattaagcaccataataaaaatagggagcctgggtctcacacagccttgattgtcttcttccttctgctccccagtggagtgcgtaggaaggtcacaccctcaatgtcaggctccttcactgttctcagtgagtgtctcaggttgtaggctacatgagcaggtttgcacctggatatgattgtggcagtaacaatagatgtgactatacacagtggcagtggcagtaggggtgggagttgggtgatgggatgatcttagaatgcagtgttggtattaactcagttttgttttgttttgatgtacagccagccatacgactctggaatatgactctgggtttaccaacttggggatggcccggggatttaggagatggccccaatggctctcctcttttttagaaaggactgttcaagttccttttttttttctttttaaacaggatctcgttttgtcacccagatcgggggcagtggtgtaatctcagctcacttgaacctttgcctccctggctcaagtgatcctcctgcctcaggtgtgagccaccatgccaggctaatttttgtattttttgcagagacggggtttcaccatgttgcccaggctggtcttaagctcctgagctcaagtgatccatgtttctgcctcccaaagtgctgagattacggtttgagccaccacatctggtttaagctatttcttctaaagatatagtcacatctattatctttgacccctgcctaagcaattctgttcagatcttaagactatttcttcccgggattcaaactcagagttaagtagagtcaactatatgaggtatatgtgaggttaatttttgaaacttttatttttaatttcatctgggatctcctctagggaagaccactttatgattatgggttgcattcccaagttcagttgattgaatttattcatacattatttaataaatgtttattgagactgaaaataaacttgaaatcctagaattcattggttgtcttaaaaattctaaatatgaaatgctaactttagcttcatgagtatttagaatagaaaataaataattcaaaaattgttcaggaaaaaaatccatgatttattctactctggaggagcatattcaatttaaaacataccgattcgtataaacttattggtaatgaggcgatatactttttatgagaacatatcaaaccatagacattgagatccagcatctcctgagtgagtaaaatgtcagggttttattgatactaatgataatgggagtgacatatgtgcatagagtaagtccatggttgaaagcctggctgattaggcgctgcgttctgtggtttttgccacttgtgtgtgattaaaccctgcagaatagagtctgttgccatgtatttggttcgtgaagaaaactagtaaagtgatattgaatgaatgattcagtttctcaaaagggtagactattggcctaacaccttcctaacttggagctgtcaacgtgtttagtttggttctaatgggagctaggctggagaagagaaaagttttgtgagaaaggttatgtgatattaataagaaccacattccgtttgatgttttctcaaatgattttttttatcttcctaagaaattgaatgattcaaaaataataaatcttccttttctatggcccacaaatgatcaacattttggatgatcaaaacaattttgtctttaagatatcacaacttctagtgcctctttatttgccagtgctgatttacagcagaaagtatcacttcatattttttccaagcatcaaagtcatgtgttttacaaatattcacaagtgcttaaaatccatgaacctctctctgtattcctatttttttattcttctataagtatgtatttaaattggttaaacagatggctttctacttttgaaaaaaaaaaacccactaagaatattcacctcaagatggagaactcataggttaaatttcattctggaatgcacgtttacaaccaggtaattaacctttgaaaatgagggtactcgaaggaaacaaggaaaatcttaacaagatgatctcactaacgctggtgtgttagacttctcagaagtagagatgccccagaagtttaacaatgaaaaactttaaaatatttttaaaaacatagttaatctttgtagctttccagttttcgtcctttattacgataaccttaggaggtaaacgcttcaaggggtgtatccttataatcataggaattggtacacagattttggtggaaagatggaggtgtcaacattaaccagtcaacatatatttgttgactgcctaccacatgcacaagtctcttccatgcttgcgaagagatacagtgatgtgcaatgtgtagaatctgcccttcatgagcttttgatttagttagtctgagaaggaatagatcagtgaaaagttaaaaggaataatagatggagtgttgaggcagtccatgattgttatctgagacattgagtttacaatgctaagttaaaagaatgagagatcactatgggatagaatggacaggaagagttcctctccttgaagcttgcattaagccataaaagacaaagcaattttggaaatgcagaatttggagatatgaagaaagaataattcccagaaagggagaagagttttggagccagacagatctgggttcaaatcttggttctcttgttctctagctgtgtaatcttgggaagttacttagcttttatggacatcttctataaaaaggatatgatagcgactattttgttaattttttaggattaattgagataatatatataaagtgttttaagcacttgataaaaggtaatcctctcagttggagagaacatcctaaacaagtctggaggaaggagacagccagccatgttcatgggacaaaaagaagactattatgagtggagggaaagattaagagaagtagagtgagatcacatggaaagataaattaggattagcttcagccattcacttgtttcttcatttaatactttattgcactctttatgtgggaagctctctcatgtgggaaaccctctgctcggcatggatatgcagagacaaagaaaacttagccttggatttctcttgaatgtcaggttaaggagttggaacttcatgctgaggagaattatatctttcaaaagtggaggagcttgaaagtagcatttttggatagttaacatggaatgtgattcttgtgacccaagatatgcattaagttaccatctcctagtggttgatggttaatgttgtgcctggagatgtgacccagattctcttgtaggtcattcctgacagagggtccattccaatgagtgaggaggaggagcttctgggctgaacttaatctcatctcctgaaataaagcaatgacattgaaatttttcatattgcacttgtgtttacatttctcatctaatctgagatattccacgtttggtgagtcttgctttgggcctgcagtcttggtgacccttattagttgcactggaatagctgtctattcagggagaagtagaatcctgggaatctggtcttcagtgactttctccatgatcatgaatttcatgagaggaggtccccttcctgttagtagatctctatagcaagaggttctgaggcacacaagcacactggatactcacctacagttctagtttaactgatggaacataggtatttctttcatgaaactttgcctggataaacagcttctgtatcttctagtgacaaaattttgcctcctgttttcccctctagctctagtcttaatctctacttccttgttcagtccaaggctcaggagaacccagatcatataagatatggaacctattgcttcctaggatgtccttgtacacagtgactaactgctaatttcaaggatcaatttctttctggagttagaatcatattatattatgtttcagaactgaaataaaattcttttaaggtgattatattttggctctcagcttggaagatgccactggggcatggcatacaagacacataacttataggaggacctcctttaatgcccaagtgccagcttcatgcttgttgttatatatcattttattcctggctttgatgcccacacacagacatatatccacacaaagttcaatctatatattttttgtagctgtttagctcaggtgattagggcattgagctaatgagaacaaggtcacagtttcagtctttgtgtgggccagcaaggtttgctttgttcagaggccacagacctggtccagccagctgtccagcacatgtctgccccaagtcatgagaggacggggcaggagtgtgtggatggacaagagcaaatccatcaccacccttagaaaaagtcaagtcaagcacgtgtcctactaatgggggtcaataatgtctcatttaaatggggctgacattttattacctcttgctgagagggtcttttgagcaccaaatttaaacattgtcgcttttttgtgtgaatttatttctaataaatggaaggttgtacaagaccttagatgattacaggtttccaaatacagattaatgacttcaatatttaagaagttgatgtgatattaaaaaagaaagttcagtatggctattcagttatcttcccttattaaaatctgttttggctaatgaaataaaaagttcataagttcttccgagagtaagtgagaatcattgccttcattcaagaatgaaaacattattattaaactcattgataatgagaccattaaaagttagcatgaagcaggtacaatacaattctttattattgaagtcttcagatattacccagcctacacatcccacctttcatttttaggcaaacaaattccccaaactatattttttttaaatttagcattaggtcttgttaggcttcaaatgggatcaaaaccaatcctttccaaagtgttctaccccagctgtttccctcacctgggtggtagtgagtataaaggcatttgatacagaagggggtggtggggcagagaacagaaaggaaacttggtgagagaatgatgaagaatgatatattagagattcttttaaaattcattcattaaacaaatgtagcataatggaaatgtctattaaattttttggcataggtaatgcacttgcaagggtaaaaacagaaatatgagatggtattttatgaaaagttttgctcaccccgcatccatcatgaacccaattctactgcccttgtatagccatttttattagtttcttgtgtactctttcagaatttctttatgccaatatatcttaaactctttcctttttttcatacaaaaattaacaccctatcaattttgttcctggcagggtgaggtggctcacacctgtaatcctagcactttgggaggcccatgcgggagaattacttgagcccaggagtttgagaccagcctgggcagcttagggaaaccctgtctttataaaaaaataaaaaattagccaagcatggttggtgtgtgcctgtagtctcagataactcaggaggctgaggcaggaggatcacttgcaccagaaggttgaggctgcagtgagccatgattgcaccattgcactgcagtctgggtgacagagaaaaactctgtctcaaaaaaaaggtcttgagcttgctttttctacttaacaatatgttttgtaaatctttctgtatacgcaaagtagcctcatttttcatagttgtatatcattctattgatgtgccacactttatttatctacccccctattgatggaccttcatatagtttctaatattttctattacagacaacaatgtattgaattactttggaatgcattaggtagaaagcattcttctttctttaaacatttgcgtagcattccactgaatggctatatcataacttatttctctagccccctattgatcgtcattgagtttccaatcttttatttttaaagacaatgtcataatgaataactttatacatgtattatcttatatatgtggaattaaatttaccatgtctagataattttatttgaatgcaattaagtatgatatcaaaaattataaaatcaaaactgcagtgagaattcatcttaccccatgtaaaatgactcttatccaaaagagaggtgatcatgaatgctgatgagaatgtggagaaaggggaaccttcatacactgttggtgggaatgtaaattagtacagcactatggagaacagtagagattcctcaaaaaactaaaaatagaactaccatacaatctatcaatcccactgctgggtatatatccaaaagaaaagaaatcagtatattgaagagatatctgcactctcatgtttattacaacactattcacagtagccaagacatggaagcaacctaactgtccatcaacagatgagtgggtaaggaaaatatggtacatatacacagtagaatattattcagtcataaaaaagaataaaatattagttgggcatggtagcatgcacctgtagtcccagcaaccagggaggcctaggtgggaggattgcttcagtccagggaagtcgaggctgcagtgagccctgatcacaccactgcactccagcctgggcaatatagcgagaccctgtctccaaaagaaaaaaaaaaagaatacagaatgaaattctgtcatttgcaacaacatggataaaactggaggacattatgttaggtgaaataagccaggtaccgaacgacatatttcacatgttcccactcatatgtgggagctaaaaattaaaacaattgaactcatggggagagtagcatgatcattaccagaggctgggaagggtagtgggaggaaggaataaagtagggatggtcagtggatacaaaaacacagttagaaggaataagatctagtgttctgtagcacaacagggtgactatagttaacaataacttattgtatattttaaaataacgaaaagagtggaattggaatgtccctggcacaaagaaatgataaatgcttgaggcagtgaacaccctaattatcctaatttgatcgttacacattgtatgccttcatgaaaacatcacatgtgccccataaatgtatactgttatcatgtacccatcataattttaaaaaatagaaaagaattatcacaattattttaaatgaagaagcactaagtaggaaataaggtacaatttaattcagaatagctttccttagtagtgttcaacctactgtacacatcaacaacacgcccttgcagttaacattgttgctggatgtttactgttatgtgtgaccagctgacatgtccctctaaagaaagaggatttaaataagtcatgtatgaaagactgggtaaaggtgagacactgtaagacctagattattttggggctgtagcaatcagattagctattgagtattcattcataaattcattcacttcactgagtcatccacttcttgtcagattctgtatttattcatctcctagtaagctactcattgtgctaaaatgctggtaaacagaagtacaaagcaccagttataactcacagtcttgtagaggaattaagaaatggacaggaaacagtaagggtgcattgtaggtatctcaagaatgatataaagtgttatggcagatctaaggaggaagacatgactttccatagataatggatggtggcatctgttctggagtaccagaaaattagagtaacaaaaacacagcaggatagattttcttacaatgcagtgattcatacaaaggctaccttgactgttagtttgtgactggaaactctcagtcagggctgacggagggagtcctgcccctgccagctgttcacctttccctggtgctggggttgacacttcacatgctcacatagtctggttctgtgctgtctactagggttgagtgtgctgctgggcagagaattttggcatttctccagatgcacatgaggggcagaccgcctcagcagttgctaatgacccaaagaagccttctttcatgacttattttgtcccctcattttattttttgatgtattttggtgagctgagctactaccttctcaggcagtcccaacctcagaaaattaaccatgtagctttctcatatctgacattgcaaattgaggcaaggtcgcatgctttctgactacctgactgcctgggcatttctttcatgcaacttgtttaagccgcccatcctgatccctgttgctaagccaccatggctgcatttggacgcagttcttcccagctttgccgcagcataactgtggaaaggatcttgatgaatttggacctggggagggacgtgggaggaaagagaaatggtctaatggaagaaagtgaacaaacaaagacatgctcacagaaaactgccaagtgtgaggggtgggaaaacagagttcagcctggctgaacgtaggaatctggatgggaatggtagatcttaggctcctgtttttcagcttgccgctctagtgatgattcttgtagatatatttttccaagtaaaaggagcatttccaagtgactgttgtttaaaataaagtacatgttgcatttgtaatgtatgaattatgagtattaaaactgacaatgaaatgagagtaatatacttaattaaaattaattagatctgttggcacaccactagaaggacaaatatgatatttaatatatcactctactccagacctgtccaattaaacttttggccatgatagaaacgttccatatctgttgtccaaaaacagtaacccctagtcacatgtggctattgagaacttgaaatgaggctagtgcaactgaaaactgaattttaactttgtttaatttcagtgaaatttaatttgaatttaaatggccccctgtgagctagtagctaccgtattggacagggaagctctaaacagggttctaaacatgtggaattaacagcacttaagagctggagtagaccttaacctttaccaggtctcaaactttgatttacaaatggggaaatggcagccaagaaggtgaaacaccttgtccagaggcacactagtaggaattagcagaactggaacctggtgtttggatgtcctggctcccggcctgggggactcttgattccaacacgctctctcccagttatgacagagggctgtggctggacccaggtaaggatgctgggttggtagattgagaaaataaggccacgcgtagtctttcaaatcaaccaagcaagagatatttgctgtacatggtggcagacactgagatcaacagagaggttgttgtggtgtgggggagggcctgtaaaatggcataaggagtctactgggaaaaacaggatagtgatagattatatatctctatatttatctttctatataatctaccctgttttcccaaatggatttcccaaatgtgtgtcacttgtatatctggctgtcactggtacaaggtagtccaaatggacagggtacgcaaaccccagacagggctatggaaatttagggagatctgtgtgggtgagtggtcggggagagcttcagggataggacaggcttgacttatattagatagtgtaacacagaaggtaaaatacaactttaggatcattcaaatttaacagtggttgatatgaaacaaacttcttatccagagttggttttgtattcttgctttctgtattaattatatgtgtttactgattcaccacaatcagctatactgtccctagaattttaaaatgtgaaaagaatgtggtttgtttcaggactatttttctgtagaatggtgattgtatagaattaattaatattacagttgcattattagaccacagtaaggtaaatggtcacaaaagaccatacatttaaatcaggagaaaagtaatggctattgttatcctgtaggcatagctgggaaatcatatccttacttggcttgctaaagtcttaacctagtactacatgacagtatctccagagatttttttttcccattcgtaggcacaacaaatgagacccaagtgctcatagaacattccaaagagtcaacagagagaagtggaaagtattagaaacatgattgtgtttgcaaagggagacataaac

SEQ ID NO: 112 - DNA, 5132 bp, Homo Sapiens
aaaagagaattttagaccaatatccttgatgaacattgatgcaaaaatcctcaataaaatactggcaaaacgaatccagcagcacatcaaaaagcttatccaccaagatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatttcaaaataataagagctatctatgacaaacccacagccaataaaacccttctagacattggcttaggcaaagacttcacaatcaagaacccaaaagcaaacacaacaaagataaatagatgggacttaattaaactgaaagccttctgcacatcaaaataaataatcagcagagtaaacagacaacccacagagtgggagaaaatcttcacaaactatgcatgggatattgctctgtgaatgcttttgtgcataattgtacatttttaattaagttaatcttttacactctcaaagtgtgatattaagcaagcaaagataagttattacaagactctaaaaccgaatgcaatgagaaacaagtgaatccaaatatatttcaaatgaatgaatgacataatcaaacttaaggggaaaataataattaatctgattaatttttgactgttctcttatttcaaattgacttttgaacatactttgactacatactattgcttgaaaaaataaaatatctgcaaaaaattattaaatcttcatgataggattttttctttttatattagtataaatataacaattctgaaacaaatgtatgtgcattgtaagattaagccaatgagtaaatattaatatatttgtattgctagaaccccagattctcactgtgaaaggacagagatacagatatggaataagacaaggaaagaagcagcccactgagttacattagaatcagtattatcaacataaatatgcaatgtgctctctcacatgctctttccttctcttaaaaaaatataatatgtacatattatatattatatgcatagacacacgtgtgtctatacatatcctatctatacatattgaggattaacaggtgctagtagaaaatattaactttctttgtattaacaggtgttagtagaaagtagtagtaggtgctaagataaaagccataattaaacctcctggtgaatgaacacaccatcaccaacaatcttaccaaaaatagaaccaagcacgtgtcctagtcaaacctctggattcaactgtcatttggataaaacgcaaaggatagtgaaaatgtcgatcttcactgagagtctcaccagcaaatttcacagtgtggacatcaagtgacaaaaatcccacatttttcaacaaatatattgtatgggaaagaaaactttgaaaagaaacctgtatgttagaagggattttaaaaacacgacaaatgaaaacaaatgcgcaagactaaatcatagtgtcttggaatgcatgcatgaaggacacagccgtgaaaatgcaaggacgcctctactggaacagtcacgtttatcgtcacttttcaggagaaaggtggctgcaactgaggagagtcacatgcaggacttcagggctggcaaagtcctatatcttgacttatgtgatgattacagggatgtttacaaaaatcaaactataagtttgttttgtgccatgttttgtattgtgtgtgtgtgttttgtttttcaacttaaaaatacataaaatcaaaaccaaggcttcattatcaagtagcacaaagtctccaatctataacctcctttgtctggatatctgcatttaactaccattgccagagctaatcctgacaatgcattcatatttttaacactgaaacacagtaaacagggaaaattttgctcctctaaaacagggcatcttcaggcaatcagaacaactcagaaagtttctgtctgttgcataaaactcccctgtgcaaagagttacacaaaatgctgtcatagtaaaggtagttaactaacggcactaattgttcttgggcagtggccaagtggaacttcagagacctggcattgccagccagaaatcacttgtcatgggaattgtctcctggaatcactttggttgtcccagggtaacgcagggaaagtggttaatgggtcacttgggggtggcatcttcatcagtaaatcacatttactttctcctactaagaattttatttttggccatgaagccaaaagtcagctcttaaataacaagggaagcaaataatcattgaataaaaatagcagaaagaaaaagctgtgcaaagaaatttatgtttttaatttgttatatatgtatatttttatcatactttaagttctagggtacatgtgcacaatgtgcaggaataaaatttatgtttttaaaatttattctacattatgaattctacattagaaaaataaaccatagcctcatcacagggtgcttgactggaggagggctggcagcagaagtgcagctgaccgggttgcgttttcgtacggctgactaaagcggataccggtggcgactcatttctcgttttatttttcaacgatttggcggagaagctcctcttgtgaatggactttggatttcttggagctgcgctgcgggtcccacagtgtggctttcggcccgtgctgtgctggcgcctgcacttcctctggcggggcacggggtggcgctccctggtaaagcagcggccagggggagccgtgagtgaggcgctgcctctcccgctgaagcgggttccaaggccaccgtgagggggaccatccatccaggagagtactgggcaggctgcaaatgtctgtgttaaaacagctctgctgggctaagacaggacagaagcagacagcaggtggatgagacacaatttcctatccagcagaacctgcagcaagctccacagcaccctccatgggctcagtcttgctcccgggaagatggttaattccatcagctccttctggccggcagcaggaagagtggccctgtgtgtgccaggccctgcagtctctcctctcagctggtgtctccagtgagggacctgagtcatcgcacacatgagcctgtgctcagcctgcacatctcccgcctcccaccagctgctcctcaactgccagggccagactgtggcaaaatctcactcctctgccgatgctggggtttccctcgtgtctgggaggtggtgtgcttggtggcctgagcactgcagtgaatccatgtttccctcccagcaccctgttctgtcctccaacttggccgacagctctggccagggacgcagcccagctggtgcccaccccgcactctgtccatttcataagagcccttggtttcctcacttccctcagattttgccaagagaatggtcctggtgtggcccagaaaggccagcggggtgcagcctgggactgaaagcagaggcggctctggtggggaaaaagtagctctcccagcctagccctactggtgggcggcacctcctggctccaggccatcttttgtcccagtcctaggtaagaaaaacacaaacaaaagccagtcccatggcactcgagaagcaggaggccgttccctgacagcaacatgctgtgtgcacagacacacgggtggacaggaggcagagctcggggttgctgcggagcgggcaggacactggagcggcaggcagtgcggacccgccgggcagccgtgcacggttgtcgtcctcagcggcaggagccagtttgttgctcagggccttgtctttttacaaagagccccaggccccgggggcttctctgggtgcctctttgctgccatgtctgcacgcgggcggagagcagaccaggctaccgaccctctcgctttgctgtcttcacgtggaaaagccagtgtcgtagccccaaaggaggggaaactgtattgatttggggagcctctatgttgatttcaaaacagattgtctcctgtgttctcaaagactggaagcgaaccccacaaccgccttaggccacaaaagctttatcctttctaattagcatccctgtgacctgctctgcgccctgcagatattttgctcagccagccagaaggagggaggccagacaccagcccccacagacctgcggctgcgaccccctgcctggggacgatggggtcggggtccagtagctgccccagaaacaagtggggctgcaggaggctgatggtgagcttggaggttggcagaattctaaatctgggcactgcagggtccccacaggtcacgaccctactctgctccacccaggctccggaggacctgagcaggaacctctgcagggggggcccggggctccctgtcctctcagcagccggcagtgctccctgacagcccgggcctctccctccagtagttcggtagtttgctgtcaccaacatggctgggcctgggacaggctcctcctctccctccagaagccaggcagtccctcctgcctcagtttctcagactaggccgcctctcccatcgcgagacactgaagaccctcagctgtttccatctgcccagtctgactgctggatcgccctctgtgtgcgttggtttgctgtgttcttgctactcgcccttggataagatttcttctctactcatgaagctgcgtgtcctggagggcagggccgcacctcacatgcatgttgcccacatagctcagcaacagatgctctcacgcttgttaaaagtaaaaccgggccaggcgcagtggctcacgcctgtaatcccagcactttgggaggccgaggtgggtggatcacctgaagtcaggagtttgagactagcctgaccaacatggagaaatcccgtctctactaaaaatacaaaaaattagctgggcgtggtggcacatgcctgtaatcccagctactcggaggcaggagaattgcttgaacccaggaggcggaggttgcggtgagccaagatcacgccatagcaattgcactccggcctgggcaacaagagcaaaactctgtcaaaaag

SEQ ID NO: 113 - DNA, 8445 bp, Homo Sapiens
accctgctccaggcagcgtggtctgtatggctccgccctgggcaggaggagaaagaagagggccaggcaccacgtgcctgcactctccctggatgctggaggctgctccgccgtgggcaggaggagaaggaagagaactgggtgccgcctgcctgcactctctccggatgctggaggctggaggcagtgaggcagcaacagcgcgagggcgaggcgactttggagctgcctcatgcagcgacctcgccttccgctgcgcctcctcccagaacccaagaagcctggaacctgtggcgtccagccctgaaaggaggagacggcaacccagccgcgcgtgagtccgggagtctgggataccggcggcagaggaaggacaggcaggagtctcggcctctcggggagcgacgtgccgggaaaggcaggagggccccagcggtgggggcgggggttgcgcgccggggagggcggcctcaggctgggagcctggcagatcgtctgactctccccgagccccatcccaggccgagccaggacccctctgatgcacaggcgtctcaggagcccgtttctttcttgaatccggggcccagtgcggcttgaacctagcccccgacctcctcctcgccctctcagagtccgctggggtgggcgctgaaggagcccgggtcggagaggagccctccccttctctcctgcgtggaagccctgcagcctccgtttcttttgggactggggtccggggccttctgcctgacccggggtgagaaagggagccctgatcaggacccggtgagagggcgctggagcccgggagcggcaggagccttgagcggcagcccgggaagaggatggggtcaccttctgccccaggtcccccactgccaggatctctgtcaccttctgggggtcctgtcccctggggtcccaccccccgggctgcctgtgggtatctctcatctggaactggaaataaccctcttcatagtacggcttagcaaatatttattcgcccatgcaccccccttttttttccttcatagtgttctttttgtcttggatcatttgtgtttttcctacattgatgtgaagcatttttaaagacactttagagattagtcctttattggttcatttctattgtaggttgttgtttcctactctggtctttgttgtttaatttcagttttaatttcttgcttggtttagttcatgtaacaatatttttcttagaatatttgtatctgtgtttgtgaaacagaacatctattatttctgggttttttattgtctgatcagattgtgtattaatgtaatgctggcttctcgaaacaaattgaaaaaccatccctttcgtctttctctttgagagagagtgagcagtgtcaatatttttttcttccttaaatatttggaacattttcaaagtctgatcctggtgttttccttgtggagcattattgttgatttgttggatttttaaaattagttagttaattttgtttaatatatataggagtgttcttattttatgctatttttgtgccagttttagtaagttgggttcagcatctgttgcgatctctgttgtcagacttttgatcatatgtatttcacaaaattctctgattatcttgttataatactgttatgtagagttgttgttttgattctgatactggtcacttgtgttctttcatcttttttccttaatcagttttgcctgcactctccctggatgctggaggctggaggcagtgacgcagcaacagcgcgaggcgactttggagcggcctcatatagcgacctcgccttccgctgcgcgtcctcccagagcccaagaagcccggaacctgtggcatccatctctgaaaggagaagacggcaacccagccgagggtgagtccgggagtctggggtgccggcagcggaggaaggacaagcaggagtctcggcctcccggggagaatttcacaaaattctctgattatcttgttataatactgttacgtaggctgttgttttgattctgatactggtctcttgtgttctttaatcttttttccttaatcagttttgctagtggtttattaactatgttgtttataaaaacaacttttagccttggtttatttgtgttatgtttttttttccatttcattgatgtttgttatctttattattgccttcatcctgtattctttgcacttgatttttctttcttgattcttgagaaaaaagttgaggtgccgggcacgttggcttacgcctgtaatcccaacactttgggatgccaaggtgggtggtcaggagttccagaccagcctggccaacatagtgaaacccccatctatactaaaaatacaaaaattagcagggcgtggtggcagacacctgtaatcccagctactcgggaggctgaggcatgagaatcgcttgaacctgggaggtagaggttgcagtgagccgagatcgccccattgcactccagcctgggcaaccgaacaaaacttcttctcaagaaaaaaaaaagaagttgaggtgattgattttcagtgtttctggactcctgccctgcagagatcctcttgctgtaacctgtttcatgtgaggtagagtttagaaaatatttattggcctctgtgccttacttttcttcatatactcttcttattttgttgatttatctttagggatttttttccttatgttaaattgaaggacttattgttaaaatctgtaagttagccctttattggcttatttttgtcataggttcttgttctctagtttgatttttgttgtttcatttctttgtgttcatagttgtatatagtaatctggttgataatgatcttgtatgcagtagctttgcttaatttatttattaattgtaacactttatgtcatgttaggctgtgctgagtgcttctgggagcagccaggtttccatgaactcccagtttactctaaatactctagcagcccacatgtgcacacactggataatggtcatgcatgtagagcaatgatgctggggaggcaccgactctgtcattctgtgaatccaccgcacaatcacaaacattagcattaaaataaaatggactgttaggcaactgcaaaggactaatgcacctatgtggcacaaatgtgtctttccgtattcaaagtacttgtaagagcttcaagttcctcatactcagccactgacctcagggttcttggtacacaggcatacatgtgcagacacacatacaggcacacatatacacatgaatgcacatatgtgcacacatatttacaggcacatgcagatgtgcacacacagacctgggtgagaaagtcagatgtacatggaacagcccctgctttgtaagctgtctggctttgtagggagaaagaggtgaaacaacacacttgttatcttggaagaggagatgaagggagctgagctggatatgtccagtggggagaaagccaggagccactccaccgaaaatcgaggtctccacatggatgatacccacaaaacattggcaggaaggacacagccagcaccacatcagtggtgactttcatgagtgtcaactgtggccatccaaattaaaggcctggcaatgggataagttagcaactgaactttctgtatgttaccttattaactttctgtatattagcttattaactttctgcaatcaaatgctgattaagcattttctgagccaaaagctttgtgtaatttgaatctagtgaaaaaatgttatgcgtttaacactataacttgagatctaaaaacaaaaaaacaattgcataagaattggtcagataccttgtctttgaaacatactgaagtcttcaaaattaatctgatagctctgcagttggtatgtggcataagaaaatatttggcatgaaggggagtaacacaccacatgaattcattcattatgaagaaattcattatgaatatatgtgggcaaattattaacaaccctcccaaaagcagaaagctcagactcaggaagatccatttaaatggagtgatttgggagatgatttcaagcgcaactctgcattgactcagcatttattaagtcatacagcaggctactggaggcctcactgcagcctgggctggtattcagtgtcctcctccttccttctcagtagacttccttggccttgataataatacgtgttaacaaacacaaatctcaaaatacacataatgtttcttcccccacaagccagggtatcagctctgcaaatcagatgaccccaaggtcagtggggttgaccagggacaccattctgcattcctcctcagcttccagatcctgaggagctctggggccttccttctggacagggaacatgtctgcctggcttcctcagccaggtacgggaggctttggggacctgtgtctgtctctgggaaggaggaaggagcctgtggcatcttccttaagcaaaagcacatccagcccatggccaaacttcagagtggggcgaggggcccagcacagctcctccgttcctgcagcagagcccagaaaacacatctgatgttgtggctgcctcaaacctacaaacaccatgggtttgaagtgtcctgttgacatggccatggccactttccccgtggaccgtggcaagtttttgtttttggtttttgttgtttgtttgagacaaggtctcactttgtggcccaggctagagtgcagtggtgcaaactcggctcattacagcctccacctcctgggctcaagcaatccttccacctcagcctcccaaagtgctagaattccgggcttgagccaccgtgccaggccttgtgtagaagtattatacattatctttaaaatgtagtttagtgctaataatctaaaattgtgttgccatttactattaatatgccctttgtggtgcatctaataaaatgctttgcttcataacctgaaacaaaaaaactttcactatatttacttgatcagatcaacaactatagaagtcttagaataatgatattcttactcaaaagaaaagcaacaactcatctttaatgaaactgtttctgtgttttattagtggttgagaaataacacattccttcagcagtggcagcagtcagataccatatgaattttttatttttttttactttgataaatcctgaggctctgttgaggaagaagcttccacagtaggccctaggagagctgcagccaccatgtccacactgtgttatgcacaaatgggaatgtagtttcccagagaaaacaacttctgtgggtagatttgtgatcgaagtttgtgaatagctttaaaaaatccttatgaaggccaggcacagtggctcacgcctgtaatctcagcactttgggaggctgaggcaggcagatcacctgaggtcagttcgagaccagcttgaccaacatggagaaaccccatctctactaaaaatacaaaaattaaccaggcatagtggcacatgcctggaatcccagctacttgggaggcagaggcaggagaattgcttgaacctgggaggcagaggttgcagtgagctgagatcgcaccattgcacacaagcctgggcaacaacagcgaaactctatcttaaaaaaaaaaaagaaaagaaaagaaaaaaaaaggctgggcatgatgactcatgcctgtaatcccagcactttgggaggctgaagcgagcagatcacctgaggttgggagttcaagaccagcctgatcaatgtggagaaaccccgtctccactaaaaatacaaacaattagttgggcgtcgtggcacatgcctgtaatcccagctactcaggaggctgaggcatgagaatcgcttgaatctggcaggcggaagttgcggtgagccaagatcgcgttactgcgctccagcctgggcaacaaaagtgaaactccatctcaaaaaaaaaaaaaaaaaatcctcaggaagattatttacttataatctcctccttccttaattagcagtctcagcatttctgcaataaccaagtctcagcatccagtgaagcagcctgcaacatgcgggagctcagggcattgccactgcacatggggcacctggtgggactttggcaaggattttgtcattaacactgagcaaaactctacgaagacagaggcattcttttagattaaaaactaacaacataaggcgggacatggtggctcacacttgtaatcccaacacttcgggaggtcaagggggacagatcacttgagctgaggagctcaacaccatcctggacaacatggcgaaacccgtctctactaaaaatacaaaaattagctgagcgtcatggtgcacacctataatcccagctattcaggaggctgaggtgggagaatcgcttgaacccaagagcagaggtagcagtgagctgagattgtgccaccacactccagcctgggcaacagagtgagacgcttacagaaaatctttaatttctatagaaaatcttcagtcttctatagaagaaaattaaatattacaaaattgaagattagaaaattacatagagagccgggcatggtggctcacacctgtattcccagcactttgggaggccagggtgggtggatcacccaaggtcaggcgttcgtgaccagcctggccaacatggtgaagccccgtctctattaaaaatacaaaaaattagccaggtgtagtggcgggtgcctgtaatcccagctactcaggagactgaggcaggagaatcacttgaacccaggatgcggaggttgcagagagcagagattgcgccactgcactccaggctgggtgacaagagctaaactctatctcaaaattagagagaaagagagagagagacagagagaaagaaaagaaaagaaaaagagagaaagaaaagaaaaaagaaaagaatgattgattccatagagaaacaggtatttatcaatcttcttgattctggtgctcatcacaaggctgcaagttactcagttccaccgtcttttgcatctgtggttgtggttgaaaggaatggcctgaatcatgcacctcataactcacagagtggccccatgccttccagttttctttttttttcactgaggttctgaattacccatgtagtttaaggagttttgttgttcttcacaattctgtctgtggctaatcttatgtccatgggattcatttgagtctggaacatgtcccagatggcaagatgcagcatgccatgatattttcaaaatccatgaacatggttgtttggcagttccacagtaaatatgtatttggagccttaagctatttctttcatgatatatgctcaggtactgatagcgacactgttgaattctacttgagccctgaggcactgggaaactgtgatggttaaagaaatccccaccttgtgttcctgccttaccgcaaagaattccccttccccgttgacttagctaagactcacggatccccctcaaaggatgtcccacctatgacaaggtcagacacagacccccccaaatgctgtccttgtttcatgaaagtttagctgaactgcttgtccccacagattcatcaggatataatgctaattaactcagctttgatatgggctttaccatgtccttcaggacctgcttattagttagagaccccttggactgcataacttcttcaaagacattttattttatgcttaatcatatagaaatataatgatttgatagattaaccaatgtggttttcctcccttgttctccagtttcccactatttctctcccatttagtctaaaccttggcatctcctctttcaaaggggaagttttaacaaaaggacaaagagaaagaaaagagtagacactcacattttgaattttaataaacttggaagaatgatgacacaagagtgagtttgtcccatcccagagcagatgaggagcttctgaatgagagtgggggaagggattgtgctgttgacactcgatggcaattacactgatgcagacagggaccttgagtggtggggggctgagagtgctgagtgcacctccccgggcagacaagaagaaacttgcaagtgcaggcacaagatgaggaatcacagtgaaacttaccacaacattcagcctctattcaggagatacttcacaacacttgccaggtacttttctaggcactggacataccgcaaataataaagccataaaaaaaaatatgtccctgtggaacttgcaattttgtgcagaagagcaaatagttcactaaagaactaagcacaactggccatgcatggtggctcacacctgtaatcccagcacttagggaggctgaattgggtgaatcatgaggtcagtagatcaagaccatcctggctaccatggtgaaaccccgtctctactaaaaaatacaaaaaaattagctgggcgtggtggcggg

SEQ ID NO: 114 - DNA, 9184 bp, Homo Sapiens
ctctctctttgcctactgccatccaggaagacgtgacttgcttcttcttgccttccactatgattgtgggaaggcctccccagtcatgtggaactgtaagtccattaaacctctttttcttcccagtctcaggtatgtctttatcagcagcatgaaaatggactaatacagtaaattggtaccagtagaggggggtgctgctggaaagatacctgaaaatgtggaagcaactttggaactgggtaacaggcagagattggaacagtttggagggttcagaagaagacaggaatatgtggaaaagtttggaacttcctagaggcttgttgaatggctttgctcaaaatgctgatagtgatatggacaataaagtccagactgaggtggtttcagatggaaatgaggaacttgttggaaactggagcaaaggtgactctcattatgttttagcaaagagactggtggcattttgcccctgctctagagacttgtggaactttgaacttgagagagatgatttagggaatctggtggaagaaatttctaagcagtaaagcattcaaaaggtgacttgggtgctgttaaaggcattcaggtttataagggaagcagagcataaaagtttggaaaatttgcagcctgacaatgtgatagaaaacaaaatcccatttttctgagaagaaattcaagctggttgcagaaatttgcataagtaatgagaagtcgaatgttaatcctcaagacaatggggaaaatgtcctcagggcatgtcagagttcttcacagcagcccctcccatcacaggcccagaggcctaggaggaaaaagtggttttgttggctgggtccagggtccccatgctgtgtgcagcctagggacttggtgccctgcatcccagctgcttcagccatggctgaaaggggcgaatgtagaacgtgggttgtggcttcagagggtgcaagccttggcagcttccacatggtattaagcctgccagtccacagaagtcaggaattagagtttggaaacctctgcctagatttcaaaggatgtatggaaatgcctggatgtccaggcaaaagtttgcagcaggggcagggatctcatggagaccctctgctagagcagtgcagaagggaaatctggggtcagagctcccacacagagtccctgctggcgcactgcctagtggagtgggcactgtgagcagagggccactatcttccagaccccagaatggtagatccactgacagcttgcaccatgtgactggaaaagccacagactatcaacgccagcctgtgaaagcagctgggagagaggctgtaccctgcaaaaccacaggggcggagctacccaagaccatgggaacccatctcttgcatcagtgtgacctggaaatgagacacagactcaaaggagatcattttggagaattaagatttgagtgaccagctggatttcaggtttgcatggggcctgtagcccctttgtttgggccaatttctcccagttggaatatctgtatttaaccaatacctgtaccctcattgtatctaggaagtaactaagttgcttttggttctacaggctcataggtggaagggacttgccttgtcttgagtgagacattggactgtcgactcttaagttaatgctgacatgagttaagactttgggagactgttgggaaggcatgattggttttgaaatgtgaggacatgagatttggaggggacaggggtggaattatatggtttggctgtgtcctcacccaaatctcatcttgaattcccacatgttgtgggagtgacccagtgggaggtaattgaatcatgggactgggtctttcccgtgctgttcttgtgatagtgaataagtctcatgagatctgacagttttaaaaatgggagtttcccctgcacaagctctctcttctctttgcctgctgccatccatgtaagatgggacttgctcttccttgccttccaccatgattgtgagtcctgcccagccatgtggatccatgaatccatcaaacctctttttcttcccagtcttgggtatgtctttatcagcagcatgaaaactactattatttacctatttttcagactcaaagtctaaaatgtaaagatattcttgaaaatttgccatccattattgcaagacttttaatttctttcctgccactacttaactgtagaaacttgagaaaattacatgacatttctataggtctcagtctctcaactgtgccatgaaagagttggcttagattacctctaggcctccttgagattaaagatggttttgcattattaaaaacattatataaatcaaatgattttttttttttttgaaatgaagtctctctcttgtcgcccagtctggaatgcagtggcacgatcttggtttaatgccagctccatttcctgggttcaagcaattctcctgcctcagcctcccgagtagctgggattacaggagcctgtgttgtaaactctttatttaagtagaattgccccctctatttttaaatcaaattgtcatttttaaaaaatctatgtggtttgctttaaacatgatatacgttttcttacatagataaaggtagatttcagatgttgggaaaaatgtgtgtggcagacactattagctgctctccttctgtctgtccatttcctctcaatctcattaatagaaactaatttagttcagcatggccatgtgcccagctgaaaattatagcttcatcatcacacatcagaaagatgagcatgtggcacagtcctggccagtgaaatataaagtgacagcttctgggaagtgattgctttcctgatttcaataccaccccttcctccctgcccactgttccttcttcctccctggacaaatggtttaggggaccggctgccatcttgtaacaaagcagacaaaagctacacgcaaaggatggcagagcagaaagaagaccttgatggtatcactgacagtctggagagtctacttctagatttttctgtcatgattgaataaactgccatattttctgtcaccagtaggggttttgttaccaatatgttcataactgattcagcaggtattgattttagtccacaacagtagagtgagataaaagcacatttccctttttgttctcaatcaaatttaatcttcctgactgtccacatatttggttggtgggacattcatcctctgtcattcctgtgcttttctgtcttctcaagatttctagatttgggggtgggggaggttgcttaaaaacacaataatggagaaaatgccagatatttggttcacagtggctgcactcactcaacatttatttatgaattttccaggggcagtataaagaatgggaatacacaatgaaaatacctttagctccaagtgtgtggtcaaggcttgttcctctggctttggttgggctgcagacaaactcagacacgacccaccagggccatcagctccatcaactacaaacctacccctggaattctaggcccccgggttcctaaccagagtcccaggttcaggcaccctgtagtctcccatctgggtaccacttggtctctcctactggtggaaacctgcaaaatcccatccctactcttggtcttaggactcttaactttccctggggtccaggagcgcctgctttatctactttgaacagtccctgcaactcctccctttacgaagggatctgtcttacttttcaagatcacagccagtacttttattctatctcagttatacagatgagaaaactgaggcacagagaccaagggtaaagtcacccagctagtaagtagcagagacaggatttgggtgcagatgtcttggctccagacccagttgctaaccactgtattgtgctactctcttcctgcaacacaaaagctccttactttctgcttgggtatgggtaaacacatcgcaacttataaaaatacagtgctgacctttttctgggtgagacgtgggaaggggtgttaactcccagttggtactttccttgataactcactctgttttgtatccaattaagaaaaatacgttgcttttaaacaatgcactaacttaagcttcctatgtctcagttttctcatattaaattgggaatagacatttctatgatgacttttcctctgtattttacctcatcaagattcagtgataggaaaaatagggtattaactaagaaggtttttgaaatcttcaggtaaaaaaaatgtggtattttaacaagaaaattgatacaacagcagatactacaactggtaaaatgaattttaactttggtgtccctagatgctccctattcagttcttagtaaatatatttcaatctagaagaaaattgggaccctgccaactagtattaatgcttgcttgcctattaattgaagcacacttttggaaaatgttgtatgtatctggggaaatataatgcattcagcataagaataaatcttttttttgagagagctagacctagagattttcctcacttttcagtcatgccacaatctttctggtttatcagcaactttttctctgctaagcagtgatggtaatgcatacatttgcctttttcagtaaatcatccttttataatttggctttctttcaatcttagattcccatcagaagggttttacctcaaggcatattgcaaccaatttcccccataattaatgccatatctgcctcagagtccatttcaattcccaaatgaaaattgatgaggcagccaaccacaaataaggatcacatagcactgattaaactatcagactagtttccaggctatcatgttacagtgctgaatcataagcagagggtgagttttctggtcttttgcaatgtatattgctcatagtaagtgtccataaatggctcttagcagatgaagagaagcattttatatggcccctatcaaattctaccagaaagactaatgattaaagaggtttgtgttacaggaaccaagacttcatagcacatgaaagaaaattgtatctagacttgataaaaatgagccacaaactgctacaaaaatcaccaggacaagaaaaactcacttaggtgtttttatcccatccacatggagtgtgaatggttaagtcaggtgctgtgtgaagaatggaaacatgcaacaataaagacaccagtcctggtggacctgatggcctatgtctggtgtggcgggggacagataagtaaacagatcgtcctatacggggtagccaacgctatcatctgatagaagtaagcatgaggtaccagtcaagtatgcaagtatctgtgcatgagatgctagtcaagtatttgtgtgtgcatgtttgaaggcttcctggaagagatcactgaaactctaagagtaggtagccaggttaagaatgggggcagagcaggatatctgaggcagtggaagcaatttgagcaatgtgtggagtggagagagaacctgacttgtttgataagcttggaaggttaagcatagctagaacagggtattggaagagttttatagaggaaaagatgactagaggtaggctgccagatgttctctcccaaaatatttgaccatcagtgtagcagggcagatattagtgtgattatgaaaacatatatgtgtgtgtgtatatacatatgtatgtatatttaaatgcattacatatttcaatcagtgatatgtgtttttctaggtatctttttggcatatttttaagaaacacatttcgaaaattaaatgtaggtgtgaacccttcgccacacccaaagaaccattcttgacactcatgcagaacattttatgccccagtttgaatatctgactttggtttatctcactgatacctgtagcccctccaaagtagtggtagacagagctgagacaagaaatttcacagctttttcctattgtggaacaaacaatctgagtttaaaacatattgacttactgaattaaagtaagtcactccacctcttaaagactcagtcacacatccaattttccaggggcctgtggccactgagtgtcacagagtgtggaaggctgtaggggccagtccagaggagagaccacatggcctgattgcccagtagaaattgatattcacaaaagaatgctggctcaaaaaaataaattgaaaaaaaaaaaaaaaccccagcaacacagtgaacaggtggcttagtatggctggccgtgcttgcactttttaatgacctgatttgtttccaaaatttgttttaggtaatgtattagtctgttctcatgctgctgtaaagaactacccaagactgggtaatttataaagaaaagaggtttgattgactcacagttccacaggctgtacaggaggcatggcttgggaagcctcgagaaatttacaatcatggcggaaggcaaaggggaagccagcatgtctcacatggcaggagcaggaggaatagagagcaggaggaggtgctacacatttcaaaaagccagatctcatgagaactcactcactatcatgagaacagcaagggggaagtccgcccccatgatccagtcacctcccaccagacccctcctccaacactgggattacaatttgacatgtgatttgggtggggacacagggtcaaaccatatcaggtaacaaaactccagtctcaaaaatggtaagtcaattttattgctattataattcttaaaactggtgttgatgatgatgatgatagcagttatttgtacagtaacatgcccaagacaaatcccaagagaggaacataaacaaaatcaagtggggagatttgactttgcccaagttcttctcaactagaaatttctaaaggtgttttgtgtggagtgctgcgctatgtgcagttttcagctattcaacctcaaggatgtcaaattgttggaagagattcaaagaaggataatcaaacttggatggagctgacttaaagaaatgggctaacctccagaaagaatgccattgaatccagagagaggtgccgttgaatcagcccttgctgatgaagcctcttcactgtactgctcagacctctccatcctggtggcaagggcttagaccattattcatggtctgactggcctcgaggtggctgtctcgcctttgaaaaagggcagacacagagcatgttcagagcacggagccatactgtgcgatttcttcaaagagagcttaaccacagaatttggattaatgaatgacgtaactgcttcagggcaacacaccctcactgcagctgcttagcccaggaagcagcaaggtcaatacaaggagagccacaggcctggggagatgcatgccttccttcctggccacgtggatctcactacttagcccagatggcctgcgagaaggacaaagccaagcacttcacaacactgtcagttgctgtcctgaagaaggtggccaggagctctagaaggattcaaagccccagggatttttggtttttatgtatacacttctctttacatacttgttcctcaacatccaatcagccttgcaggtttgtccccgctcctagcattcagaaacactcaagagcagggtgggtcagagctctccaccacatacgcagcagagtgaaagaagctgccctgcaggacagctccaggctcatggccacccctcctcacatgcatacctcctcctcttccaccaaacaacaacaaactccttcatgtagcattcacgccctcctcttgtggcctctacctgccatcccacaccaatccctttttatgtccccacaggtacccaggagtctcccctaactaaattccccactgcttctccaaatcaccccaatcctacttcccactgaaactaacaagaagggaaggaaggtgttaacaaatgaagtcttcgaaggaagtcaccccaagaatctgggcctactagtcattccctaaggctcagctcttggcatttgcttcgttccctgggccattattttcatactgtgaagaaatttcaccctagtcccattttggagagcaagtgttggtacagtgctgggtaaagaccctgacaccaggtcctggtccctggcccagagcaggggatatgaagggaagccccactcactgtgtgctccctcactgactcctcaaaggaattccaggaagggtgctttagtgaccctttggctcacagagttagagtgacctgcccaaggccacccagagaatgaatggtgggactgagatcacacctgggcctgcctggctgccaagccttttgctattttcattattccacatttctttccaaggatacagaaagcagggataggaagtgctgtggaaacaagcaaaaagccttatccatagtcagcatccaaaaagtactataccttctctgacccctgctttatttatttgtttattttcagggatgatgtaatagccagaaaaataagtgaacagaagattccgggttctactttatgccaatttttcttaaatatctcagtcactagaaaaagatctatttgaaaatcttgctctgagcagtttctgtcttgggcccagttgtttgaggagcctgttgaatttttaaatttattagtgttcccatgcttcattcattggcatatatgtatattctctatactttataattacaagtaagctcttgataataaaaagtaactgtcattctgtgaagctctttaatgcagccaaagataatttcagggggcaattggcagtctaagtccttgctttctctcattttaaaggagaaccaaatcaacttagagtgaatttgttcaaatgtgggtaagatttaacaggcacttcagctgcccagggtacttttccatgtctctccaaccaaccccacccaaatagcttaggattggcattttctgatgagcacagggatagagaatgagaacggagtcaggtcctcaggtattcaaggttagaattccttcttaaccttgcccactatgccctatgtggggacatgctacagcagagatcacttgagaattatcctgtggctcacactgccataattagttatctgttcggcacctctcaactaatcagaacaatggcacatccaaaagtaaaaggagaagaaaggagacaagaatacagcgactgaataataaaa

SEQ ID NO: 115 - DNA, 2012 bp, Homo Sapiens
gtacacaagaagaaatgaaaagaagtctgctaggaatccttgcagactaaaaggagatacatgagagagactttctttctgtctctggacattgtcatctgtctggagtacctagaactgcagcagtcttcatagaatcatgagagtaagcttttgtgttttagataaagtggcagatctgatttgttgatagcaattccctggagtgttgcattgagaagattctgaggccttggtctactatctgtgactgccatggaatcctgagtggagcgaaattaagttcccagacttgttataccctcctgacttgttctccccttccttgggaagggcatctgttccaggcaggtaacacctgtcatcctggctggtctagctgtgttctcgtcacccatgccggcacagtaccttacacgtaagaagagctcagaaattctttgctgaattcattcattttgaggcataaaatccaatcttcctgaagataagtcctttccactgaactggtggggtgtggggaaaggggttgctggtacttcatctggggaccccgaagggaccaggatatgagttggctagaaaaggggcaggtaagtatggggctttcccacccacagtagtcctgcttcatgttcttctttcacaattatttgacagggcaccccatgaaatcaagtggctaagtcagatttaggaagtggttttgaaattgatgggtgcagggaagtacccttgagtcaaaatcagaagaaatgggggaatgccgaagaaacactcagagttaatgagatgaatccccctacatgagcattgtgggatgtctgcccaacccacacagccaagatatgctccttcaggtgtgtcctgcccaccgaccacagctgactgaaccacagaatttccttttaccccgggctgctcccctttttgtgttcagcccagcagtctgccttcattccctcaaggaagagctgacataaaagaaagcaaaggggtggcaaaaaaaagaagttaatgattaaccttgagcttcaagagcttaagcataggcaaataggaaggcttcgtgcacatacaacatatttgagagaatatgagtggagtaaagatctctgccaaatgtaaacatgagcatcgccgctctgtgtaagactcttcagtgactcccccttgccttccagataaagtccatgtttcttaacatggttccaaggccttgcttgatccagtgactatgcatccattacaggctgaattgtgtcccataaaattcatacattgaagccccagcctccagtaattcagaacatgactgtatttgtagatagagtctttaacgaggtaattaagttaaaatgaggtcatgtgtgggggcccttaattcaatatgcctgacgtctttatacaaaaaggagataaggacacagacacgaacagagggaagcccatgtgaaggcaaagaggaaaatggccattaccacccaaggagagaggcctcaggagaaaccaacccagctaacacctggatctcaaacttcctgcctccagaatgatgagaacatacatttctgttgttttaaccacccagtcggtgatactttgctctggcagccctagcatctctctccttcacctccctaaaccgccctccccaggttatgacactctagctgtgtgctcaatgccctctccactccaggctggccccactctcacctgggcatctacattgctcccaccactcttcatccagctaactccttcctccatgaagccatccctgacctttaagtatctcctaagatacccgcttccttcccctctcagagccccatgttacgactacccatttactctgtgtcaataccacactgtgtgctacattagaacaggggccatatgtatcttgctcacatctgtgcctagaacagtgtctggtacctacaagtgctcaataaattcttttggatgactggcaattaatgaaaataaatcaaataattcaaagc

SEQ ID NO: 116 - DNA, 7000 bp, Homo Sapiens
agtctctctccgttccttcttctccttccctttcctgacacatcccagcgtccagccagcaaacccttgagtccaggctcggggctcaccgggtgcgggagggagtgggagtgagacccgctgcctcctggggtgctcctctaggggcgtagggggactgggtgggagaggatcactttcagtggaaggaggagaccagtgattgcatcccaactctcccaagtgctccctgcctagaccacctctctccgggtctgggatgcaagaaggtctggagctggccgttactaactttctgttgtcaagacccaggggtacgtgcgaaggatagagaagagcccccgattaaccgctgtgtggccaggaagagggactgggagtgggggtgggtgcccagagcttgcacagatccccatgtcaagcggacacccgcctggctcttcagtaaaagagtgaagaaaggccgagcacagcgcgaaggaaacctgaggtctccggcaaggcaggagaggagaccaagtgactccccgaaacccaccctccagcccttcgagaggcccagagtccagccggagcaagcgtaacgctacagtccctggcgcgcatccctgcagaccccagctcgccccggggtcccgccgccgccgccgccaccgcctgcgactgcgagggtcctggcccgagggtgcaccagcacctccttccactaccggccctttatctgacaaaagagccggagcccatgactctccgactgtgagcagtgtggcctttccaagcctccagaactttctcattacaacttttccggggtcgcactactccctgggccgcgcgggctcgggcacgaggacctggccagggcgcagcgccggcacgaaggcgcgcgccgcagaactgtttcctcagccgcgtgccggggaactaactgtttcctcagccgcgtccagcctcgcagcactgctcttctgcttgctactccagcgaagggacatgcctgctggccaggacgcttagtgggcctcgtaacctggcgagtgtgtgcccgcgcgtgtccaccctgcccccggccggtgcgccccgcgcgcccaaacccggccggcgaccactgcgcgccgggcgcttccaaactgctcctgtccagaggcatccctctttcggctttctccatcccgcgtccgcttccgcacccgagagcgacaagcaaaaaagattcagtgcaactcaaggactggccatttgcagccccacctgcgagagcgaattcggggaactgcgcctgggcaacctctttccctttctgctgggtgccctcccctcccccatctccccgtctggctggagttggccggactcggggagcctcggtgcccgcagactcgcttacctcgcatggtgtggccgctctcccgctccgcgtagtcatgaagctgctcccagcccgaaccccggagagcccaaaaatcccgctcagcacgagtgaagaaggtggtcggcgaagagctgctctgccgagaaaaccatccctttaggcggacgccgtggctgcagggtgacgtttgccgccgccgccgctatgttaacagttttgatgttggtggtgactgttttgatgattgtttgtttgtttgtttgttttcaggaagggtgaaaaaaaaatgttctggctgtctggtgcctgggttttgttttggttttgtttttctttttctttctctccaatgtgcttgctttttaaaaaatgccaccgcctccggctcagaagatttcttttgtgatcacttggactgaggaggaggaggaagggcagcagcaggaggaggagttggtggtggttttgttagttacaaagaagagggagaaggaacaagggggaaaaaaggaaacagaaagaaaagaaagaaaggcggtgtggatggcagagcatgtgcgttttcacatgacatctgtgcctgttagcggatccacaatgtgaattttcactgttcagttacagggaggaagggagcagcgagagagaaagagaggggagagatggagagagagcgctgagaggggcttatacgcgagggcgggcttggccgcgacttccaggccccgcctgctgtcagcgcagccgccaatcagagcccagcagcgcctggagaggctgggaccgcggggaggggacgtggtggaggcggggggtggggcgggggctggggaccagggagtccgaggtggccggggctgcgacggggaattcgagactgtccgaactgggcagagaagaagggccgaccgggagagtcgggcagatccgcaggtgacaggcacttccgactccagcagagaaggggacactgatcacggaaaaccttcggaggcaagagacgcggggctccccgggtttcacgttcggtccctgtctcgcaacccccgcgggcccggcagagttagttttgaatttatggcagcgctttgccgagcgctatttgggtaaacttcggtctccggcgggggtttccgtgggcaggtggtttgggtgttggtggtagaataatgcaaacccactttcatcacttttagcacaactaaaatgcagtcccatggaagtagctgtccccttcctttaaaaacgtccgtcagatgctccctgaccctcttctaaaaaaaaaaaaaaaagaaagaaagaaagaaaaaaacgtgtatatgttcttttgtctgggaaattgatttttattagcatttggagactcccctggcgatggactacaggactgaaggagaacagctcaaattggcggtgtagccaccttactaattcaagagaaatggctgttgctagaaggtgtgattgcagggtgctctttagaaaggttttagaaggaagacattgttaactttagttagaggcgattggtaactgaacatagataaacttacttgtattccttaggtgaaaattgtcatctatgaccatttatttgtattttgataaaaatctaatacatatatccaaactgttcctttgcaagtttttccaactcagttgacaaaataagcatatagatgattacatctacttccttcccaatagtagggaacttcttaaatacttgagttaattgaacaccctaaaagattgggaggtgaaaatatttgcctcattcactcagtcttgaggctgggagatgtctactcattagcatacctgttggcacagcaggcctcatcatcatttaagtatccaaataatttgatttttgactggtatttattcatgatatgtcatgtaacacaaagtacaatgtagaattggcagttatttagttaattaggtcgctctacactgccaagtagttttttccttcctgattaaatgaaaaatgaattatctgctgaattttcaccagtattaaattgacgtagccctgctatatgccatcccatttgcaaaccaatgtgtaatttaggaaaattttagtattaagagtgaaagttgattgagtcattaattaaatgaaatgaacaaaaggaagttactgtttagaatagttattcctttataaatatctttctcctagatttgtaattgacacagtagttaatcttttaagataatatttaaggctccctggttttatcatttttaatcaagtaaaatatattcatcataactatgttaaagctgtacaaagttatgcctaatttagttgcttcattaaaaattactgaatataaaatagtcaagaaacaaattgtgactatatcattttaattttgttgcttcaagcagagacacaagaatattgaaaattccaaaggctttgtaaacattgtctaattattattgttgttgttatcattttagatttctatttctctttagagtgaacaggaatttcaaaatccaaaaatttaaacatttatgtaattttaactttctaaacatttattgaattctgaatttttttttaatgctgcaatatctgtaatccttgaaaaaggtagtcaacacgtgtataaaaagtatttacccccccatacatttttatattctctttattttgtggtttcagcaaggcataattttgcttagaacatatttcttaattccttctgagtatttttggagaaattattaattagaagactatattatttcatttttcaaaactatgtatataatctctatatatggtgatacaaaagtatgtattttctctttaaatgctaatcattggttataatgtggcggcctgggacattttggatctttctaaaaatttaaaaactggtttgttgaatatttctaataattttcacatttatttcactgaatggagcccatttatttaaaataaatattaagaatttgaatgaaagaagtcagtattttctaagaactcacaaagcacatatatataatctgatggttttgtaacctatctgccagcaaataatcatatttcaagtggcataataataatacattactgtaatgtcctagctcatatgaagtacggtatcagtaattttatttgaatgattatgtctggtttcctataagcttgaaactctgcttttcactctgggcctgaaggattttctaagttgacagttgcatgttgattaatttaaatgacaatcagtcacatagcactgtcctcaatctcaagaattgacatcagattccacttaggcttgcctgcttacctgtttttctgacacattagcacccctcaggttgagctgtaccacagaataggaatgacaacaaatatcctgaaagaggcaaagttttaatataagccaaccaggtagggtgaccatggcatttaggattatttcaatcctaaaaggcttaaacaggaagtcatagttcatgttattctgagctgataagtcagaatattcactggtcagggaatattttaaataattaagactcttgaatggacattagcaatactgataacaatgttacttttaggaatgactgaaagattggttatgtttaactctatttagggagctgtgtggctgtgaaaattgggaaagagatataaagctgctattaaatattagaaaagccagaaaaatgtaagaacttttaacattcaaaccttttacaagtgggaagggaagtactgagttccctgttgctgaaggcatccaaaaaagggttgaatgaaaggttctgttagagatgctctagtatacagatttctatactagggtagaaattgtctagattacctccaagatcctctgtagctctaagtgtacagttggcctttatgtccatgggttccacaactgtggattcaaccaagagcagagcaaaaataaattgtgtctgtactgaacatgtacagatatttttcttgtcattgttccctaaacaatacagtataataattatttatatagtgttgacattggcattataagtaatctagagatgatgcaaagtatataggaagatgtgcataggttacatgcaaatactacacaccattttatagcagaaacttgaatatctgtgggttttggtatcggtgggaggtcctggaaccaatcccccgtgcataccaagggatgcctgcattcacatggactaaaggttgctaccactgccccagcaggcatcagagccacatttcctacctgagaatgcaaaattcatgacaacaggagccaggatttccctagagtttgtaagagctcctggtactttatgggtgcttgatcattattggtggagtgaatgctttctaacctttcagccactgaatatgaatcacaaatggagtgaagacctgaataagatccttctttctcagtttctattgaatgggaagaggagagtggggagaatctgcattttaaactctcctaatttggggaagcaaaaaataatggttgagattggttatatagtcataaaaggaagctaaaatttagttattttcatatttattactattcttaattaatttatttattctttgaaaggaagtctcgctggaggctggagtgcagtggcacagtctcagctcactgcagcctctacctcttgggttcaagtgattctcctgcctcagcctcctgagtagctgggattacaggtgaccaccaccatgcttggctaatttttgtattttagtagagacggggtttcaccatgttggccacactgttctcaaactcctgacctcaagtgatctgcctgcctcagcctccgaaagtgctgagatgacagacgtgagccaccacacccagccctattctcaattttattcccaggtactgagtcttcttcataatctttgagttctttaagttctgcttcattttaaagtgtagatgcaagttcaataagttttcaaaataaaaaaaagaaagcaaatattaaaatagagcatgtaattttgaaataaattggaaaaggtgataagggccaaagcatgaattaaccccagtatgtgggagaggtaaggctagctttggaacaaagacaaaacatacaggtcagaaaaaacaagagccaacatttattggatgaatcacatgatttctcaacctatctaatttctatttcttacaagagtctacatgttatacattatatctcttcctcctccccatcttttaaaaaattattttatggctaaaagaacagaggcttaaaaaagttaactcacctaagatcacaaatcgtaaaatgctggatccaagattcaaacccaggtgtagccactaaaacgtgtttcgtgagtgcaggaactttcttcattttattttattttttcagtgctcaatccacagaatctagagtctcttgcctgataaatagtagatgtttaaaatacacttgtgaataaataaatggacatttaaaccctcgtccaccacacagtattacatatgtacattctcatcactaaatgacattaaataaagaagagtgaattttgactttaaaaataaaaggacattgtgaaaaatttatgaa

SEQ ID NO: 117 - DNA, 1254 bp, Homo Sapiens
gccttcgccagtgtgggagcctcgtctcactggagagtccgttcaggctctgtcactatttcccattggccaaacgctactggaagtggaaggctaagaagcccgatggtgcaatccatacacgtcagcctctggggccagagtgggatgaaaaaaggctcatgatggagcccgagttatatggcaggagatgatttccacggtctgtgaacactgaagatgagactggcttggggccacgtgccaaactgcacagccagtaagacctgcttccatcgacccacagcagctctgactttttttttttaacaatagagaagaaactaccacagggaagagagagaacaatggcattttgacaaatggaacaaagatagagtgtgactgacaattcaggtcagaaggaaaattaaagcacaggaagactgatgttggtcggcctccttgccaagaagcaaaaactcagggggaggcatccagccacatgcgaactggctcaacactggccattttgtttgagcaattttgttggatgttttctacaaaagagcactttttctcggacttcaaacattcttatatgcaggatcgacaccacacactgccatcatcccctggagtagtatccttgagacctgaggaggggaaaactggagggacgttgtgggactccattgagaaatgtggtcctttgtctccctggagatctttgaggacggttcagataaagttgctgccagtggaagcagctaggctcagaaacctccagttgccctttctagacttgtaatcctctgaaaaatggaaattaggaagcgttcatttatgaccttgaaaaaaatcgtttacaaaagtatattatatcactaaaatgagctggaaaaagggtttatgtgaaagttcatgtgagaaacacagctattagcacgcatgccattccccaccttgacctcagcaggaatgtgtaaattgtaacatatggaatgtaagccctgtcgagatgtttcataaatctgcctggcaatgagcatcacaaggccctgcatgagaacaggccccagaaatggagagacaaataaagaaacatcagaaatattaaaatgaggaccaaaaggagtcccagagatggggtttcaccgtgttagccaggatagtctcaatctcctgacctcatgatccgcctgccttggcctcccaaagtgctgggattacaggtgtgagccaccatgcccagccaaattttcaaataaataa

SEQ ID NO: 118 - DNA, 5435 bp, Homo Sapiens
atcaaaatctacttaaattctatagttaacagttacataagaatatatgcagagggaaaatgtcaatagttcttgtgaatgaaggaattatggatgtttttattttaattctactttgctgttttttttttcttttcagtgagcaatctgttatttttaaaatcacggtggggggaaacccataaagtttaaagagttaaagttaactgaatcgtaagcacttatataataactttttaaaagtcatttttattaccagagctcagaacattgtttggagtcctttgatctaccggttctcttaagtacgtgatttcgtgaagatagcaatggttatggcttttttgttctgttatttttattgtgtaacgtagtgtagtggttaagagcttggattttgcagtaacttggattctaatcctttaaaatggggctgatatacctgcctcatattcaatgaaatattgtgtgtacagcacttagtaattaatgaaactggtaattattagcttagttactgtaatgataatttgggaccataaacacatatcaccctacattttctttgcaactacaatttgtgaaggaaaatctcccactaactattggttatgttaatattcttcatagagttgggttcaagaagagaaatgttttataatgaagcatataactattttataaacaacattgtagttataaagaagcatgcctatagtgttattaaaaattttttgtacgactttctggagctacaagtaatgaacttgctttgagagggtccagacatactcatcctgaaccacattcctacaacatatgcccaacaacctgcaccagagtacttatatcttaaccaaaaagtttcacttcaatggtggtgcttcacaaaatcttcaaagtgctttcatgtgtattgcctcatttgagcttcaaataaccttataaatcgggcaggtagatgttagtttacagaggaggagacagctttggaatagtggtgacgtatctgaagaatagaaaaccggaatagtgctcgatgcctgaagtggtgcctggcgccagcagatgttcacttctgtcaaacaaggggaagtagtggtggagcctttattcaggcacgggtctcctcattcctaactccaagatgcagagggaaaacgaactgctcaattaagagttcttccatggacactttcttaagccttcacataaaataacaagaataatagatatttattgagtagatatttattgagttctttctattttccagcactcatctattaagtgcttttatgtattaactcatttaatccacacaacaaccttatgtgagaaataccatttttccttatttgattggtgaagaagcacacagagagggtaagcataatcaaatacaccagcataaccaaaatcacacatttagcgagtggcagggcctggatgggagtctgttcaactctctgctgtattgcctcttaaagtaggttttcttaaaacataaatctttcataactttatatatttatagtaacttaatccaaagaaccccaaaagtactagcaatgattgtttctgcaatttaaataaatccatttaattatacaactttgcattatatactgttattcagaccttggaacagtctataattgtttgtcaaaagattttatgtactactttttcttaatttcagatattatccagagtttttcttggcagatggatgtattaaaaaaatagctttccagtgttagttctcaacagtgctgtttcaaaagttgttttaaaagttctaacggttggtcttcaaaacgtaattaagaccttatcataaagagccttttgcacaggactatctcaaaccctaagaagctattcatatttaagaaaattttgttgtattaaatattagtccaagtgagctctggaaatacagtcttctgctttcttgtttcataaataacactggtatgcagacccctccccatgactcaaatattaatatatgcaattctgttacagtaaagttttcaccatggtcaacctattccagcattaggtactttttgttgttgttgttttgttttttttttttttttttgagatggagtctcactctgtcacccaggctggagtgcaagggtacaatctcagctcactgcaggctccacctaccgggttcaagtgatcctcctgcctcagcctcccaagtagctggcgctcaccactactggtgcccaccacaatgcccggctaatttttgtacttttagtagaaacagggtttctgttggccaggttggtctcgaactcctgacctcatgtgatgcgcctgccttggcctcccaaagtgctgggattacaggcgtgagccaccgtacccagcctagcattaggtactttgttttgttttgttttgtttttgttttttttgagatggagttttgctcttgttgcccaggctggagtgccatggcaacacagcctccacttcctgtgttcaagcaattctcctgcctcagcctcctgagtagctgggattacaggcgtctgccaccacgcttagctgattttttgtatttttagtggagatggggtttcgccatgcttgccaggctggtctcgaactcctgacctcaggtgatctgcctgccttggccttccaaagtgctgggattacaggcgtgagccgctgcgcccagcgcactaaatactattaaaaggaattaagcaaaatgctacgtaccaatgattatgattcatgatcacctaaacacagaatgcagacttaacttttcattcttagtgtgctaattaagtagtagtatggtgcagtaaggaattttgttaattttgttataaactccctctcctgaaatccgtaaggaaatgtgataataagaaagtgataatagtgtcatattttaaaagtagaatccactgttaagcaccaagattaccttttcttccccctgtggcacagtttatttaaatgaagtattagcaataatcatgtcactattttgtcctgaataattaagagtttgcttttttcccatgtctttgcaataggataatataaagaatagtattaaaagtcagaggctttactaatctacctatatgtattccatggctaacaaaccctggcccctttacatatgagctctggaggttcgcctggctgcctcaggcttgcagaaggctgccccaatcacagagcctgggtaaggtggaacaggaggcagccccactcggcttttctgattgcatcccacctgtttctgagtgtgttggtttggtttaattcttttcaagggttggagttggaaagtgaaaaccctagacacttgctgtggaatgtttgcctggttgtattggtgtgtccctcttcttcactggcatgtcgctttcaagtgtaccaaaggacattttgttctgttgaaagccacaggaccaaaaggaaaatattgcaactatttgcaaacatacttccctacctgtacaagcagccatatactaaaaagcactaaacaagcacaaatgaacactaaatagccttataccaaaaagcattcttgtaactgtcagggcatggtatgaattccttcctctttaagcagcaacttaccacaggcttggtggctttaagtaatatagcattaagcaaatggtcagttattttttaatgttgaaaacttccaagtgtgaataatacggacatagtttactaccttttgcttttaatatacctggttatctatttccatttgaaataaaatgaaaggagacctcaaactgatgctgagaagtagacaaaatcagctctcagacttaactctccccaattaaaatagtttttttttcccttcccatttttttgtttttaagagatagggtcttgctgtgttgcccaggctagagtgcagcagtgacatgatcatagctcactgcagcctggaactcctgggctcaggatccttctgcttcggcctcctgagtagctaagaccacaggtgtgtgccaccacacctggctaatttttttaaaattttttgtagagatggggacttgctatgttgcccagactggtctcgaactcctggcctcaagccaccaacctctcaaattgctagaattacaagcatgagccaccacacctggcctgttattccttctttatctaatgtgtgctaagcttgtgaaaaatatatgttgaggtaaatagggcaaaacattagttgataaattatgctaattaatgggaaaaatagacatgttcctctctgaacatttagaaggactctgccctacaactatcttctgtttttagaatttgtagtcactgttcttagtgccactggaaatatattcattctttgagcatgtacagggtgggctccctgttgtatttattacacttttcaaaatgccagcaagtttttgtttgtatagagttggaatgtattgttcgtgcatgcctgtgatattcatcatcaaaatatacctgtaaaaaataaactactgcttcctctccacagcttaggcctccctcttactaaaaacaatagtagtttctgtagaagtttcagtgagaaattatggttatataaataacagatatggcagaacaattttgttgtagtatttttttccgtagcatttcttaataatagctcagtttttaaaggaggggaacaataccccatgagttcaaattaattttctctactttgaggtataccttcctaattatattttacataggctgttttttttaagtttaaattctcactgttaagttgcattgagagacaattagaaatgttgtaattgtcatatctttacatgtggattatgaacaaatgaaagtttgctgtgtgattgcagttttaaattataacatttcataaatatgtcaattttagaaactcaaactctttcccatcttttgtatggataaagtttatggtttcatttctgagaatagagttggtctgctgtgctaacttcatgtttcttattccaaaggcttgattatatttttttctccagtgattaaaaatgcagcgaaaatccaatctacaagttcatatattggtatttctagacatagtctagttctaaaagaatgtacttggtgtgcatttttaagtgtttcatgtagacagattaatatatttttgtacaacattgtatttctacatttatttcaagactgtacttttcagtgactttttcaagtgcatgtgttaacagaagattgtttggaacgagagtgcagtggcttctttactagcaaagagaagtgtaatacaagtgatcatagaaggtgagaatgtgtttatactgtatatggaaacctaatgcctcttttctaaagctttgtacatttttttcgtgaaatagattaaatattttctctct

SEQ ID NO: 119 - DNA, 11132 bp, Homo Sapiens
cccctcaccgtggccttggccgtgagcaccaacgcctcctggttgatgctggacacctcgggggagctcttcatgatgacccggatgcgggatagaggcagcgagatgagccgctgctccccgcccttgtctttacccacgaccacgtccgccatcttcccgcccgtcgcgcgggtgcccgcagccggcgggcccgaccgcgaagtggctgccctgcccggccagctggtgggtacggggagccgcgcccgctgccccgtgggagttgtagtgtggggaggcgaggccgcgaggccgggagcggcccgtccgggaaactacgagctccgtgaggcctcgcgcccccgatctgcgcatgcgccgacgctcggacaccgcccccgagtgcgaggcccggcgcggaaccggcagccgagagcctggcgggggcggggcgcaccgcgccgctcccgggagtctccgggctgcggtcgcggaatacgactttgatccgcgggtgagggctctgtgaatgggcaagcaaagccctctgactccgggcctcgtggctgggtgctgtgtgttaagcgcctgcgctgtactaggaccgggcgtgccgccgtcggcaaaaagtgacgctttcttgaagcacaaagtccaggggggacgaccaagcggacagcggatgcgtcctgcgccggtagccaggcgaccggtggaagagcagagtccagcgcgggcgatgcggcggggccaggcttgctgcgccgcggggtgattgggagaagagccttcctgcggggtggaggacgaagagctgccctgaggaggtcccggagtctggtgggaacggcctcttcgggactgctccgagagacggtgtgcagagcctggcgtgctcgccgaggtctgacaggcagcccggggctaggtcctgttggatttttttttctaaggaaaatgggaagtggtggtagggtttgagcagtggagtcccgggcagttttaaaaggatccctgcagctgccggctgggagggcgtgggtgcgcgtaaggccggaatcacagagaccaggtagaagatgattacgagaacccaggaacgtggccctcaggaggccggcagtaccaaggggacagcagctgggaggagagaggcaggagatggtcaggggccagaccagggaaggccgcggagaccgcagaattcgctctgaatgagtggggaggcccttggaagagtaaggggtccaacttaacttttttttttttttttttttttgacacagagtctcgctctgtcgccaggctggagtgcagtgcgatctcggctcactgcaacctccaacaccccgattcaagcaattctcctgcctcagcctcctgagtagctgggattataggcacgcgccacccagctaattttttgtatttttagtagagacgggttttcaccatgttggccaggatggtctcgatctcctgacctcgtgatccgcccgcctcggcctaccagagtgctgcgattacaggcgtaagccaccgcgcctggccaccaacttaacttctgccaggatcatgggaagtggtagggtttggggtctgatttcaagagggagctgctgtggagtatcagcacagcttactgagatatcagaaaggccttggtaaagagccctttactgagacagggagcacattttggcagaggtttgaattggagcgtgttaagtgtagtgtcttcttcaccactgtgacgtgaggtcctggcgcaaataattgagcacagaaatacatgtcaggcattgctaggcacaagggtacagccagtgagcagggctgccatggtccctgccctcttagagctgaccttcaggtctgagggagactgaaaaataagtaagaatacctccagccgggcgctttggctcacgcctgtaatcccagcactttgggaggccaaggtgggtggatcacctgaggtcaagagttcgagaccagcccaaccaatatagtcaaaccccatctctactgaaattattaaaattagctgggcgtggtggtgggcacctgtaatgccagctactcgggaggctgaggcaggagaatcgctggaacccaggaggcagaggttacagtgatccgggatcgcgccactgcactccagcagcctgggcgacagagggagactccatctcaaaaaaaaaaaaaaaaaaaaaatacacctccaatgctgaaagctacgaaggaaacaaaaccatgtgcgagtgatagggcagcccctctgggaagtgacatttgtgcccagatctgaagaaagaaaaggagccactcatacagaaagactgagacaagatgagctttcgggacaagtcaggctctagggagaacacctgacgaggaaaatgcctgggcagtttgaggaactgaaaagccagtgtgtctggagcttagtgagggaggcagagagcacgggaggtgtggttaccaaggtaggtgggaccggctctggccctgggtaaaaagtttgactttcattccaagagtaatggaaaataatgaagaattttgaactcgaggtggtgcatgcctgtaatcccagcactttgggaggccgagggggggcagatctcctgaggtcaggagttcgagaccagcctgaccaacatggcgaaaccccgtctctactaaaaatacaaaaaattagccgggcatggtggcacgcgcctgtaatcccagctacttaggaggctgaggcaggagaatcgcttgaacccgggaggcggaggttgcagtgagccaagatcacgccacttgcactccagcctgggcaacaagagagaaactccatctcaaaaacaaacaaatccagaccagcctggctaacatggcaaaaccccctctctactaaaaatagaaaaattggctgggcatggtggtaagcacctgtaatctcagctgcattggcggctgaggcaggagaatcacttgaactcagaaggtggaggttgcagtgagcacagatcacaccactgcactccagcctgggcaacagagcaagactctcaaaaaaaaaaagttttgaagggagcagatccactttaaaagctcacactggttcttgagtgatgaccaaatggcactgtgccttatgcagagccgactcctggcagtttgcacaggctggaggtggagctgcagactccctctccctctcggccttgcctctgtaaatgggaaagccgttgacattcacaaaagaggggcagggaactgctacacaagagcagctacacaagagggtcctttggtccacacaggaaacaagccatagtgatgacatattttgaagctgttagatgttttgtttccctagctggctattatttttgtatggcttgtctttctcttttgagtatgtgtgagaacaggatggggatgagaagctcagcttgtagaattggcaggtgatgtttgcagtcattaatcatttgagaagtagagagagaagccaagcaggaaatcttcatactggaaaagaagtgctcaccattaaaaaaaaaaaaaaaaaaaatccagtgtggttcacagctgtaatcccatcacttggaggctgaggcaggagaaatacgtgaagccaggagtttgagaccagcctgggcaatataacaagacccacatctctacaaagagaaaaaaaatgtaaaaaaaagaagctttaaacctaagacggcagaattcaagactgttgtccttgagaacttcctggctctggaaaaagctcagtgagttagtctcatcctgtcgttagctctgttttttaggggctcactttgtcttcacgacagtaccttgcaccattctcatgggtatcccagggtggtgcaaggcagttttctgcacttcccagaatgccctgtcagctggcttctgggtaggttctgcaaattggaggcccctgtgaaagatcgctgtggggtgggaggaagaagctttatctgcctgctggctgcagggtagaggactgcagtggggttatagggatcaccacctgcacatgtggagctttgagcggcttcactctaagtttctgctcaacagtggcagccctggagtccttcgggggcgagtgtgggctcctgggctccaggccaggggcagtcccagcttcctgatctcgaggtagcgtctcctcccttttgctccatagcacctcgcccttctcagtgacgtgcctccttctcagtcatgcgcctccagctctaacaatgtccttgaaaacaattcttgaccatgcgccgtggctcacgcctgtaatcccaacactttgggagtctgaggcaggcggatcacttgaggtcaggagtttgagaccagcctggccaacatgtaatcccagctactccctccacttgatttgtgttccttgaagaaatttgcataatccctgtatctggttggcagatagcagagatgtagcctcagtctttcctttaaaaattttgctttaggcagggcgcggtggctcacacctataatcccagcacgttgggaggccaaggtgggcagatcatgagagcaggaatttgagatcggcctagccaatatggtgaaaccccgtctctactaaaaatataaaaattagctgggcgtggtggcacaagcctgtaatcccagctatttgggaggctgaggcaggagaatcgcttgaatccaggaggcagaggttgagatgagccgagatcacgctattgcactccagcctgggcaacagagggatactccatctcaaaaaaaattttttgctttagggccaatcgtggtgacacacgcttgtaattctggcactttgagaggccgaggcaggtggataatttgaggtcaggggttcgagagcagactggccatgatggtgaaatcccatctctactaaaaatacaaaaaaagccaggtatggtggcatacgcctgtaatcccagctactcgggaggctgaagcaggagaatcacttgaacccgggaggtttaggtggcattgagccgagattgcaccactgcactccagcctgggtgacagagcgagactccatctcaaaaaaaaaaaaaagggccggacgcggtggctcacgcctttaatcccagcactttggaaggccgaggcgggtggatcacctgaggtcaggagttcaagaccagcctggtcaacatggtgaaaccccgtctctactaaaaacattaaaaaattagccgggcatggtagtgggcgcctgtaataccagctactgaggaggctgaggcaggagaattgcttgaacccaggagacagaggttgcagtgacctgagattgtgccactacactccagcctgggcaacaaagcaagactctgtcttaaacaaacaaaaagcccagtgtggtggtgtatatttgtggtcctagctactttgaaggctgaggtgggaggattgcttgagtacaacatgtagaggctgcagtgagctgtgattgtgccactgcaccccagtgtgggtgacagagcaagaccctgtctcaaaataataaaattaacattcattaacaataatgttaatatatatgttaatgtatatgttaatcgtaatgtttatattttaccatgataaaaacattttaaaatcatatatcaactcttgccgttctcctgttgaaaactctccaatgacttcccactccatcatcctgtgggatgggtccaccatgctggaccacaaggctctgcacaatgcggctcccaccagcctctccccttggcccagattgcttcctcctacccctttctctagctgccaggccccccaacccccgcatggagcccttcagcagctctgtgagctccctgcctgttggcagccatcacagcaacgggctctggtgtgccccttgttatccctgtattcaggccattatctgtaatgacagcctggcataattttattttcacaatttgtataattatattctattgagctaaatgatcattataatcattattaaatatttattaagcacttctagctgtgcaaacataataagatgtggcctcagctcttaaaatctttcttcctaattccaacccaaattcatttcaacttaaccaatcttccttcttggagaaggagggaacttcggcgttttgtctgggtttccatgcccgagcttataggagcttcttagcaatgctgtggagcagatgctattgacttcagtttacagataaggaaacaatcagactgaggaagctagtattaataagtagcagagattaagatttgcctgtggttcttttttacacaaagcctctcccactcctttcatgcactgttagccaagtttactagaataggcaacttcctttttaaaaaatcctgtttacattttaggtgccaaacactgtgctaatccagtgggggaaacatatgctcaaaaagatcactctgagaccaggcatggtggctcatgcctgtaatcccaagcctttgggaggatgaggtctgaggactgcttgaggccaggagtttgagatgagcctgggcaacatagtaaggccccttctgtacaaaaaatttaaaaactagccaggcctggtggcatgtgactacaggctgcagtaagctatgatcgtgccactgcactccagcctgggtgacagaatgagaccctgtctctaaaaacaaaacaaaactcaagcagtatcctaagtcagggtccaagcagtaatggaaatgggtgaagctgacaggcgagtgatagagaatggaggggtctgtagcaaacgtgacgactctggcttacctaagagggcagccaattttgccatgaggcaatgtgggatcagtgagtgctgttccagtcttcaatttcgatttataagtaaaatctccaatattttatatgttggcaactttggcattcctttccttaaacctcactgccaccccgcaccccaattcatttcagtagggatcagatagccaacatccttataaaatcaaaagtatacaggccgggtgcagtggctcacacctataatcccagcactttgggaggccgaggcaggcggatcacgaggtcaggagatcgagaccatcctggctaacatggtgaaaccccgtctctactaaaaatacaaaaaaaaaattagccgggcgtggtggcaggcgcctgtagtcttagctacttgggaggctgaggcaggagaatgttgtgaacccgggaggcggagcttgcagtgagctgagatcacgccactgcactccagcctgggtgacagagcgagactccatatcccaaaagaaaaaaaaaaaaaagatacaaatcttaattggcataaaccagtcctagtaatatcatgccctttggccagtcgttggtcacagggtgagctaatgacccaactctgacaaattacatgtaagaggaatactgctaaaaagatattttcggccaggcgtgggggctcacacctgtaatcccagtactttgggaggccgaggcgggcagatcacttgaggtcaggagtttgagaccagccttggcaacatggtgaaaccccatttctactaaaaatacaaaaattagccgggcatgctggtgggtacctgtaatctcagctactcgggaggctgaggcacaagagtcacttgaacccaagaggcacaggttgcagtgaaccaagatcatgccacggcactccagcctgggcgatacagtgagactcagtctcaaaaaaaaaaaaaaaaaaaagagtatcttttcttcagtaaaaagacaaagctgtttgggtgcagtggctcacacctgtaaggagaattgcttgaacccaggaggtagaggttgtagtgagctgaaatcataccactgcactccagcctgggcgacagagcaagacactgtctcaaaaaaaaaaaaaaaaaaaaaagacaaagccttgagggctgaggaagaaatgtggaaactgccctttccctttgttcttgtctaatgcagtcacaaagtctggagcagtagcagccatttttcaaccatgaggcagtaagcatgaagcctaaaaccagcatgccaagaaggacaaagcagaaagactgaaatctctaaggcccttgcagacacccttactgcatcagttccagacttggctcccatagctccagatgtggccatggccactgtatatgtaagcttgatggaataagcactaatgcggcaccttagagctgctggaaaagagaccaatggacatgtacgaatgggggatcctgccatttgccgagtaaaggcctcctgtgtagaaggtgtcctttgataagcattcacatggaatacaaatctccactcatctctccccaatccaaaaggttcatccacaccccctctccagaccttcttgtctttctgtctccaaacatgttctttccaagtttctgaaccttcaaagtgttagtgactgtccgtgaactggagtagacccaacccttctggctttcttgcttgctttttttttttttttttttttgagatggagttttgttcttgttgctcaggctggagtgcaatggcgcgatctcggctcaccacaacctccgcctcccgagttcaagcaattctcctgcctcagcctcctgaatagctgggatcacaggcgtgcgccaccacgcccggctaattttgtatttttagtagagacggggtttctccatgttggtcaggctggtctcaaactcctgacctcaggtgatccacctgcctcggcctcccaaagtgctgggattacaggtgtgagccaccgcacccagcccacttccctgttgattctgtctctctggaagaaccctcactaataaactttacttgaccttcaaaataataatgctcaaaagacaccctcatttggggtgccagagtctggcatttgttctctaccagtgcctggtagcaaatctgaagctgtgtaatgcttaaatggagaatagtcattttcagaggagggtatatctttgctctaaaccccttggagtctgtgctgtgacttttattttttatttttttttttgagacagagtcttgctcttgttgcccaggctggagtgcaatggcgtgatctcggctcactgcaacctccgcctcttgggttcaagtggttctcctgccccagcctcctgagtagctgggattataggcacccaccaccacacgcagctaattttttgtattttttagtaaagactttaaagacatttcaatttcaccatgctggccaggctggtcttcaactcctgaccttaggtgatccaccgcaccttggcctcccaaagtgctgggattacaggagtgagccactgcacccagcctgtgctgtgactcttatactggtccctgccagaacttacaggagcatgacctgtcacggacaacctgagcaccactggatctgcagggttatctgtcaaatgggtcggagcagcatactcaaatgtggtcgctattatctctaaaagtcaaggaaagccagcagtgcaggacactcaaatccagacgtcattccactagctaagctaagcaaacagttggagctatcccagctgtcgaagctaacacgctgcatttagactctcttgcaagtcagctgtgttggtaactagaggctctggattgacacattagaatccactcccatacattccccaggttttggctggtaaaaattgattgatatcccataattccttcagcatgtgaacttctcccaaatcaggtgttttgttttgttttgttttgttttgttttgttttgttttgttttgttttgtttggagacagagtctcactcagtagcccaggctggaatcgcaccattgcacttcagcctgggtgacaagagcaaaactccatctcaaaaacaaaaaaagaatgacgccttagtttggggttagagcaaatggtgctgcctatttctgggatggggaagacaagaaggaatagagttggggacagaggtatcaagagttatttgagggcacagaagtccaagatggctataagacagtcaggtgggaaggtcagtggaggctcaggggggacatgcaggctgggatagaaatgtgagcatccccagataggtggcctgtagggccatgagcctggtagggtgactgagcgaggagaatagccggagaaggggaggtccaaggacccagacccacctggttatttcacatttggggccagactggctttgtttaccattgatctgagcatgaaaatcaagtgaaaatcaaaaggaagccaggagccacgcctcctccgtgactgcggatcctgggccaatgtttcgctgctgcagtgagacccctgactttgtgtgggcagtgggaccaactgggcatgtgcagtgatcagttgctaaatattggcactctcattagccttgggatctggaaacctccatccaccagacacagcccatttccagctcacccgctctccacactaggactctgaacaccctttcttcatgcctcttctccttcctaactgcctgcctgctccagcaggcctcaggccacttcttttttgtgtgccaccacacccagtggtgtatttaaaataacaaaagctggaggaacatggtggcacctacctataatcccaacactttgggagtctgaggcaggaggatcacttaagcccagaagttcaagaccagcctgggaaacatgttgagacctcaactctaaaaagtttttaaaattagccagatgtggccagcatcatcctgataccaaagccgggcagagacacaaccaaacaagagaactttagaccaatatccttgatgaacattgatgcaaaaatcctcaataaaatactggcaaacagaatccagcagcacatcaaaagcttatccactatgatcaagtgggcttcatccctgggatgcaaggctggttcaatatatgcaaatcaataaatgtaatccagaatataaacagaaccaaagacaaaaaccacatgattatctcaatagatgcagaaaaggcctttgacaaaattcaacaacccttcatgctaaaaactctcaataaattaggtattgatgggacgtatctcaaaataataag

SEQ ID NO: 120 - DNA, 5134 bp, Homo Sapiens
attattacttcgctaaaggatgcatgatcacaaatatttgtaatgaagatagtgactccttttttctcaaaataattttaaattaacttaaacatgcctgattttcagaaagaaagtattaaaagtaaaaccatacctttaatttaggactgacttctgcatttcaactgtagattattctagtatgaagagtgctatttgcatgttggaatgaatatcttttaattcttaatttgtaagttacaaagaaataggagactgaaatactttttatcttacaaaattccaaacaccttttcaagcaatttatatcttatttctgtaatagttttatcaccagccaatgggtatgcactgtatgtcataatatggaaagaaattctttattatttcagatattaaggatttcagattttaaaagagttatcagtgaaaccatgttacaagaatatttccttcctgagacatctcagtattataggtggcttcagactcacaggcacagaatacgatagtgggaagcatctgattcgctttactctacttggtacctttaggacgttcagccagaggtgattggagggatttgcacgtctaccactcgtgtgtgtatctgtgaaccatatctcctttagtgcctgcttttgaacgttatataaacagaatgatgctgcctgtttatttctataattttcttcttttccttagcatgtgctgttcttggcagcttgcttctccatgtgaattttggaaaagcttctgaagttccctttagtaaacaccaagagaactattgctgggtcgtatcgtagttgcatgttcagttctctaaggcactaccaatctgttttcttttcttttttgtttttttttgagacagggtctcactctgtcacctaggctgaagtgcagtggtgtgatcatggctcactgcagctttgaccttcctgggatcaggtgatcctctcagctcagcctcccgagtagctaggactataggcatgcaccaccacgcccatctaatttattgtatttttagtagagaccatggatttcgccatgcttcccaggctagtcttgaactcctggggtcaagtgatcctccctcctcggcctccaagtgctgggattacaggtatgagccactgcatccagcccaacctgttttctagagtgactgttttatagttttaaagtccctcatccattttgagctatgtttttggtgtaatttatgtggtttaggtcaatgtccagttgctccagcaccatttgttgtaattgtgtaaaaaatcagatgagcatttttttgttgctctatttctgggttctctattctgctccaatcatctttgcatccatgcctctgccaatataatatggtctaatgactacagctattattgtaagccttaaggaaaaaataaaacagtccctattttcagatggcaagatggtttacacagaaaaccccaaggtatctccaaaaaagagctcctagaactggtaagtgagttcagcaaggttgctggattcaagagtaatacacaaatgtcaatcacattttgcatattaacgatgaacatatggaaagcaaaatttaaaacacaatgtcatttataattaattgctccaaataaaatgaaatgcctagaatatacacttaataaaacatgaatagaatttgtatgttgaaaattacaaaatgctgatgaaagaaatcaaagaagaactaaataaatggagagacatactgtacttatgaattggaagattcagtatagtaaagatgtcatttctccccaacttgataatagttgtaatgaaattgaattaatgaatcaaatagagtgatttctcccactttcttcttcttcatccagattgttttagctattcttgggcctgcgcttttttcatataaattttacaataaacttacctttgtctataaaaaaaccttgttgggattttgataggaatttcattacatctgtagatcaatttgggaagaaatgacatgcttactatactgaatcttccaattcatgaattagtatgtctctccatttatataggtcatttcttataggttgattataggtatataggttgatttcttttgtcagcatttttttattttgttgtgttatgtccatgggttttagttgtaaaggagaggacctgggggaaaaggagctacttcatcttggtggaattggaagtcctattacagttgtctcctcttatccatgcttttgcttggaaagttagtttcagttacttgtggtcaacagtggtctgaaaatattaaatggaaaattccataaataaagaattcataagttttaaattttgcactgttctgagtagcatgatgaaatcttgcccctttctgctccatcccacccaggacgtgaatcatttctttatccagcatatctactcagcatatgctgcctgaccactagttacttggtagtcctcttggttatcagaccaaaaaactagtatatatagcgtttggtactatgtgtggtttcaggcatcctctgggggtcttggaatgtatctcttgcaggtaaggaggactctctattggcttttgaactcttcaaggtcagagattttgtctgctttttttctgcaacatgaagtctagcatgctgtctgtcacagtagatggtttaatacatgtcggattaataaacaagtaattgatatttgttgagaaaataattttgtgttggatgcagagaatatgtatgaggtattttttctacccttagagaacaaactatatgactgtgaaaacttaatgtgaaacttacacgtttagttttgtgtaatgtggttttgtttagtgggtattagaatgaaatttgaaatccagtggtcctggatatgaatctggcctccattaatttactagctatatgaccttgggaaagttccttaacttctctgacactaggattttctcatttaaaaaattgggtgctggctgtagtcacctgtcagggtttttataaggttaaatggtataatacatgaaaagtacttgactctgtgcttgacatgtaggaagccctcaaaactggtagtgactaaagaaaatgataagcagcattacagcacaggtaagtgataactgggttacacaaagtataacaggaacgcctatggaaacctaaagttgtagggaaagactttatggaggaagcaggacttgatctagcccttaaaaaagaacaacgctagctgggcacagtggctcatgcctgtaatcccagcactctgggaggccgaggtgggcggatcacctgaggtcgggcgttcgagaccagcctgaccaacatggagaaaccctgtctctactaaaaatacaaaatcagccgggtacagtggcacatgcctgtaatcccagctactcgggaggctgaggcaggagaatcgcttgaaaccaggaggtggaggttgtggtgagtcgagatcgtgccattgcactccaacctgggcaacaagagtgaaactccatctcaaaaaaaacaaaacaaaacaacaatgcttagacaagcttcgaggtgagagtgagtgaacatggttatggcattccaaagagacaagacataatgagctatggttaggaagctgcaatgtgtatggcaggctcgcaaaacaaaaagattacttggatgatccaagaaatcttgtacagaagtaatagcaataaggtagactagatgtcctgaaaatcattcctctacaaaatccctaaaaatgcttattttttaaagactttatagttacattttcaaaaagtaagggaaatcctcaaattccaaaaaagtacttaaaagcatgaattcaagcatcagagttaaactacatagcagaccaaataggcctaagcgacatttacagaccatttcacccaaatgctgcagaatacacgttattttcatcaggacatggaacattctccagaacagatcatatcttaggccatgtgacaagtctcaacagattttttaaaaatataaatcatatcaagtgtcttttctaacaaaaatggaataaaactagaaatcagtagcaagaagaaccttgaaaaccacaaaacacatggaaactaaacaacatgctcttgaacaacctatgggtgagaaaagaaataaagaagaaaattaaaaaatttattgaactacatcacaaaggaaatacaacataccaaatctattgaatatagcaaaagcagtactaagagggaagtttatagcaataaatatctatatcaaaaaagtagaaagactttaaataaacaacctaaaatgtgccataaggaactagaaaaaaagaaaaaaccaaaccctaaattagtagaaggaaataaataataaagatcagagcagaaatatatgaaactgagacttaaaaatacagatcaataaaatgaaaagttggttttttgaaaaaataaacaaaatcaacaaacccttagctagattaagaaaaaaagagagaagacccaaataaaattagaaacaaagaaggagacacaactgagaccacagaaatagaatcattagagactgttatgaacaactacatgccaacaaatttttaaaaattctagggaacttagaaaaatggataaattcctggacacatacaacttaccaaaattgaacaatgaagaaatagaaaacatccacaaaccaataatgaatcaggagatcaaagccgtaataaaatgtctctcatcaaagaaaagcccaggacctgatgactttagtgctgaattctaaaccaaactctaaccaaactcctaaaaaaaaaaaaaaaaaaaaaaaaaaaaaaaaaaaattggacaggagggaataactgcaaactcactctgtaaggtcaacattaccctgataccaaaaccagaccaaaaaagaaaactacaagccaatatcactgatgaacatggttgggaaatcctcaacaaaccaaagcaatcctgggcaaaaagaacaaaggaagcatcacactacctccgttaaaatggcttttatcaaaagggcagggaataacagatgctggtgaggatgcagagaaaggtgaacctttgtaccctgttggtgggaat

SEQ ID NO: 121 - DNA, 1835 bp, Homo Sapiens
gtgtatgctgcgaattaatacgtgaatgaacaaatgactacaggcattatccgaatgatatgatcttccttccccatctttctgggtgtcggccttcattcaccatgaagttgtaaacacaacattgattttggagtcagacaacctaagttcaaatctagcctttgctaattactggctgaaatcattgagaaatctacttaacctgcctgagacctcagtttccttatttgtaaatggaatagtagtgcctcaagtgagataaggaagaaggatgcctggagtgggataaagaaaatatagaaaaggaagggagtgtcttcacatcccagcagggcacatggaggaggaggaggaggtgctgactatggacagcaagaagcaacatcaccatcacaaaacacccacccagggcaggggccctttcaacaaggagcataagagactgtttctgcctctgatggaagcccagcattttgtttttctccacatattttaatcaatatttaccaagccataacaatctggctttcactgtcaccctagggttgagtttcatgagtaactaccttttccactggctgcagaaataatgactccatgtatgattggcagaaggtcattcatttgagcataggaaaacaagcagtttcaagaaaagagctggcatctctgcatgagtgaatcagtgcacatctaaaatgcagttactgaaattatagaagcctctcctcggccaattggcctcctttggaagatatggcctcacaccattccatgtgcatgtgaaatgtctagacgtgattatagagttttcttgagagctgatgcatccaaggaacatttaaagtaagaagcaaagtaatgaaaaacgtttctcagaaaataaaaattgttaatatggtcttaccacattttctaatgaaagcatgttgtgaatgctcaggaagaagaaggtacagtaatgggactagaaatctgcagcttggatgggagcccagtcaccaattaccaagtgctacaagcctgaggctacttctcattgaaagggcctcccaggcattgagggtgtccacagttcagtgagacctcagaagcctgcacgtagttcatgctcagttcttaggataatcctgtctctccacaattccttcaggcttgcaacactctcttaccccaaatcagctcttcccctacatttcccctttctatcaatggcactagaattctcccaaattgatcaatgtcaacatctcattgtttactcacccttcatgtactcacctcccattataatgtctagattacagatagcctttattttacctcacggcatgtccagaaagaatctgtcttaactacctacttacaccaaggcatcagcaattcatttatttattcattcatctgttattgtatgaagtattggctaagagatctatagtgaagtggggagagatagtcatttaaagtaactgtcatataagaatgagtaagcattcacaccgttgcttccaccagaactcacactttcttccttatatttttccatctttaaacacaagttaggagacactacctcctggaagcctcccctgaatccaccctcagctgactaaaatgtctctccaatgggcttttacaagtgcatatctagttcattgcactgaaatttcactgattagctattcatgtgcctgcctgctccccccaattagactgtcctattcaaaaacagggactgtgtcatattcatctctgtattcctgatacttaacatagagcccagctcattgtgtgcattgcatatttttaaatgaacacatgaatgaatg

SEQ ID NO: 122 - DNA, 1919 bp, Homo Sapiens
tggcgtatggaccaccttggtgtctccagcacccacctcaggctttcatgcatagtaggcacccggggtagggttgtagcctatatttgctcacattaaaaaattagagaccagcaagatatatgcaagttgccgcctctaacctcgccaccccatggagtttctttttagcagttgttgaccaagtgtcagcagaggttgcattggggtgttggtgttcaggagcccgagccagtcggggctcaccatggtggcagcaggctttatgacttggtcttttcctctttccttttcctctcaggtcatggtcaccccgctgctggctaactgcagctacttctgccagccagtggactacagatggagaaagcatggaatgagggtatggcagggagcaggaagcaagcctggagagggttaggaggaacaacttcataacaatcggaggtcaaggaggtatcacctgagccttttgatgagaggcaggggactagctagttttggagtcagataacatcaatttggatctcagctctgccagttacttgctgtgtgactctgggtggcacacctaactcttctgggactcaattttcttatctataagattgagataataatacctattttataaagcgaaatgattgaaggaagacggaatcagataatatatgatagataatatatgaaagtgtttagcacaggggccggcacacactgagcggtagctaggtggtagtgatttcatcactgttagctgttctctgtttcaactggaagcagaacaaaagactctagctgaagcctgtctccaggtagctaaggcttctcaccagctgatatggatgttgagtcactggatgttggtgatgggctcatgtcctgtgactcaaagtatgatccttgggccagcagcatcatttgggagcttgttggaaatgcagaatctgtgctccaccccaggcacactgattaagaatcttcttttcaacgaacaagatgcccacatgctcattagattccaaggttctgggctggggcacatttggagagtccttctgtggtcactccagtagcttctccccttctttcctgtgcgaacaggcatcttcctggagacaggaaggtaggcactgtggaatcagcggtgcgtagaacagtgaggatttggggctgaacccagcccaggtgggccaagccgtggcaccagccggactgcagtctgatggaacttccccttcctgcccagcagatggcgagcgtgtgctgctggtgcctctttccaaaggacgttgaattgcttgacaggtgttctttactttatgaatgaagccagagcagcccaccttcctgcatctctaccaccatggcaccatgccctgtgatgggtgggctggagtcaaatatgtagcaggcagccagggtcagtttgtggccactgctgccccctcttcctacagtctcctcactgagtgccccttccctgttgggttcaacacatctgtgctcctgtaagccctcagcctcctcgttctcttcctcaacttctaccaccagacacatctgagaagcaagcaagagaggctgaactaggagcaggacccagggactgaaaccagcacagcatccccacagagaattgggtggaaggcagcatggcttccagcttactggtgctgagcagattgctctgggtctccattgtatcctctgaaggaaggaggaggattgccttctgtccagatctcaggatcaaacaaataggtccaatttcctgtgctcacttcagttagagcacttctcatgtgactttgtagctttgtgtgcatctccttcctctactagacctaagcccctcacgggagggactctcttattcttgatgttccccacacctggaatttcaataaacatctcaa

SEQ ID NO: 123 - DNA, 2338 bp, Homo Sapiens
tgacttcctgagtgtctgcttccacccctataaccacaacctggattttgtgtataccattctcatgaatcaattttgctatgcatgtgtcccttagaacctgtgagtgtagtgaatttcataaataattttagaacattgccagtcatgcatccctgggataaaactaacttgatcatattgtattttataggagtctcatgtatatgttcactgaatcaagtttatcatactattcaaatatggttaaaaacatgtgttgacttgagctactaactactgagagagggatgtcaaaaatttcccagtgtgttgtgtctttgtcaatttatccttgttggtctgtcaaatttcactttatatattttgagactatattattaggtatattaatgtttataatgattatctctttctagtaaattgaagattttaccattatatcttgattattttcatctttaaaaaacataaatattaatgtagctataccagcttggttatggttattttacctggcaaatatctttttccattcttttattttttaccttttcatgtcctttgacttcaatgtagctcttgcaggcagaatatgtattgatttttccttgtttaattgaggtataatgagttttaaaatttaatgtgataattctatcttgtaactagaacttggtaattttatgttgtgattgtagatatttacatagaataatttctccagtgatatttatattataaagcacatttaccatgtgctttatagttaccttgcttttactattttcatttttttaagtttatagtttttttaaagaaactgatttgttatgaaaaaacatttatctagagttgtttttctatcaattgcactttagtattttcttctatcagatccaaataacattaaatgttttgataaatacttgtgtgtacatatatgtatccacactatttatatctttttttcttacaatgaacatattttacttctgtattctaaaaattgtttggagatagtttaatatatagatgaacaaataaataatacttacatggaaattatgttattgttacaaccaggtggacttaccaacagccatacagtggaagtggtctgaaggcatggcagaatatccccaacctgcctcgcctaaatatttttacctatgatgagcaaatagctgccaagcaagaatggatgctggcaagactgtctgagctgagcctctatggtagggttgccagatttagcaaataaaattatcatatgggatatacttaaaaattttgcattgtttatccaagttatatatagttaaatataactgggtgtactgcattttatttgaccctaccctatgggtaagaccccattcatttcactggagagtgccaggaagcaaggtggctcttccttgcaagtccctgacctctcttgctgaatgtgcctgagaagggttagaaatgcgtgctctccttttagacacccagctcatcattccttttttgcaagcactttctcagggcctctttcagcatttaatctagggaatgagggcactgttgccatgtggttttcaaactaatagagctgacatcctagaactcccacctggtcccttgccaacattgtcacacaacccgccctgccccttcagtacagctctgactgggaaaagcatgggctctgaccctaactggcttttggcgttgaggtctagaactatcatttacctgctgtgtaacattaaccaattcactgagtttctctgaaacttctatgcctcatttataaaatgggactattaaaagtaattcctttgaaccagaccttattctataagaaaccattcaaactaatggggggaaaaatgcaaacttcatatttgaaccagatcttacccttttagagccataaagattaaaggacaaaaactgtgtctgctcaagctacaaacttcttttgcagcagaactagggactaataagccagattacaacactcgcatgcagtggaatgctatgcaggcattaaaaatgagcatgtttcttaatcctcgtgattataagagctagactttattttagtgagaaaagaaagatgggaaacagtatgtataacatgctaccttttgtataagaaagggagaatataaaagtatttttaattgcttattttacataaacaatacacaagaacttaataaaagggattacccctggtgtgaggatgggagttgttgctagcaaaatgtagtggtttagggcaggtctggaaattagatttttcactatataccattttgtatcgttttgattttagaaccatgtg

SEQ ID NO: 124 - DNA, 4313 bp, Homo Sapiens
gttaaagaagttgtcttatatacatagaaatggtataataagctactttaaacaaccctggatatgtttcttttcccttcctgtcactgtcctctttcttcccttttcccttttgattaagaagttccatcagaaaagtcataaaatctaactcctgtttattctcgagctatcagctaaaatgtcactttctcaggaaatcctgcctgacccccctttcccctttgttctggcacccattcccctggcctttaaatgctttcatagcagtgtgtacctatctatcattttttacagtttgtaattacggctttttttttttttttttttttgagatggagtctcgctttgtcgcccaggctggagtgcgtggtgcgatcttggcttactacaacctctgcctcccaggttcaagcaattttcctgcctcagcccccccaagtagctgggactacaggtgcgcaccaccacgcctggctaatttttgtatttttagtagaggcggagtttcatcatgttggccaggctggtctcaaactcctgacctcaggtgacccacctgccttggcctcccaaagtgctgggattacaggcgtgagccaccgtgcccggcttcctgtaattatgtattaaaatgtataattacttgattaatagctatcttcccaactagaccaaaaactccatagaatgtatggaattttcctccatcatccttgtagtccaagcataatatttattaaatgagtaaatgagtgaattaactagccattttgattaattttctctttttagtgcagttttggtttaggactgtaaggagtcatactggccatattcagaatgtcacattagtgttttaagtccattctgtatttttttcaatgagtttcagcaaaatctgagagtgtcttaagtgaaattggttatatctagggtggaggtattatatttggaaagacttgtaacagtagaaagctttttatttaaatctttgagttttaaaatatttttattatgaagttatttatgattttataggtaatatttttaatgagaccttgaaaaatttatagagtgcagtttattacagaatctgagttgcctaatagtttttaatagtttttgagtatcagtattttgattaattttaagttagggatcatttcctctaattctttgaacataattatttgttggttgatttttttttttaatgtaacagtgtttttgagatgtaatttatgtaccatacggttcttctactttagggtattagattcatggattttttgtacattcacagatgtgaccgtcattgcagtcaattttagaacattttcataatctcaaaaggaaaactgtagcctttggctattatccacttattcttccatccctgagcaaccactaaactacttttggtgtgtatagatttgcctatttaagacattttctataaatggaatcatataatttatggccttttgtgattggcttccatttaggatgttgttttcaaagtttatattgtatcatgtatcagtactacatccttcttattgctggtaagtattctgttgtatcgatataccacattatgtttagccgtttattagtacagtggtccccaacctttttggcaccaaggactgactttgtgcaaggcagtttttccatggatggggtgtgatgggggaggatggtttcagaatgaaattgttccatttcagatcatcaggcattagattcttataaggaacaaaaccaaaacagcaacaacaacagtgattctcataaggagcacccaacctagatcccttgcatgtgcagttcatagtaggttggtgctcctatgagagtctaatgcctatgctgatctgacaggaggcagagctcaggcagtaatgcttgctaacccaccgccactcacctcctgctgtgcatctcagttccttacaggaaccagtactggtctgtggcctgggggtttgggatccctgcattagttgatagacatttggattatatccacttattggctattatgaataatgctgctataataaacattcatacaagttttttgtggacatggtttcatttcttgggtatatgtccagcagtggaatttctgggtcatttgctaactatgatttcgttattggagaaactgccagattttttgttgatttttttttttttctgttattatgtagtgtcaagaaaccgtttaatgcatatgaattgaagccctgtaaggaaagtgatcatttgggattagatcgcaaattgcttgacttcaaatgtattactttgagaattttctgtgacagtttagctagtcctttatcttccttatttttcttgagaatacatgaattagctccctgccttcatatttgaagatacatacctatcagtgtacagacatgtacacacataggtacacatataatactttgctaagcagtttgtgctggggacaatagttgaaactcggtgttttttcctaaaatttatatcgtttgtttatatatgaaatatcaaatgggagatatttttggaagcagtgaaacttgtttatgaattctttccttacacaaaagaagacaggttttttaaaaacaaattaatctttttctctttgtttctttcagcattgatgactgggaagtgagagacatagatttttgaaaagctgaaaataacttctagtttaacaaaatagtttcttccagagcttagaatttcagatgattggaaaattcatacatctaggtctgaaagtttaagtctttcgcatctatggagatctctattttctacaacctaaaatgctatgatgggtgacaggttaaagacaaacctttttaaaaaatgtatatttttattgctatatagtggtattatggcttttgaaattcctatttttaccataaacagattattaggtgcttactgattccagataatagcctaatctattagaaggtagaagagagaatctctggtgatacactgtccatacatggttcaataggaggtagcaaaggctaagtatgagtaagtgacaaaagcagtaaatgctgcagaactgaaattcagagaattgcgcttccactgttgggtaaggcttaaggggagactttgaaagaggaagatgagctatgccttcctttgggtactgatttaatttcttttgccatttttttgcatttcttgaatgtaggaatttatccttacccatgtgcatattcatcagctccaatttaggagattgactagtgtagcacgtcataaccagaaagatacttggaggtagacttttccctaaagtttatacaagacacttaatgggctgggtccttgatcatgtacttctttcttagactttgtgtatatgaagtggtgttcttatccttatttctttccacattcaccctttttaatgcttttagtaagtcttttcagtttttgttaagatttattttatagttacactattgtatttattgaaggtagcttggctgatactgttccaaagtcacttgccactttcctctctgcataattaacatttattctcctcattatttgtcaatgaattcccttctgtttatttatagtttctttatgattctgcatatcagaagataacaagcacttatcacaaatgcatttaggggatgtactactctgtaaaaaatttaaatatattgaaaatagaactctttgaattttattttactcttttgaggaaatgaagatatcttgattttttttatggtattctaacctgcttttccggggcatacagggcagcacttatttttatataaatctgagaatgtgtgaattgcaaattaatcttctggcagatatctaatgctgttgatagagatgtgttgccctaagatttattggatttaatgagacagtcttttgatatatccttgaattatgatgggatattgggttgccacatgtaagttttagaatattttttaatgatatagagaaaatgcttcagatacaatggcatgtaaaagagaaaacagcaaaaaaaccctgattttaaaacggtttgattcaatttatattttaaaaacacagacacatgatttgtatgcctgtgtatatagaaaagattgcaaggatatttaccaaaatattaagtgattatctctgggttgtagtaattggggtgatttttattttttaagtgccttttctttgggtattgcctgaaatgttaaatattatctcattttagcaaataataaatactacttttaactaagaaaaaatag

SEQ ID NO: 125 - DNA, 10342 bp, Homo Sapiens
gttctccagccgaggctcgggactgctgcagggtggaaaatgaaagttctgagagcaccttccgcccctccgcttctgcacagccggggctgcggtgcgaggagcttggccgcggggcccgaacgaggcgaaggggccggggcccttggggaacccccttctctcttccactctcccttaggtaaaacccgtgttcctctcacgctcgacccagcgcctttccagctgcggtcgatttgcttctccgcgtgtaagtacagccaccctcaaggtcattgaaaaagtttgctttaaatgagcgtctgcggaactcgtcctgaggctctcactgttacagattagagatgggggcgctttctagtggaggattttgcttttgctcttctacttttgcaagaagctttttgtcctgaaaagtggacagtcatctccatttatagcttggaatgaaaatttgactatggaagttgcagtcgctacttgagaaatatttcctccttctttttttttttttttttttatttttgacacggagttttgctgttgttgcccaagctggagagcagtgcgcgatctcggctcactgcaacctccgccttccggtttcaagcgattctcctgcctcagcctcccgagtaggcgggattacaggtatgtgccaccatgcccggctaatttttgtatttttagtagacacggggtttcaccatgttggccaggctggtctcgaactcctgacctcgtgatccacccgcttcggcctcccaggtcctccttccgttttaaaggataaaccttgaaatgcttttaaaatatgcagcgtgtagaatttggttagttggttggttggggttttttagagaaaatgagaggtagaatggactctaagttaaaccctgggggacagtgtcactctggccgctggcctggctgggaaaggcgatgagaccctgagcaggttaaaacccgtgtcctgaaggtgtcctgtaaagggaaataggcccgttgcctccttcgtaggtgccctgagactccgacaaggcaggaatgccaaggtatttcgtacctgctcagccctggcatgtcaggttgctgagaccgagcagtgtggggctgaggtggaagcggaccttctggggcgtggaaagcgcaccaggagaccccggctccttctcagccagcactgcctcatcctcagaacaaatttaagtcaattcagcatttattcaatgcctgttgcatgcaagtgacaacctaaataacagagaggatctctaaaagaaacagatatttattttgcaatagagctttgcagtagaaatatgcatgccatggtaaacttgtgcatattcagagaggcaaggaaagcaaaggctttaaaaaaaatgaggcggattgcacaattgtttgaaaataattatctgtggctacaaagatccataacgaaggcgatgccagttcaaagtaggacagccagtggctgggccatgtccttgcaggactagttttttgtgggagattgcagtggcctttgtgcaaggttgcggtttttccagagagtcctttttgttatcaggcatgcacgcgcaagaaccctctcttcatggccttccccggctctgtttgtcagggttttcttaacattagcggctccatttcgattctgacaattttcacacaagctacagtgcctggcctgggacgacacaaacatgagtcaggtttggtgcctgttggccaggcgcagtggcacacacctgtaatcccaccactctgagaggccgaggcagatggatcctttgagcccaggagttcaagattagcctggcaacatagggagacccccgtctctatgaaaattacagaaaaaatttgccatgcatggtggtgtgcacctaccccagtgactggcacctggaattcaccgagcaagttggttgaaaaagttaaaggaattttccagcactttgaaaactaaaccaagagaatgtctccatatcaaatttcagccactccttataaaaatgtcttaaaggctgtaaatcaccgtattcacctgcaggaagcagtgttgaggaaggaggtagtatagggttaagggtctatttaaaccagctgcttagggccaagttagatgtttattctgtctagtttaaaccactggcttaacagggtacttaattttccagtttcatcaaagaaatgtgctgtgaggccaagaaaattatgtagttcatttttttaaaagagatgcaaactgagaaattctgtgaccattaacagtctcattaaagaaataagaaaatatgattgtttctcttagattttgcaaaatggctaaggagcatttttagacactttgttgtagaacaactctcttttaagctactttcctcctttcttaaaaacaaaatataggccgggtgtggtggctcacacttgcaatcccagcactttgggaggctgaggcagatggatcacctgaggtcaggagttcgagaccagcctggccaacatggtgaaaccccatctctactaaaagtacaaaaattagctgggcgtgatggtaggcacctgtaatcccagctacttgggaggctgaggcacgagaatcgcttgaatccaggaggcagaggttacagtgagccgaggtcatgccactgcactccagcctggtggtcagagcgagactttggctcaaaaaaaaaaaaaatgtattatccatttattatgtactcattcagcagataggagcaaaagcgcccattctactcttaagtcccaacccagaaatagagcagtgagggaaactgacagcatcctgggcctcagcacctgctgggagaaagagccaacaaaatacacagcaacacacaggatatagcacccttggtgttgattaaacgctagatgaagaaaagggaggaggagacgggaggaatgcaggctgaggcggtggcagggggctccattttaaacaggatgtcgacaaagatagaatttcagcgagtgctagaatgaggtaaggacttacatcaacaatctgcccgcaccatttcttcttagatttcagaaactgttttcgtttgattcaatactggtgccttccttcggttcattttctgtttatcataaaaattatcctaggtcttcaaaactaatttaatggaattgtatagaaatggaaataaaagtgactacaagcttcaaaaaggtagattttgggtataaagacaatcttatatatttttttctttttcaagacaaagtctcacgttgtcatccaggttagagtgtagtggcacgatctaggctcactgcaacttctgcctccccgattcaagcgattcttgtgtgtcagcctcctgagtagctgggaccacgagcgtgcaccaccacgcctggctaatttttgtatttttagtagagatggggttttgccatgttggccaagctggtctcaaactcctggccccaagtgatacacctgtcttggcctcccaaagtgctgggattacaggcgtgagccaccatgcctggccaaagtggtgaattttatattagtgtggttttgcagtggctaggtctgtgcaaacctatccccaaaggccaaggaaactgacaggctgaataaagaggctgacatacccagtttcctagaaagaaacatttagggccaggcgggaagactcacgcctgtatcccagcactttgggaggctgaggtgggtggatcacctgaagtcaggagttcgagaccagcctggccaacatggtgaaaccccatctctactaaaaatacaaaaattagctgggcctggtggtgcacacctgtaatcccagctactcaggaggctgaggcaggagaatcgcttgaacctgggaggtggaggttgcagtgagcccagattgcaccattgcacttcagcctgggcaacaagagtgaaactccatctcaaaaaaaaaacaaacaagaaagaaaagaaaagaaacatttaataaagattggcgaacagaagccgtgtctgtgtcttgggcacccttacctgccagacgcaggccttctgtactacagcaaaagggtgactcagaggggatgtgcaagggaattgaaggacgataacatcaaggttgtttcaacctaaggacaggatttacaatgaggacctgctcttactcaaggaacaataaactggaaatcctagaggccttcccagaactggggttagtcagaagtgaacccggcagatcgcgtcccaggtggagctgctttagcctccgtatgtatatttcacccccaagaaaggttaaaccgaactgacaacagagacattcctctctgtacctctattcaataatgaggcacagcaaactgtagaacgcatgacaaccacagataaggaaagcactcgcacggtcctgacgccattgcccaccctgacattcgttcatggaggtcgcctgcacattccatcttattcaaaggggtggtggaatggggtggggggagagcatctgctattatctccggtcgagtgctagaggcttgagcccacatctggggtctgagagaggatcctgcactaggaactgggacttgataatggcctcgaggacagcttggagcgtagaaaatatttttgggttcactgacattttaactataattttatataagaacttaaatcatcaaaatgggggatccaggactctgtcctctttatggggctgctgggcaaactgactcgcagagagatgatgagccataaacatccactcacaagcgggagaaagtcaatggagaccgtgtggaaaccacttcccctgcttaaaaatcaccaaagccgtaatgatggacagtgagacagcagtgaccctcagtatttcaatgggacgtgaataatgtttaattgtatgttcatatattgcttaacagttttagaaaatctgttcttctgcagcactagcctgctctgcccatcccaaaagtgagtggtgcctgaaggaattctgagcccctctgtgagaggaagcgcgtctgtcttttctttacgaccccggcactgagcacagggcttggaatactataagaaataaacacatcttttaaaaatagtgaaaaacggagagaacataatcaaatgcccatgttattattcacggcacgagtgtcttagagaatacaggtgtttagggctgaagtgagtccccctgagattcatgctgaatctctaaccctcagcaccacacactgagcctgagcttgaagagggggccttgaaagggtgattaagttaaaattaggtcactggagagagtcctaatctaatgtgactggtgtctttataagaagtaattaggacacagacacatggaccaaggggcagccatgtgaggcctcacatgggtgggaaggtgaacccagcccggccgacaccttgatcttggacttccagcctccagaacggtgagaaaacaaacatctgttgttgaagctgatataagagttaagaagaaatcacttaggcagatagtaagggtgtgagtgtcctcaataaggcttttatttttcatgaaaagcagccccagatcattttctaacaaagagcatcctgtaaagtggagctgcagacatggacaagcaggctgggagcttgcacgggtgaatgccagcgggaactagggtctagaaacgttcaagatggcggctgcatcttcccttctctgccagccacgtgtaatgtaaggagcagaaaaaatggcaccgatggcccatcaactcaaaagcccatttgcataataagattagggtggggtgaccagccttcctggtatgctatgtaaacgccatacgtgatcaaaccaatttgtgagtcctatgtaaatcagacactgcctcctcaaactggactataaaaccgggcgcattcaccaccagccagtcttttccgattggagacccctttctctatggagagagctgtttctctttctcttctcttctgcctattaaacctcccctcctaaactcctcgtgtgcgtccgtgtcctaaactttcctggtgcgcgacaacgaaccccagggtatataccccgacaacgtagctgcttcaaagccaccaggtctggatgctttgttgtggcagcacaggaggactagggggaaaagaggcctctgttcttgttcccaaggaacaagaatggatggaatggccatccgtttgtggggaatcaaacataaagacccacatgcatcatgagacagatgtgtggacaagcctcgagacataataggcattgcgtgtggtccacactgccaagggctggagtcagggaaaagggagagggggtggacaacgttctcagcacccagttatgctcaataaatatctgtagcctgaatgagtctgaaaacttgagctggagtcagtgaggaatacaaaatcaagagatgtaaagaggaagaagtgttcgagcaccttggctcacgcctgtaatcccagtacttgggaaggccgaggctggtggatcatctgatgtcaggagatcaagaccagcctggccaacatggtgaaaccctctctctactaaaagtacaaaaattagctgggcatggttgtgggtgcctgtagtcccagctactcaggaggctgagacaggagaatcgcttgaaccagggaggcggagactgagtaagctgagatcgcgctactgcattccagcctgggtgaggcagagttagactccgtctcaaaaaaaaaagtaagaagtgaaatatttcaaggcgggcacatccacaaaacaccagaaaaggcaatgctttcacagagaagacaaaccatcttcttttctctcctcggtcagagaccatctgatgctctagacagtggctgcagtactggcaagacaggcaagtcaaggaggtaacatggacgaatttgcacaacttagaaaagacctgtaggtataatgttaaaaacattcagcccggcgtggcggcctgagctactctggaggctgaggtgaaaggattgcttgagcccaggagttcagctgcagtgagttatgatcatgccaatgaatagccactgcactccagcctgggcaacatagtgagactgcagctctaaatagttttttttaaacttttttttttttttttttggagacaaggtctggctctattgcccaggctggagtgcagaggcatgatctctgctcactgaaacctctgcctcccaggctgaaaccatcccccacctcagcctcacaagtagtgtggactacaggtgtacaccacacctggctaatttttgttttttgttttttggtttttgttttgtagagacgggatttcttcatgttgcccaggctggtcttgaactcctgggctcgagagatcttcctgcctccgtctcccaaagtgctgggattacaggtttgcaccactgtgtccggccagcaagtactttggaatagttccttattccgtctgcaaaggacggttcctagggcttagcaaggggaatttgaactgttaaaggaaaaacctaagcctaaagtattaaactatggggaagggccaggtgcagtggctcacacctgtaatcctagaactttgggaggccgaggcgggcggattaccaaggtgtgcctataatcccagctactctgcaggctgcggcaggagaatcgcttggatccgggaggcagaggttgcagttagcaggccgttaggaaaggtatttgagtcctgtgactttccactatccagcaaatcacatctggtagctgttattctccttattaaacacagatatccatgtagataagcataatcttcccttcatgcttttcctttccttcattcatttccttcattcagagccgagatcgtgccactgcactccaggctgggtggcagagcaagactccgactaaaaaaaaaatgaaaataataataaactatggggaagaataaagaaggaattgcctacatttagagggaggtagaagaacaaaaagaggaaaatatataactattttaaaacctttttaacataagtctttcaaatcctagaaacttgggacttgtgtgaggggaggacccttctctcactctgttatactttctgaatgttttcaaaagcactgtagacacggtgatgcttagaactgggggaggccaggcctcctggaagaagtttgctgagggcctgtggatagagaagcagaaacaggaacacagcctggggcaaacatcgtgcggatgatgggcatctcaaacactggaaataaatgaggctgcgggagcaaaattgctggttcccctgctgagcacacctgccctgcttggaacaagagcaaagatgtctggtgggggagccgatgtgagatggatggatagacagggcccccagcctgggggatgggaccagggaccatttgtgagataaacccaggtattagcccagggcagaggctcccagctgaccttaaaacagaggcagcccagctccacccagcacttcttcagcaggcctgggctgggggtcagagaactcgcatttctaagatgttctcagactgagggacccagtggaaaagcgtcctgattactgggttataaacacctgaagagttctgaaagaaatgggccacaccctcaggatccaaagtcttaaaggaaagctgaagaggtgtcctgtgagttcaggggcaccccggtgaagcctggggcttagaaagaaaagaagtgtttataccaggagagcagagagcaaggagcagggaggggccagggcagcccccaaaccggagcccgaggccggaccctgcctctgacgaggagcatgcccggccaccatgctgacccctgcatccttctttctttgtcccttgaagcccctcaaagtccttcctgagacacatcccctcccaaggcacaccctggagggtctcaagacttgaaaatcagtcaagaagcaggcaaggagtgagctgatcactgtagttaaagagacggcaccaaagacattgtacaaaagagggcaggaagatgtccatgtgtctgcaccagaccttctgcgccagtgagggatgctgcaggcaaaggcagggcagatggcaagagggtccctacccagccgcagcacccggcaatgcccaccagagccgaccccctgcccgtgttctgtgagtccacgtcgtctgcatcagggtgctgatggcaaagcctccgggtgtccctccgttgcagggtctactcctgcagtgtggacagcagagacggaggaagttctcccaagtgcggggaggtaggctctgtgggaagcccttcactcaaaggcacactcatggttttgttaccagagcagctgaagaattcaaagtagcttctgagaactctaactgtctggaccatgctatagtaagggctaagctaacttaagagccatccaaaaaaaaaaaaaaaagaagaagtgaaaaggtgattgatgtcagatgtaaacccaagagggtaacacagcaatgctgagacatccgaaacaacttcctattagctgtccaggaccttaacccaggtcttaagggatcctgtcttttttagtctaaggcagttgaatactaaattattaaaacaggtcttattttatgaccctaatcatcgacaagaggcgccttttgttgttgttgacacagagtctggctctgtagcccaggctggagtgcaggggcgcatctcggctcactgcaacctccacctcccaggttcaagtgattctcctgcctcagcctccagagtagctggggttacaggcacacgccaccatgcccagctaatttttgtatttttagtagagacggggctccatcacattggccaggctggtctcgaaccctgaccttaagtaatccatccacctcggtctcccaaagttctgggattacaggtgtgagccaccgtgcctggccgacgaggcacttttccctcaagttaacaaaaggaaaagagaaaagagaaaccttctgaagacaaacaatagataattgggtgaaagatggatgaattctccccacgtctgtaactcctaagaaacagaggccctatgttctgcatgaggacatatccgttgttcacaatccccacactcagctgaaaaccacaaacccacccagagggattgcctttcttcttctccatttgggtacttgctctccagctgaattccactttaatttcatcagtgaaggtcagttcaattggatagactgcaagctcttttcagaatgtaagggaggattactctgtgagagatctaatcatttatttttaaaataca

SEQ ID NO: 126 - DNA, 2679 bp, Homo Sapiens
gtaagtcgtggtgttccgtattgctttggatgtgtagcccaggaataagatggcagcactgcaggattccggagccacccacagcaccgactgctgctggagatacacaatcatgggcactcgtgaagctgcagaaactcacggggaccctgacaccagctgctccttggacagagggaggcccgtcatctgggtctgaaggaggctcccaagactctgacacagaacactaaactccagggtgttctaggacagtgacaggcaaggctgttctcaatcatctcctgtctgacacggacatcgagctaagctatgagcaagggcgaacaatgcctctcagcagctcctcctccttgaccaggctcccgaccacggagcatttcagtcaaggtctagggatttgagggtggaaggagagaatttcatcactggggaggaactcccctcacagaccccccagggccactcagcttcaatcagctgtaacccagccccaacatctgcaggccactgcgcagggagtccacggtcagcagccacctcagcacacctcctcctgtggccacatcttcactggtttctggaatccaacctggggccttcctgaagccaagtgagaaactcaggacaaggcttctcttctttgaaagccacatcaagtagcacaaaggactgaggtttgcagctattttatttacaagtatacatttaacacaatgaaataaacactgatatactgaagcctagttaatagtagtgtaacaatatgcatcattttgatgattacattattttaaacaacaaactacactgaaaaattaatgccgataaaattcttggtcataatattaagaaatacaatatataaattgaaaatatgattgcttaaaatttgaaaatggaagtgaactcatttggacagactcagagttaacataatctgaagggaggggagctctgacccaaatgatatctttcaggttaacagaagaaaaaagaagcatagtttatcttcaaggagaacgggcagtttgcttcttcaggtagaatatattcccagtgtcctcaggctttgcagcagaatcacatcaccgagcatgaagacttgccttgtgaagctgccccgtccattttttctgcctccaaaattatccttcgaaaaacatccacagcagtctgaaaagagaaagaaacccaatcacagtgttagtgtgaagccgaactccgagagtattttacggactgaggagggcgtgccgcctgccctgccctcctactggtggaggaggaggggttctggtgagccccagaacttcagggccccccgacgcccagtaaggccactgtccacccctcctgacccagaccataaccagcctccgattgtgcttttgaccctgtttccttcaggcaccaggagacgcccgaagagtcctcactcccagactcaccaccatctcctgtcccactccaccccatgacccccaccccagtgtcctctgacctcagggtccctcttcacttctggcactatctttcctcctttcctacgggacatactctcccagcagcccttgcctctcacatccttgacactaagaggcctgaagtggggaaggcaccctccgtgctcctgagatgccacgatgccagcctccaacacctctgtggcgtaattctcggtcatttcaatccacaaactgccctccctatctcctggcctctcctctcctgcccgtcttcctgccctcagcctcagcccagggtcaaccccaccagtccttcaccacagacaggaatcatggccacttggagcaggaactcttcctacactgagtggggaggagaactgtcagaccctgtcctttatttttccttttttgttatacagattggaggtttctatgttgcccaggctggcctcgaaagcctagcctcgcctccttatgcaccaggacaacaggcctgagccaccgtgactcccagaccctgtccttgaaatgcagtcctgtggtcatgaaaaactgcccctgttctcagaagccccacaggaagtaccctgttctcctaatcaccaagaatccccctcccccatcactccagtgacttccactatcccacgaaaccagaacacaccaactgccagcgtcccaccacaccaccttcccagctctttctctagctatcctgaagcaacaattctcagccccacaaggggcctgatttgttgaccctattattacatctcccctgtcccttaaccacttcttgctgctcctttccctctcggtcagctcagactcagcaggccaccatggcgccactgtacttcaactcccttccctaccaactgtcgctggcacggtgcccgcggccacaccgtaaacgctgcccagggaaaacacacaccgctcactgctgacctcacacccatgaccaggaacctggcgcagacacttggtgctgcctagccacccgcctgcatccctggatctgggcactccccagagaaagcatccacgccttgtcccttctcctcaaatgttccccgtgcttacgctcagctgaaaaccttgttttacacacttcactggaaaacagaagccacattcatgaaagaactccacatcctccatccaccaagctgacccacccacttgaatgtgggctcccatcctc

SEQ ID NO: 127 - DNA, 7063 bp, Homo Sapiens
caggagcgggagccgagcctcgcggcccggggcacggcgccgcctgcccctccccggcagtgcctcccgaccccctgccctccgctgggacatggcctgaggccccgcccgccgcccgggacccctcccccacgctgcccccggaccctcgccccaggaccgcggggtctcttcccggccccgccgcccgccccggcgagaacaggcccggcgggcaaggcggcggcggaccgagggaggcctggcccggcagcggggagaagggtgcggcgcagcccgagtttcccaccttttatcctggcccagacgcggctggggcggacgggacctctcgcgctctgcctcctcctcttgcttcatggagccatgcgcctgggtgggggctcccgagagaagctggcctgcgggcgggccggacgcgctgcgcggacgggacggggcgaaggaggccggcaggcggaggaggaagcggcggggcggcggcggcggcggcggccgggaagaactagaggtattccccgggcggctggaggactgagtcgagccgggacccgagtcctccggtatcccagcagccaccggaggcagtgaggtaatggaggaagaatgtagggagtcctccggtggaccacactccttctagcgagccgcggaaaccatagagatcagggctcagccggagggccggcccactgctgtcacgtggcctccatccgtgcgctttattggctggtgctggctttacggggttgaattttggacgctgcctgccattcgtgggaccgagtttcaggcagctggaataaagagagatatcgggggaaagccgcgagaaggccagcgtccctcgctgggagcagagctagccgagtagggcgcccggctgtcaaactggccggcgcagtgcacgctgggccgccccggagcgatcgcagagcccgtcgggagtcgtagtcccggacgggcccgcggcatcgtccgcgacgcagctcgggatccgggtcggggtgtcggccgggttgctgccgggcaccgtcgagcgttagccacccagcattgagctgccagcggctgttctccctaagcaccctcgctcacgtcgcctcgcctcgcctgaccggccgcagccttggataccagccttaaatcgagccgactacggcccagccccgcccgcggcgaggtgcgcggggttcggtgcgagcccctcgcccctggccgggccagcctcttgatgcaccggggacgggcgcgcccatccgactcttcgaggggcggcagggccccatctgtgtctttcgctctcgagcccccagctagagttggcttcagcggaatacctactgtgcgggattattcaacaagccgattgatcacattcttcagctctagcagtgcaaaggcttcactgaaaaagaacattacaacttttttgaaagaaatttgggggtaaatttaattttaaatactgatttttgataacatttgatcttatgacagcatttgtatttttaattacagataggattacactaaaagtcatttctgacctgctcccttacccttatggctaaaataaactgctaggccctgaagcaaaggcgagccatgttctagagcaatgtctttcttgtattaaaatacagccccatgctcacaaaaaaaaaaaaaaaaaattttggagtgtaaacatatacatcatcttaatttgagtccttatgtgttgacggtgtgcagggaagaatgggaaagtaactgtaagtggagcccagaaagaactaacaaattcatgaaaaagtgacattattgctggtctattttttttttaattttctgcttcctcacactctcccatactaaatgaattatttagtggttttttttttgtttttttttttttgtttttttttgtgatacggagttttgctattgttgcccaggctggcacgatcttggctcaccgcaacctccgcctcccaagttcaagtgattctcctacctcagcctcccaagtagctgggattacaggcatgcaccaccgcgcccggctaattttttgtgtttttattagagacggggtttctccatggtggtcaggctggtcgcaaactcccgaccttaggtgatacgcccacctcggcctcccaaagtgctgggattacaggcgtgagccaccgtgcccggccgacaggtgttttttatgagttacagactatgtgctttcagaatgaggcaactgatttaaggatgtaagcataatttaaggatattgaaaatgatataggaataaatttgtttagtcattcatggatttattcattttcagatgactatgtgtgtgaatatttaagaattctaaaaccgcatgggattacttataactgtataggagcctaacacgataatggaatcagaatatactttgctgaaggtatgaggcttttaactgaaagtcttctctctacgtttttatgtctgtaacaagaatccactgaagacctacatttcccggaaggttaacagcccccttctcagttttcctggtaaagtgtttttatattggtagaataccttctgtcacactctatatttttcttatctcaagtagaaaaaatttttgcccttttgcttgggactgttaacagccctggtagtggaaaagtagaaggaaatgattctgtgaattttctgttatataaattttagccagtttaggacttttgaatgaggggccatacagccaaggatttaggatttcagctcaggaaagaaaactacataggtgtttaatcgtgtcctagccacttattagctgggtaactttgagcaagttttatacatatccttcccatgagtttttcatttctaatactggctgtgtaatacagtatgtttcataggcttgctgtaataatcgatgggatgtatctaatagtgtttattttactgtaactgggccacagttaggaagttctcaattaaaattagctgtcattattcctagtattaatatggtgatgaacagctaaagagcatttaaataattatcattaatatggataaattttgaccatacctgaataaatatttataatataactgttgagagtatacaagtttaatattttagggaaatacaatgtcaaattctatcaagctctattctcaaactaaaacaatagcagtttgctttcagatattttgaatattattgtgacatttcccccttctacctttctgggaccttggacacaggaaccatgtaagggtaaatagtctaggtcttcgttgtgggacaggggtgatatactacagttccacaggggctgagccaggtttcaagggtgagatagagagctgatggtaaaaataacaatgagagcaaaggccaaaatgtatggagtatttattatgtgtcagacatttttcactaagcattctagtacaatatttcttcagatctatgaagatcttaatcttaagtagtaaatggttttattataaccactatacaaaatagaaacactaacataaaaaggttaaataatctgtttaaattatcttggattatcaacccaatcagctgtgtcctcagaacagaagctggtagcactacactgaactataccacacttgcaagccttcagaggaaaattccctaagagaaaatggtatctatgactcaatatttcttcccataccctcagtgacttacggtatttatttactaaatgccaaagcagatagtccaataggaaatacgtagctaaatggcctgcgaagagaagggaatgtcaaataacaggcaaaatagaatctgacaccctaggtctcagcaagtgttttgaatggacaataaagaaagtgactagaatgtaacctctgaaaaaatgttgtgaagcaccaatggccttgaaaaaatctagggagctgatgtaaaggacatccacttcataatgacaattattgaacaaattacttgttggagatggagttgcagacaaaacaaatatttaccactgctttaaaatacatttattgtactcaggagaagagtctggaactgtggtttcagaatgagcttatccaaaagtaagaagaggactggggcataccttttaaaataataatgatatatttataatcatcctagtatgatttatttaccttttagtaaatcaagttctcagaaaactaaagtaaaaaaatcttaacattacatatgcaggacttaatctgaataatcataaattttcataaacttaatttacataccacaccatagtagctgtgatatagtaaattaataagttttttgtactatggtgtagctctttcatcctaagaataaaaaagattctattatgtcaaaagacatgcatctggatggttaaaaaaatccaatcatacataactgaagaaaatgtaggtattttagtggaataagaatgtgatatatgaaaacagaaaaataaatatcttcaatgttacttaaagaaacagaattaacaaagatgtatcatggaagagaggatagttctgtaaaaacacgtaaaataactttcaaagatgaaaattttacatatgtaaaaacatttgtcaatgaaagtaataataattccattcatgcatttgttcatgtataaccaataacttacttgtgatgccatagaaaaaattcaagcatcaaactgaaaagcaaattttaataggtaagaaactagtggcctttaagctgacaatatatttgtttgaataaaaaatattattattttaaaataatcaaattagcaaaatacaaaaaaaagaacatttcacatgaacatcttaatttttggtatgtgtttaaatatcaggacatttactcatattcttcataaacagagttcataagtcttagtagatgctgccatgtgtaggcgggttgtcttctctaattatcctcagtccccaccattccatagtgcccccagtagagatattactgacatttttcatttattgccataatttagctgttgtttttcacagtcagcttgccttctttattttaatatttatataccacgtaggcatctcagtgtttcactcttgctatgagacagccatagatctcttttgacctagagttttttattctctttgtttttcaaaattattttccctaaaagcatggaacctatgagcctccaaatagtgcatttaaactcaatcacctctagaaaacaatgctaaactattcagaaagaatgaagagaataagtgaattctccaaacccagagctaatgagtgccagctctgaaaatgaggtccttgattcttgacatctggcctagtgtgcctaggaagtataatcagttactctgactcagtcattttaataattgaagtaaactacttaacagttaaacattatatacttaaaatacttaaattagcttagatataatcgaagaatttcactttttaactccaaataatgaagtgtttggttgtagggtattagatctttcatggaagaaagtagtcccgtaagtctaagtacaaatttcaaatgtaaaataaaactgatcaagccagagaccaggtttggcaaaaagtatcatttgatatgacttgtaaaatgtcaattattgtgaacaattttaaaaagacctcatcagaccatattgcatgttctcgtaaaggggaaaagaagtatataacagcatgtactgaatactttatacccattatacatcgggctttttagattcattctaccatttaatttttatggacatgctggggatacagtattgttatcatccttattctttagtgagaactgagatttacaaaagaataagtaaattttccaaaattaattactgataatgtgtacacagaccatttccaaattcatgagataattgctgttttagttactttgggctgttaaaacaaattaccgtagactgggtgacttaatcacaaaacgcgtgttctcacagttctggaggctggaaaatttaagataaaggtgcttgcacatccagtgactgatgagggcctgtttctttgtttgcacatggccattttctcattgtatactgacatggcagagactgagagagagaaagagattatctctttgatgtctcttcctataagagtattaatctcattcaccaactaattacttcccaagggcccaccactgaatactatcacactggggactagggtttcaccatacgaattttgaaggcacatagacattcagttttagcaactgctaacaatattactcttacacaaccatttttctcacttaaatattttcaattatttaataaatggaagcagtgggattaccttggtatggccataagaatttatctgggagatgtctatgtgtgtgtgcatgtgtgtgtgtatgtttatcgtggggaagaagtttgtgagtagaagcagcggattgagaatctggataataagaaaatattctattgatcctggtgatttgaatgtacgataggagctggttgtcaactgatttaatcagtgggtatttcagtatgaggcatagttggtgactgagctttcatgtggtaatctgaggtgaatattgacatagaattagaattataactcacataaattcacacaaaaacatttttacattgcctactgatttttatacatataaccaagaaataaagtatatgggggccacctttctccagggatttatagggtaattagatgaactctaccaataattataaaaataagaactgaaataacaaatgcatattctgaattacaaaaatcattcaaagtaacaaaaagcctatatctttgatcccaataacctattttaattttctttttaaaataaaagtgttagaggcaaaaaacagccataactaaaccaagtacagataaaggaaataagaatgagaaacagtgtatgtgtgtgtgtatgtgtgtgtgtgtatatgtgggcatgcctataggtatagttgtgtgtgaatttaagtgaacacacttactaattgaataaaatacagtaagtgt

SEQ ID NO: 128 - DNA, 2850 bp, Homo Sapiens
aaaggtaacatctacctccagaggtaagcataatttggcaaatatggaattgcctatacaactgctatgaataattcttagatgatggccaggaaagtttcctaaaaatagtttctggatgggagtcagcctcccaaagtcctaggattacaggtgtgagccactgagcctggcccaaaatgttttttaaaaaacaatgtatgattaaggatcagccatttgtttttaatgccttttaagtttctaaatctataataaatagtgcctccttgagtgtgtgtatgtgtgtgtgcctgcatgcacatatatgacactaatttttcaaataaattgggctatgtccagatgtggaatctcactcatataatcccagtattttgggagtctgaagcaggaggattacttcaggccaggaattcaagaccagcctcagcaacacagccagacctcatctctacaaaaaataaaagaaatattagctgggtatggtgatatgcacctatagccctagctactcgggagcctgaggcaggaggaatgcttgagcccaggagttcaaggctgcattgagcttagaaggcatcactgcaccccagcctgggcgacctcatctctttaaaagagcaagatcttatctcttaaaaaaaaaaaaagaaaaaagaaaacaaattgtgctagtagtcttgtagaacgtctcaattctgttttctttctttttcctttactctctgtatttccaataaattagaaattagagctaaagggtgattaggtccaggttgaacatttttggcaagaaaacttcctagatgatactgggcctgatcacttggctaaggtgacaacagccagacccctccaatggaagggaatgctccctctgccacagtgaatagtctatggacataccctctgaagcagcggaaaacctagtttcccatcaacctttcacctaatggttttagtatttactggagatccttgtctgaatcaatgatttcattagggactgcaaaatgatgatttttgaatcccatcattccttttgcatacatcagctgacatactctgtaaagagctttctctcatcaaatggggttatttggttatcttgagctcctattaaaaaaggcagaataatacttctctcattttaaaattctgatattcagaataaggagtattacaataggagattttattttgctttgcctttttatatttcctcattatcacccaatgacagtttctataaaaaaattgcaaactcattaagctaggcatctgaaagttagtcatttacccaccagcttctaacacgaaaacacattccttataatgttctcatgatggctggaagaaacagtgggaaggagagacccccaaaattgtttatattggctatagccacactgagtttccatggctaacaaaagctcaagataaagtgcttgaaataaccttgacacaattggtactgatagccatgttgaaccctttaaatgtaaaacaattctatttatataataggggtttatgtcaatttataaaaacagtgcttactttgcaggcttaatgcgggatcagaaatgttattttgagaaaagaaaaacagatgataagtttgcttaagtggctttgtttaaaaaggggatgaaaacagttctgtatacttgattttaaaaacagaaaaccattttaacagaaacccacaacaaaactggctataaagatagattccaatataattatggaaattcatttgaagagattgtttctaaaagcagcccatactgtcctcatttgtagcaaacagaagaacatcaatttcaaaagacaagtaaaattaatgaaaggaaaccagataagaaaaattgactgattcttatatttctgggaaaacggtgttataatttttttttgaggaaaatgtatgactagaaattaatctcaattggagagctttaaaaaggcttttcttctccgttctagaagaccaaatttgcatgtttctctataattctgggacacagatttgaaggcagtgcaaagccccagaatgtaaataagaattctgtcctccgatcagttttgcaggagggcagaggctggggagatttggtctgatgagaagcaacccctgcatgagggttaaagcctggaatctgtgccaggcccacagacggtggagttgctagattttagtttctctgacatttgaaaaataatactgaagctcttgaaatattattgtacttttaaactattttctatatagaagtgagctatcttttgagtgaaagagacaaacaaaagatctatttttccaagccaatgtgaacaagtcaacaggagcaaagaaattgcactctggcaactaaacaaactgagtcacagtccatgtgggagaagaaagagagtcagcattgtttgtgcatcagtatcactagttttcagctaaatatactagctggacattaacaagtatattcttacactttttggaaatatctaacaataaccgttagactcagctacttgctaatgaaatggctcattgatgtagctaagagaagctttagatcatctgactgagtataagaccagctgactggctgggcgcggtggctcacgcctgtaatcccagcactttgggaggctgaggtaggcagatcatctgaagtcaggagtttgagactagcctggccaacatggtgaaccctcatctctactaaaaatataaaaattagccaggcctggtggcgggtgtctgtaatcccagctactcaggaggctgaggcaggagaatcgcttgaacccgggaggaggttgcggtcagccgagatcgcg

SEQ ID NO: 129 - DNA, 2296 bp, Homo Sapiens
gacaggatccagagacactctcagtcttggaaatcctaccaacaaggattcaggaaggattcgccctcaggctgattctggaccaaaacaaacagaacattccacctggcagcagccaagtccccagcactattgtgccaaggagactctttgatttgcctcaagcccagagaataaactacgattccaggggacagctgactccagcccatctaccatgctccagtagagaccttcaggtgacccaggtcaacaccaagccaccctctggaggatctgatgctgcctcagaaacaacacctcatgcctcatcagatactaatggaaatgttgaaaggcttttataaaactccagggaagtggtttgaggaacattgagaaagaacatattgttccagcaggaaactgagtgcaaggcagacactatggcaaaattccagttacaccagaattatcctcacagtactttacaaaatcctgtctgggaatctccactctttcctcactgtcgcccatgcaactataccatcatctagatgacttagggagattctccacgtggtagagactaatctggaggcaagaagtccaggatcaaggttctggccaattcggtgtctgggagggctctcctcctggctttcagaaggctgtcttcccactgtgtccttacacggcagagaaagtgtgagctctctggtatctcttcttttaaagacactaattgtatcacatcaaggacccacctttaagatctcatttagccttaataacttccttaaaggccccatctgtaaattctgctgcattggtgactggggcttcaacctaagagttttggtgggacataaaatctcagtccataacacctggcaaactctcttaatcttctaagatataattcaaaccttgtttcctttggaaagcctccctagcccctaaactataattagatgttttctcctcaatcttcatattagttcctatcatgcagtattaattacattgaacaataattaagtacatgtttgttcccctcattagactacaggacatttgcattactctgttttcacattgctgataaagacatacctgacactgggtaatttataaagaaaaataggtttaatggactcacaattccacgttattggggaggcctcaatcatggcagaagatgaaaggcacgttcttacatggcagcaggcaagagagagaatgagaaccaagtgaaaggggtttctccttgtaaaaccatcagatctcttgagacttattcactaccatgagaacagtatagaggaaaccgcccccatgattcaattatctcccaccaggtccctcccccaacacataggaattatggaagctacaattcaagatgagatttggatggggacacagccaaaccataacaacattgaaaatcagggacagtagtttgtttgctttttatccctaacacctaggacagtgcctggcacaaagttggtgtttaacaaatacttaaggaaagaggaaaagaaacattacacctctagaagaaagtgtaaattttccaaacaattgaattacaaatgaatgccagaatatccatcatccactgaatttgtgtcaatgatatataaattcaacttccagatgtagtggttaagagtgtctgggttaatagaatactatgcagtcataaaaataatgaactcatgttgtatgcagcaacaaggatgcagttggaggctgttttcctaagtgaataaacacataaacagaaaaccaaataccacgtgttctcactaataagtgggagctaaacattggatacacatgaacataaagatgagaataatagacactgggaatggcaaaaaagggaagggggagtccaagggttgaaaaactacctattgggtagtatgttcactatctgggtgacaggatcaatagaagcccaaacctcagcatcatgcaacatacccttgtaataaacctgcacatgtacctcttgaatctaaaataaaataaactgggggggaaggggaagaggagaggtggggatggttaatgggtacaaaaaaatagaaagaatgaataagacctactatttgatagcacaatggggtgactgtagtcaataataacttaattgtacatttaaaaataactaaaacagtataattggattgttcataatacaaaggataagtgcttgagggaatggataacccattcattctccatgatgtgattattatgcattgcatgcctgtatcaaaacatcacatgtacgtcataa

SEQ ID NO: 130 - DNA, 1963 bp, Homo Sapiens
tacaattttgagtaataagaacagaaatcaaaagtaactgttgtatgttatattttagtagaggaacactgaagaagaatgaaaacaagaaataatattaaatatgaacatatggagaacagaataatatttctaaaatttttagtttctaagcttatctgaaattttaattttgttttcttatgtaataccagagttattaggaaggtattatctactaacactattttcagtgatattttaagtagttgtcctagttaaatttctattttttaaaaatgtatatttaaaaatacattaaatgtgtatatacatcaatcatatgtatcgatttctgtttttcttgaattgcaaatgaaatttgtatttttgtgttcctggaataaaataaacttgaatggattgtaatattttattcatgctgtaattcaatgtatttgaattctttaagaatgttacatttacagttaacagatactgacctataaattttctgtcatataatgatgctgtgagacaatctaagaagaattaaaatttaaattcatgtattcttacttttttctctgttctctaactgtaatatattttaattacagatggaggaacagacagatgttagataaatagatatataatatatagatcatccaaaattcttattcttatggttttatgtagtcagtatttacctctatttttctacatgtttatccttccaatttagttcattatttcctgcacctttgatttcatatatataaacaggaaataacacatggtggccgttatgtagagagagccacaggacttgtgaataaaatccacaggcaaggacgtggcgattcgttttgcaatattggagggaatgccaaaccctatgtttgctgtggaaaagagtatggtagttcctcaaaacatcaaaatggtattgccttacgattcagcagccccacatctcaagacagcaaaagaattgaaagcagagtcttgaaaaaatatttgcacatccatgtttgcagcagcattattggcaatagctaaaacgtagaagcaattgaagtgtccaacaacagatgaatggatatgcaaaacatgatatatacatacaatggtaaatcattcagccttaaacatgagggaaatattcagacatatgttgcatcttggatgaaacttgaggatattatgccaagtgaaataagttagtcagtgaaggacaaatacagtacaattccatttgtataagagacttaaactggacagaatcatagagatagtacaatgatgaatgccagaagctggggggaggaagacatgggaaagtactgtttaatgggtatagagtttcagtttcacaagatgaaacgagttatggagatggatggtagggacggctgcacaatgttatgactatatttagtaccactgaactgtacatttaaaatggttaacagagtacattttatgttatgtgtattttaccacaataaaaaaataaaataccttaggaacattttcctgaaagagtccacataaaattcattttaatgcatgtgtttatgcatagctttctatttttctcttttctatttatattccaaattagaatataatgctaatcaagcatagtggctgtgtttcttgcttcctctagtctgcaggtagcatacaaatgtaagaaactactaattaatgtcacatctatttattttctgctttataccaagcttgtgggattctcttaaatacaacatttttatacttacacctatgaaatacccattaacatcgccttcctaaatcagtggaaattgagtctctgtaaggtgcagtaacttactaagatacaaaactcagcatttaagtctgtatacttcaatatcctgccctcttctcatttgtctttactgccttttatgtatgtgttagatgttcaataaattctcttttttaaactgaa

SEQ ID NO: 131 - DNA, 3928 bp, Homo Sapiens
atttattttatttatttatttttattttttatttttttagataaggtcttgctcttgcccaggctggaatgtaatggcatggtcgcagctcactgcagcctccgtcttctgggctcaagcaatcctccttcctcagcctcctgagtagctgggactacaggtgtgtgccaccactcccagctaatttttaaattttgtgtagagatggggtctccctgcattgcccaggttggtctctcaaactcctgggttcaagcagtcctcccaccttggcctcccaaagtgttgggattataggcgtaagccactgtgcccggctgttttttgttttgttttgttttgtgttttaattgaacggactgaagtttactttctaactaggttagccctccattcatacaaaattatgagcccaaatgtcttggggagagtacaggagaggccagatcttaaaagccaggagtggaattaggtttgagcatatgtagcaatatggaaacaaagagtgagtcaatttataagcataccaatcttcttggagacaaaagtttgaattgctcacgtgtccattttttttctggaatccctgaagaaattttgagatactgagtactagaaaaccctctttgatgagggttgtatactttatttttaaacagtatcaacaccgttgaggcccttcaagtctttgcagtcaaaagccatacactttttctttgagtgagcctttactttaaggtatgtagtagaataatataggtatctgaaaaagaacttggttcatgacatccactcattcatttatgcacttagcaaatattcattgattgccaaatacgcatcagacactgagctaggtgctaggtactaggtaaacaaaattccctgccttcatggagcttagcttgtggtggtggaaagaagccctcagcctgaatactcaacttatgtctgccgtttattccttaacacattaaactataggtaatagcatatgttagtctaatctttgtttagcaaagctatttcttgttctggaatataagtacagttacagcagaataagtaccaaggcaagattggagaatgaccggttgtgaacagggacttaggaatatgtgtagcataggattttattttagagttgttaaaatcagatcaacagagcatgtttttatgggccatctgacaagactagaggtagctttggaacctcttattccctggaatgcaaacatgtatttgcatttcatccactgtcagtatgaggagacaaaaacgaagtcaggattttggagctggaatggatcttaaatactatgtagtccaaacgtttggttttacagatgcactttttccagagtgctgtcatctcatatacttttttcttcatacaggtttttaatgtaactcactcagatcgttggtgatagactctctcttaaaacttatttatcctaatcttttttttttttttttttttaagagacagggttttgctctgctgtccaggcacacaatagctcactgtaacctccaactcctggagtcaagtgatcctcctgcctcagcctctcaggtagctgggactgcactactagtgcactaagctaatttttaaattttttttgtagagacagggtcttgctgtgttgcccgggctgctctcttaactcctggcctcaagtaatcctcttgccttggcttcccaaagtgctgggattacaggcgtgagccaccatgcttagctgatttgccctaatcctctgctgacattctgatatcggacaactaaaattataacattgggcagctattttgtatgatatatagggtagtggttcttaagcttattggtgagtaaccttcacttgggaagcttatttttaaaaatgtagaccttcattactttcctcctgagattttgaatcagtacctttgagagagggtccagtaaatctttgttttgaatgaactgatggttttgaagcaggtgacctggaggactgcatgtagaacacagtgatgtcaaggagtaaaggagagaacagaagtgagattagcactaatcacctctaatgccttatttccagtaaagtttagagaagaggaaaagctacttggcttgctcctttgaaggttttgtttccctcttaacacagaaattaaaaggtagaggagagatgctgaatgatgctttttttcttcttaatcttggggggtcattatgattaagttattgaatccatatcaccgtatgacagcacatgatgaaagaaaatcaaatgtttgtttcaatcaaagtgaaacaaaatgagaataactatttgggcaaaacacttttatcactgctaagatattactagaactgagcagagaaatactcagagagagccatggcatagtactaattaataatggggtaccatttagcaactggaatattctccgatgatgcctgtttaattacccataggtgctaagtgaatgttaaaaattacggtgctggttgagtaggccgagtagaatttgtgttagggcacatcccatggagatcttttttactgcttaattttttggagttacctcagtaacttaacaggcaggaatatggttttaatggaaaggaaaccatttgcctttaacagcattagtcccgctaagagaaagtttttgcttgtctagtttattacaggtctttgactttgtcagtatatggcaaatttagtataaaagatgattaattatcaaggctgatgaaatataggcagctgaaaagaaaattcttagcaattcataccttagaaggaaccctgaaggacaggacgccatagaaatcctgtttttttaaaaaagtaatttcaagtaagtttgcaaatgcaatgctagtaaaaagtatatagaggtatgtctttcacactatcttgttactattagaatttttgtagccatgtgcagaggagagaaaaggtgttggattttctgcagttctgattcagttctaagaatttggtgtgaaaagaatgtttgcaaaggagcaggcacaaaggtgagaacaggaatacgaaacacaacatctgtaaatgactaaattcagagggaatttagtggggcatatctcttaaatggttttgaataatttggtgttttaaccaatgacttaatttaacttagtgggtatactgttcccagtcccattactgatttttattcctctgtgataacatacacccaaataaagactgctatgtatttgactttaaaactataaagatgtaaaaaaggttcactaagccaaacaccttagaaaatagcctcagctatttgctatgtttatattatacctgcataaaagtatttatgtatagatgtacttaccttacacagtaagtacctaaaatttgtaaattgaatacttttgaatgtaagcagttgaagtaaaacctgtagtgagttcttcagtcagtcaacactaaacctgttttgtaaatttgatgctagtattatactggactttctcaaaatgaagtacacctatatatgcatatagtatatgagcatgtgtatttgtacaaaagcccttcaaaaggagttcagcttttataaacaccaaaacactctctgcctgtaaaatgtttttgctgaaatttgtatcattaactctcaaatttacatcttcatgtttgagatacgcttttaggactgtctatgcatgtagactttggtcaactctctcctcctccctcaataaatcagttaacttaaaaaatatattgtgaccatttttataaaatacatgttcataaaacagatcaacatatttagcttatacagaaataaaattaagtcaatccactcacaaagaatttctattttgtaaaaatgtagcttgtatttcagtataataaaatctgatgtaagaaactgt

SEQ ID NO: 132 - DNA, 1590 bp, Homo Sapiens
ttaacattttgattacaattccacatgagtttctgtagggatacacaaccaaatcttattattctctccctgcctccccaaatctcatgtccttctcactttgcaaaatacagtgatgccttacctgccatttccccaagccactatgctttttttacagcctgcagaaccatgagccaattaaactcctttttgttatgatcatacagaaaattagtactgtgaagtgaagctatgaaatgccttcagtgacttttccccatcgtcttggctaagacccccaaggtcttaactcattccagcatttactcaaatgtctgaagcccaaagtctcatctgagacaaagctgcagtctcttctgcccctgagcctctgaaatacaaagtaagttaactacttccaaggtacaactgtccaggcattgagtaagaatccccagccaaaaggaagattttcaccagatagaagaataaaatacaagtgggacttacaggtcccatgaaaatccaaaacccagcaggccagtttttcaaacctacagctccaaagtcatcctttttaaatccttgtcccacatccagggcacaagggtgtgagggctgggctcccaaggccttgggcagctctgcacctgtggctttgcagtgttcagcccccgcagctgccctcatgggctgtgctggtgttgagtgcctggagtttttaacccatggagggtatgaaacttttgttgggtctatgaatctgggatctgcacgatggtggcctccagtgtgggggctccaacctcatattttctttctgcactgccctagtagaggtttcccatgagactctgcctcttgggcagccttctgtctggacacccaggcattttcatacatcttccgaaatctatatggaggctcccaagtctctggactagtgctccgtgcacccactggcttaacactatatagaagtcaccaaggcctatagcttgcaccctctgaagcagtgacccaagctgtacctgtacatctttcagccaaggtcagagcaggagctggggctgctgggatgcaggcagcagtgtcctgaggctgcacacagcagcagggccatggggctggcccaggaaaccattcttctctcctaagtcccagggcttgtgacagcaagggctgctgcaaacatctctgaaatgcctccaaggcttttccccacattgtcttggctattagcactggcctccattttatgcaaatttctggaggcttcatgaattttccccctgaaaatcagcttttctctttgaccacttggccaggctgcaaatgttccaaacttttgagctctgcttgccatttaaatagaaattccaacttgaggtcatttcctcagtcacacataagagcacaggctgtttgatgcagacaggatccctcttgtgctatggtgcctagaagttcattccaccagatatgcactaaattatcaccctcaagttcaaagtttcacagatcttaagggcaagatcgccctgcagccacgttctttgctacagcaaaacaaaagtaaccttggctcctgttcccagtaagttcctc

SEQ ID NO: 133 - DNA, 2047 bp, Homo Sapiens
cagagtttcactcttgtcatccaggctggagtgcaatcttggctcactgcaacctccgcctcccgggttcaaacaattctcctgcctcagcctcccaagtagctgggattacaggcgctcgccaccatgcctggctaatttttgtatttttagtagagatggagtttcaccatgttggccaggctggtctcgaactcctgacctcaggtgatccgccctcctcagcctcccaaagtgctgggattataggtgtgagccactgcgtccggccaagacctaacttttaatttcattgattttctgtgtcatttttatattctctatttcattaatttccactctaatccttctttgggtttactttgctcttcttttttcaatgtcttaaggtagaaatttaggttattgatttgagatcattcttcttttcctttatttatttatttagagacagggtcttgctctgtcacccaggctggagtgcagtggtgtgattgtagctcactgcagtcttgaactcctgggctctggcaaccctcctgccttggcctcccaagtagctgggactacaggtacacgccactgtgcctggttaattttttaatttttattttgtagtgacgggatctcactatgttccccaagctggtcaggaactcctgggctcaagtgatcctccagccttggcctcccaaagtgctgggattacaggcgtcagccactgtgcctggcctcattcttctttttaaatgtagacatttacaactttaaatttccctctaagcattgttttacttgcataccgtaagttttcatatgttatatcttcattttcgttcatctaaaaatattctgatttcccctctgatttcatctttgacccattggttatttaggagtgtttgtttttcacatatttgtgactttcccagattagttattaacttttactctagtgtgatcagagaacgtactttgtacgatttcaattcttttaaatttatggaagctatttttttttaattgaggcttttttttttaaagatggagtcttgctctgttgctcaggctggagtgcagtggcaccatctcggctcactgcaacctccgccgcccgacttcaagtgattctcctgcctcaacctcctgagtagctgggacctggtaccggtgtgcattaccacatctggctaatttataaattttttggtagagacagggtttcaccatgtttgtgaggctggtcttgaactcctgacctcaagtgatccacctgcctcagcctcccaagtgctaggattataggcatgaaccactgtgcccagccctaattaaggcttttttatttttatttatttttaattcatttattattattactttttgagatggagtctcactctgttgccgaggctggagtgcagtggcgtgatctccactcattgcaacttctgcctcccaggttcaagtgattctcctgcctcagcctcccaggtaactgggattacaggtgtgtgccaccatgcctggctaaattttgtatttttggtagagacagggtttctccatgtttgccaggctggtcttgaactcctgacctcaggtgatccacctgcctcagcctcccaaagtgctgggattacaggtgtgaatatatatatgtatatatgatggtatactactcaaccataaaaaggaatgtattaacagcatttgcagtgacctggatgaaactggagactattattctaagggaagtaactcaggaatggaaaactaaacattgtatgttctcactgatatgtgggagctaagctatgaggacgcaaaggcgtaagaatgatacaatggactttggggacttggaaggaagagtgggaggggggtgagggataaaagactccaaatatggtgcaatgtacactgcttgggtgatgggtgcaccaaagtctcccaaatcaccactaaaaaatgtactcatgtaaccaaacaccacctgttccccaataacttatggaaaaataaagtaataaaaattaaaaacaaa

SEQ ID NO: 134 - DNA, 2918 bp, Homo Sapiens
ttacaagtgagtggataaatggtgagaatttatcacccctttgaatatcaggaagaagacaacgatgcccactctgttaccacctctaatcagcactgcactaggggttccgaccagtgtagaaaagcaaaaaacaaaacaaaaataaaaacataaagtaaaaatccagaacaacaggaatgggaaagaaaacccattactcatagaaaacatgactgtgtgcctaaaaatgaggaaacagctacaggcaaatgattaaaattactagactgccggatacaaattaatacacaaaaatgaatttccatgaaatggcaacacataattaggaaaatgaaatccaagcacatttttaaaaacagcatcgcaaaataacaaggacctaggattaaatgtaacaaaagacatacaagaccactgtgaaaagtatcaggctgtatgaacacccgctgaaggagccctaacatttggagagacagataccatgttcagagcttgtaaaacccagtactgcaagtacgtcaatgattcccaagttgatctacaggttcaacacaatcccaaacaaaatcccaactcgaccggctagttctaaaatgtatgaaacacaaagggtcaaaaacagccaagacatcctaacataagatggaggtacgcgccccagagtgtgtggtattggcagagacagacaaggagatgcagaaacggacacagagatcatcctgacaaaggaatcttcagcagccgggactgggaaaactgggcttatgtctgcaacacaatgaaactggatccttaagcttcacaacaggcgcaaaaatcaattctgggtagaatctatatctaaaatccaaaatatacaaaactataaaatcctttggaaggtaacagagtatctttatgatcaaggcaaagtaaagattattaaaaattaggatccaaaatgctttaatcataaaagaaaatattgatacattgggccatattaaagtttaaaatttctcttaaaagacaccattgaagtaaaaagacaagaaaagctatttgcaaatgtaattcacaaagcactactacccagaatcataaataacacctgcaaataaatgagacagaccatccaatagaaaagtagggaaaatacttgaataggtactttacaaacaggaaatcccaatgagccgcagacacatgagaaggtgctgaacaaggagaagccaatgaaaccagaaagaggtctaccccacacgttccaccaccccgcgccctccgccaccccgcgccctccaccaccccactccctccactaccccacacccaccggagtgaaggtgctaacacttcaggcaatgggtgctgaaaacatggaccggcagacgtggtcatacacaactagcagtcgggcctgcgggtaccaccactttggaacagttgggaatttctagtaaacctgttaaaaacatggttaagcagttaatggaaacgtgaacataatgggatataaaactaatgaaaaaaatcaaatggagtttttttgttttttttttgagacggagtcttgctctgtcgtctaggctggagtgcagtgctgcaatcttggctcactgcaacctccgcctcccaggttcaaacgattctcctgcctcagccccccaagaagctgggactacaggtgcccaccaccatgcccagctaattttcatttttagcagagatggagtttcgccatgttggccaggctggtctcaaactcctggcctcaagtgatcctcctgcctcagcctcccaaagtgctgggattacggtgtgagccaccccgcctagcctcaaatggaattttagaacaaaaatatacctaatttctgatataaaaaattcactatacaagcttaacatcaaattaggcaagtggaagaaaagattagtaagcctcgcaacaggacaataaaaccacctaaaggaaaggatgagagaacaaggatgaaaaagcatcacgtttagtgacctgagagacagtatcacagtctaacagaaagctaactagagtcccagatggggacagggaggaagaagtgagagacggggtcagacaagaaatatgagtagtggctgcaactttgccaaatctggtgaaaaatatgaactcacaggtccaagaagctcaatgaaacccaaacgaggtaagcatctataagcttaaagtggattaatattaacatcttctaatactcttacatacataaattacgtgatgacaaattaaccccatcccaaccctacagaaaataaatttggtatgacacattttcctgttaggaccacaactggacagagaggtgacacaagagggcagcctgaagcctagcaagtcctcttcggggaagagacagcagagtcccacctctgatttccccagggatacaatccacacgcacacacacacacacacagaagcacacacacacacagctagcagacacacacagctagcacacaagcacacacatagcaagtgcacacacacagcaagggcacacacacacacagagctagcacagagcattttcttcttaggcctgctcattcttcccaaatcagttgaacgtcatttaaaaaatgaccttgtcttaccaatcacagcaagtatgacataagatatgaagtttccaaactaaaaatctagttttgtgtcctattatgacataattttcagaactacactgcaaacaagagagcgagccagggcttgggtagatgtttccgctgtgatatgttaatatcataagacaatatttttaaggttttttcccccacatctataagtgtcacttgtgttaagtctttgaacttaattattcccactcacctatcatggtgcacagcttgttctataaaaaactcaatgacaaactcagttataa

SEQ ID NO: 135 - DNA, 1836 bp, Homo Sapiens
gactgatcaggaaacttcctgacttgccaaaacaattgaatctgactctgctgcccgacacgatggctgtgcaaacataagtcatttcccctccccatttatccaaaggtcaatcgaccatgaaaaatacactggaagataactaagaagaatttaatcagaaaactgtgaatttggaactgaatgtagtaactgaaaacatcttgaagttgtctgtctttgaggaaggagtgggtacattttcatttatatatgggatagttctctttcttaagaaagtaatatttctggaatttatgaaaataagggttcaggaatgcacagggcagccaaggggtggaatgtagtggtgagagcacatctattttctttgggtctactaattcccctccccatttctatgtgttcacactgggattgtccatcatgatggaccatcatgatgatggaccatcccaatgtgattgtccgccctcattagttacaaggtgtttcagttatccattgctgtgtaacagatgacaccaaaacttagtggcttaaaacaaccataacgcattatatcccatgatttgtgggttggctggattagcttggccctgctgctgttctgtgtgattgttgtggtacattctgcaggtaactcatctgctgggatatatccaggatggccccgaaagactaaaaatgaaagctgcaaggtctctgacgacataatcccaaaagttatacagtgccacttccaccacattctattggtcaaaatgaatcaaaaggccagctcagattcaagaggagaaacatagactgtgcctccctcttaaggagaggagcagtacgcatagacaaggatgagagaatgttggtagatctctttgctgatgatgtattacacttcaccctggctacaaatatttatgtctctcatgtgtacaaaatactctcagacccttgcaagatccctgaagtctcatccaatcatggcataaggctgctccaagtccaaaatctcatcatgtaatgaggtctaggtgcagattaaacttcttaggtgtgatttcttgaatgtaatgccttgggtgcaacaccacttgatccagtggcctgggcactaaaaaaaaaaaatgatcctctgcataaacactcaatatgcaatgataagacaggaccaaagagctgcatttgatacttgtgtttatgaatgggaaaggaggaagaatgggaagcacaaagccatcattagccactctgaaatttagccaggcatatgtaacttgtaccctaaacttagttgcttaaaagagaaaactataacaatttattctttgttgatgattctatacattggctgggttttgctggatggttctgctccatgagccgttggctggtgtcactcagatagctgcaggactagcttcatgagcatgtgaccagggcattttaagggccctgtacttaaagggcctcaagattgaggtttaaagctttgtggtcactatcttaaaatagtgatcacatttatctttgaatttgtgtttcgtaaataataggacaactgaatattcacagagggcttggaacatgtggccctgcttcccactgtatcactcctgtctccccaccacatccccagacaggatttttagccaccttctccatgtaccttgatgtcctgggctccacctagcattcctctcttggcttctgccccatgaccactgttgccctccacctgggatggtgaccaggttgggtcagcaaggggaaagtctgttttctgccaccaccctctactctctagtgttggagggacccaggcacagggtgttggga

SEQ ID NO: 136 - DNA, 10782 bp, Homo Sapiens
gatgggtcttgggggagaccaagggtgccctgctcaatgtcagccctgactctgtgccacgtgcactcagctctgccacggaggtgcatggctctgtagacgtggacggtgagctggggaggaaggtggtcttggagagaaatgccccatggggagctgagacctgtgtgtcatgggatcatcctggatttggcttaaaatccacgtggctgtggaaatcccagggtgcaccgaggatctgtgggggagcaggggtctcttaaattaccacggtgccagctacatggcccgggtgggtggttccccacactgcctaccccttcatacctcgccccattacaccctcctggaatcattctcactggaggctgcaccgtttcctgctgcccacgatgaacaaagcaggaaactgtcttttccagacttccccacgaagtgaggttttgacgacctcattctccaagagcaaacccagcccctggagtccgttctttccctgcgcgcgtggacacccctgcagcagtggctccttttggtggccgctcttcagacacgtgctagagagcaatcattgatgacaacgttttctttcaaaaggcccagaaaacaaaattaaatcttgggactcgaagcttcctgggcctgtgccacgaaggcccatgcttagccggtctggtgccaggctctgtgacgtgtggaaaccaggcccaccgaccacacagcagtggctgaggatggctccctcctcggctactctctgaaatggtagaggccactctcatggctgagtggtctccgccgttctgcagaggtgtggataagaacaggagttcctgcttgtctcctaggggtccgtattgaacgttggcaatcagtggaaatcctgtctcaggccctctcggggccccacactgatcattgtatttaaatcctcccagtgtcctgcagacacctacctcccagaccaaagagggaccttgctggtggccaggaaacaagctgaagcacagagaggagagaaagagacagagttgggtcctcgggtcaccttaaaaggctgtgagactttttgccagggcagggcctggcgggtggtggagatgcaggatgaaggacttaaggagggatcttttactttcagtgtgaaagtgacctgtgtttttatgagggggctagagaaatactcagaatctgagagcaggcagttggagtgggatctcagcaaacttccgtgtctgcatggtcctgcaaccatcgccctggacagaggtctcagctgggtagagatggacggttgtcagggcacagcctgtccttagggggtgctaggaatggggattggggtgaagaggagttcaggaaagaggggtgaggcatggggaacctgctggcttagaggatgcaaaggggcaggttttatggacgctttatgcaggtccctttcataaagatacttgcccagcctgagcagaaacccacaccctagagtttgtttcttccctgtgggcaccccccgcccccgcagcagcggcttctttcagtggcagaggctgactctttttgcagcttctccagcacttgcaaatgcaacttccttgcacccacttcagacactttacagctggaaccccttccttcaaggttaggggcccaggcccacagcccctacctccaagtttccacgtttgaagaatcccaaccttttccctttgcctcctcagcctcaggggtgacacctcagagctcctgtttacctctttagccaccaggttagtaattttacacccatgcaagtgtgtacaggaatcttccggatccaagtggctggtgtgggcgttgtcttctgtctgaaccctggcccttgtctgtgcagattcctcccctcctgtccgggagagaagagacagtttcgatgtcatgtggagacaggaggctgtggtcaacgaggggaggctgtggtcaacgaggggaggctgtggtggggggtggcgttctgagtcacttggctggcttgggaatgtgagctgggccaggtgcaccttagagagcctgggtggtgctggggaccttcaggctctggagtcctgggtgaccctgacaggtgcatgtacccacatctccttggcccctgtctctgttgctaatgtccctgcacagaccccccccagccgtcatttacagattcccagcagtgaagcacacgggcttaggttaaaatcactgagccccttgcacagcggccttctggtcccctctgctgtaaggcaggaccacctgtcagcccctgtcttctggggaccccactaggcctaagagatgaggctgtggggttctgtcttctggaggccccactaggcctaagagatgaggccggcggcggaggtctggcctggaagagaaatgtggtgagtcaccccaggcctgacagattcactcagacctggtccttctgctcctaggctgagccatctctcagggaccctcctgccctccttcacctctcacctggcctgccccaaccagttctccaggcaagcccaaaccagttccacctggtttgtgactgtgtttggaaagagggtctttgccgaggtaattaagttaaaatgaggtcatgtgagtgggccctgagccagtctgatgggtgtccttacaggaagacattaggactcccagagggtgactccaggggcaggtggcttggaggactggccgtgcaaggaggcagcaaaggggcggccatctgcaagctgagggcagaggccttggaggaagcagccctgccagtgctggtaactgggctggagagacttcttcatgaaggaatacagggacagtcacaggagacaggagcaccaagggattcggacatgtggctgacacagtcttctggagagccccggatggcatcagggggaaacctggcctgagacagtgccctgatggacaaggacaggaatacggtcatacctcctgcccacttgaccaacgaccaggatgagaagccaacagatgatgaatatgaattaaagttggacaactagcaagtttaaaacttggactgggacctagatcttccgattcctacagctagcctccctttccatcttctctgtggtcatcactaatgcagtttttgaccgtcttgtccagaagctgcaaaacagacaacagaagccaggactggccctgccttagatggctttcagtgcaggaaagtatcaagacagtcttgttcgtagcgtatatctctctccaccttttctgctaagcacctcatgtatgcagctgccaatgtaacacctccatttgcgtgtttaatcaccatctcaagctaatgtaaccaagcagacttcttggccttcatccctgcctcctctagtcttctcatctctctctctctctctctctttttgagacagaatttggctctgttgcccaggctggagtgcagtggcaccatcttggctcactgcaacctctgcctcctgggctcaagccatcctcccaactcagcctcctgagtagctgggtcttcccatctctttaaaaaacaattcaattgttcagaacaaaaccctggagtcatatttaattcctcccttcctcttgcacttctaaaccaatcattcatctctactttgaaaatgtttctttattcatccagtgcaccaagccaccatcacctcgaggcaggaatattcaacggcctcataagtggtctccctatttgtgttatattcaatgcatgtcttttcttactcaaaatcctataaaggcttctcttcaccatccacgactgtttcctgccttcctcactatgatcccatcactgacccctcaagactatgttccagcctactttctgctccttgaccaacacccttactctgattcccacttttgtgacttcacatgagtcccctgtctgcctggacactctgcccccaaccttgaagtgctcacccttccctgtcactcagttgaaagtcaaattccatttcctcatgagggcttccctgaatacccacttttaattaactctctgcctcctcccatcacttctgttttaccccctcttttagttccttcctatcttagtttcataagagccagggccgtttccgacttctttccccgtcaagcctccttagataggacaggtcctctgcctcaccgactttaatcagtatttgctaagtaaacagagcacaggaggatcctgttgtcatcaaagagcagctctgcctccaatggcgaaaggattgttggaacctcatccttccttcaagttctggttcaaaaaattccatgctatgcctcacatggccttgcccaggtgcctgtttgatttgcctgggttgtctgttctttcttccccactgtcctcatttgccatgtggctcggtggtggctggagacctccatgctggcccctgggagcagctgctaaggctcggcgcctcaggacaccttggcacctgtggatatcgaccaccaggcttctcttctgttcatgtctctgcaagaatgagaacctgcccccataccatttgtgctgtgtaggcctcaggaggcatggactcacgcatccagcttcctgcaagccctctggtacatcgcagtgttcacccccagctttctattacagccaccacccagggactctggtgcaggctccttagagagaggccaggaaactgccgaggtgataagtgacagcaggtctcaggggaagagaggacttctctccttagtaaagaacctgtcgaggtcggaaagacactccaggctcaaagccaaatttgaaagttaggctgacagcccaactagggcagattggaggagccaggtggagagaggatgtgggggagtcaggaaagaggtggaaggagaagcctggaagagtggctccgctcctggagtatggccagcggcacttcgtcaggacctcgaccttcacccactagtgggagggtgttcctcgcatgacttgtaggatcacctgggaaacacacaaatggaagaatttaaaaatatctgctaggacaccccgtgtcccccacaactcatcacagagcaaacccatcacagagcaaactccttggctacttcttgtcttgggccgtcttttcatctggcctgtttgcctgactggactttggggtctttgttcccagcatcaaaatttcctaccagcgactttccatcacagctcccttccagtcttctggaaattgtcagatgtgcctggatttgcagggcctgcacaagatatgctgtcgatctgggatttttggggatttttgcagttcacactccaatgtgcaacagcaaccaaacggagatggaggacgtgaacatgaactactggagatgctgatgaaacgtgtgtaaggaccgcaatggtatctgtgtcctgctcgtgaaattgaccagatacagcggcttccttttgcttccgaaggcccggattgacctgacaattgatatgctttgctctatactccaactcccattgaccatggggtgaaagcaccctttctcggtcagcctcactgcttccccgcagatggagggattttctgcaggagcatgggccctgggccttcctttcccactgtctcttgaaagcctcctccagatgtgctgcctggctcagctctttgggtgacttttgttctgtctcatgtgacccatcaagattcacacagggctgtgtcccgggcagggctggagtcgacattcagggaggagatcactgttctggaacagagcagtgattggtttaattgaaatctgatagatcatcatgtaaaaagctggcatgtaagcatgctcccggagcctgcagggccctgcgcggcctcttgcctggccatcacgtagaggcggtcctcttgcatggttgggggcctcacctgcaccacgggcccccaagccaaacagtgagattgtacggagaccatcctggtcaggtcttgcagtttgcaccaggtagccccaggctatcctgccgtgcaagagctgccttctcagcacagtggagttctacggctgcctcggctgcagaggtcagctctggagccttgctgagcacctccatggatgcattttgcaaagggccgagtaagaggcattaacgtggcctgtgcttagttcctgacagcaagcgggattaaacccggattaaaggatcagccctaaaccaaagcagaccagtaataggtctcatgataaaagcagccaaataataatagtaaaaatctattcttggacttattactttcctgggaaaagggctatttcttgtgaaatatgcagcgattggaactttccccgacagcccaccgtgagctcactcactgcccctgcctgtgctggggggtggtgggtggtgagaggtgcaagtgaagggtctggacagaggcagagggaggagagggggcagggggatggggaggaagaatggggggttcgctctgggatagcttcatgatccactgaacctttcaaacttgatgcttgacgttttgaaaaaaatgacagaaaatatgggctgggcactgtggctcacgcctgtaatcctagcactttgggaggctgaggtgggcagatcacctgaggtcaggagttcaagaccagcctggccaacatggttaaaccccgtctctactaaaaataagccaggtgtggtggcacatgcctgtaatcccagctgcttgggaggctgaggcagaaaaattgtttgaatctaggagacagagattgcagtcagccgagatgctgcctctaaactccaggctgggtgaccaagtggggctctgtctcgaaaaaaaaaaaaaaagtgtactagggggatgtcgttgaggggcttagccacatgctacagatctttttataccaagatgcattcaatgattagctaagttggacagtttgttactttaagcctccacaaccaaaggggcaagataattatctcccagagaacaagttgatcttctttgaaggataaggagttccccaagcagcaggaagagcttctgttcccaattccagcctttgaagtttaagcttcagaagaaaaccttagcatttaatacaggaaggcatgcacgtgtgtgtgcatgtgtttgtacccacacatgtggctcaagcttccctgtgacaatgggttgcctgcgggtaagcgtgggatgtgtggagaaggcaggagggtttagggcgtgggctcagtaccctgatgagagatttaaagcaggcaaagggattcggcaaagtgcagctcccatttcatcatttcttcagaccctgccttagttatttactgctgtggttttaaactctgctcttcgaaacccttggtttctgcagaagtccttcgagaggttcgtgggggcaaaggaaggtgaggggcaggagcccaggccacccggcctccttcctttccccacgtctgctttcaactgtttcatatgcatcatgcaaatcgcagctgtcatggctcaggtcctcatgtgtacaatgggcgccatggcagcgtccaggtcagagggtgaccagagtgacatgaattaagacacgagaggactccaaagagtggtcaggcctctcacgtcataagatctccataaatggtcactattattttgtgttattaggggtacgcttttcatttgtaagatgacttccatggggccccacgcctcatgaccccgtctcaccccctgcaaataccatcccatggagaggcaggacttgagcctatgaatttgaggggtacacggttcagtccaaaccttttggtgtttctgtgtatccatttctgcatgtgtaaaatgaggagaacagacagcttccgacctcatctccaaaggcgcacggaggaggtggaaaggccctcgccggagactgagcactgcagccagcgcaaggccggatttgctgcttccgcgcggggacgccctcggaaaggtggcaggtgcccacggcgaggaaggggcgggagtgaggggtgcgtggcccgagagaactcagtgaagaaggccattagggaggaaataagggaaacggggtgtgcgaagctctgagctttttctgcccggtttggctgaggacacgccacgggtgagcatctgcgcgaggggagcttggtgggtgaggaaggaagaagacacgatagagaactggaagcaagaagggaggaaaccaaaaggaacggggaggagaaagggcttctctggagctgcttgcttttcccagattctcctgccattcctggctccagggagtcctgaaggaacgatggttagggcggagaatcctgcagaggaaaggagagaaaggactagaggtcacacacggcttcttggaggggagcggggagcaggggctccgaggctgcgggtcgcaggctccagggcaggaagctctccatgggaaccgtagtatgaattccaccgaggtgcgtcccggcacagacccgaaggcagccacatttgtggaaataagatttgacgtgcatttcggatccgcagagaaggtggactctgttttgcagaatggaccagcggtggggggtggggtggggggcaggaaaagactttaaacgctggcagaactttgtattccactcattcgtgcatgcattcattcagccatcctttcgctatcattcatcaaactagcgcgcactgaggccactttgtgtcagcgcagcgcctggcctgaggacctcagggtggtgtcggcaaagttccgctgccaaggagttcacgggccgtgtttcctgccaggccgcagacactctctgcgtggagcccgaggaggttctgtgtgagatctcaccctgcgggaagaaagaggcggaggctcggggttggtccaatcacacccctgatggtgagagacgggcgggcggggcctgacgcccactcccagctggatgcctgtctcccaccccgcgtgtcctttcccagaccccaaagcttcctgcctggtctcagttcttcggagaagagggattagaagctggaacaggtatttctgctaatggggcgtggcagatcggcatttgcgggggctctgtcaccccgtaagatgtcccagcaggaagcgtggcgggtctccactgagagctccacggagcagctttggctccctgagaagtcgaggtgtgagcagtagcggccttccctttgcagagagaaggcttggggagagaagaccctggtgccatcttcataggaggtggaaaggaaactgtatgacaggagaatgaatcaggtttggggctcaaggtgccggccactgggaaaaacagctgccccgagttgcaaaactctgggtcctatatgtataaactatgccctgaggaaggaatctcaggcgtatcttaggagaaaatgttctagcttgggaaacaaacacaacaggaccgtgaatccaaatatttcaagtgggtttagaggactggagttctaaacgctgcttttactgtaagtgatcacgccccggaatgtgctgaagaaaggaaaatgagccagtatcggcgaggactatgggcaaggaaaacgagagtgtgcgatgtgtcaaagcaagacatctgtgtatagtaatataatcaagtaatagatagtcatagaatcaagctgatgtatttggcaggggccgcgggaggatgaggcaactcccatcagattagaaagatgttaacactgtaacaaaagtggggctcgaggaaggggaaaagcgcagctctctttttaagacgccagaaagtagtcagacatgctaagaacaaaacaaacacaaacgaaaaccagcaaagaaagctcttcgagaagagtaaggctactgatctttaggaatcaaatcattatttccacacatgtcatgaagaacacagacattaaagcacaaaggagaaacttaaatgaaagtaggagggagaagtcaaagctcaagtaaagagatttttaacctagagaggctgagttatcaaggaagaaagaaggccaagccagcttgttgcagaatgttccagaagataagataatgatagacttaaataaatagggactgatcaaggtgatagcgagttcttggtgaaattgcttccaaggattttatagaagtgtatttcatggaaatgtacagtaaccggatgactgtattaaaattttaaaactgctgggtgtggtggctcatgcatataattccaacactttgggaggccaaggcgggtggatcacatgaggccaggagttcgagaccagcctgaccaacatggtaaaaccctgtctctattaaaaatacaaaaattagcagggtgtggtggtgtgtgcctgtaatcccagctacctgggaggctgaggcaggagaatcacctgaacctgagaggttgcagtgagccaagattgcgccactgcactccagtctgactccgtctcaaataaaacaaaataaaataaaaatctaaaactgacttaggcagttaagtgtgtttccaaagaacgtaattggtgggaggcagagcgggcccgaattgccacctcttcccggcacggccagtgctcttcctcccactcccggccacctccgcaggcccctgcccgtgccaggactgggtgaagctgtgaatgtgcttctccacttgggggtgcgggacaatgctggggccctgggctgggtttctgccctaggaagcctcactgttgagtcaggggctgctggagctgagttttgtcttcagtggcttatgaaggaaagatgaagcta

SEQ ID NO: 137 - DNA, 2593 bp, Homo Sapiens
gctggctgacattttcctgcccggaaggatgcatggcccggggtctcctgcacctgaggggaagaattggaggcgagtcacagagcgcagtgaaggaagcaagtttattggaatctactccgttagagagtgcaagtcctcagactgcaggaggaggaactcccgtccttcggtagtgtcactacttagaggcagctgtgaggagctgtgattaatcgtggaatgtgctgatgtgcccactaaagagctttgcccttggagtccaggctggagtgcaatgatgaaatctcagctgactgcaacttctgcctcccgggttcaagtgattctcctgcctcagcctcccaagtaactgagattacaggtgcccacacccgggtaatttttgtatttttagtagagacagggtttctccatgtcggtcaggctggtctcgaactcctgacctcaggtgatccacctacctcagcctcccaaagtgctggggttacaggcatgagccaccgtgcccggccaccattctaatttcttaatcttgtcttctttctctggcttcagtggtagatatttattaaccagtttaaacatgagtcattatttatatcaaatgtttggatgtataacgtaaaatgaaccttaatctctgtcaaaaaagatactactgggagcatcgtttggctgggagtcaagatgagattgagctactttatgggtgtggaatgccaagtcagagagatttgaataagtaacacttcagcaatatgagatctggacagcatccaggagccaaggtccaagatgctaataggagtgatgtagctgtccctgaacaaaggtttgccacagtttacgagcctcagaggttaagatgcaaaccagaacaatgctattggatgtgcaatccatgatgtttcatggggaggtgggtagatttgggcaaccttgccttcagtttactcctactagcatcaggctctgtccacctgatcagcagaggctatatggttctattttgtgaaaagatcaagttggaaatggaggagtagaggagaaggttggaaatcagaatcctcccacatgtattcttccctccattgagacattttatttgtatatatttattcctgaaaaaaaaaaaaaaaaaagagtcccaggattttttctcctgtgtttttgtcttgtttcttctcggtccatgatgccagttgaggtcatcagtacagcgaaaccaaactggtgagatgggaacaaattattctgtcacttttctagatctttttatttatttttttatttattttttgagatggagtctcgctcttgttgcccagtctggagtgcaatggcgagcctgggttcaagaccagcctgggtaacatggcgaaaccccttctctaccaaaaaaatacagtatttagctgggcctggtgcatgcctgtagtcccagctacctgagaggctgaggtgggaagatcgcttgagcccaggaggtcaaggctgcaatgggctgagatcacgccactccagcctaggcaacagagtgaggccttgtcaaaaaaaaaaaagagagagagagagatacaagccttcagagaccctcatattaacttcatggtaaatctgcctctgctcacccctcccacctgtagcaactaatatcttcatttccagatttactctgaaaaaactgtgcaactgcttcacatgtttcctcttgattcactaatttgtaactcacttactgaaactctgatgaaagaattgagtcaaaaaataaatagacctccttcccagccctggcttgttcagagcatctactacagaggagtcttaagggttttgtatgcttagagttgagagaccaaatagctcctgaaaactgtagctagaggaaatgccatatggagacaggccacaaggagaactcaagcccctgtaaaccaaaaatgaaatattctaagcccccaatttactaaacagattcaacctcccacttcagcctcccaaatagctgggattacaggcgcatgcaaccatgcccggcaaatttttgtgttttttgtagagatggggtttcgccatgttggccaggctggtcttgaactcctgacttcaagtgatctgtccacctcaccctcccaaagtgctgggattagtgagccactgcaacagccctctaacacttatttctgaagttttttttcttccctccttctcggaagccccttcctccctctcttgttgccttaaggtaccttcaccctggctaggccctattgttcttttatcggttttttgtttgtttctttagcctacatatgctcttccacctgggttatacaaatgcaaagtacaccctagttccatgctgggccttattattaacaagaactttctgaatctcttaagatgtagtgaaagcagatatacataaactatgttgaactaaactgtattttcttttttttatttcactttaaaaatttattttcataccaaaaaaatcattcaaagacagtattaaaaaggatgacaaaatacataaaattggcagatgtcttacactaaaataaagttggttttcccagatctg

SEQ ID NO: 138 - DNA, 4821 bp, Homo Sapiens
tcatattataggttttttaatttttttgaaaagtaactggcttcacaaacaccaagtacaacatgatttagacaactgagaaacaggcaagtatattttgaagtgctaaaataaaacatatttatacaagtacaaagcaaaacaatgctgataaaaatgttaaactttatgaaaaaaaatcatttgcagttcacatcaaaataatttaacattctctattattttaatagtacaagctgccacaacagagaaagaacagatacacgcacacaattttaaaaccaaatcagttataagtgcagaaaaaagtaagtacaagcacttttagcccacacaaatcttttaggattggcaccatctttctaaaacatctataatctatatagatttctaattacaacaccatcagcagctgccattgatttctagaaatacacacaatatacatagtatatttgttcacattgggaagatcagtgaaattcaaccaactattttatacatgcctcattcttcaatagacagtagagactctcccaggcctcagaccctcttcaaagtgaattctgacttgtctttatgctttcactgatctgtattttttcacagtataaaattgtaaatggtaactatagagattctgacagcttgagggttattaataagctgttgctaaatgtgaactcacataatacctttgaagtctccaaaacatgtacattttactgggagactagcataggaaatgcttttgttttttgttattcttaaaaagagcatttaattcctggcttggaagtcacagaactgcagcagagctattatacaattcatttacagtcagaaatagctcctagtcttcctgatcacttgctggtaacagcagtagtttgggaaagatagttactttcaaggattagcacgtttggggatttgctttttttccttgcttcagtcaaatctcttataatttttctttccatactccctttctgttccccatccctagcccagaaagacggttcttcccaatccagatatgttcttcttaggctgcccccactcctttcccaaaatggaaggatgagtggactgcttagattagtcagtataacttggttaaaccacgtcttcttctttccatcctgggacatatctctcatttagggtcactttgctgagccttagcatatccccttccttttagtcatgctggtcccgactgaattatcactgggcaccaggaacagattgttttgaaggaaattcaatgagaatgtacccaaatgaattgtgaagttcatatcctatagccctagaatgaatattcagttctctttgtactgtagagttattacttggaacctggtattagaattggcaaagagacagagttagcatcattccaaaataaaagatctcaagaatgcattactaataatcttatgtccaacatacaatgtattcaatggagtggcaaaagttatagaaatacagagaaaaatatatcttgtccttttctaattggataaatcatttttattattacagttgattatgatagcatgtggaagtatcagatggcaatttacttgcattaaatttaatttctgatgaagttttttataaggtagtgtgctttttaagagatatgttactaaaaaaatagaaaatgaatttgaccatgaacaaagtttaaacatgttcttcaactggtctagagtgaaacgtattgtacttgagaataaaatgaaaatcaacataaggattttataaaacaaattttaaaatgtagagcatatcaagaaaggtttttaatacctaagaagtcaagataggaatcctcaggtgaatgccatccttttgatgaggatccaaagggtattaacacctcaaaagatttccatttgtttttcagatagaggcagacatttgcttttaatgaaaccatgaaacttagctagatttcacttacattttaaaagcctcggtgtaatatttgggatcagggtgctgtgatgatgttattttcaaatctagcatgggaggttcgatttcttttaaattaatactttagtacattaatgttagcttttaatgttttgtattgggaggtttgacttaaagttgcaagtaagaacaaatagcagaaaagaaaactcaagcagaatatttattagaattttttaaagtgaagaatgataaattatgccaatggactgacttctatttctcagtttattttctgttaagtagatgtgaaataaaaaaaaatacttaccaaagtaaggatattgagctaaaagaaaaagttttatttattattctctctgccaaaatatacttctgcctcacagcacatatttttcataaggctatcttaagtataaggctgggtcaactgaactttaaatttataggacacctcctccatttattactatccttatttaaaaatcaaaacatttggtacctgaggatagctgcaatgggaggaagaaagagatgacagtggattcaggtcttgaactatgaattctacctatttgagactatcaaagcacacttgtttctgttatactctaaatctcttttctgtagttttaaaaagtgacagtatgaagtgcacaaaatcatattaatcattattttaaaaaagaaaataagaattgctttgcctctttttggaatggctaagaaagactgtgtggttaatattcattaaggttcctcttttttagtattttgtattgctttgaaaaatctacatttgtcatagttcatagctgccctgtttaagcagccaagaatagttaaaatcactgctcactggcatagctaaatctccactaagctgacttgacacagttaaaattttcagtgtattaagattgtgttaatcctttcaacaacagtctctcaaatcatgacaatgtcttcatggggtctatggaccactcttccagtggtgggactcgaaaagaacaaaggagctctttgtgcatcaggttctcaaaataaaggaatgaagaagccccaatgcatattttaatattttagttggcaatgcaaacgcaacagcattcctaaagagtggccatgtttcttgaaagagatagccaggctggagctcaagaatgatttttataaagagaatttccagctacaatgcaccccagtgagggaattacaaaacagtattccagaaaatattttttttgctactccagtattgattggcaacatggtgaaatagtcaagaaatcttccactggttttcttggttaatggaggtgaatctgaaataagtaggtggaatccccgatgcaggcttttggaagagtatttcacaacccaattggagaggaaaatctctggtagaagccctacgtagtacattagcgcagcactcactatccagtagtgtgttatgcatgggacacattcacaacgcctccgtaaatactggacccaagttactgcttttcaaggtctttacaggaaagaaaaaacaaaaagaaagaaaaaagaaagaaaaaagttgatgttttggtcccagattttgagtttgttagaaaatgtacattcatgtttggtgaatcaaagactcttctgggaaaagaattaaagtaaacaaataaaactttttacagttgcttattaactatgctcttcaccctccgttacgctgtttcacacgcactgcttccctagagcaaagcacttggtatggaactgtttgaagagacgccttgtcagccctcaaagatatcagccgtgtttcttaaaagcccatgttttctaaggccactagaagaaaatctgccaaaagatttgtcgtcggtttcttcgtcggttgtcatgagatagcactactgatctcgtgtttccattaaggggtgcccttggcatcttccccctgggccgtaaccaggcgactatgcttgccattgtgtgtgtgtgaacacggggggctccgctccgcacgcgcaggccggcgtgctttccagggacattcacaacgacgaggagctctgagtgtaatctcttatgataagagtgtcatatttgggagacgacgggatacagagggccgactcggacactggcgagttgggggttgtgctccccgagtccaccgagtctctgaagggggacggcggggtgagagccaccagctcctccaggtctggcttggcggccgcagcctcgggaccggccgcggggctctcccgggccgcgtccccagccgcctgcgcccctgccgcgggctgcgcgcctcccgtgacttcgatggccggcagaggctggatttcggcaaaggtcgtcatggtcgtgggcaactggatctctttggggatcaggtgtccactagcttctggaacatggcagagaagaaatgggccagtttatttacgagatttgattgggaggatggttgccaactacaccctttctcctatcagaaggataagaaacaggtgtttcgaaagttgaacatgatggaacataactttggatgttagcagtaacagtctttggaatcacctgtagccatgccccaaaacatgatagcatgttgcaaaacctctagtgcccatggccataagggagaaagagcaccagaccatctgaataacgtgaaagtggacacaggaaacaccagacacccagagaaatggagtccaaatagaaactcagaccattcttgctggagatacatcaagtgaatacctttgtagatctggacctgacccaaggaagcctggatgatttgcaaaagttttccttccatacctctacaccacagatggattgaga

SEQ ID NO: 139 - DNA, 59461 bp, Homo Sapiens
atccaaaaggctgatgagcatgtggaaaggtgttgcgcctgactagcaatcagggaaatgtaaataaactcaggagctcatggcccgtgggggcgagtggcagacttccagcaggaaaccacacagacattacttagtcacagccaggagaagggctcagagtgaaagggctctgtgcccatgacatccttagagagaccagggaaggacctgtaaggcttgaagaatgtgcagatttggagacccacaggtctgggacctggcagaagcatgttactgcccccattttagagatttggggctgagattcaagtaccctaggttatataatgcagttgtcaagtgacagagctaaaacttcatccaggattcaattttttttaaaggaaggaagaaagaaaaaacatattttgatgtttgcatcacttgtatgtagaaggaacgatggagcacaggctagaacgtagagttgctttccaaacacccatgatgacaagtgcccatctccaaagcctgagggccaagggtgagccacctgacccctgaggaaggttctgtcctggtgttttaggaaattaaaatgtgcacatcagttggctgcccagagtgggtgggacctgcacctgccagagaggaatgtgtgctttttggtttaatcctgggaacggcatatggggcccctataacaaggggcagagaaggcctccacagatttgtttttccaattcaagaggagaggttattgtctgctggcttgtgtgttggagactgtggggcgtgctttctccaccacagggaggcagtgaccagagctgccacctcttccctgttttcacctgtggtcgtagccaggtcaggcatctaggagagcatggaggggagctgggggtgggtgggtggggattcagctctttccagacacactggtgctgcctctttcaggccagggcttgagggcaagtgctgtgccctaacaggtcttgcttgtcacccccacctctgaagtgggtatttcacagcctgaactcacagctgcagagaaggttgagcccatggtgtacttgaaagggcagttcatctggatatccaggctctgcaggaggtaccggagcaatgccaggtgccctttgctgaactgcctagagtggctggccctggggacaaagagcacagcatcctggtgacaatgaagtcacactttcctaagacagtcctggtttttgatgctttaattctttggctgcctttgctttgtcaaggccaggatctgggcctaaattttcagggcagaacaaaacaattttgttttctaggaaagtgggaggtctgggatggcaaaggcagcctcgggcgtggcgactaccccagctggggacgctggctgccaagtctcaccctctcaagagaacaggaatcaaactcagcacagcatcctcctttctagtcagtggtcctgctcgatagggggatttgaattttatttttttaaaaatacaggcacagaaaaaagactagaaggaaacagatccaaatgttaactttgtctttgggtgattttcatttccttccttattgtgtctgtgttttctattttgcatgatacttttccaagtcaagaaacaataatttgtggaagtctcctgtatctgtgccttgctctctggcccacgaccttgcacatcttatcctagagttgccagaatatgtccctccacctggcctggagctgcccatgaggctacatagagctctcctatcatgaaagtctttgaggctttctgttcccaagaaattctggtctcacttcctctgccttctcatcgagccccagacccctccctgcccagattaggtcagcattcaagccccaagtccagcctatgacaaagctcaaagctccagcccatctctgctgccctctgccctcaagagactctcgccagtgtctgggcccttcctagtaacttcacccaaccactcaccccctgcccttcccctcctgattgattaaaatccggcctaatctcccaggtgtaacccaagccctcttccacaagctttccagggctccggagattgccccctcccctgtacggctgcagggcttatgtgtgcctggcgctcagcacgggaaccttgccttctgcctcacccatgtctccccagggtttggcacaggcgagttccctgagccagcctacttcacaaggatgaacagaagctctccctatcctttgcaagtagaagccccctccctggccccctcaagaaatctccccctctcagtggattcaccaaagccctgcggatcctgcactgtgaaggagaagccctccccaggggcatccggacagctgcagccaggccctgcgtgacattgctgagccgcagccccacagcctgtgccagctgcccatgcccggctcatagaccctgagccagagtggccccgccaccacctgtgtctccactcagaggcgagaagtaagggacatggatggaaagtgtaaaagccattcccacaacagctgccaggaacaaggcgaggaatggagtgaaaatgtatattcacagctggcacccagttccgcttaggaaaataccttgcttgagtggacacctgttgtttttgcctgccagcagccaggcctggcttctgggaacagcttctcaaatcttccttagggggctcttcctttcccactcctagtgtgcagtgtttaggtaccctctggccatccccaaaggggtccctgtggaccttgcctcagccatcggaggtacagctgcaggtccaaggatggcttgtaccccagctgaggccaataagaacctggccttagattctggcaggaatcctggaagagatgacctcgttctgctgggcttcctgagctgttgaatgcaagctggtggccattttgccccttttagaaagtagctgcctaaggatacagccatcccatggggccaatggatagagagcaagggaaagggagaacaaaagagggaacgggaagggagaaggggagtgcaagaggggagagtgagagcaagtgagcaagatcatctcagctctggggtccagctgtgtctgaaacagctgggtccagctgtgtgagccaaaaaatgtcccttttgtgcttaagcttgtttgagttggggttccatcatttgttaccaagagagtcttcaggaatgtgcatgacaaagttgggggtgaggtgtgagcctacggacatgggcctgggggcagtcaaggttacaaaatagctaaactggtctgcactgcccccactagttttcagggcagagggcagggagaaggcttgtgggaaagaagctggcctgaggccaaggccctggccctagccctgcaacagcacagggaactcttggaaagggatttcctaaggtgggacattggctttctactgctgtgatgcaagtcctcatctccccaaaccttcagtgagcctctctccacaccctgctgtatgaggatgtttgatgcaaattatggaacatgttggatctcacattggatcaaaggtgtgcagaatagatttgcctcaagcatgacagtgatgtgacacagtcaaagatgacttccggaatcctgagaagtcccagggaggatgctgggctttccaaaacctaagtttaggatactgaggaccacaccccacaccccaaacacttctccttagaataagtatagcaagcctcagcatacacaaatctcagagtgaacggaaatgtctctgcaggcccaagggtggggtctgagtagcgggggcgctgaggaagacaggcagtgacagagccaggacagggtcaaccctgagcgtgagtgagcccaggaaacggaaagagagcaacacagccacccacacaactaaaatcgacccacccgggtctccatgctgcaggaagtcactgtctaggtctcccaagacacattttcaggggaaggttccaggcagcaagagcagccctaggaaactttaatatacaatggaatctgggttaagcactatcttctccaagagttgagctcacaggacattccccagaaacctctggagaggtggggaggaaagtttctggaggtctttggatggagaaaacaaaaaagtggccttgattttcaagacaaaattacacaggaagaaaaaaatgtttttaatctaattaagagcgatcttttcaccttcatcacaacatcgcggaaatgtgccagttcttaacttcacacaataatcaaagcaattagtgagggagaagccttggaaaccggtgcagatgttctcagaatgtttaatggggaaatgagttgcaggcctcattctcagcatccggctccaggccctggctaccaaatccagacatctgctggggccccacccccaggccccgagggcgcgggcttgagaaacacaggtcccttcccaggccacctcccagccaggccagaactggggccgagaggctccccatagcttctcaaattggagcctggacacagtcagagccaccccagaactggggggaggctcaacatcaaaattatgttaacaactgatgtcaaaagtaatcaactcagcttggctcccccactgctgctggctgcaggagggctgtgagtaggaggagagcaagcggccccagagggaccctcggctatgaccccctcagcctgaacactacttcaagaaaagatgtggtggcatctgtctggtatggtcctgtgggctccattccaatgctaatggactcttaaggggcccaggaatcaaaatggtcaacacttgaggaatttccagtaatcagagaaaacgtatagaaatgaggatgatgcttacttaggaaatggcctattacaggaaacagagggccacgtggctaatgtcagtgagctgtgggagagacagagaccccaggtggggcaggcagatcagcaaatcttggaggacctgctatgtggcaggcactggagacatggaggtaaagaacacaatatccatgttctcagggacacactcatatgcccttagcattcacgttcttcacactgacagcttcttaatgcaagcccaccagatactttcataagcactacctctgacttcaggcacttgctgagctgcacacagggcaggccaaaaggaatggaaagtgagccaccaccggggcagcactcactagtgaaagataaataccccagctctctcagccgcttgtagaactctgaggagtgttctgtgcagcttcccagctgcccaccatgaagctctttctcaataagtgaccagcacagcttaattcctgaattaagctgtgtgtgctgtgagactgacacaagacagggtgacaggaagctgtcggaacatttgagtagggaagcagcaagatccactgtacatttaaagaactcccttgagctgttatgtgaagaatggagtacaggaagcaagagtggaaatcaagagaccagtaatgaggtatggacaacaatgtaggcagagaaatggtggtggttttaaccagggagatagctggagagactaggtgtgggcaaatccagagagttgataagacatactgatagattagaaaggggtactaagaaaaaaggataatttaaaaaagactttcagccaggcttggagaaaaatagcatgctgctcctcatcccctctgactataaatcatctcactcatcctcccctaaaagcataaaatcagtaagtgcaaataaaaccacatgacccatgctgttagcagtattaggagaaagaataccttcaaattgcctgtgggtagcaaagtgagccaaattccaatagcattctagtcccctgcccagcactgcaaaactgcatacagaatcagagaagaggcttaaaatgctttgtcaaaaagtttgaaggtagttagcaacatcagcaaaaatagaggagtaagtacctctaaggagccttcttgccttcacagacatcctaagcaccaagcagcctaagccactgatgaacttgcagataccactgatgtggattatagtctaattaattgtagagacaccacacttctgcactgaaccagaaccaaagccaaagcaccctacccaaatgatactacagacgcgtgtacaggaaaagtccttactaaggctactccataaaattggaagtctctgttattccagatatgcagatatcaacttggggacacaaaaaacttggggggaaaaaaacaagaaaacatgacttgccaaaagaacacaataattctccaataatagactccaaagtaaaggaaatcttaaggaaacccaatgagatacaagagaacacaaatagacaatacaaacatatcaggaaaacaattcattatctaaatgggaaatccagcagagttagatatgaaaaagaaccaaacaaaaatcctggaggtgataaattaaatgaatgaaataaaaaatacaattgaaagcttcaaaagccggctaagtcaagcagaagaaataatttctaaatttgaagacaggtgttttgcaataaaccagacagatttaaaaaataacaataaaaaagaatgaagaatgcctgcgtgacatatgagacactattaagctaacaatatttcacattttgggagttccagaagaagtgttgggataaggaccagaaaatctatttaagaagataatacctgaaaactgccaaagtttgggagagaaagagactaacagataaaggaagctcacaaatccctaaatagattcaaccctaaaagggcctctctgaggcacattttcatcaaactgtcaaaaatcaaagagagaatttaaaaaacaagagagaagcatgaagtcacatataagggaatcaacagcagattaacagatttttcagcagaaaccttctaggccaggaaagaattgaatgccatattaaaagtgctgcaaggtggggaaaagctcacaaaattgctagccacaaatactatacccagcaaagctatccttcagaaatgaagcagaatgagggaagaaattttgcctccctcagacaagcaaaaactgagggaattcattactactaaatcagccccacaagaaatgcttaagggagtactacatctggaagtaggaggatgatatctaccatcatgaaactacaaaagcataaaacactagtagagcagatacacaaatgagaaaggaaaaggaataaaagattatcactacagaaaaccaaaaaattgcaaagaaaaacaatgagaggaaacaaaagtatacaaatcagtcagaaaacaataaaatgacaggagtaagtcctcacctattgataacaatcttgaatgtaggtaatttaaatttcccaaatgaaagatagatactggctaaatgaattaaaaaaataaaacccaattacatgctgcctataagaaactgacttcacctgtaaagacacccatagactgtaagggaatggatagaaaaagatattccacacaaacagacaccaaaagcatgcaggagtagacagacaaaaaatactgagtcaaaaaaaaaaaaaaaaaaaaaaagaaaaagaaaaaagagacaaaggaggtcattatataattataaatggatcaattcagcaagaagatataacaattatatatgcaaccaacaacactggagtacccaggtatattaaacaaatattattagtgctaaagagatagaccccaatacaataatagttagggatggcaacatttcatactcagcattggacaattcatttggatggaaaaatatcaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaattgaacagatacacggaaatcaaactacatgttcctgaatgaccactgtgtctatgaagaaattgattttaaaaatttaaaaattctttgaaacaaatgaaaatagaaacacagcatacaaaaatgtatagggtacaacaaaagaagtgctatgagggacatttatttcaataaacacccacatcaataaggtagaaagtttttaaacaaataacctaataaacgcatctcaaggaactagaaaagcaagaacaaatcaaacctaaaattagaaggaaataaatagtaaagatcagagcagatctaaatgaaatagagataaaaggtaaaaaagacaaaagatcaatgaaatgaggcctcccccccaccccccgagacacggtctcactctgtcacccaggctagagcgcagtggtgtgatcttggctcactgtaacctctgcttcctgggctcaagcaatcctcctgcctcagcttctgagtagatgtgcagcaccacacctcgctaatttttttttttttttttggtagagatgggggtttgccatgttgctcaggctggtctcaaactcctggactcaagcgatcggcctgccttggccttccaaagtactgggtttacaggtgtgagccaacaaacccagccaaaaaactgattttttgaaaagagaaaatcaataaaccattagctagactaaccaagaagacccaataaataaaatcagaaatgaaaaaggagacttacaatggacaccacagaaatacaaaagattattagagaccattatgaacaactatatgtcaacaattagaaaacctagaggaaagagataaattcctggacatatataacctcccaagattgaaccaggaagaaaaaaaatctgaacagagcaataacaaggaatgagattgtatcagtaataaagtctcccagtaaagaaaacctcaggattgcacgggttttctactgaattctaccaaacctttaaagaactaacatgaattcttctcagacaattccaaaagactgaagagaaaggaattctccctaactcattctgtgaggcaagcagtatcttgataccaaaaccagataaggacacaataacagcaaaaaagaaaactacaggccaatctccctgatgaacatagatgcagaatcctcagaaacaaaacacacacacagacacacaaactagcaatctgaatccaatcgcacatcaaaaagataatacaccataatcaagtgggatttatcccagggattcaaggatggttcaacatatacaaatcaataaatgtgatacatcacattaacagaaggaaggacaaaaaaatacatgatcatctcaatagatgcagaaaaagcatctgataaaattcaaaatctcttcatgataaaaaaaaaagctcatcacataatgtctagaaggaacataactcaatgaaggtcatatatgacaaacccacagccacctggggaaaagctaaacaccttctctcttagaactagaacaagacaaggatgcccactttcactattcttattcagcagagtaagaaaagtcctcaccagaacaattaggcaagtaaaagaaaaagggtatccaaattggaaaagagaatgtcatattgtcctttgcagatggcataatcttatacatagaaaaacctaaagattccaccaaaatcttttagaactggtaaaggaattcaataaagttgcaggataaaaaaatcaacaaacaaaaattagtaggtgtggacatgatggctcatgcttgtaatttcagcactttgaaaggatgaggcgggtggattgcttgagcccaggagtttgagactgtcctgggcaacatggcaaaacctcatcagtacaaaaatgagctgggcgtggtggcctgcacctgaagttcagctactcaggaggctgagatgggaggatcacttgaacctcggaggtgaaggttgcagtgagcagaaattgcaccattgcaccccagcctgggcaacagagtgagaccctgtctgcactcccctgcctcccccaaaaaatcagtagcatttctgtgaaacagcaaattagccaaaagagaaatgaagaaagcaatcccatttgcaatagctacaaaaaaaagcaaagcttaaccaaggaggtgaaagatttccacaatgaaaactataaaatactgataacagtaattgaagaggctacaaaattttttgagacatcccatgctcatggattgaaagaaaaatgttaaaatgatcatatttacctatagcaatatacagatgctatgaaatccctatccagatatcagcaggggcttcaagatggctgactagaggcatctggcactcacctcctccacaaaatatagcaagtaggtaaccacagtttatatagatcgcctctgagagaatgctggaattcaactgagaagtaataagaaaaacccaatgcaagggataagaggggagtcaggcagtctgcttctatgggactggctgggatcatgaagagactcctcgatgtgcagaaaggtaagtaagtgagcccctagtggtccacattcccacagcagactcctgaaatcctagtcagagaaccccctgacccatagatgccttgagactaacaagaggctacctacagactgtgaaatggcaatgaacagctcccagagagggagatcaccctgaatcctcaggcaattcacacatcccctgaatcctcaggcaacttcaggaaagtcccattttgatagcccaacccccaccagactgcatctgctgtgggccccacatccctctatctcatccctggagccccatggacatcccttacacaaagctggttgccactcctgactgctccctccaggccaaagcatgagccattggcaatactctgctacctccgaagcaaggctgccatgaggaaaggtgaccctgcccatagtcaccacctggggccgaagcatgcattgcccaactgcctgtttatagctgctgccactgaaagcaatcccactcaacttccccaggagtagggctgcaatagagttgctgctgccccaacatgagcattcagcagggtatacagggatcttcctgtgcctgcctaccacagtcagtacattcttgcattactggagggcctcaggacaggcccacctggcctggtcccaccctcttttctcccagtgccagcgcataccatctctgggcctagggatcaccctgccctatccagtattgttggcacctgagcactcctgggggcttgaggactgccctacccaactgaccattaccaccacaactggcattcacttgaatttgccacctgtgggccttgggacaagctcatccagcttatcccagccatcccaataccagcatggacaccttgggaggcagaagattgttctgccactgctactgccattgcccaagccatatctgctgctcagagctcaaggacctacccaccctgtggcccagctctgtcatcattggcacctgagcaagttgcctggaggcccaaaattggtttccctggacttgctaacactggtaccagcatacactaccattgggcccaaggataagcattcggggccagccactgctgccactggggcctgaggactggcccagctggtgtccctatccccagccagactttaccacagcctccaccaacaactgcatcctaaactacagaggaactcccagacactactggtgctgtttacagctgaaaaaaattccatggagatcacactactgcaggcacccagaatcaaaaccaaagtgccctgcccaaagaacaccatagatatatcttcaggaacaagactctcttaggaaagacagatcaaaaaattggaagaaactactgttacaccagatgtgcagataccagtgtaagcacacaagaaacatgaaaaggcaaaacatgacaactcctaaggaatgcaataattctccaacagattccagtgaaaaagaaattgatgaaaccttgaaaaattcaatataatattaaagaagatctgatagactatacaaagaaatcagaaaaaacaattcggggtatgaatgagaaatttgcccaagagatagatataaaaagaaccaaacagatattctggaattgaataatagattgaatgaaataaaaaacatatttgaaagcttcaataacagaccacaacaagcagaagaaagaatttcacaccttgaagataagtcttttgaaatgactcagacaaaaatatagaaaaaatagaaaagaatgaacaaaggctatgtgactataggatgccataaggtgacaccttcagtgtcccagaaggtgaagagcaaaccaaaagattataaaacctatttaatgaaataatacctgaacacttcccaatctcccaagagatttagatccaaatataggaatctcagaaccctaaatagatacaattcagaaaggtcttttccacagcacattatagcaaattgcccatcccaagacaaagagagaatcataaaaccagcgataaaagaggttgtagacacttacaagggaacaacctgcagactaacagatttttcagcagaaactttacaggccaggaggatgggattatatacgcagagtgctgaaagaaaaaacaaaaccaaaaacctgccagccaggaatactgtacttagcaaagttatattcgtcagaaatgaaggagaaataaagtatttcccttaaaagtaaaagctcagggaattaattgccactacactggcactacaaaaaatgcttaagggagtcttacaggaagaagtgaaaggacaacttcatgaaagcacacaaaataatcagaaatcaattaatgacaggaataagccctcacatatcaacaataaccttgcatataaatagattaaactttctacttaaaagacagactggctgaatggacttaaaaacatgacccatctaaatgctatctacaagaaacgcatctcacctgtaaagacacatagttgaaagaaaggaatgggaaaagatattacatgcaaaaggaaacaaaaaccaaacaggagtagctatactttcatcagataaaacaaaggttaagctaaaaacactaaaaagagacgaagtcattatatagtgacagagggatcaattgaccaagaggatataacaattctaaacatatatgcacccaacaccaaagcacccagatatataaggcaaacatcaaatctgaagggaaaggtagacttcaacacaataatcttgggaacttcaattctccatttccagtattagacagatcatctagacaaaaaattaacaaagaaacattggatttaaactgcactttataccaaatggacctaacagacatttacagaccagttcataaaacagctgcagaatatacactcttctcatcagtacatggaacactctccaggatacattatatgttaggacactaagtatgattttaaatatatatatattttaaattggattcatatcacatatcttctcagaccacaatagcataaaactataaataaataagaggagcattcaaaactgtataaataaatggaaattaacatgttcctgaatgaccaatgggtcaaagaagaaattaaggcagaaataaaaaatttactgaaacaagtgaaaatagaagcacaacattctgaaacttaagggatactgcaaaagcaatgctaagaggaaagtttattgtaataaatgcctccattaaaaaaggtagaaaagatcttaaataatctaatgatacacctgaaggaaccagaaaagcaagaacaaaccatactaaacataaaattagtagaaggaaagaaataacgaagatcagagcagaactaaacaagaaactaaataaatataaaggatcaatgaaatgcaaaatcggtttttgaaaagaaacaaaataaccagtggctaaactatccaagaagaaaagagagaagacctacatgaataaaatcaaaaatgaaaaaggggatattacaactcataccatgaaatacaaaaatcaaaactcttcagtctgatcaataaattgattacagttacaggatttaaaaatcaggcttatttctatataccaataaagaaccagctgagaaagaaatcaagaaggcattatcttttacaaccactacaaaaaatctaggaatgagtttaaccaaagaggtgagaaacctctaacaaggaaaactacaaaagtctgatgaaagaaattgaaaagaacacacaaaaaacatcccattctcatggattgggagaattaacaaaattaaaatgaccatactacccaaagcaatctacagattcaatgcagtctctctcaaaataccaatgccatttttcatggaaatagaaaaaatcctaaaattcagatggaaccaaaaaagagctggaatagccacagcaattctgagcaaaaataacaaagttggatgcatcacactgcctgatttaaaaatataaggctatagcattaaaagcagcatggtattggaataaaaactgatagaccaatggaacagagtagaacctggaagtaaatccatgtatttacagccaactgatttttgacaaagatgccaagaacatacactgggaaaagagcaccctcttcacttaatggagctgggaaaataagatatccatgtgaaaaatgaaaccgtttctatctcttgctatactaaaatcaactcaagatgggttaaagacttaaacatgaggcatgaaactataacatcactattaatgaaggagacattggggaaacactttaggacattggtctagggaaagattttatggataagacctcaaaaacacagacaaaaacaaaaatagacaaatgggactatattaaatgataaagcttgtacacaacaagggaaacaatcaccagagtgaagagacagcctgttgaatgggagaaaatatttgcaaactactcatctgacaaggtactaataccagaatatactaggaactccaataactcaatagtaaacaacaaattaattccaataaaaagtgagcaaaagacatggatagatatttctcaaaagaaaacatacaagtagccaacaggtatatttaaaaaaaaaagcccaacatcagtaattataagggaaatgcaagccaaaaccatagtgagaatggctattttaaaaagacaaaaattaaccaatgctggagaggatgtggagggaactcttatacactgttggtgggaatgtaaattaatactatagaaaacagtttgatttctgaaaaacctaaaaagagaaatatgacataatccagcaatctcactactggatatttatctaaaggaaaagatatcagtatactaaaaatgtacctgcatccccgtgtttattgcagcactattcacaacagcaaagatatggactcaggaacctaagtgtacatcagtggataaatggaaaaagaaaatgaggtaaatatatacaatggaatactaattgaccaaagaagaatgaaatcatgtcctttgcagcaacatgaatggagctggaggtcattattttaagccaggcacagaaagataattatcttatgttattatcatatgtgggagctataaaagttgatctcatggaggtagagagtagaaggatagataccaaaggctgtgaaaggtatgtctggagggtgaagagaggttggttagtgggtaaaaatacacagctagttagaataaataatttataatgtttgataagagttggttgactatatttaacaatataatgtatatttcaaaataaaaaagaggacttgaaatgttcctaactatagagatgataaattgagggtgatggataccctgacttgatcattacacattcgatgcatgtaacaatagcacatgtaccccataagtattatgtatcggtcaaaaaaaaaaaaaaaaggaaatcccagtgctttggggggccaaggcagaaggatcgcttgagcccaggaattcaagaccagcctgggcaacaatgcacgaccctgtctctacaaaaaattaagaagttatccaggcatggtggtgcatgcctgtagtcccagctacttgaggggtcaaggatggagaatgacttgagcctgggagttaaagattgcagtaagtggggtggttccaagatggccgaataggaggagctccagtctatagctcccagcgtgagtgacgcagaagatgggtgatttctgcatttccaactgaggtagtgggttcatctcactggggctcgtcaagacagtgggtacaggacagtgggtgcagcccactgagtgtgagacgaagtagggcgaggcatcgcctcacctgggaagcacaaggggtcagggaattccctttcctagccaacggaaggggtgacagacggcacctggaaaactggatcactcccaccctaatactgtgcttttccaatggtcttagcaaacggcacaccaggagattatatcccgcgcctggctcggagggtcccacgcccatggagcctcgctcattgctagcacagcagtctgagatcgaactgcaaggcggcagcgaggctgggggagcctgccattgctgaggcttgagtaggtaaacaaagtggccaggaagctcgaactgggtggagtccaccacagctcaaggaggcctgcctgcctctgtagactccacctctggggacagagcatagccgaacaaaaggcagcagaaacctctgcagacttaaatgtccctgtctcacagctttgaaaagagtagtggttctcccagcacggagtttgagatctaagaatggatagactgcctcctcaagtgggtccctgacccccgagtagcctaactgggaggcactccccagtaggggcagactgacacctcacacggctgggtactcctctgagacgaagcttccagaggaacaatcaggcagcaacatttggtgttcagcagtattcgctgttctgcagcctctgctgctgatacccaggcaaacagggtctggagtggacctccagcaaactccaacagacctgcagctgagggtcctgactgttagaaggaaaactaacaaacagaaaggacatccacaccaaaactccatctatacgtcaccatcatcaaagaccaaaggtagataaaaccacaaagatggggaaaaaacagcagaaaagcagaaaattctaaaactcagagcacctctccccatccaaaggaacgcagccactcgccagcaatggaacaaagctggacggagaatgactttgacaagttgagagaggaaggcttcagacaatcaaacttctccgagctaaaggaggaagttcgaacccaaagcaaagaagctaaaaaccttgaaaaaagattagacgaatggctaactagaataaccagtgtagagaagtccttaaatgacatgatggagcagaaaaccatggcacaagaactacgtgacaaatgcacaagcttcagtagccgatttgatcaactggaagaaaggatatcggtgattgaagatcaaatgaatgaaatgaagtgagaagagaagttcagagaaaaaagagtaaaaacaaacgaacaaagcctccaagaaatatgggactatgtgaaaagaccaaatctacatctgactggtgtacatgaaaatgacagggagaatggaaccaagttggaaaacactcttcaggatattatccaggagaacttccccaacctagcaaggcaggatattatccaggagaacttccccaacctagcaaggcaggccaacattcaaattcaggaaatacagagaatgccacaaagatactcctcaagaagagcaactccaagacacataattgtcagattcaccaaagttgaaatgaaggaaaaaatgttaagggcagccagagagaaaggttgggttacccacaaagggaaacccatcagactaacggcggatctctcagcagaaactctacaagccagaagagagtgggggccaatattcaacattcttaaagaaaagaattttcaacccagaatttcatatccagccaaactaagcttcataagtgaaggagaaataaaatcctttatagacaagcaaatgctgagagatgttataaccaccaggcctgccctacaagagctcctgaaggaagcactaaacatggaaaggaacaattggtaccagccactgcaaaaacatgacaaattgtaaagaccatagatgctaggaagaaactgcatcaactaacgagcaaaataaccagctaacatcataatggatcaaattcacacataacaatattaaccttaaatgtaaataggctaaaggctccaattaaaagacacagactggcaaattggataaagagtcaagacccatcagtgtgctgtattcaggagacccatctcacgtgcagagacacacataggctcaaaataaagggatggaggaagatctaccaagcaaatggaaaataaaaaaaggcaggggttgcaatcctagtctctgataaaacagactttaaaccaataaagatcaaaagagacaaggtcattacataatggtaaagggatcaattcaacaagaagagctaactatcttaaatatatatgcacccaatacaggagcacccagattcataaagcaagtccttagagatctacaaagagacagactcccacacaataataatgggagactttaacaccccactgttaacattagacaaatcaacaagaccggaagttaacaaggatatccaggaattgaactcagctctgcaccaagtggacctaatagacatctacagaacattccaacccaaatcaacagaatatacattcttctcagcatcacatcgcacttattccaaaattgaccacataattggaagtaaagcactcctcagcaaatgtaaaagaacagaaactataacaaactgtctctcagaccacagtgcaatcaaactagaactcaggattaagaaactcactcaaaaccgctcaacgacatggaaactgaaccacctgctcctgaatgactactgggtacataacgaaatgaaggcagagaaataaagatgttctttgaaaccaatgagaacaaagacacaacataccagaatctctgggacacatttaaagcagtgtgtagagggaaatttatagcactaaatgcccacaagagaaagcaggaaaaatctaaaattgatgccctaacatcacaattaaaagaactagagaagcaagagcaaacacattcaaaagctagcagaaggcaagaaataactaagatcagagaagaattgaaggagatagagacacaaaaaacccttcaaaaaatcaatgaatccaggaggtggtttttttgaaaagatcaacaaaattgataggcctctagcaagactaataaagaagagagaagaatcaaatagatgcaataaaaaatgataaaggggatatcaccaccgatcccacagaaatacaaactaccatcagagaatactataaacacctctatgcaaataaactagaaaatctagaagaaatggataaattcctggagacatacacccttccaagactaaaccaggaagaagttgaatccctgaaaagaccaataacaggctctgaaatttaggcaataattaatagtctaccaaccaaaaaaagtccaggaccagacggattcacagccgaattctaccagaggtacaaggaggagctggtactatgccttctgaaactattccaaacaatagaaaaagagggaatcctccctaactcattttatgaggccagcatcatcctgataccaaagcctggcagagacacaacaaaaaaagagaattttagaccaatatccctgatgaacattgatgcaaaaatcctcaataaaatactggcaaaccgaatccagcagcacatcaaaaagcttatccaccatgatcaagtgggcttcatccctgggatgcaaggctggttcaacatatgcaaatcaataaacattatccagcatataaacagaaccaaagacaaaaaccacatgattatctcaatagatgcagaaaaggcctttgacaaaattcaacagcccttcatgctaaaaactctcaataaattaggtattgatgggatgtatctcaaaataataagagctatttatgacaaacccacagccaatatcatactgaatgagcaaaaactggaagcattccctttgaaaactggcacaagacagggatgccctctctcaccactcctattcaacatagtgttggaagttctggccaaggcaatcaggcgggagaaagaaagaaaggatattcaattaggaaaagaggaagtcaaattgtccctgtttgcagatgacatgattgtatatttagaaaaccccatcatctcagcccaaaatctccttaagctgataagcaacttcaacaaagtctcaggatacaaaatcaatgtgcaaaacatcacaagcattcttatacaccaataacagacaaacagagagccaaatcatgagtgaactcccattcacaattgcttcaaagagaataaaatacctaggaatccaacttacaagggatgtgaaggacctcttcaaggagaagtacaaaccactgctgaacaaaataaaagaggatacaaacaaatggaagaacattccatgctcatggatagggagaatcagtatcatgaaaatggccatactgcccaaggtaatttataaattcaatgccatccccatcaagctaccaatgactttcttcacagaattggaaaaaaactactttaaagttcatatggaaccaaaaaagagcccgcattgccaagacaatcctaagccaaaagaacaaagctggaggcatcacgctacctgacttcaaactatactacaaggctacagtcaccaaaacagcatggtactggtaccaaaacagagatatagaccaatggaacagaacagagccctcagaaataataccacacatctacaatcatctgatctttgacaaagctgacagaaacaagaaatggggaaaggattccctatttaataaatggtgctgggaaaactggctagccatatgtagaaagctgaaactggatcccttccttacaccttatacaaaaattaattcaagatggattaaagacttacatgttagacctaaaaccgtaaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccgtcagagtgaataggcaacctacagaatgggagaaattttttgcaatctactcatctgataaaaggctaatatccagaatctacaaagaactcaaacaaatttacaagaaaaaacaaacaaccctatcaaaaagtgggcaaaggttatgaacagacacttctcaaaagaagacatttatgcagccaaaagacacatgaaaaaatgctcatcatcactggccatcagagaaaggcaaatcaaaaaaccacaatgagataccatctcacaccagttagaatggcaatcattaaaaattcaggaaacaacaggtgctggagaagatgtggagaaataggaacgcttttacactgttggtgggactgtaaactagttcaaccattgtagaagacagtgtggtgattcctcaaggatctagaactagaaataccatttgatccagccatccccttactgggtatatacccaaaggactataagtcatgctgctataaagacacatgcacacgtatgtttattgcagcactattcacgatagcaaagacttggaaccaacccaaatgtccatcaatgatagactggattaagaaaatgtggcacatacacaccatggaatactatgcagccataaaaaaaggatgagttcacgtcctttgtagggacatggatgaagctggaaaccatcattctcagcaaactatagcaagaatgaaaaaccaaacaccgcatgttctcactcgtaggtgggaactgaacaatgagaacacttggacgtaggaaggggaacatcacccaccagggcctgttgtggggtggggggggaggggggaggggggagggaaagcattaggagatatacctaaggtaaatgacaaggtaatcagtgcagcacaccaacatggcacatgtatacatatgtaacaaacctgcacgttgtgcacatgtaccctagaacttaaagtataataaaaaaaagggagagagagagaaaagagaaatctaaaaaaaaaaaaataccaaagacaatcttcaccgaaatagcaaaaacacaatccttaaacttgcatggaaccacaaaagaccacaaataggacaaacaatactgagcaggcagaatgaagctggaggcactacactgcctgacatcaaaatacagtcgactcttcaacaacatagatttgaactgtataggttcatttatacgtggattttccccataatctaacaaggatagaatgcaatattcacaaaagtgaaaactatgtatacagatgactgacattttgtatatgcgcattacacagggctgactctgggacttgaatatacatggcttttggtatatacagggggtctcggaagcaatcccccttgtatacaaaacaatggtaaccaaattagcatgcaatgggcataaaacagacatatagaccaatggaacagaatagagaacccagaagtaaataaatttatttacagacaactggtttttgacaaaggtgccaagaacacactctggggaaaggacaccatgttgaacacatcatgttgggaaaacaggatatcatatgcagaagaatgaaactatactatctctcagcatataaaaaaatcaactcaaaattgattagagacttaaacatgagacctgaagcaaacagtactagaagaaaacagaagggaaacccttcaggatatgggtctagcgaagattttatgggtaagactttataagcacaggcaacaaaaacaaaaatagacaaatgggactgtatcaaactaaaaacctacacataaaaggaaataataaactattaagagatatcctgtagaatgggagaaaatattcatctgacaagggattaatatccggaatatacaaggaattcaaacaattcaacagcaaaaaacaccagattatctgatttagaaatgtgcaaaatagaacaactggccaacaggtatgtgaaaaaatgctcaacatctctcatcacagaaatgcaagtcaaagccacagtgagacattatttcacctcagttagaatggctgttttcaaaaagacaaaacataacaaatgctggcaaggatgcagagaaaagggaaataatacactatttgtgggactataaattagtgagtcattatggaaaatactgtggtgttttgtcaaaaaaactaaaagtagactatcatacagtttgacaatccactaccgggtattgactcaaaggaaaggaaatcagtatataaaaaagatatttgcattctcatgtttattgcagtactgttcacaacagttaagatatggaatcaacttaaatctccatcagcagatgcagagaaagaatgtggtatgtatacacaatggaatattattcagtcataataaagcattaagtcctgtcattcacagcaacatggatgaacttggataatatgttaaatgaaattaggcacagaaagatggaggattttgactgctcacaaaacagagaaatgatatttgagttgatgaatatgctaattaccctgatttgattatgacacattatatacatgtatcacaatatcactgtgtatatcccataaatatctacaattattacatgttgactaaaaataaaaggacaaagaaaaagactcctagaagaaaaacccacaaggagcatcataatggtgaaaagactaagagcttttcctctaagatcaggaataaagcaagatgcgcattttagccattatattaaacatagtagtggctttctagccaaagaatatggaaaagaaataaaggcatcatttagaaaggaagaattaaaattatgtttgttcatagatatgatcatatttgtagaaatccctgaaaactcaccacaaaaactgaataaattaattcagcaaagtagcaggatagtaagtcagtacacaaaattcagttgcatttctttttttttttttttttttttgaggcagagtcttggtctgtcgcccaggctagagtgtagtggcgcgatctcggctcactgcaagctctgcctcccgagttcacgccattctcctgcttcagcctcccaagtagctgggactacaggcacacgctgctatgcctggctaatgtttttgtatttttagtagagatggggtttcaccatgttagccaggatggtctcgatctcctgaccttgtgatctgccctcctcagcctcccaaagtgctgggattacaggcgtgagccactgcgcccagctttcagttgcatttctatacattaatcacaaacaatctgaaagggatattattaacacaactctatttacacgacagcatcaggacactcagccttggccaccaaggacctttgtaatgtttgccactgctgacctcagctgatggagctgcaagaagagtattccattatatcctcatctgggctacagctgctgcaccctacctacttaacactccatcaagtgagcagatttcaattcattgtaacaagaaacagaaaaaccaaggaaacatagcacccacctgagaaatacaataattttcagggactgactcccaagaaattgggatacattaattgccttacagaaaattaaaaacgactgatttaaggaagttcagtgtgctaccagagaacagagagacaacctaatgaaatcattaatacacaaaaggagacattcaataaagaaatagaaatcctaaaaaaaaaacaaacattttggaggtgaagaatatagtgcatgaaatgaaaagtgaaatagaaagcatcagcagcagacttgatcaaatagaaggaggaattcatcaactggaggataaattatttgaaaataaccagtagaggagaaaaataaagaatgaaaaggtaacaagggaagtttacaggatttatgggacaccatcaggagagttaatgttcacacaggatttatagaaggaaagtagagaggtaaagggtagaaagttaattcagagaaataatggctgaaaacttcccatatctggggctcttcccagattgatggacatctaggtacatgaagctcaaagaattacaattagtttccatctaaaagaggtttcacctagatatattgccatcaaaatgtaaaaaatggaagacaagataattttgaaagcggcaagataaataaagttcttacatctgcaggaacctccataaggctatcagtggatttctgagcaaaaactttccaggccaggaaacaataggattatatattcaaagttctgaaagataaaaaactgccatctaagaatactttacacagcaaagctgtccttcagatatgaaacagatacaagacttcctcaggtaaacaaaagttgaaggagtttatcagcaactactcttgccttacaagatatgccagagggagttattcaggcttaaatggaaggatgataattagtaacatgaaaacatatgaaagtacaaaattcactgataaataaatatacgggcaacttaagaatactctaatagtgtaatggtagtatataaatcacataactctagtataaaggttaaaagaaaaataattaaaaattactattgttttcataatttctcaatggatatgcaatattaaaaggtgtaccttggggcatcaaaaataaaatgtagcgggggaagtataagatcaaaatattccccccaaacaaagagggaacaatcccaacttattttacaaggctagcattgccctcatactaaggccagacaaggacaatataagaaaagaaaataactggctgatatttttttatgactatacatttaaaaattttcaacaaaatatgatcaaactgaatttaacagcacattaaaaaaatcatatatcacaaacatgggatttatccttagtacataaggacagttaagtgtacatatacaagaaatgggatactttaataaaatcaaagataaaaatcatacaatcattttgataagtgcaaataatgcagttcacataattcaacatccttccatgataaaaactatgaacaaattaggtatagaaggaatgtactgcaacacaataaaggccatatatgaatagcccacagctaacatcatactcaatgctgaaaagctgaatgcctctcctctaagatgaggaacaagaaaaagatattctcaccacttctattcaacacagtactggaagtcctagccagaggaattgggcaagaaaaataaataaatacactcaaatcagaaagaaggaagtaaaattgtctctgtttgcagatgacatcatatatgtagaaaatgctacagactccacaaaaaaaacctgttagaagtaataatctaactcagtaaagtggcaggatacaaaatcagcattcagaagtcatttgcgtatctatacactaataataaacaacctgaaaaacaaattaagaaaacaatttcatttaaaatagcatcaaaaagaatagagagctcccaaataaatcctttcatatatgaacgcatgatttctgacaagcatgccatgtccattcaatggcaaatggattctcttttcaacaaatggtgccaggaaaactggatatcctcacgtgagagaatgaagtcgagacctttacctaactccatatacaaaaattaactcaaagtggaccacagacctaaatgtaagacctaaaactataaaactcttagaagaaaacatggggcaaaaactgcatgacattggatttggtattgacttcatttggatataatatgaaaggcacagataaaataaaaaatagagaaattggactgcataacatttaggcatacatttaaccaaggagataaaagacctagacactgaaaactatgaaacattgaacaaattctaagatgatacaaataaatggaaagatatctggtgttcatagatcaatagaataaatattgccgaaatagctatactactcaaagtgatctacagattcaaggcaatgcctatcaaatttccagtgactttttttcacagatatagacaaaaaaaatcctaaaatttgaaagaaactacaaaagaccttaaagatctaaagcatacttgagcaataagaacaaagtgaaagatattacacatgcttattttgaattatatttcaaagttatggtactggtatagaaataaaccaatggaacagaatagaaagcatagaaataaacccacacatttatggtcaactaatctttgacaaagacaccaagagtacacaatggggaaagggtactctcttgaataaatggcactgtgaaaccaggatatccacatgcaaaaaaattaaattggaaccttaccctacactgtagagaaaagtgaataagatttaaacatatgacctgaaaccataaaacctataaaacagggaaaagctccttgccattggtttttgtgacaattttttagatgtgacatcaaaagcacaaggaataaaacgcaaaaataaattagaactacatcaaacaaaaaagtgtctgcacaacaaaggaaacaacaaaatgaaaaggcagcacatgtagcgggagaaaatatttccaaccatatatctgataagctattaatatccaatatatataaggaactcatataactagcaaaaaaacttaataacccaattaataacctgttaagatggacaagggactgaatagacatttattcaaagaagacatacagatggtcaacaggtatataaaaaggtgcttaacatcacttatcatcagggaaatgcaaatgaaaaccacactgagatatcacctcataactgttagaatcgctattatcaaaaagtcaaaagatagcaagtgttggtgaggatgtggagaaaaggtgtcccttatacatttttgttaggaatgtaaattgatacagtcattatggaaaacacgatagattttctttaaaaaattaaaattggaactgctatatgatccagcagtctcagttccgggtatatctaaggaaaacaaagtcagtatcttgaagaggtatctgcactcccatgttcattgtagtgttacagtagtcaagaaatgagcaacatagtattcataggcatggtggcttgtacctgtaatcccagtacttgggggtggccaaggtgaaggatagcttgaacacaggagtttgagaccagcctaggaaacatagtgataccctatctctacataaaattttaaaaattagctgggcatgggggtgcatgactgtggtcccagctactcaggaggctgaggcaggaggatcacttgagcccatgaggttgaggctacagtgaactgtgattgtgccactgtactcctgcctggatgacagatggagaccctgtctcaaaaagaaaggaagaaaatagtgtgtgtgtgtgtatcaccaaattcccaaataaacacatcacatacatatacatacagacacacacacacacatatatacacacacacaatgaaatattcatcctttaaaaagcaggaaatcatgcaatttatgacaacatagatgaacctggaggatattatgctaagtgaaatagccagacacagaaagacaaatactgcactatcccagttacatatggaattctaaaaagcttgaactcagagaaacggagagtagaagggtggttactaggggtcagggagtaggggaaataggaaatgttgaagggtacaaacatagagttatcagatgaataagttcttgacataacgtccagattggtgactatagttaatatattctatacttggaatttgctaagagagtatagcttaggtattctgaccacacacacgcacacacatggcaactatgtaaggtatatgttaattggcttgattgtagtaatcatttcacagtaggtcaaatatgttcttaaatatatgcacttttaatttgtcaattatacctcaataaaagctgaaaaaagcatcaagaataacaaacttaggaaccaactttaccaaggaggtgaaagtcttgtacaatgaaaattacaaaacaatgctgaaagaaattaaagtagacataaagggaaaacacctcctatgttcatggattggaaggccaatattgttaaggtgtcagtaccacacaaaacaatctacaaatccaaggtaatcccaataaaaatcctaatgatgttatttgcagaaagaagaaaccccatcctaaaattcacatggaatctcaagggaccttgaatagctaaaacattcttgaaaatgatgaacaacattggaggactcacactttctgatttgaaaacttactacaggccaggtacaatggcctacacctgtaatctcagcacttttgaaggctgaggtgggaggacttctgagtccaggagtttgagaccagcctggggaacacagggagacctcatctctacaaaaaataaaataattggccaggtgtaatggtacacacttctattcccagctactcaagaagccgaggtgggaggattgcttgagcctgggagattgaggtggcagtaagcagtgataatgccactgtactccagcgtgggcaacagagtaagaatgtctgaaaaacaaacaaaaaccccaacttattacgaagctacagtaatcaaaactatgtggtattgacataaagatgtagagaccaatggaattgaatagagagcccaaaaataaacccttgtatacatgatcaaatgattcctgagaagagtgccaagaccattcaatagggaaagtgctgtattttcaacaaatggtgccaggataactgaagttgagacccttacctaataccatacacaaaaattaactcaagagaatgaagttgagatccttacctaaccatgtataaaagagaatgaagttgagacccttacctaacactgtgtacaaaaacttactcaaaatgggtcaaagtcctaaaactatgaagtcttataaggaaacataggggaaaaactttacatcattggcagtgcttcttgtatgcgacaccaaaggcacaggcaataaaagtaaaaatagataaattgtacttgcacaggcaataaaagtaaaactagataaattttaaaaatttacattgtgtgcattaaaataatatcaactaagcaataagacaacctacagaatgggagaaaaatttgcaaatcacatacctgataagggattaatgtccagattatacagagaacttctaaaagtcatcaccaaaaaacaatgcacctgaaaaatgggcaaaagggccaggcacggtggctcacgcctgtaatcccagtactttgggaggctgaggcgggaggatcatgaagtcaggagattgagaccatcctggctaacagggtgaaaccccgtctctactaaaaatacaaaaaattagccaggcgtggtggtgggcgcctgtagtcccagctactcgggaggcaggagaatgatgtgaacccaggaggcagaggttgcagtaagccgagatggcaccactgcactcagcttgggcaacagagtgagactccatctcaaaaaaaaaaaaaaaagggcaaaggacttggacagacgtatctccaaagaagatatacaaatggataatagtacgtgaaaagttgtttaacatctctagtcattaggaaatacaagtcaaaaccacaaccttacatacactcagatgactactattaaaaaaataaacacagcctaggcaacatagtgagacccatctctagtatcagctacgtgggaggttaaggtgggaggatagcctaagcccagaggtctaggttgaggctgcagtgtgccatgatcatgccactgcattccagcctaagtgacagagccagatcttgtctcaaaaaaatcccacataaacagaaaataaccactgctggaagggacatggagaaattggaatccttgtgcactgttagtgggaatgcaaaatggtacagcctctgtgttaaacagtttggtgttccttcaaaaattaaaaacagaattatctgatccatcaactccacctctgtgtatacacccagaaggattaaaagcagtctcaaagatatatttgtatacccacgattgtagtggcattatttacaacagttaaaacatcaatgcaacccaaatgtccatggaagaatggataagcaaaatgtggtatatacatacaatgtaatattattcagctttaaaaaaaatagaaattttgacacatgccacaacatggatgaacctcgaggccattatgttaaatgaaatacagcagtcacaagaagagaagtactgtatgtttccacttatatgaggtatgtagaatagtcaaatcagagacatagaaagtacaaggtggtttccaagagatggcggtggtgggggggttggggaattattgtttaatggatatagagtttcataattacaaatgacaagtgttatggagatggatgatagtgatgattgcacagcattgtgaacgtatctaatacattcactgaattgtacactaaaattggttaggatggtaatttttatgttaagtgtattttgccacaataaaagatttggaaatcaacaacaaatagaaatcccagaagataacataggaagaaatctagatgatctttagtttggtgatggctttttagatatgacaccaaaggcatgattcatgaaagaaataattgataagctagactttgttaaaaataaaagtttctgctctgtaaaacatactgtcaagaggatgaaaggacaggccacagaagggagacaatacttgtaaaagatatacctgataaaggactcatccaaaatatataaagaaccttaaaaacataacaattagaaaacaaacaatctgattacaaaatggactgaagaccttaacagacatctcaccaatgaagatatacagatggcaactaagtatatgaaaagatgccccacatcttacgtcattagggaaatggaaattaaaacaagaaatgtgatatatctacacgcttattagaatggccaaaattcaaaacactgacaataccaaatacttgccaatatgtggggcaacaggaacactcatccattgctggtgggaatgcaaaatggtacagccactttgacatataccattaatgggaatgtaaagtggtgcagccctggtggagaagagtttggtggttcttcaaagaattaaaaatggaattatcataggatccatcaattccacttctgaatgtgtatacatatcccccgaagaatccagagtatatcgaaatcagtggtttcttataaaattaaacatattcttaccatgcagttcagcaatcacatccttggtatttactcaaaggaggtgaagacttatattcacataaaaatctgcacagagatgtttacagaagctttatttgtgattgttgaaattggaagcaaccgagatgtccttccataggtgagtagacagataaactgtagtacatccaggcaatgaaatattattcatcactaaatagaaatgagctatcaagccatgaaaagatatggaggtaattaaaaaacatattactatgtgaaataaggcaatctgaagaaactacatactgtatgattccaatcatattgcattttagaaaaggcaatgctatggaggcagtaaaaagttcagtggttgccaagggttgttggggaagaagggttgaataggcagtgcacagagtacttttagggcagtgaaaatgtacaaatatatgtaaatatacgtatctgtatgatactataatggtagatacatgcatattagtccgttctcacagtgctataaagaactacctgagactgggtaatttgtgagaaaagaggtttaattgactcacagttttgtaggctgtacagtaagcatggctggcaggcctcagaaacttaaaatcatggcggaaggcaaaggagaagcaggcacatctttaccatggcagaacaggagagggaaagaaagtgagatgggaagtgccacacacgtttaaacaaccagatctcatgagaactcactatcatgagaacagcaagggggaagtttgccccccaccaggcccctcccctgacacatggggattacagttcaagatgagatttgggtgggaacacagagccaaaccatatcaacatgttacacatttgtagaaacccacagaatgtacaccccaacagtgagccctaatgttaactagggactttgataataatgtgtaaatgcagattcataagttgtaacaaacgtgccactctggtgggagagttggtaatgggaaaagctctgtatgtatgggtgcagtgggtatacgggaaatctctgtacttacctctcaattttgctggaaccctaaaactgctctaaaaatataaagtctttaaaatacacatacacacatacagacaatcgaatagagaatcataatggtacactatcagaaaatcatcaaacacaaaaaaaggcagtaagggaggaaatgttgtatttaaaaaatgtaaggcaaaagaaaaggcacaaaatgtcagaacttcttttttataagtaagtactttaaatgtaagtcgattaaattctccaaaaagcagaggttggcagaatggatttaaaagaaaaccatcaacctatgctgtatataacaaactcacttttggtctaaagacacaagtagattgaaagtgaaagaatgaaaaatgatatttcatacaaatagtaacctaaagaaagctggaggtaattatactaataaaagaaataaacttgaatttaaaaattgttataggagacaaaggaggacattacatactgagaaaatggaaaattactcaagacttcgcaattggaaacgtatacacaccaaaatatagagccccagaatataagaaaatatactgacagaattggagtgagaaagacagttctacaataatacttagggacttcaataacgtactttcagtaatgggtagagtcaaagaagaaatgaaaacagaaacttaaaaatatcttcagacaaatgacagtgggaacacaacataccaaaagcaaaacatgcagcaaaagcagttctaagagggaagtttacagcaataaatgccttgcctacattaaaaaagaagagatatttcaaatagcccaaaattgtacctcaaggaattagaaaaagaagaacaaactaaagccaaagttaacagaaggaaataataaagatcagaacagagacaagttagaaagaaaaaccataggggaaaaaagtcagtaaaactaagacttcaatttttgaaacaaagaattgatttttgaaaaataaaatcaacaaactcttggactaagaaagaggacaaaatcagaaatgaaaatggagaatatattacaacaggtacttcagaaataaaaaggatcataagggacttttatgaacaattatatcccaacaaattggataacctagaggaaatggacaaattcctagaaaaaaaccaacctgctaagattaaatcaggaatagaaagcctgaacagaccaatagcaaagagatcacagtggtaaactaaagagcttctgcatagcaaaagaaattatcaacagagtaaacagacaacatatagaatgggagaaaaaatatttgcaaactattcatctggcaaaggtcctatgtccagaatccataaggaacttaaaccaatcaacaagcaaaaaacgaataatccaattgaattggcaaaggacaggaacatacatttcttaaaagaaaatacagaagtagccaaacaaaaaaacattctcatgatcactaataatcagaaatgcaaataatgaggccaggcacggtggctcatgcctgtagtcctagcactttgggaggctgaggtgcgtggatcatctggggtcaggtattcgagaccatcctggccaacatggtgaaaccccgtctctactaaaaacacaaaaattagccaggtatggtggcggtcacctgtaatcccagctactcaggagtctgagacaggagaattgcttgaacccaggaggtggaggttgcagtgagccgagattgcgccactgcactccagcctgggagacagagcaagactctttctcaaaaaacaaacaaacaaacaaaaaagcaaaaaacagacaaaaaaaaacaaaacaaaacaacaacaacaaaaaaacaccaaaccataatgggatgccatctcacaccagtcagaatggcaattattaaaaagtcaaaaaaataaaagttgctgggaaggctgcagagaaaagggaacgcttatacactgttggcaggaatacaaattagttcagccactgtgctaagcagtttggagttttctcaaataactgaaaacagaactaccatctgacccagcaatcccattactggatatatattcaaaggaaaataaattgttctatcaaaaagacacatgcatttgtatgttcatcacagcactattcacaacagcaaagacatggaatccacttagatgcccatcagtggtggattggataaagaaaatgtggtacatgtacaccatggaatactatgcagccataaaaatgaatgaattcggccaggtgcggtagctctcacctgtaatcccagcactttgggaggccaaggcgggtggatcacctgaggtcaggagttcgagaccagcctgaccaacatggaaaaaccctgtctctactaaaactacaaaattagctggacgtggtggcgcatgcctctaatcccagctactcaggaggctgaggcaggagaatcacttgaacccggtaggcggaggctgcagtgagccgagatcatgccattgccctccagcctgggcaacaagagcgaaactccgtctaaaaaaaaaataaaaaaaaaaaatatatatatatacatgaatgaacttacgtcctttgcagcaacatggatgcagctagaggccactatcttaagcaaattaatgcaggaacagaaaaccaaatactgcatgttaccacttgcaagtgggacctaaacactgagtaaacatggacataaagatgatcagtagacactggggactacttgggggaggaatggagaggtgggctgaaaacctacctattgggtactatgctcactacctgggtgataggcttatccacactccaaacctcatcatcatgcagtatactccatataccatgcaacatatagacctgtacatataccctctaaatcaaaaataaaagttaaaaaaaccccaaaacctcaaacaaagaaaagcccaggaccagatagcttcatgactgaatactacccaatattcaaagaataccaatacttcttaaactcttccaaaaaaatgcagctatagggaatacttccaaaaaaaaaaaaatgcagctaaagggaatacttcctaacacattttatgaggccagcatcaccttgatacccaggtgagccaaaggcatcacaagaaaaggaaactacaggccaacataacccaagaataccgatgcaaaaatccttaataaaatattggcagactaaatttaacaatacatcaaaaagattatatatcatgtctatgtggaattaatttctggcatgcaaatcttatttaatatacatgtagcaatcaatgtgatactaacagactgaaagatgaaaaccacatgatcatctcaattgacacacaaaaagtatttgatgaagttgaacatcctttgttgataaattctaacagttcaggtatagaaggaacactcctcaatataacgaatgccatttatgaaaagcccacagctaacgttataatcaatgagggaaaacagaagcccttctactatgaaccagtacaaggcaaggatgcccactctagctactactactcaacatagtactggaagtactagtacaaccaaacagacaagaaaaagaaatgaaagacattcaaatcaggaagtaagaagtaatattatctttatatgaagatgacatgatcctacatatagaaaaccccgaagactctgacaaagcaacctgttagaactaataaatgagttcagtaaagttgtaggatataaaatcaatataaaacagtagttgcatttctatacacaaataatgacctggccaaaaaagaaatcaagaaaacaatcccatttatgatagcatcaaaaaaattgcttaggaataaatttagccaaaaagatgaaagacctgtacactgaaaactatgaatcattgatgaaagaaattaaacaagatacaaataaatggaaagatatcccatgctcatgaatctgaataatattgttaaaatgtcaataatatccaaatcaatatacagattgaataaaatccctatcaaaatcccatggaaaatttttttaaattctaaagttcatttggaatagcaagaaccttaagtagccaacgaaattctgaaaattctgttctgaaaaacaaagggagacttcatactttctggtttattttacaaaactattgatcaaacagtatggtcctggcataaaaaacaaacatgtagaccagtggaacagaatagagagcccagaaagaaattcaaagatatatgatcaaccaattttccacaagaacacgaagaaaacaatgcagaaagatagtctctctcataaatgacgttaggaaacccagttctgtggcttgtccaacccatggcccacagaccacatgtaagcccaggatggctttaatgaggcccaacacaaatttgtaaactttgttaaaacattgaatttttttgcatttttttagcccatcagctgttgttattgttagtgtattttatgtgtggcctaagacaattgttcttacagtgtggccccgggaagccaaaagatttgatatcgctgccttacaccatacatagaaataaactcaaaatggataaaagacctaaacataagaccaaaacccacaaccagaagaaaacataggggaaaagctcgacatggctctggcagtgattttttggagatcacaccaaaagctcaggctacaaaaacaaataattggtataccatcaaactaaaaaacttctgcacaggaacggaaacagtcaacaaaaggaaaaggcaacctatggactagaagaaaatatttgccaaccatatatcttataagaggataatatccaaaatttataaggaatgcatacaactcaataacaagaaaatagataacccaattaaaaaatgggcagtggaactgagtagacatttttgcaaagaagttataaaaatggcaaacacatatatgaaaagacatttaacatcactaatcgtcagggaaatgcaaatcaaaattactatgcgatatcacctcacactcatgagaatagctattaagtgttggctagggttagggaactcttgtacagtgttggtgggactgtagattggtgcagtcataatgaaaaacagaatggtggctcctaaagaaattgaaaatatactatcatctgacccactaatccctcttctaggtatattcccaaagaaaatgaaatctccacctcataaagatatctgcgctcctatattcattgtggcattatatgcatgagtcacgatatgaaaacttacgtgtccattgatggatgactaaactgtggtgtgtatgtctacaatggaatattattccgcattaaaaaaggagatcctgccacttgccacatggatgaaactggaagacattgtgctaagttaaataagccatatacaaatgaaaagttttaaataatctcacctatatgtagaatcttaaaaagaaaaaagtcaaatatacagagatagaataaactagtggttaccatgggcaaggtgtgggggaagaaaatggaaagatgtaggtcaaaggataccaagtagcagatatataggatgaacaagtctagagatctcatgtagaacatgagaatagttagtatattgcatttggaatttttgccaattgagtagatcatagcttttctcactcatacacacaaaagaataactgtgagatgatggacatattaatttgcatcactatgttaacgatttaactgtatgttttatacactaaatatgcatatttttaaaattaaaaaaaaaaaacacaacaagataatgtacagccagacagaagcccaataagaaaagagaggacttgaacaataccataaaccaactagacctacaaacatatatggacactccacccaactacacattcttctcaagtgcacatggaacattccctaggagggatgatatgttaggccacaaaagagtctcaataaattttaaaatatagaaatcatacaaaatatcttctctaactacaatatagtgaggccagaaatctgtaacagaagaaaaacctaaaaattaacaaattcagggaaataaaactacacactctttaaaaattattgtgtcaaagaagacatcagaagggaaattataaaatactttcaaaaagtgaaaatgacgacacaacatactcagacttatgggatgtagtgaaagaagtgctcagaggaaaaattatagctgtgaatgcccacactgaaaaagaagaaggatccataacctaatattataccttacgtaaccagagaaagaagaacgaagtaaacctaaagttaaaagagagaatgaaataatatgtatgagtggagataaaactgaattcgagcttaaataaacaacagagataatttaacaaaaccaaaagttgcttgtttttgaaaagatcaaagttgaaaacctttaactagaatgactaataaaaaattagagaagttgcacatatctaaaatcataaacaaaagtaggaacacaacaaaaaaaaacaaaaataagaaaaaaaaacaaaagtgggaacgatataactgatcttacagaaataaaaagtgtgataaaagaatactatgaataactgtataccaacaaattatataacctagataagatggacgaattcacaaaatactaatacagaccaaaacagaaattgaaattatgagcagacccataacaagtagaaagtttgaatcagtaaccaaaaaccttccaatgaagaaaatgctacacagatggcgtcactgttgaattataccaaacacttgaagaattcacaccaatccctctcaaactcttccaaaaaacagaggagaaaaaactttgcaatacattctatgaggccagtattacatggattccaaagccagacaaatataccacaagaaaagacaaactagatactaaaatcttttatttaacaaagtactagtaagccaaattcagcagcatattaaaaaggattatatatcatgaccacatggaatttatctcaagaatacaagggtggttcagtacaagagtatcaatcaatgtaatacaccacattaatacaatgaaggataaaaaatccatgcaatcatttcaattcactcagaacaagcatttgacaaaattctacaacctttcaggataaaaacatggaactttcaaaatgtgttaaagaggatttgtgaaaaatccacaactaatatacttaatgagaaaaaaaactgaaaaatttctcccataacaaagagtaagatatggctgtatgctttacccagtgctattgaacaatgtactgaaagttttaaccatgacaattaggcagataaataaacaaacaggtaaatgaatagcatccaaattggaaaggaagcagtaaaactctttattcaataatgacatcttctatctagaaaatcaaagaatccacaaactagtagagctaataaacaagtccagcaaaattgcagggtacatgttcaacatttattttaagaaaatcatttgtgcctctatataccaggaatgaacagcccaagaaggaagtcaatttttaaaattccacttacaatagcatcaaaaagagtaaaatagctaggaataaattaaaacaagaaggtgaaagacttctgcactaaagactacaaaacactgttgacaaaaattaaagaagacttaaataaatagaactatacatcctgtgttcacagattggaagattaaatattgttaagttggcgatattacccagtgatctacagattcaatgcaacccttatcaaaatcccaagggcctttttatttgcagaaatgtaaaaactgattttaaaatgtaaatggaattttcccagggccccaaacaatctaaaatcatattgaaaaagaacaaagttggaagactcaggcctgccattttcaaaacttttacaaagctgcagtaatcaaaacaatgtggtactgacacaatgtggtctctaggacacaaggatggacatatagaccaatggaatataatagagaatgtagaaataaacactcacatatatgatcaattcattttcaacaaatgtatcaagaattcagtgggaagagtagtcttttaacaaatggtgctggggcaactggatcctcatatatcaaagaatgaagttggacccataactcatagcatataaaaattatctcaaaatgtatcagagaccaaaaaataagagttaaaggcataaatttcttagtagaaaacaggagtaaatctttatgacttgagattggaaataaattcttagaaaagacacaaaaaacacaatattgtaaatgtactaagtgacactgaattgtacattttgaaatggtttctgttacttaaaaaatttaaagggtgcacagaagactaaaaagcagcacagacagaattatcaccagaaaaagaagactctatattaaatgtcaacatggagaacacatgtcagaaataggtagtccagagcagcagctatagtggaggctcttgcaaatgactaagatttgaggtggcaccctcagagaatcacctcttgggggtagattcgatttatggagtagatgtatctcagagacatggtaggaaagccaaagaatggtgagcatagctgccatctagaaaccacctacacatgcaagcataagagattggttgaaaggttatagcacagtcacactaaggaatactatgcaactttagcaatgcaatgagaaagatctctgtgaatggatgttgagtgatttctaggagatgttgttaggtgagaaaagcaaagttcaaaagggcatatacagaatagtacttttttgggaaatgagaaaataatcatgtcttataaagagcaaacacacacaaactataaactagaaaacactgaaactggttacctataatgggtagggggaattaggatggaagagatatgggtgagaggaagatttctctcagtagctccttttgtttagtattgacttttggaagtatgttaatgttatatgtattcaaaaaataaaattaacaagatagggaccacttctgaggtggtggaatgagcaccttgatataaccactccctgaaaagcaatgataaaactggacaaagaaatataaaattgaaaagtgctaattaaagaaaaaatattaagccttcctaagaatagcagggttatgatttaacgtggggctgccatctccccacccaagctcaggggcacggtaggcttgaggaccagcaacaaagaaggctcatctgattttgaattccatagaaaaccctatgcactatgttaagcaacaaggatttcagtggcaaataattggaggcaacccacatcacagcaacctaatgtttcaatactggttgggcaagcgacagattaagaaaaattttaaaaggaattctggagatatggaagttgtacatgcttgcaggagagatcagagaggtttcctgctatctacttatccttggctgactgtgagaccttttgcaagcagacagtaaaatacaggacagagttataaagtgcctgaactttgaatgtcccaacccacacatagatcccctcagcagagggtggaagattcactggctcaagatgtttaaacaaatgtctgactaatcatggcttgaccactaggttatgctgatccaggggtgacaccaatgaagccaggcttacaaaacaaacataagaattaaaacaaacaaaactgagcaaagacaccagtggctgcacactgcaggagaacacagactctgcagaatccatgcagagaaggcatacacaagcgagcaaacaaataaatgagtaacagaaatcatccctggttagggagaagaactagaatccagagtttctacgatatattatctaaagtaagtttttaacaaaaaaaatgagatatgcaaagaaacagaaaattgtgacccttgaacaagaataatgagcaataaataggaattatctctgaagggccccaaatgttagggcgcgatttcaaagtaagtattataactatgttcaaagaaccaaaagaaaccacattaaagaatgcaagtgtgatgacaaagactcatcaaatagataatatcaatatagagatagaaattagaaaccaaatagaaattctgtagttgtgaaatataataacttaggtgaaaaactcactagtgcggctaagcaaatttgacctggcagaagaaagaatcaatgaacttcaacgcagatccataaagatgattcagactgaagaatagaaagaaaaataatgaagaaaaatgaagagatacccattggataccataatatagtggtccccaacctttttggcatgagggaccagttttgtggaagacaatttttccacagccagttgggggaggctttagttagattctcatacggagtgcacaacctagatccctcacatgctcagttcacaataggatttgctctctgtgagaatctaatgccatcactgatcagacaggaggcagagctcaggcagtaatgcttgcttgcctgctgctcacctcctgctgtgtagcccagtttctaataggccacagactggtaccagtccatggccctggggttgggaacccctgtcctaacaggatgtgtaacaatgtatgtgtaattaagttgtaacatatatgtaattaagagtagaaaacatatgtggaattaaggagtaacaacatatgtgttaataagagtactgagaaggagagaatagggcagacaaaaatatttgagtagattattaacctgaagcagattgtttttgcttaagctgcttattgtaacctccagattacactttaaaaatgggggaaataaactaacaaaggaattagaatggtactctagaacatatctattcaacctgcagaaggcagtaaaggaggaagagaggaacaaaagtgatatgagacatatagaaaataaataacaacatggtagatataaatccttccatatcaataattatattacatataagtgaattaaaaactcaataaagagcagagattgccagactgccttaaaagcaggatccaaatatatatggtctataagagtcacattctagattcaaagacatagttgaaagtaaaatgatggaaaaagatgacatgcaaacagtaataagaaagctagagtgactgtactaaaatcagacaaaattggctgggtgcagtggctcacacctgtaatcccagcattttgggaggctgaggcagacagatcactcgaggtcaggagttcaagaccagcctggtcaacatggtgaaactctgtctctactaaaaattagctgggtatggtggcaaatgcctgtagtcccagctacttgggatgctgaggcaagagaacggcttgaatccgggaggcagaggttgcagtgagccaaggtcacgccactgcactccagcctgggcaacagagtgagactccatcccaaaaataaaataaaaataaataaaatcagacaaaatagactttaaaaacaaaccatgttattagagatactgagaagcattttacaatgacaaaagggaaaatttaacaggaagaaatagaaatcataaacagaagtcataaagaaataaaaatttataacagctaaaaacacagccctgaagtatatgaaataaaactgtcagaaatgaagagagaaacagacaactgaacaataatagacaactcaacaataatagtactaactcttgttgattttctgtcttgttgttctatcaattattcagagtgagttattgaactattacccaactactattcttggatgaaatggtgggaggtgaggctatgtggcactctgcttaataccctcccctgttctggtgtcagggagacaaatgtggagctgacttttcgtcagaaacagtggtacccagaaagtagtggggtaacagatcccaagtgctcaaagtaaaaaaaaaaaaaaaaaaaaaaaaaaaaagccaaccaagaatactgtgtccagaaaagtttctttcaaaaagaaggcaaaataaaagcattcccagataaacaaaaacagaattccttgttagcagaccagttttgtaagaactactagaggaagttcttcaggcaaaaaggaagtgctcccaggaagttcacatatatccaaaagcaaagagcaaggaggtaaataggagcaaagctgttctagagtaaggaaataccaccagttggtaactcaaatccataaaaaccaaaaaagtggatcaaatatatgatataaggaggttaataaaacagaaactagaaatatatacttgctctcctttcagcttctttaaagatatatcattatatagtatgatcattataatagcgcataataaagatgtaatatatgtaacaataccacaaaaagtggtaaaactgaataaactcatacaggaataacttctgtatctcaccaggattaatataaatatgaagtaaattttgagacgatacataaggtaagccctagagcaaacactaataacaaatagaatattgaagaatcataaaagaaatgaaaatttatattagaaagtagtcactagatggaaaagaaagcagcaaaggagaaatagaggaacaagaaatagtacatagaaaagaccaaaagtaaaactgtggatataaatctaattatatcaataataatattaaatgtgaatggattaaacaatctaatcaaaggcaggaattatcagaccagatttgaaaaacaggatccatctgtattccatctatatgaggcacactttagatgataaatgccaactgaaagtaaaaggatggaaaaagatatatcatgtaagcagcaaccataagtaacctgaagtgctataataaagtcaaaggagattttaaattaagaatgttactgaagttaaatatgaatatctcataatgataaaatgtcaattcatgagaagatacaatgattataaacatatattcacctaacaatagagaactaaaacataagaagcaaaaactgacagaactgaacagagaaatagccaattcaacaatagtagttggagacttcaacactccactttcaataatgtgtagtacaagaaagaagatcaataaggaaacagaagatatgagcaacaccataaaccaactagactcaaaaggtaattatagagcacttcgcccaacaaccaacattgaatatacagtattttcaagtgcacatgagacattctccaagaaggaccatatgctaagtcacgaaacaaacctgcataaatttaaaaggattgaaataatacaaggtatctttttctgaatataatgaaataaaagtagaactcagtagcaaagaaattagggaaacatacacatgtggaaattaaacaacactacattcttaaataatcaatgggtgaaagaattcacaagggaaatggaacgtactttgagattaatgaaaatgaagatacaacataacagaacttatgggatacatttaaagcagtgtaaagatggaattttatagctatgaatgcctatatcaaaaaataaggcttcaaatcagtaagccaactctccacctcaagaaactagaaaaagaagagcaaactaaacctaaagcaagtagaaaaaacaaaataataaatattagagtagaaataaaatatagaatataaaaataataaagtcaacaaatccaaaatttggttctttgaaattaacaaacctttgatagattggtaagagagagggagagggagaagaaaagaaggggaggaagaaagagggggaggaggaaagacagagagggaagtgcatgaggcaaagggggagagagaaaactcaaattactaaaatcagaaatgaatgacagttttacaaattaaagcaaaaaaacgaggctagctgcagtggctcacacctgtaatcccagcactttgggaggccaaggcaggagaattgcttgtggccaggagttcgagaattgcttgtggccaggagttcaagaatagcatgcacaacaaagcaagaccctatctctacaaaatattttttgaataacagctggtgttgtggtgcacacctgtcataggctaaggggcaaggatcacttgagactaggagatcgaggttacagtgagctatgattacaccactctattccagcctgggcaacagagagagactctgtttctcaaaaagaaaaggaaaaaggaatgaatgagggaagtatactaccaacctgacagaaataaaaaggattatgaaggaacactatgaacaattttgtgccaataaattataaaacttagatgaaattgacaaattcctagaaagatgaaaactatgaaaactgactaagaaataagtagaaaatgtgaatggatctgtaataagttaaagagattgaattagttatgagaacactagttgaaaagaaaagcccaagagggccagatgagtgaatctaacaaatatctaaagaatatcaattctttatgacctcttccaacaacaaaaaaatagaagagaaggaaaatttttccaatacattctttcagtccagtatcaccctgacaccaaaaccagacaaaaacatgaaaagagaacttataaaatttattttacccattttaggtatatagttctgtggcattaggtaaatccacgctattgtgctttatgctttcttgatgttgtaaatagaattgttttcttattttcagattgtttttgacagtgtataggaatactattgatttttgtatttcattacaataactgtgatgaaaatgatgtaaaaccctcaaaaccctcaacaaaatactagcaagtaaaatcaagcaatgtttaaaaaggattatacattataaccaaatgggacttatttcaggaatgcaaggttgaattaacatctgaaaatcaattaatgtaatacaccattatcaacagaataaaagacaaaacaccacgatttctgtcagtctgttcagactgttataacaaagtatcacgaactggtggcttataaacacagaaatttattttttgcaattttacaggcttggaagtccaaggtcaaggcactggcagattcagcatctggagaggactcgctttctggttcatgaacagttgtcttcttgtgtcctcatatgacggaagaaaaaaaggagctcactgaggtctcttttacaagggcactaatccattccatgaggtctccaccctcatgacctaaccacttcccaaaggcctcacctcctaataccaacattgggggttaggatttcaacatatacattttgaggaaacacacacattcagtctatagcaattaatgatagaataaaagacacagaaaagcatttgggtgataaaattcaacacccttccatgatgggagaaaaagccctactcaatatactaggaatagaaaggaacatcctcaacctgataaagggcatctattaaaaatcacagttggccgggtgcagtggttcacacctgtaatcccagcactttgggaggccgaggcgggtggatcacgaggtcaggagatcgagaccatactggctaatatggtgaaaccccgtctttactaaaaatacaaaaaaattagccaggcatggcagcatgcgcctgtagtcccagctactcgggaggctgaggcagaagaatggcgtgaacctgggaggtggagcttgcagtgagccgtgatcacaccactgcattccagcctgggtgacagagcgagactctgtctcaaaaaaaaaaaaaaaaaaaaaaaaaaaatcacagataatatcatacttaacagtgaatgactgaatgtttccccgttaagatcaggaatgagacaaagagatctgctctttccacttctattcaacatttattgagtgttccatccaggataatttgggaagaaaaagaatccagactgaaagaaagaagtagaactatttggagatgacataaatttgtgctggtccagttttgtgttactataaaggaacacccgaggctgggtaatttataaagaagattttaattggctcacagttcttcaggctatacaggaaatatggcaccagcacctgctcctggtgagggcctcaagaagcttacaatcatggcgaaaggcagaggggcaggcatatcacatggcaagagcaggagcaaggtggagggaggtagcagattctttaaacaaccagctcttagcataaactaccagagtaagaattcgctcattaccacggggatggtaccaagccattcacgagggctccgtccatgatccagacaccccccaccagaccccacctccaacattgggaatcattttaatgagatttggagggaccaaacatccaaaccgtatcaatgttgtatacagaaaaccccaaggaatccattgtgaaacaattacaacgaatgagttcagtaaggctgcaggagacaaaatcagtatataaaaatcaattgtatttctacacactgtcaaaaaacaatctgaaaatataattaagaaaacaattccatgtataacatcaaaaaagaataaagcacaacagtgcgaatttacctaatgccacataactatatacttaaaatgagtaaaatagtagattttatgtatatttttaccataataaagaaaaaataaaataccttgggaataagtttaacaagtacaaaacttatcctctgaaaattacaaaacattgttgaaagaaaagaagatacaaataaatggacagacattacatgctcatagactggaagacttaatattgttaagatggcaacactcccggaatcgtgctgatctacaaactcaacacaatccttaccagaatctcagctggtttctttgtagaataataagctgatgttcaacttcatatgaaaatgcaaaggacccagaatagcaacaattttgaaaaagaaaagttggaggcttcatacttcctgatctccaaattgactacaaagtaacagtattcgagaaaatgtgatactggcatgagatagatatgtagatcaagggaatagaatcagagtgtaaaaacggagccatatatctatggtcaattgatttttgacaaggatgccaagaatgttcaatgcggaaagaatagtcttttgaacaaatagtgttgaaacaactgatatccacatgagaaaaatcaattggtccactccacatcatatataaaaattaactcaaagtggatcaaagacataaatacgtaacagataaagctataaaattcttagggtaaacataagggtaaatctttatgaccttggatttggcagaggtttcttagatataacaccaaagaacaaggaacaaaagaaaaaaagtagatatattggacttcataaaaattaaaagcttttgtgcttcaaaagacaccttaaagaaagtgaaaagacaacctacagatgggagaaaatatttgcaaataatctatctgataggggacttgttactggatatataaataactccttcaactcaaaaacaaaaagacaaatatcccaacttaaagaatggatgaaaaatcggaatagaaatttcttcagggttgacatatagttaataaacacatgaaaagatgctcaacgtgagtagtcacagggaaatgcaaatcacacccaaaaggagatactgcttaacaaccactaagatggctataattgaaaaaagataatagcaagtgttggtgaggatatggagaacttgcgcagtgctcatatgctggtggtgagaatgtaaaatgaggcacccactttggaaataattggtcagttcttcaaaaagatagttatcggccaggtgctgtggctcacacctgtaatcccagcactttgggaggccaaggcgggtggatcacgaggtcaggagatcgagaccatctcggccaacatggtaaaaccctgtctctactaaaatacaaaaaattagctgggcatggtggcatgtgcctgtaatcccagctacttgggaggctgaggcagaggaatcgcttgaacctgggaggtagaggttgcagtgagctcagatcgcgccactgcactccagcctggcgacagagcaagacttcatctcaaaaaaaagatagtgatcatttgactcagctttccactcccatgtgttttcatatctctttcttttcttcctttctttttgtttttttgaaacagtcttgctctgttgcctaagctggagtgcagtggcacagtctcggctcactgcaacctcttcctcccgggttcaagcaattctcttgcctcagcctcccgagtagctggaattacaggcacctgccaccatgcccagctaatttttgtatttttagtagagatggggtttcaccatgttggccaggctggtctcgaactcctgacctcaggtgatccacctgccttggcctcccaaactgttgggattacaggtgtgagccaccaacacacccagcctttcatatctctttcatgcccaggagatatgaaaacacatgtccacacaaaaacccacatgttctagaagcattattcatagtagtcaaaatgtggaaacaatctaaaatgcttatcaacaaataaatggataaacaaaatgtttattcattgtatatcatacgatggaagattattcattcataaaagaatgaagcacaagggccgggtgcagtggctcacgcctgtggtcccagcaggttaggaggccgaggtgggcggatcacctgaggtcaggagttcgagaccagcctggctaacatggcgaaaccccgtcactactaaaaatacaaaaattagccgggcttggtggtgcgtgcccgtaatcccacctacttgggaggctgaggcgggtgaattgcttgaacccgggaggcggaggttgcagtgagccgacatcgcgccactgcactccagcctgggcgacagagggagactctgtctcggggaaaaaaaaagaagcactgaagcacaaaccttgaaaacatgatgctaagtgaaagtaaccagtcacaaaggaccatacattgtatgattccacttatataaaatgtccagaataggcaaacccatagagagaaagattagttattgcctagggctgagggggatggaatagtgggtttgggggtgatatttaaaaggcactgggtttctttttggaatgataaaaatgttctcaaactggagtggcagttgcacagctctggggatacacaggcacacttcacttttttgcactttgtggatattgtgtttttaaaaaattaaatgtgtgtggtaagcctgcactgagcaagtctatcagtgccatttttccaacaacatgtgctcacttcattctgggtcagcattttttagcaataaagtgtctttcaattaaggtaggcacattgttttcttagacatggggctattgcacacttaatagactacaatataaacataacttttatatgcagtggcaaaccaaaaaatttgtgtgacttgctttattgcaatatttgcttcattgcagtgtactggaaccgaaccacaatatctctgaggtatgcctatactaaaaaccattcaattatattctttaaatgggtgaattgtatggtatgtaaactatatctccacaaggctgttagaaaaaagctatagcagaagatatttggggtccagggccaaagacttcttagacctgacatcagaagtgtaatccataaaaaggaaacattgaatctcatcaaaatttaaaatgtttgctctgtaaagtaccctgttgagatgatgacaatgaaagctacaatgaataaatatttgcaccctgtttctgacttaagataagtatctagaatatataaacatctcccaaaactcgacagttaacaaaaagtctaattgggaaatggaaaaatgatatcaacaagaatttcactgcatagaatacaaaaatggcaaacaggcacatgaaaagatgttcagtatcatcctaatgaggaaatgtaaatgtaaaccacaatgagatctcactacacacctatctgaatggagaaaattaaaaacagtgtgaacatcaaatgccagcaagaatgcagagaaactagatcacttagaccttgctggcaggaatggggaatgtgaaatggtgcagtcactctggaaaatcagtttggtagtttcttataaaactaaacatgcaactgccacacaactcagcaattacaagcttgggcttttatcccaaagaaataaaaacttatgttcacacaagaaccttacaagaatattcatgtcatccttatcaatgtataaggttcccatggctgctgtaatacatttccacaaacttagtggcttaaaacaagacacgctttttttttttttctcacagttctagaggccagaagtctgaaaagagtcttaggggacgaaaaatcaaggtgtcagcagggctggttccttctggaggcttcaggggagcatcccttccctttccttgccttttcttctggaagcgttctttggtttgtgaccccttcctcaaatcacattgccatttcctgcccctgcttccgtggccacgtaaccctttttctcttctgtagtcattcttctgcctccctgttataaggacccttgtgattacaccgggcccattcagataacccaggatgatctctccatctcaaggtccttaatttgacacatctgcagagtgccctttgccatagaaggcgatagtcacaggttctaggcgttaggacctggctactttgggggccattgttcagcctactctgatttgtaatagcccaaactgggaatgacccacatgtccttggatgagggaatggttaaataaactggggtatatgtccataccgtgaaactccactcagcactatgatttaatgaactgtcgcgatacaaaacaaccggaatgaatccagagaatgatgccgagccaaaagaccccgtttctaagatatcgtgtattgtgtgattccatttacgtggcatttttgaaaagacaaaactagagaatcagagaacagatgagtggtcaccagggattggagggatgggatgggagaaagtccgtgtaaaaggacaaataatgggaaccccgtggcgacgggagcactctgcatctggactcttgctgttgacatcctggttatcatattgtgctatggttttagaagatgctaccactgacggaaactaactaaagggtgcatgggatccctattatttcttaccactgcatatgaatgtctaaaaataaaaagcttgaaagtctcatttttttaaacgggcaaaagatctgaataaatatttcactaaagaagatacacaattgggcactaggcacgtggaaaaatgctcagcatcattaggaaaatgcaaatcaaaaccacaatgaggtaaccattccaactggacagtatttttttttctttctgtactttcgtggaaggggtgctagagttggaaaatgatcatttttgcaactaccacagtaaagcctggtttccaaaagcatttaaatctggagagactttttttttttttttaacaagtagcagggtatatgcatggccttaaagaatctcccccgattgtttattggttgcaaggcaaaatatagtaactgtaaggtagaaaagtggataacggcctcaatttggtgatcaaaataacatcgttaataaggggcagatacactgtgtgcctcaggatgtgatacactgagaaggacatcaggtcacttacagagtacacaacgtggatctaacctgaggaaacatcagactcccccaagaagtggcaggactgtatctttaaaaaatatcagtgtcataacagagaaagagactagaaatgttccagattaaacaagactgaagagacacatctaaaggcagtactgaccctgaactggatcttgcagtggaggaaaaaatgccacaaaggacattgtcatggcaactgacaaaatgggaacataggcattaaattaggtccaagtattatattgatgtttaattgcagaagtcaataactgtattactgctttcaaagataatatctttatttttcagaaatacacagcaaaatgtttaggggcaaagagctgtggagtatgcaactcacagatgtttcagaaaaacatgttatgtgaatataatgtagagaaaggggttcaaatgataaagcaaatgtggcaaaatgtaacaattagtaaactggtaaatcttagtgaagggtatgtaggtgtttttatatctcgtgcttgtaatttttctgtagttcaaaattatggccaaataaacagtttgttttgttttaagaaacaatcctgagggactgctttagctcagcaggtcacaactgggggcaattttgccctccaggggacatgtagcaacatgtggagatgtttttggtggtcataactgaggccggagatgctgctaaacatcctgcaatagacaggacttcctccctcaacaaagaattatccggcactagatttcaatagaggtacagtggagaaactctgccccacttggctgacaataagtcactctgccaggactggtgggcaggaatgccggccgggaaagaggaaccctgcctgtggaattcaaggtcagacaaaacgagaaaaacaacctggctacatcactgaaattaacaagcctattcctgtgtcacgggctgaattgtgtcccacaaggtttgcagttgaagccctggtctttaatacctcggcacgtgactcagcatgtttggagacaggacctttaaagaggtgatgaagctacaatgaggctgttagggtgggccctaatccagtgtgactggtgcccttaaagaaaaggatatttggacacacagagaaacaccagggtgcaagtgcccagagcaatggtcatgtgatgacacaggaagaaggcggccatctgcaaggcaaggaaagaggcctcagggaaagcagccttgctgacaccttgatctcagacttctatcctccagaattgtgagaaatacatgtctgctgtctaagccacccagcctgtggtattttgttatggcagtcctagcaaactaatacatcctggaaagttaacacatagaaataaaagttctgtacatagaaacaggttcaagaacctatgttcttgaacaaaatgaattttaagcgatagagaacatcacagagtatgtacaccaaaggaaattaagcagagattataaattttagaatagaattgaaatagaaataaaattcaattagagatagaattaaatcaaaataaaattgtttcagcagccttagaggcatttttactattttactgattgagaaaaacaagatgcagaaagcaggtatgatatgatcccgtgagtttggaaaacaatgataatgccttcattatgtcacatgtattttatttcattgaatattatatgaacatcaggaaaaatgtaagacaacaaatcctagattatcaacataggtaacagagaggaggggagcccaagcaaacataagaaaaaagttctgtactgaaacacatctattccattctactcatctgtaaagttaaagtgtgaatattggaaagtaatacaacattaaggacactaaaagaaagaatagcccctattcagatctggtattgatagagcctgaggccaatttggcagcagacagagacacaagactgtttgctgcatatgggtcctgggtgagcacttacatgttctaactcactcagtcaacacaggagtcctgggagcaggcagttaggatcctgatttcacagatgtggaaactgaggcacagagaatgcagtagcttgcttagggccacataagaaaatggcagagctgggctatgaccctaaagaaggttggccatataggctgtgctccaaaccactccatgaaacctgccactcaatttttagaaacataattgtacaggaagatttaattttcctgtctcagaatttggcagatgtattagggttttttttttttaactaagggcagagcagacctaaatgaggcaatgaataagtatgtatacacaatccatctcaatgtacattttgtctgtccatgtatacaaataaaactttgtgttatacaaatacagaagatattttctgaggtctgtggagcatttacaaaaataatgatgttattttcatacttggagacaaagaaaatcttcattttaaaaaaagtggagacttcataggctacatcctttcactgtaagcctactaaattagaaataaataacagtgataaaaatttactgcttaaaaattaagaagacattaaaagaactctaaagagaaaaatcaaaacacaaaattaaaactatcaagaaagcaatgaaaaggaacatatttcataatcagatctacgtgtcacagctaaagctgcaatcagaggaaaatttatagcctttaaaaatgcctttagtagaagaacttcaaataaatgaactatgactcttaagtaaaagaaaacaaaaatagagttagccaagaaaagggaattaatagctataaaagcttagattaatgaaatagataacaaagagtacaaagatagttttctgataataaaatataaataaaacataaatttctcatgtgcttgattaagaaaaaaggagaaaaaccacaaaagttcaggcataaaggaaaagaaaaacgaagagatgatagagaagaccataaaatcactaaaggaaaaaatcagttgctaccaagtggcaacacaattgaaatgcttgaggaaattaaatagcaatgaataaattactccaaaagatgcaataaactaatttagaacaacatatcataaaacagactaaaaagaaattactaaagatatcctataaaacatgtatcaggcccagatggttttacaactcaattctatttaacctctacagaaaagataatcccaatgttcttcaaacagttccaagacacagaacaaggaaggtagataaaactttgttttgtaaaccattgtatttgcccccacatgatggcagatttcatactcttctgaaagatgtactgttatttctaggatcagatatcagggatgtcctgcatcagtgatgagagtgaagcttcacagttttgatggctgtttaacggagatatgatacttgaagcagacctccactgatgggtatgtcggtggtttgcaattttttgctatttaacaattgcagaaatcaatatcctgatgatggattattttgcaaatgtgtaagatatgtgtagaataaatttctagaatgattcaaaggcatatgcatctttaattttgattgaaattgccttatttatctccacagaggtttgtatcaatttatttttctaacatcaatgactgagactgagagtttccatgtacacatacccatagagtgttatcaaactctttgatatttaataatcagataagtttcaaaaaccccattgctttagtttgcatttctcttg

SEQ ID NO: 140 - DNA, 1226 bp, Homo Sapiens
gcagaatgcagatggagccagcggggagaggagtggacatgagagaaagatcccatagccctcttggtcttggttggaacaggaggaaaatgaaaactggacatccatcttaggacttaatcctacggagaccacaagctggaagaggcactcaatactagcatggcttctgtggcattttgatgagtagtatgggctccacactgaaatattaatatcttattgttttgatgatgatgatgatgttcattggcccagggcaaaaggtaaaggttgtgttataaagctgatctattcaatatctgtggatgttaactccaccccatccccttattgaacaattacgatgcctataaatattgtattgagaaagaaaaaaaaaactaaggcagaagatatcatattacctgtccatatgtgacattttggctggccaagccataatggccaaagaggagcaactgtcaaaatttaagtggggttagaaaagaagagaggaacttgcacgtttgcacctacaaggaccctcttttctcctctggtagccatggaaaccactccttggacctcctttcaagagactctgcatggggagcacagttgactgacagctccaattgctgctccttcgagtccaccatggcactcatgcccacgcaatgtttcctccagggttctccaggtagagatggagcaggtggggttgccagaggcaggccatcaggccatcttgactgatgtgggacttctaatgcttccaggtctgaaggctcacctgccacttcctgctccctcctcctttacccttcacaggagtttcctccccataaatttcttgtgtatctagtcctgtcttggcatcagcttcttggaggacttgaactgatatgcactcaacagccagtaaatcctgctaattcacaaaatccttgattatcagtactaaagaaagacactgggggtgaagatgtcatcttctaaaagacttactggggataatctaccaccaaatgtaggtggcaaatgccatctttgatcacataatggaatcaatgaaggaggttattgatctggttcagaggtgactttagaatgtcccaaaccctttaaatatgtgtgtattgagtatgtgtgcaattctccttgaagaacatttatacctttcatctcattaatctacaaaattatcagcagtggcagctaattgtcagttaactaggtagttg

SEQ ID NO: 141 - DNA, 3516 bp, Homo Sapiens
gccaagctggctcaaagagcaaccagccacctctgcaagggtgtgccaggagcaggtggagcagccaccaacctcacccactcaaagaagcagggatggccaggttccaacagcctgagtggctgccacctgatggctgatggagcagaggcgtgaggaaaagctgatggcactgctttgtagtgctgttctttgtctctcttcatctttttcagttaaagtctgttttatcagagactaggattgcaaaccctgcttttttttgctttccatttgcttggtaaatattcctccatccctttattttaaacctatgtgtgtctttgcgcatgagatgggtctcctgaatacaggacaccattgggtctttactctttatccaacttgccagtctgtgtcttttaactggggcatttagcccatttacatttaagtttagtattgttacatgtgaaatttatcctgtcatgatgttgctagtttttaatttttcccattagttaatgcagtttctttatagtgtcaatggtctttacaatttggtatgtttttgtagtggctggtactggttgttcctttccacgtttagtgcttacttcaggagctcttgtaacgcaagaatgtggatttatttctggtaaggtaaataagtggatttatttctcaatgctgtattctatgtcctttaccccaagaatcattactttttaaaatgcaattcaaattagcataaaacatttacagcctaggaaaaggcttgtggcattagaatacttatttataggattattttgtgtttttttgagatacggtctttgtcatcgaggcagaagtgcagtggtttgatcataattcaccacagccctgaactctgagtccaagccatccttttgccttaatctcccaactagttggatctacaagcataaggcatcatgcctggctaatttttttacatgtttttttttttttttgtcgagattatggtatcactatgttgctctggctgatctcaaattcctgacctcaagtgatctttctgccacagcctcctaaagtgctaggattacatgcatgatgcaccatgcctagcgtagagtattacattagtttcaaagtcttattctaagagccatttattgactttggcctaaataactcaatataatatctctgaaactttttttgacaaattttggggcatgatgatgagagaagggggtttgaaactttctaataagaattaacttagacccatttaagaaggaaaaaacacaaattatcagaaaaatataaaagtaagatcaagtgcaaaagttctgtggcaaagatgatgagagtaaagaatatatgtttgtgactcatggtggcttttactttgttcttgaatttttgagtacgagttaacatttaaagaatctacattatagataacattttattgcaagtaaatgtatttcagaatttgttattggttttgtatgagattattctcagcctatttcattatcaagctatattattttattaatgtagtttgatgatcttacagcaaagctggaagctgtatcttcaaaatatgtctatttgactaagaagaagttattcaacaggagttattatctatgaaaaaagtacaaccagaatataaaaaacttgaggaggataaaaagatgttggaagaagtaatattaaatcttaaaaaacatggaaactgcacattggtgaagacacattggtgaagtacaaaaatataaattggatgtagaagaaagggcaatgcaggcaatagaaaaattagtagaaatccctttacaggttagtttgtaaaatcaggtaagtttatttataatgtgctttcatttatttcactgcaaattatattttggatatatatattgtgtttcctctgcctctcttatagcaatttgccttgtagagttctagcaaaaaggtggcatctgtttttactttcaaatatttaaatttccatcattataacaaaatcaatttttcagagtaatgattcttactgtggagtcatttgattattaagacccattggcataagattacatcctctgactataaaaatcgtggaagaaaacctaggaaatattcgtctggacattgcacttggcagtgaatttatggttaacctgcggacgcccaggggctcctccatctccaccgtgttctcctcgggctgaagcccaaagtcccacattttctcctcaaacagctctcagagccacttctgcaggcaggaggacagcgcgtggactcagtgtctgacttgggaagccacatgtgaaggaactgctgggtgactatggtcgtaagtcaatcaaagcagactttccctggcttgctgtgctacgttgattttgttttcgtattttaaaagaagcagaagggaggttctaggaaatttgcccaacgtagatgctgacaagagtggtgacatgaaaaagattacccagaaggaaaacgagctattttctaaacatctgaaatctgtgtaggcttttggaaaagtgaaactagatgcaaaacacaatgatataattctggcaatttccactgacacagaactcagtcaatctgaattaatctaagagttataaggaaaatggcactccaagaagtacctattaacatcactcagctgctgtgaaataggcttacaggcaacatggagtgtcaattacccaatgtttaaagtcgatcatacagattggactacaatctctatggctcataaagtctttaaaggattgacagatgatttatctcatatgtagacaatgattctcagcagttaactagcgcaacttgataatgtcaattgcttgagaaaatcagataattgcttgagaaaattaggacattgcttgaggaagttaggtagttaaataaattactttttttaaagaatagtttaatattttggcaagtagactttaaaataggttggtaatattttaaaggctacttttaaagaagtagcaatataacatgtttaattatgaaaaataatgttggaaacaattcaattttctatcagatcattcacaaatacagaaataccatctcaataattagaagaagtagcagcaatttctgtcatttttatgcaagttactcttagtccatttatttggttttaaatagtgtttttaaaatttgttttcaaacagggctaatcataaataatagaacatattttacaatagttgaaggtaacaaaaagtaagtgccatttaaaaaattgtattagattgtttaaaaatgttgtgggtacatagtatgtgttgtgggtacatcgtatgtgttgtgggtacatagtatgtggggtccatgagatgttttgatacaggcatgcaatgtgaaataagcacatcatggggaatggggtatccctcccctcaagcatttatccttcaagttataaaaaattcaattacagtcttagttatgtcaaactgtacaattaaattattattgaatatagtc

SEQ ID NO: 142 - DNA, 3205 bp, Homo Sapiens
ggcaaccagttgggggtccactgccgcagtgtgggaggtttgttctttcgctctttgcaataaatcttgttactgctcaccctgggtccacactgcttttgtgagttgtaacactcactgggaaggtctgcagcttcactcctcaagcccgggagaccgcgagcccaccgggagaaacgaacaactctagacgcgccgccttaaaagcggtaacattcactgcgaaggtctgcagctttactcctgagccagcgagaccacgagcccaccagaaggaagaaaccccgaatacgtctgaacgtcagaaggaacaaactccagaagcgccacctcaagagctgtaacactcaccgcgagggtccgcggcttcagtcttgaagtcagtgagaccaagaacccaccaattcgggacacaatacctataatcccagtactttaggaggccagggcaggcggatcatctgagctcaggggttggagaggagcctgaacaacataccgaaaccccgtctctacaaaaaatacaaaaattaaccggttgtggtggccggtgccggtagttccagctagtgggggactgcggaggtgggagctgaagcgggaggatcgcttgagcctggaggttgaggctgcagtaaacagggattgcgtcaggacactccaacctggggaacagaacgatgccctaaaaggctggctgagctgactggagtccaatctcctgactctcaatcctccaccatgccggaatccacttgcatttctggcaagaaggttgtttacgctcaaggtctacagggatggaagtggcacccagtgagagggctctgccgatggagctgtgaaggcgtcgacctcattctgacgggcttgttgagactggtcagcgcctgggcaagagggcagctgggatatgtctatgccatgtttgacccatgctattgttttttcctccctttttactttctatctgtactcctctccttctcttccactccattcccctgcccacctccacactgaaaatcgaggccttgggaggagaggtcaagggaggaaagaattctggaaagaattcttccacactttataacaaggagcccaggcactagtattttcctcttgccatcggcggccagccataaaaagggttgatccatgagttgtttctccaactcttcgagcagctcagttcatggcactgctatagtttagactaacccgctcaacattgttagaaacatttagaaatgtctccccctttgccgcaatttccctctctctgccggtgtctgctctaacagctggaagaaatttctccttcatctgctatattcagcctttcactaagcgccatcaattttgcctttgaaatttcttttgtactggtctccttctctcctttccaccgctaatcccggggcctgtctctagccctgtgattctgaactgtttaagaacctcctgacagagctccctgcctctggcttctccacctttgatccattctgcacagccaagacagattcatttttctcaagctctgtttgcatcttaggaggcctcagctcaaaacccctaggctctctaatgtccttggcattgcccagacagctttcacagctccctctcactctaccttcttcccagatcgtggctgcttttgcctcctgtactgttgtaacaaatcaccacgaacttggtggcttaaaacaacggaaacttattctcttacagttctgtggccaaaaatccacactgagtcttataggcctagatcaaggtggcagcagggctgtgattccttgggaggctcccagggagaattctctttcctggcctcttccagcttctcagggctgcaggcatttcttggcttgtggccacatcactccagtctctgcctcagtggtcatattgccttttcttctccctgtagtgaaatcttcccctgcttccctcttataagatacttataattacattaggagcccatctggataatccagggtaatctccccatctcagaagccttaacttaatcacatctgaaaaatcccttttcccatgtaaagtagtagttataggctccatgaaagggatggggacatggatctttggggggaccgttattcagcctctcatcatggccagcttaatccttccacttccctactcgctactacaacaagtatcagttgagtatctactatgtgctaggcactgttttaggcaataggaatcataatgactaatgagccttttcggattcagtctcctgcagggtgaactatccctttcctgagctctttacctcttagagcttggtatcattacatagcatgatcatcacatactatgtatgtctgtgtgtttgacatgtggttcatagctggtgaacggtgctcttcgtttctataggcaggtaggatggacgtgcttcgtagggcctttctccgcaagccctgacatacacagcacagagatgggacagccccctactacatcctgccagatgttgctggcttattttaaaattagaaacgcctatacagtaccataaaccagtgatgccaactggtttatactccataagtttgtactcttggaagtgctagggttggttgcagcctaatatttaggaagagttttgaaaggcactgtgacttgtagcttcacacctgtcttcttaaaagcctggccctttcccgatttcaggttgacatgtgcctcctgcaggcactgacactgaggccttaccggtgactgtttccttattggtaagtgtgttgctttcctaggtggaaactctctgaggaaaaagatcacgttacacgcacacaagcacacacatacacatctttgtaactctctggccccccattggatctagcaaagataacttggatgctagatatttgcataccagccagtgttgtccagcactttcgttcaactctttgacaactatcgtcacattcctatactgcttgtgctatcatttgattaatgtttgtatttaatttgtctcaacttttagcttgtgtaaacttattttaaaaggaagcatttgcatctctaccataaatagaagaccagagtcatttatcataaataaagcataactgtaaaaataaagatactgaaaatgaaataatgttattcccctaagaattaaacaataaaatattgagtaataaaattg

SEQ ID NO: 143 - DNA, 3206 bp, Homo Sapiens
ggcaaccagttgggggtccactgccgcagtgtgggaggtttgttctttcgctctttgcaataaatcttgttactgctcaccctgggtccacactgcttttgtgagttgtaacactcactgggaaggtctgcagcttcactcctcaagcccgggagaccgcgagcccaccgggagaaacgaacaactctagacgcgccgccttaaaagcggtaacattcactgcgaaggtctgcagctttactcctgagccagcgagaccacgagcccaccagaaggaagaaaccccgaatacgtctgaacgtcagaaggaacaaactccagaagcgccacctcaagagctgtaacactcaccgcgagggtccgcggcttcagtcttgaagtcagtgagaccaagaacccaccaattcgggacacaatacctataatcccagtactttaggaggccagggcaggcggatcatctgagctcaggggttggagaggagcctgaacaacataccgaaaccccgtctctacaaaaaatacaaaaattaaccggttgtggtggccggtgccggtagttccagctagtgggggactgcggaggtgggagctgaagcgggaggatcgcttgagcctggaggttgaggctgcagtaaacagggattgcgtcaggacactccaacctggggaacagaacgatgccctaaaaggctggctgagctgactggagtccaatctcctgactctcaatcctccaccatgccggaatccacttgcatttctggcaagaaggttgtttacgctcaaggtctacagggatggaagtggcacccagtgagagggctctgccgatggagctgtgaaggcgtcgacctcattctgacgggcttgttgagactggtcagcgcctgggcaagagggcagctgggatatgtctatgccatgtttgacccatgctattgttttttcctccctttttactttctatctgtactcctctccttctcttccactccattcccctgcccacctccacactgaaaatcgaggccttgggaggagaggtcaagggaggaaagaattctggaaagaattcttccacactttataacaaggagcccaggcactagtattttcctcttgccatcggcggccagccataaaaagggttgatccatgagttgtttctccaactcttcgagcagctcagttcatggcactgctatagtttagactaacccgctcaacattgttagaaacatttagaaatgtctccccctttgccgcaatttccctctctctgccggtgtctgctctaacagctggaagaaatttctccttcatctgctatattcagcctttcactaagcgccatcaattttgcctttgaaatttcttttgtactggtctccttctctcctttccaccgctaatcccggggcctgtctctagccctgtgattctgaactgtttaagaacctcctgacagagctccctgcctctggcttctccacctttgatccattctgcacagccaagacagattcatttttctcaagctctgtttgcatcttaggaggcctcagctcaaaacccctaggctctctaatgtccttggcattgcccagacagctttcacagctccctctcactctaccttcttcccagatcgtggctgcttttgcctcctgtactgttgtaacaaatcaccacgaacttggtggcttaaaacaacggaaacttattctcttacagttctgtggccaaaaatccacactgagtcttataggcctagatcaaggtggcagcagggctgtgattccttgggaggctcccagggagaattctctttcctggcctcttccagcttctcagggctgcaggcatttcttggcttgtggccacatcactccagtctctgcctcagtggtcatattgccttttcttctccctgtagtgaaatcttcccctgcttccctcttataagatacttataattacattaggagcccatctggataatccagggtaatctccccatctcagaagccttaacttaatcacatctgaaaaatcccttttcccatgtaaagtagtagttataggctccatgaaagggatggggacatggatctttggggggaccgttattcagcctctcatcatggccagcttaatccttccacttccctactcgctactacaacaagtatcagttgagtatctactatgtgctaggcactgttttaggcaataggaatcataatgactaatgagccttttcggattcagtctcctgcagggtgaactatccctttcctgagctctttacctcttagagcttggtatcattacatagcatgatcatcacatactatgtatgtctgtgtgtttgacatgtggttcatagctggtgaacggtgctcttcgtttctataggcaggtaggatggacgtgcttcgtagggcctttctccgcaagccctgacatacacagcacagagatgggacagccccctactacatcctgccagatgttgctggcttattttaaaattagaaacgcctatacagtaccataaaccagtgatgccaactggtttatactccataagtttgtactcttggaagtgctagggttggttgcagcctaatatttaggaagagttttgaaaggcactgtgacttgtagcttcacacctgtcttcttaaaagcctggccctttcccgatttcaggttgacatgtgcctcctgcaggcactgacactgaggccttaccggtgactgtttccttattggtaagtgtgttgctttcctaggtggaaactctctgaggaaaaagatcacgttacacgcacacaagcacacacatacacatctttgtaactctctggccccccattggatctagcaaagataacttggatgctagatatttgcataccagccagtgttgtccagcactttcgttcaactctttgacaactatcgtcacattcctatactgcttgtgctatcatttgattaatgtttgtatttaatttgtctcaacttttagcttgtgtaaacttattttaaaaggaagcatttgcatctctaccataaatagaagaccagagtcatttatcataaataaagcataactgtaaaaataaagatactgaaaatgaaataatgttattcccctaagaattaaacaataaaatattgagtaataaaattga

SEQ ID NO: 144 - DNA, 4673 bp, Homo Sapiens
tccacctttactttcttctcttaatgtttataattaggtcgttaccttaaattctcctattgcttatgtttgtcactttaaatgatatctttaacctctatttcttgttctgtgaattttaggtaggatcccttaactctacactttaaaaattaagatatggtagaatttttttggcaagaaaaaaattaaaaagaagaaaaacttaagctatttggctccttactcttccttcaacttttcttccacaccagagtcctttccacatcccaccatctaccacctactttttccttttatatttccaaggttgttaacatttaccttcatgcaatcaccacccgggtttctgtgctttttcacagattgactctaaatataatgacccagaaacagcatttacattatccttattgtgtaaatattctttaaagttggaccaagtactatattaagattgcattacttttttctgtggaccaaatacaacccctagggtcactcaaaagagattgtgatggctttgtaatgtgttagtgcgttatgctaccagctaggctgacctatgtgttctggaattcctctccctatatgattcatattagattgggccacaagagacattctgtgtcagattttgaaggcagaaatgaaaaagtggttatattgtttgtatgctcagaagatcaaggaagaggcaacaggaggttttagctctcacatattttcttatttagcagctcacattgttgggtaggagcagaagcccagcctgcagctgctccatcttcccctaggtctttctgtttcttcttctttcagtttcttctacgccaggtgtgtgcttagctccatgacaaaaggtgacagcttattctgcagcacacacacatcatcaaagtgggaggtggtgagactggcacactgacagtctgtcctagcagatttcagctcacactggtgagttccagcatgcttataccgctattttacacgtcttcccttcgccattgtctatctgcagacttctccaacatcagatgccagatgtctcatggaaactaaataacttctacaattgtgtgtgtatttatataattgatacaaatattggttctaacatcaattccaagttgattttttaacattcaacaattacttccaattgtgtcacttcttattttgcttcatattttttactgacatttctaattatatttcttggttccttgaatttgtaactttatcatactcatattcttcctcattcttaatcatattgtccatagagttccttcccccacacctttcccccaaccccatagataaacttatttatttccttcaatcgaggactatgcaaactataattatgggatttctttgacttctttaccagttagacacactgtttccaaaattccatataacctttgtgcactcttctgttttactttaatatatcctgttagtcacaaagaaaaattgatgaagaataaatattttgaattttgcatgattaaaaatgtcttcaaacaatcatcatatatggttgatggtctgagcataaaacattttgtctcataaatttgaaaaatatttttatagaagtttttagtgtcttttctccttggtgatctgtaaaatgttacaagaatatgcctttgtggggatctttttgcagtctcagacacctagtggatccagatccttttaatctgaagactcatgtccttttcagttttaaataatttccttatatccgtatctttaataatacttcctcttccatcgccaccaccccatcctaaccccaagcacgcactattttttgttctctttctaagactcttactaaccaaaagttgaacattccatatttgaaccctatgcctcatttccttgctaacatttccattactttctcatttgggtctactttctgggagattattatcttttatctcaatggttacattttaatctgtagaagctctcttttattgtgtaatagttttctttgcattactttcctgttcttggattaagattaataaaaaaatactaatatcctctttaaatttctatgaatatattaactatttcagatacaatggaaaggacactggccttgagtcagatatctggaccttgattatttaatgtaccaaacaaggataatatttactattccacaggattattttgaatattaaaagagataatatattttaagagccttgtaaattatgaaatatgtaagtacaacataagaaagatatttaaattattatatatccctgcatgacaatgtttctgagcatggcaattaaatgcttttacgaacccacgtttagttatttccttctataatgttctatatacataaaacttcaaccacatcacacaatgaaacttgtggagttatttttttgagtcctttgctgtcattcctccaggccttgcttttgttaatggagcagacactgtcatatatacccaatattcattttccacatcttcagtaataaaatcctgtttttagcaaaacacatcatttccccacttctccacctctcttgaggttgcttccagaaataaacagaatcagtgtacacaacttttggtaaatgtttggaaataaagagggcatgctcttcttccctactatccctttcctttctgctggctggaatgcagatatgatgaatggaaataatgtggccgtcttagagcctgagctggaagccatgtatggaatatggtggagaaacaacatggagggaacacccttggctcctacctctgagtacagtacccatgctagactaactatacctagatttcttttatgggagcaagagacagtttcctagcttgtcagaccaatataacttggggttttctactactccatgatgaacctaatcctaattaatatgctgttatagtttctcagccttttggttaagatcagatatactaagacactccccatcaggacatgacagtatttactcatcctttatgagccaatgaaagcatcaccctctctagtaagtcctgcctaatgagacctccccaataggatttaatgtctttattatagaatatatttttcatgagacaaaggatcctgtttattttattcactagtgtgtgcctagtgccttgaaaaatgtgtgggccatattaagcaggtgtttgtttgttttttgagatgcagtctcgttccaccacgcatggccttaagcagttaaatagttgttaagtatgcacaactctataacccttaggattttgtggttacctcagctaaaccatagatgcttttcccaagcctctctccctacacaaattgtaacctcactagcgggtaaaaccgtatatatgtatcacttactttgctccttaatatatggtacatgactgacagtacttatgaattgaataatttaaatgagaataagtgtaatgatatataaaaaattatttttaaaataaaatttacataaaagtattacaatttgagatgaactacatcaacactttttcatcaaaaaatagtgttttctctcccctgattataatgagacaatttagtgactgcttttatcaaacataatagagcaaaccacaatctgacttggagcaatttgctggacttccaaacctcagttttgtcattaataatatgaggttcatatccaccacatttggcatcttggactgtgcttgattaacacttgtgctcagtaagtggtagctgcaattcttatagtgactaagaaaaagcattatctttaaaatttactgatttaaagttttatatacattcatttattcaatagctatttgcttgatccctacaatgtaacagcaatctagatgctggggacacaaggtccaccttccaggaatatggccatgacaccagaaatcacaaacatgatgagaatggaatgactggggaagaagtgccagatgcttcacttgtaaatgaagacccagcctctggggatgcagataccacctccctgaagaagctgaatatctgcagataagtggagttcaccaatgatgaggagcgggatggagaaaggaggtagggagagtcatccaaggaacatgagcaacatgttaaaaggtaagaagtgagacaatggtgaggtggtgaaacttaacaagtcggccatggctgggggtgagagtgagggagggtggtgggaaataaagttgctgggatagggagaagccagatgatgcagcttttgcaggacatggtacagatttgggaaaatattgtaaggttttgggagagtatgagggatttatgggtcaggtttatattacaaagattattctaaaaatattaggcctcccgaggcactcaagccttttaccttgcagtttctactcaccctttgggactcagctcaaatgacatttcctcgggggtgctccctgatacccagattgtgcaccctgtgattctccttcagagtatcacaagtcgaataaaatcgttaataatagaaaaaatatcctgtatgtaaataggctactttaaaatgaaatcatttcacatgtattatattttctatttaaataaattctaccattaaatttttgaaacatatttacctcttaactatatgtctagttaagaaagt

SEQ ID NO: 145 - DNA, 2093 bp, Homo Sapiens
acagatgggagcagagaagccggtctttctagcatttctctccctcttttccactagtcctcagtaaaacagccttgccagaaccagatgtcttttttctgcagatatttactgttatgacttgggaggcagcaggttctggactgttgccctcacctagaccgccccccccccttgtcagatgccacccgttttctcagacccgtcggtctcccagaccacattgctttgtgagcagatgcctgtcagggacagctctatcagaacagaccgagtccagcccagtgagccgtgatgttctctcactgctcggtcccccctctgccatctacagcgacataggttgggtctgttcccctggcagacagcaggccttcagagccctgccagaatctcttgtgtctcccctagcacacacacatccctccccacccaccaccgccaggcctggatagccctagttctctcccatttcttggtgtcagggtgttcagaccttttaagcagatgaatgctaactcattcaaggcttttaaaacccagtgccttagcagggtacagtggcacacacctgtagttacagctgtgtgggaggattgcaggagttcctgtctagcctgggcaacatagcaagacctccttgtcttttaaaagaaaattaaaaaaaaaaaagtgccctaaactgaatccagccctgcagatgtagctgggccaggacagaacagagggtaaccactgccttcccaagcaagcaatggaaactggcagctgcagtgtcttcatcacgcgatggggtgggaatgctgccccttatctgggcacaaggaatagtgtcatctgtgcaccttaaagttgcacaaaagctttcctagtagcgacatctcatccttgtcaaacttgaaattatctaaaaaccacaagtctcttcataggaactgtttgcaagtcagcagttccccattttgtactgcatgaaatgcacccttgagcctaaatatctggcttgcatttgccctggtacatttaactggcgtggtgaagtaggaggagcaaaggcgtcggaatctaacagtgctgtatgattcttgcttctttaagcttcggtttccttgggtttaaaacagggttcctaggaagctgagatggaaaaaggtggctgccgcctggctccattccaagttgctgctctcgttctgtagctagcccaggtttccgggttccgtattaaccctgtgaccatctcaacccttgacactgtcgataggaagctggtcgttctctcagctgggcctttacttaagtcctggacaaacaagttgaccaagggcaggcagagactgctacagggtgccacatagtgtatgcagtgcacaaatggttctatttttggtgggtcggtgttgccagcgagctgaccctgaccaggtgtggaggggagtgggtggggggctgtggaaatgtggccaggtccctacccctatcggcagaggctccatcctgcccttcctctcagccacaggtgcaggatggtagatgggaacttgccagaaggatgcgaccctatttaagtagttgtgttttcttccagcccagcatccccaccaaaacaggaaaagaagtgctctcgtgcagggcttgttcacagtgagcctggctggctcctcatgatctctgagtttaaaatgtgccagcagatgattttaacgatcccatcaaaaattgttgtctggatcagtttcgagctagcgtttccttgcagaggccattcttccttttttgacaaaagttgggtcggccaggtgcagtggctcatacttgtaatcccagcacttcgggaggctgaggcaggtggatcacctgaggtcagaagttcaagaccagcctggccaacatggcaaaaccctgtctctactaaaaataaaaaataaaaataaaaataaaaaaaagccggacgtggtggtgggcacctgtaatcccagctactggggaggctgaggcaggagaatcacttgaacccaggaggcagaggttgcagtgagccaagattgcaccattgcactccagcctgggcgacaagagcgaaactccgtctc

SEQ ID NO: 146 - DNA, 1476 bp, Homo Sapiens
atgctactcctgggaggaagcttcaaaggcctcagccacaagtagctctagctcaagcaaaaacaaagcatgttgagaattgtgaacaatcagtgatgcaacacaaggtggtgctcttgtcccagtgagtgctgtagagccttgttagggcattaggcaaaggatgtacaactccaaaagatttggttggtataaacgccaatggggatctgccggacagactgaacagctgactggggggcacaaagccaaagggcatgtgccaccatgcctggctaatttttgtacttttagtatagatgaggtttcaccatgctggccaggctggtttcgaactcctgacctagtgatctgtctgcctcggtctcccaaagtactgggattacaggtgtaagccactgcacccagcctgagagaccgtattatttctaggcctgaagaagcaaggggagagagcagatactgtaacacagagtgggtggctgtttggagataactgcccaaccagagctgaagcttcccaaagagagaccaaatgattcacaatgacccagcaggcagggagcaaggaaattaacagtcttacctcattctcctatcaaccccaatctgccaccaggcttcccactgacagaacctcatggaacctagagggcaagggattcagtagacacggtccatgcagaactaccaaaaaggatttcttataataatcttgaaatctagtcttagtggagaaagaaaaagaatttccaattgtgtagctcccattaacataccaagaaccaggtctgggaacttaggttgttgcattttttcccagctttgaaatggtactgcctctaaggatgatggctaggccatgaagtttgctattctaggggaaaagagggattggaagaaagaagaaagcctgaatctgtctgttctgtccccaggagaatgataaggggagagagtaagaaagcaatgagatacacatgtcttgactgcttctcttcatgctgaaatcctgggggaaagaagtgctaaatcagttgaggacatgggaacatttattctggtgagtggatgttgagggcagaggggtgtttgccccattcctttggtgtgctgagtgttaaccactttgcagggagagctgtatggggcgtcatgttaacatgaagtcattaggtgggccttaatccaatataactgatgtcttcataaaggaagaaatttgggtacagagacagacaagcaccaagagaagatgatgtgaagaagcacagcgagaacaccatgtgaaaatggaggactggaatgaagcatctacaagccaggaaatgtctgaggctaccagaagccaggagagaggcctggaacagatcctgcactagaaccttcaaagagagcatggtcctgctgacatgttgattttggacttctggcctccagagctgtgagaataaatttcagttgttttaagccatc

SEQ ID NO: 147 - DNA, 2400 bp, Homo Sapiens
gtgggtcaccacatgttgtcctcaccatcatcgtttcctgtagaaataaaatgcctaaggagagaagggagatatgaaatatgaatatctactttaacaagggtagaggaaaacatatactcctgcatgggcaaataaggttcaaaatcagagactctataatgttgcaatatttggaaacaaagagaaaaaaacagaattattaaataaccaaccccatatgtgtaatcattaacttaaacatcattctaaataataagaaacatttagggacatcaaatttctcaagatagataacagaaacaaagaacggtttggccccactgatcaactaaactttggtttaaattctcttcttccctcatgcccctgcattttgatccaacacagcctgaacctgcacacaacccatctttaatacccaactattgggtacttgggtttaatacctaggtgatgaaataatatgtaccacaaactaccatgacatgtgtttacctatgaaacaaagcttcgcatgtgcctccaaacctaaaacaaaagttaaaaaaagaagatatttgttatgacatatcactatgtccttgggagaaatattgttgccagttaactcttcaactagtttgtctgtgttttttattttagccatataaaagacaagacaggtttttagcattccaactgatttttattttctcagtctcctcttgcccaaattctgacttcattattttgtgagacaaagatcttcatcattgtccattttgctttgattagatggctgattggacaggtggactaaagtcaatctttagtattttttcattgtaagattaactattgagtcatttgatatgacaatgggttcacagtagttttaaagattatgcacaacacatatttgagtggaataacacagaaaaatacaaaggaaaatatttggagtttacatcttaacaaatatttggagtttggatcttaacaatcacataggctgccatctatataattcatgtaacagacaaacaagatttgttgtaattttcaatatgggaatattcacttttaaatataattatgtattctacgcataagttggaatgaaaatcttcatgtgtacttctcacattgaaattctaagtttaaatgtatatttattttctaagaataaaatgctacaataattaatatgattacataggtgtataaagctcaccagcttgtacactgagatttaatgttttatttttgctacacctcaattaaaaatcttttttagaagataaagtgtcagtgaagataattttcttccctgaggttatataacattttgttacaaggataagatgcagcaaaaattatcatgaaactaattgtgaaaatacacttatctttgaaagttcttaactatttgtttacataaaacaataacagagttaagaatattcaaatataagtaaataacaaaataggccaggcatggtggctcacgcctgtaatctcagcactttgggaggcccaggcaggtgtatcacctgaggtcagttcaacaccagcctggccagtatggtgaaaccccatctctaccaaaaatacaagaattagtcagctatggaagcgcaagcctgtaggtagtcccagctactcagtaggctaagcaggagaatcgcttgaacctgggaggcagtggttgcagtaagctgagatcgtgtcactgtactccatcctgggcaacagaacaagactccatctcaaaaaaaataaaataaaatacattggtggtatattacaattttaagagaaaatgtgaaagatggctaagtagttgagttattatttgtacccaggttgcctgactctacagcctacatgtgaaaccacaaaattccattaaatgaatacaatatgtaattgcctgcctggtaaactgtgaatattttacacacagtgaaccttttggaaaaatagactttccagtgttattggtataagatggtagcccaaattcattggtggggtggtgggggcagtgggcaagaatcttacatccaatgaacaaactctgaaaagaaagcttaatgtttctcatagtttttatgattctcaaaaaagaaaaaaaaaagaaaaaaaaagagataactaagacatgtgatgagcacctttaaatactcgaaggttccccaaatactaattcagggaatgtcatacccaagcctgtagctggcagatgacaaaacactactgctcctgtgtagacacataattaaatataaaaacataaccacaccatcagtcttggaaaataatacatatggttgccacatatcacttaatcaccacattttcatcttcccagactaagagtttagcctacttttacttggttattaacaaatacat

SEQ ID NO: 148 - DNA, 3900 bp, Homo Sapiens
gggatgcgcttcgctgttctctaggaggtaccaacctctggcggtgggtcttgcgtcccggcggaaagctccgaggagtcctgtagacttgtggctcgggtggagccggcggaaaaccccgagaagcttgagacagccgtggctgaggtggagccggcgtcgctgccctggagcgtgggcgagtttcctcttagccggagcttcagggattgactcaaagactcctccgcttttttagttgttttgggtgtgaatacagcccggactaaaccttagtcgcctagactaaaccttagcctcccaggctgccaaaacagcacagcttttacagatgactcttacatcaccatccctactctgtgatactgtgtttttcaaagtttagtgcctgaaccatcagcatgaaatctgcctgagacggttgttgaaaattcacatcgctgggccttgcggcaggatgcctcttgaagcccaagtggaagccaacagaagaggggtccatgtgtacagataggcctggagtgatccatgttccaacagcagtccctttaacctcacttgaatgtggaggctgcacaggtcacaagtctgaagactacaagctacctttgcttaaaaggaaccacaccaccgctgatagctaactgctagattgttctccagcatatcagagctacattgaattgcttgagttgtgcttcaattaatgtagagatcttcactgaatcgcacataaccattgaagtaacctgctgtttacagtctctatcatgctctgccaagagagttattttacagtgacaaaacttctcttctggtgccctgacacatcctaggactttgatgttggtaattctttcccctcagcaaatgttggttctaaatccacagaactacttgagaaactagatgcaaaattgtagtaggtttaaactatcaatactcttttttttttttttttttttttttgagacagagtctctcgctctgtcacccaggctggagtgcagtggcgcgatctcggctcactgcaagctccgcctcccggattcacaccatttgcctgcctcagcctcccgagtagctgggactacaggcgcccaccaccacgcctgggtaattttttgtattttttagtagagacggggtttcaccgtgttagccatgatggtctcgatctcctgacctcttgatctgcccgcctcggcctcccaaagtgctgggattacaggcgtgagccactgcacccggcctatcaatattctttatatgttttgctattcccatttaaaagagggaaactgtagctatacactttctagtcatgttctttggtgattttcctgcacaaaccaacactgttgttcagaaatataatttcccctagaattaccctccatccaaaacatattgttattctatcacagagataaataatggctttccaaatcctggttaaaaaaaccaaacactctcttcttctctgtatttttacagaacaggcatagatgatggcaattgtgttttaccatcttttttttttttctgagatgttagttttctaggatatggaaatcttaggattcataaaaagtgaaacaactttttgaaatgttagttttccaaaattggacaatctttttgagccattctatttttaggactattggttagctgactttagagcctttaatgtttccttattatttcaaacaatagagaactttcttcccccccacgttttgagacagggtctggctctgtcacgcaggaggctgtctgtagtgcagcggcacagtctcagctcactgcaacctccgcctcttgggctcaagtgatccttccacctcagcctcctgagtagctgggactgtaggtgcaggccaccacatctggctaattttaaacaatagagaacttccaaaacaaaagttctttattaattcttcaagaaatctgttttttacttagtcaattaatgtccatttcatgttgcctcaatagcccatgtatgaatcactcttcttgcagattttgttcagttttgttgtatgtagacccatctttctttgattgagttggtttctttgattgagttgatttgtctgtattatatatcagtcagtattaaaacccaaacaatacctaagccaaaaaagcaaggtaggcacctgtgaactcacacacttggttgcaattgcttcagtaaaaaggacagtttacactcaaattgaagcaaccattatgtttccacaaacaacattccttattatcccacctcaccttttcattcttcctatgctgtctaatctgattcggtacaagagataaggcaggtactgctaaatgataacttagatgcaggggccatcatgaaaatattcatcccatatcttacattaagcaaactactagcaactgtttgttgaaaagtataaatgaataaatgaaaataggacagataggcagtgtgggaagctaaaatatggaagtgttattgctttgctttatgtggtataatgatctgactttatcttcccagctctcccaggaagtatgcagaataatatttatctcatattgtggatgtggcaatcaagacagagaggctagatgctttacctaaagtcatccaacaaatatttggtagaaccagtgctagaatgcaataaatggaaacagagtttatttttgtgtttcttttcctaatacttgccctattcctgacaaatgaataatggcttcagaaggtgtcacttgttgctagggctaaaaggataaattttacctgtaataccgtaccacttactattagttaacgacccagtatttattctctttttttctttggaatctttggaatgtgtaaatatttgcctcccgggaagctcactttatcctctcctcaggaaaaaatcctgatttggtctgaaccaatcttggtaactatctttcttgccagttttgttttaggaatgggcacgcaactcagttctagccaatgagatatgaggagcagtctactggggagtttctgggaaagtttgtttttcttgtcctaataagcaaacaagtaatggggtcactggattggagatcctattgagtcaaaggaatattgaatttgacacagtaaaatagtctggaaggaaaggaaatgatattcagtaaatgaaatgctgaaaattgatattatgaaggtggcacagtagttgttattgattaaatgaaacagttgagattaagaaagtttagccaggacaagttgtatagcacaaatcatttcaggtaaggaagttaaaaaaaaaaccctgagaggctaggaagtcctggctccaaacttctgctcctgctggacttgagccccactagcttctcatcttccactaatctatgcacccctcctttcccactcctcaaaagccgagctcactcaacaactttaattttattcaaataaattatttacacagacattttgtttttagtagatgttattagtgattaggaaaaatgaaagagattgacatctttcaattgacagagatgccaataattttaagtataattttttaaacactttgttcttaaaatgagaaagaaatgcaaggaagggatcactaccctgggtgttagcatgtccgaatatgataactaaacctgctgcaattatcttgcaaccagggaggagctagcttgaaaataaagccaacacagttagatgacaagcagaaagtggaaagaacctaagtcattgatgatgctattcagctgatgaattaaacctggagtgtatgttccatgggcttctgtaaggaattaaaatatttttactgtttaaaccagtgtttcattgttttctgcagaaatcctaattggcataaagaaactattgaccga

SEQ ID NO: 149 - DNA, 2474 bp, Homo Sapiens
aagacaagacaagatcagcaggagaagggttggacgcatggtacctttccatggaaatcctgtctggggttcatgacccagagtcttggtctgtttgcttgtctcacagtgcacaagaggcaagagcttagaaagcagatcagggaagagtggggaggaaggtatttgtgcatccctgtgggggaaaggtgggcacttcccagcacagcccgggacagtgcgaggaatggcacagaggaacactctgctttttggttcacagtatggccaggacagaaatgagacctttctctacatcctgaggttttattttctttgtctttctcaggtggagcagttaggtcaggccaagcctggccctgttctgatacagctcacctagcagatttgaagttagactatttacaacaagaagaaggcatgccctgccatggcaaaacctcaccaggtctccctgtatgattcttgaatgtcttctttagcaaggttacacctggcacacagaccctatcagccactgactgcattccttacaaacccaaacccattggtgggcagagcgggaaggtggctggccaccatccagacagtaaacaatagaggcaattattatgcagccattaatcttgtcaattacacattaacccaggctgtgtgtaaacaggagcacaatcctcattctttttctctgcctttctcaatggcttcccaccccacctcctcagaaaataaaaagggactgcattctaccacattctcaatatcatccttaattccactttttcacttatggaaacaatcataccaatctggaaattcctttaacctgtgtatcgattttatctttttgtgtgtgtgtgtgatttctattacatatgatactctgctgagtgcttgggaagctgattttgctgttttctacaaatctatggttcctttttcactttgaactccccagttgaaaaggctatattcatatatattacctcatgaggtaatataatgattgatagcacaaatttattacatgttttgaagtcgctttctaatatacctggataaggatctatttcctattcatcttcatctgggtagatgccacccaaagacatccttgtccacttaaaaacctgtagcagttggctttgtggtcaaaggagatttttgttttttaaagtgaggagcagttctggaagcaattagatctggcattgttcagggcagatggtgaagtgggcagagattctcttcaaagcctctagcctttcattttcctgtgctcactcttcctttagtacacttgacctctcctttccctcctcctcctccaaagccatctctaagaaatggcccacgtcagtcatttatctcttcctgggcattaaagagtctggggaatgctcattcctgctgtgttttcactgaaagccttatctttaattgtggaatgaaaggaatttcaggtattggatcacagctcaaagttcaagtttttaacgttctattcacatagcagtcaggaaaaaaaaatcctttttgattggaaggagggcagttttcacaggccctcttctcaggctctggtggtgatccgtctctgttctctcctctttgtggagccattctggaagacaaggcttgaggttggggtgggcaggacaagtagcacagagatttctcaaacgttgctggataaggtgtttgagaccgatttcagtagaaccctaatacacattaggtaagatttctgaatcaggaatgtgagaaaggtctgttgaaactgggcatcaataccctttttccttgggatatgtcagggaattccccaagaggcttcaatgttcagggcagccctgctaccctattttttgggtggtggggtgggaacttggaaagaggtcttgctggctgaaattaaattagcatgttgtttcgagggagttgggaacattttcaagttgctgtgcataaacctgcgagctcattttctcagatttggttcatgcatatagggtggtactatgtattcactagaaagggttcagacttgttgcatcttggttctgtctctagatctaggataatgcatttattccaaaacttaattttggtaaaacgaaagaatcaactaggcaatcactgaggttccttctagcttcaaaaatcccgatgatctctgagatctatgaattaaaattaattggtgcaacttgtgggatgttatttaagtgaaaattcttagagtcagggcactagtgaaaggtaagagccaggaatgcaggggatactggtcattttccatagcttctttcctcccaaattgtagcaattctggggttgtgggaagaagtagagatatgagtggcaaatcaatacaaactgtgtcaccaataaggttgttcagggaaataagtttataaagagtggaaaggaacaggctgagcctgacagggttaaaggaagcaccaatttct

SEQ ID NO: 150 - DNA, 4953 bp, Homo Sapiens
acgtgacggggctccggctgggccggcgggttcttcatccccggggatgatcgagttcatcaaagtggaaaacttaaggcggtcttcgtcgggctgatacttcctgctttattgaatgttgatattaaatgcttacctccggaattattttttgaggtatcgactttagattaaaagcctaacaattcttacctttcccgtgggctgcctggctccccgcgcggttcaacgcgagcagcgccagtgcgctgacccttgccaacgacgtggctggtcctggggatcacagggcttcgctcatcccatcttcctccatatccccaaggtggaaacaagggggcgagatgtccacaaactgaggaacagacaaaatgctggctgtccatgcagtggagtgtgagtcagtcatcaagaagagtgaagttcagacccatgccacaacatgggtgaaccttggaaacatactaagtaaagcaagccaatcgcaaaaggacaaaacctgtgcgactccatgctatggaccgagttctgtccccctaacatttgtatgtgaagccttaatccccaatgtgactgtgtttgcagaaagggcctttagagaagtaattaaggttaaatgagattataagggtggggtcctgatctgataggattagtgtccttggaagaggtaccacaggcctggcactgtggctcacacctgtaatcctagcactttgggagtccaaggtgggaggaccacctcctccaggagtttgagaccagcctgggcaacaaagcaagacccctgtctctacaaaaaaattaacagggcaccgtggtgcgtgcctgtagtcccagcaacttgttatggttacgtaagaggaatgtgaattcaaccctggtgattttgggtcgtgtcaggagcagccctgcgacaccagttggcaccttctgcagactctatgtgtcgataagacaaggtcccacccagcaagtgcccttttctcagctgatgaacataagcctgcatggacgttactgtccatggaaaggagcggccggcaccggctgtgacagacacgtgcctgtctgcgatctgagtttcatgaacagtaaactctgttggtcacagcctctttggaaaacaatgttagttaaaagaagtgccctgtgaccagcagtgccaccctcgacagggttctccaagtgggacccgggcaagcagcctcagtatcactaggggttgttagcaatgtgccttcctgggctctgccccagagtggccgcaccagtgactgggagtgaggtcccagggccctgtggtccatgaagagctctcaggggattctgatgcccagtggtacaggtgggccaccggactggggtgtcatctgcccgtgggcatgagacatgaacaaggacatagcaggtctgttagtagtcataactaaaagaacaaaggagccgggcacggtggctcatgcctgtaatcccagcactttgggaggtcgaggcgggcagatcgcgaggtcaggagatcgagaccatgctggctaacacagtgaaaccccgtctctactaaaaatacaaaaaattagccgggcgtggtggcgggcgcctgtagtcccagctactcgggaggctgaggcaggagaatggcatgaacccgggaggcggagtttgcagtgagcccagatcatgccactgcactccagcctgggcaacagagcgagactccgtctcaagaaaaaaaaagaacaaaggaaaaaaccagaaaaccacccagatgttgatgagcagatgattgtactgttgtaatagtaatctggtacaacatttgcaacatcgcggttgttaaaaatgctaacgcatgaacctccagtgtgtatacacagatataaataaacgggtgaagaccatctgtgaggttgcatgacaaaggcaagtgcagaagcagacagggtgggcacatttcttttctttctttctttctttttttttttttttgagacagagtctcactctgtcgcccaggctggagtgcagtagcgccatctcggctccctgccacctccgccccctgggttcaagcgattctcctgcctcagcctcccgagtagctgggactacaggcgcccgccaccacgcccggctaatttttttgtatttttagtggagacggggtttcaccgtgttagccaggacggtctcgatcttctgacctcgtgatcctcccgcctcggcctcccaaagtgttgggattacaggcgtgagccactgcgcccggtccacgtttctatcaaattgaaatcatgagcggttttgctgagggtgtggggcacccagagcctgcggcctgtgctcgagtgaaaatggtggccccgctccagaagcctgcgacggcgctcacggaaccgcagccttcgtgcggcggcacctgggccgtgctactcctctgtgacttcccggaagagatgagctgctacgtccagcaaaaggcacatccaagatcgttcaccccagcatgactcgttacactccggactagaaggaaccccaaggtgcttcagtgacagaacgatgaaccagctggggtgtaacccccatgcaatggaatatcgtacaggaacgaaaaggacacgctacccctacaagcaacatggatctcagaggcaggatgttgcgcagaagaaaccagacacaaatgcttcggctcgtgttgctgcgactcattacaggcagccgaatctgcggtgatgggggccccaggagcagtgaccaggaggcagtgccacggagcctgcggtgggggctgatagtcagtagcgtgacctggttgggatgttctgtttttaagctggagtccatcatgtttgtttatttgttcatttcgtagaggtgggggtcttgtagaggtgggggtctcactctgttgcccaggctggtctcaaactctgggcctcaagcgatcctcccaccttggccttccaaagtgctgggattacaggtgtgagccactgcataaggccgttattgttattagtgcttaaaaatatttagtaaacattttatttagcctaaaaaccattcagagagcagaggctggatggaacacggcgtgccaggcggtgagagcacagaccctcctcttccagagcaggaagtgggtaaatgacttttaagcctcatttctggggtggcaaaactcttctgtatgaagaagtacaaatatgtaatgtcccataatggcagctatgggacgttacgtatttgccaaaacccacataacgcacaacgccaagagtgaactgtaatgtaaactgtggacttaagtcaatgatcgtgtcccgatacgggctggttggttgtgatgcagggcaggtgaggcccaaagtggagcttagcctgccagcgttcttggctttgcccaagaaagaattcaaggacaagccggaggtagaagagaacaacttgattgaagaggcagtgtggcagccccagggcctggcaccgtaggacctctgcaggctggtgggggtgaatgaatgattgattgatgaatgaatgaatgaatgaatgtcagttcagctgccatttcaccgcctggaatttgggactcggactggcttcctggctcctcagcttgcagacggcctattgtgggacttcacctggtgatcatagaaacagtggacccactgagaccaagggcaaggggaggaaaggcccggggtagggctgaagacacaggttccaggcccagctctgctgctcaccgatgaggcttctcctctgttgagcaggtagccccagttgggagctgaggtgtgttgattggggctctgggaaccatagcctgccagctgtggcttggccatcccctctgccagcgctttcccgcccatcagcccttttctctggagtccctccttcagccaggtcctgaaaagtcataccttttggccaagctgctgaaaatactactcagccagaactcatgtgctcatgccagcctcattcatgacaccctccaaaccagaaacagcccaggagccgatcaacagcttcatgggaaaatgtattgcagtctatctcatcgccgggcccttccgtggccgtggagacgggcgaatcatggtctatcccgtcgccgggcccttccgcggcagtggagacaggcgaattgcagttatgcgcagcaaggaagcctctctcaatcacattgagcagaagtggccaggctcaattctgtggaattctgtgtggatcacaaacaggcaacatagaggatggtgttttggggtgcatgttgagggagagacggggttctcttcatcacaatggtggctggcctccaggaagggagggacagtggctgggaggccaggggcctctgggatgctgaaaaattctttttcttctccttcttcttctttttttttttgagatggagactcactgtgtggccgaacctggagtgcagtggtgggacctcggctcacggcaacctctgcctcccagttgaagtgattctcatgcctcagcctcctgagtagctggaattacatgcgcctgccaccatgccaggttaatttttcgtatttttagtagagatcgggtttcaccaggttggccaggctgatctcgaacttctgacctcaggtgatctgcccactttggcctcccaaagtgctgggattacaaggcatgagccacagcacccagcccagaatggttaattttatgttatgtgaatttcactcaataaaaaaaagacaggaaggggaaagaaagaaagaaaaggcagggagccgggcatggtggctcatgcctgtaatcccagcactttcggaggccgaggtgggtggatcacgaggtcaggagattgagaccatccgggctaacatggtgaaaacccgtgtctactaaaaatacaaaaaattagccaggcgtggtggtgggcgcctgtag

SEQ ID NO: 151 - DNA, 2535 bp, Homo Sapiens
cctaatctgattcgttcaaagaatgttttggctgaatgtaaactccttgtgtgtaaacttgaaggagttagtacagtttacctttaaatttcaatatcattgtaaatagttagtttaaaaattttaacatgcttttcctcaacatttggccctcatttaaaaagaggtcagataagaaccaactcaaattccatctggtatttttttaatatatcattcaagggtatacattttagcctttttttttcttttcttttttttttttgcattaagaccatgcattcctaagacaaacttagttgtcagaaattttgccaccaaaggcaaatgcttaaggccatgtagggattgatgttgtattttttggtagagacgggttttcaccatattggccaggctggtctcttaacttctgacctcaggtgctccacccgccttagcctcccaaaatgctgggattacaatggataatttgggacatccatgtccaaaatggtggcaagatcagtttgttcctttagaatctttatgagcctgattttctagagcttgactcaacatacaaagattttttttaaagttttttaaatatcaatagcaaggttcactgaagaaggggcagccataaaaggcaaaaggacagttaatttattaaagggtaggacatttttcagcagtttccaaagagaaatgttaacactagtgcacttgtatataattagacaaattcatcaactgaccctgaatttcatagtttgtattcctgctaaggaaaaacaactagttttctatatgctattaggctaatgatttgtttgactgccatgtatgcatcatcagaaaaagaaaacacttagcaattgtagcatttgcccctagaataacctttctaaagagactttggaaacattccctaattgaagctttgatccacacctgggaccacacaagacataaaaacgcagtcagaaaagaggcagagaagagctattctctgaaacagagagtattaacatcccttctttaaaagggcacagaaagaacactggatttcactataagatgaagatattttgggaaagtattctatgcatgccaaagttccagctggcaccagagcatacctctctctatcagctaagaccacagactaatactatattaaccatttctttaaaaatatctccagtgtgagctggcaggtttgtttatccacaaaagagtctggagacttactctgacaagctggtgtaggacatattttttgtcacatgaaaacacataccacacgacaaatttttagatacaaaatgcaaacttagtacttatctgttgactctctaaatttttctagaaaatttcaacagatacagaaatagaataccacatactccacattcaacttcaataattattaactcatgagaaggggtggtggggataaacccagctctgctgaacaagccttgagccctggcctggggctgctcctgcctggggcagggagcccctttttataatgtgcacgaagtctccatatggcctagaggtagcccaggagctggcatacaaaagttgggtggcatctcctgaaggaggagacattatagaggcatgtcactttctgagactcagtttacaaagcaagatgcagagaagaaaggaaggctggcagcttgaactgagctgagccatctgacaagtgaagacagggtcctggcaggcaggactccctactgtggaggtcagggccttcctggcactctgtgaggccttttctgggtgttctccaagctgctgtccactgccaaggaggagcctccaccaggcaggccagagtggcatgcaactgctggcacccagcggctaccacattcccacccagatgctgcctgagctttgggcacaccccttcccacaactgtccccttgctttccccctcctcctgggctatcatcaggctgtagcgaaagcatcagaagctccctggggatatgtctgaaaccccttggctgggataatcagcaccagaaaagcattaaaaacaggaagccacagggataattgacaggcattgctgcaaacacctggggtgggggtgtgctcagaatagggacagaataaggagaggcagcgtccaggattggggaagaataacacaggactgttctggggatgtggggatgtgtctcatcataaggtcccattcattatgttccactaggttctcccaatatactaaagctgagatcataaactgtcatgacaaagaacaggtcatctgtactttctctgaaagcctcatgattagacagtagaatagcttagaagagtgacataatgtttagaccctttttttctgtttcttgcccagagttctttcacaacctctagatgatatgaaaatggacacaacacatggctccaaaatcccagagtactacagaattcttaaacccatgcatggtagataagaaggcaaaaagcaaagcagttataaatggaaggctgcaagcagaagctttctgtttacc

SEQ ID NO: 152 - DNA, 3223 bp, Homo Sapiens
ttatcttccgtataagctttggaagcagtttagtgacaatggtactcttgtctttttcttgattttaaaaggagtgatttcgatatttttaatcacaaaacatgataggtgctgtaggttatttgttgactccttttatcaggttaaggaaattaccctttattcataggtggaaatatcatgaattatttaatttttgtaaaataattttataggccttttgagacaatcatataacttttgtctttaattcattgataaggagatgatttcagtagattttctaacattggactaaatttgtattactaaccgagcttgttcatggtttttatactttgctaggtatacttcctagtattttgtttacaatatttgtctctgtgtgcatggatgaggtacacaatagcaaggttaccctagtctcaaatgaattgaagaatggcctcttttttctcccctcgcaaataattagtgtaacattggaactacttgtgacatcatctgggcatcctgttttctttgtagaattattaattatcaactcaattactttaatggtatgatttccatccagattttctaattatttgagtcaactttaataagttaaatgtatccaaaaatttgttaatctcacttatttacaaatgcatatatttaattgtcttattacttaatgaaatagatcataaatataaaagtgtgtatgtacagcttaagaagaatataaaatgagcatatgtgtccttccttcaggttatgaaatagaatatttccagtatcttagaaactcccattgcccttctacaatgccactcactccttccacaagaggtaaccactatccctaacttcctgttaatcattccattgcttgtcattacagacttgtatattgtttagttttgcacatttgactttttaaataagtgaaactatgtattgtttcttatgatcagatatgcatacacacaaacatgtatatgtatgtatatatacacacatacacacattatttttaagagcagttcaaagttcacagcaaaactgagcagcaggtatagatttcccatatactccctgtcccccacacatgcatagcctcccccataataaacatcccccaccagagtggtgcatttgttacaattaaagaacctacatgatacatcttatagtttgcattaaggttcacacttgggcttggacaaatttacaatgacaagtattcactattaaaatatcatacacgtactttcactgccttaagcatcctctgtgctctggttattcatccctctcttcctcctaactcctgggaaccactgatttttttttctatttctatagtattaccttttccagaaggtcataaagttggaagtgacatatgtagcctttttagattggcttctttcattctgcaatatgcatgtaagcttccactgtgtcttttcatggcttgacagccatttattttatcattgaatggtattcagttgtctggatgtaatacagtttgtttaattattcacctactgaaggtaatcttgcttgtctccaaatttttgcaattataaataaaacgtccataaacatctgtgtgcaggtttctgtgtggacataagttttcaactcctttgggtatataccaaaaaacaagattgcagggtcgtataataagagtagatttagttttctaagatgccacaaaactattctccattttgtatttccatcagcactgaatgagagttcctgttgcttcacatcctcatcagcatttggtgttgtcagagttctggatttttgccattctaatatgcatgcagtagtatctcattgcagtgctgtgtttgagaatgtgagtagctgcaattcattcactcttagtgctgcgaggtactctattattggaatatatgatcatttagttacctattccacaatctacccatattgagagataactggattgtttccaggtttttaaaattgtgaacattctcatatatccctaggtaaacaaatgcaagaatttttctggggcctgtaacaggctgactagattgcactaggttgtagtgaagccactgggtcatagggtacatgcatgatcagctgtatgagctaacatccgttttccaaatggctgtccttctacttgcatgggatgaatgcttccacggttctttatccttgccaatactacacctttcagaacttccaaaaaattttgtcaatatgtgtgaaagggtatctaattgttaattttcattttcatgattattattaggttgagcactttttcacatgcttatgggctatttatgctaacttcttgaggtgttatttttcacttattaatttataggagagctttatatattctggatactaaacctgtctaggtaacatgtgttgcaaatatctctgccaagttttgcatatttttttctcattgcggtatccaataaacagaagtcttaaatttttatgtgatcaagttagtttttactcttgccgtttgttcttcttccctatgtaaagataaaagagatgctccacagtttttttctaagaatgttgagaaggtatctttatccattaaaatatatttttaggtttggtctatgggattaagtttcaatttccttttttcccccttatggagaccagtggtcccagtgttgcttattgtaaaatttactatcttcacttaaccacaataaaagctgtgttacaaaatatgtttccaagtatgtgtgaaaaatatatttatctttatgattctactcagattaattagctctcaggactgctgtgtccagagttgattccttctggtgggttcgtggtgttgctgacttgaagaatgaagctgccgaccttcacgagcgctgattggtgtgttttacagagcatggattggtgcgttttacagagcgctgattggtacatttcacagaactcgtgagacagtcgcaggtggcatgatttgatttgtgtgaaggcaatgaaatgatacacagatacaccgaagcctcccaaaagaatcctggttccaagattcaagaagatggattaatgtttttccattaattgttggaatttatgccatttttttactatgtgccatcaattttaaagcacttctgaaaagagataacaatctacaatagctggcattttaaattcataaaaatatagtattttcttc

SEQ ID NO: 153 - DNA, 1521 bp, Homo Sapiens
attcccagggccagatggggaaacacgggaggggaggagctggccacctgccaagcccagacctctggccgagccccagctcctagattccagcctgtgctcagcctctgactctacacctgactttcagcaagtccctgatccctctgagcctcagtttccccatctcttgagttggcacagagagttgtgaaaaagaactcagaggctgggagctggagcgggaagggagtccccagggagcacagctgactggtcttcacaccaaaagcaagcacaggagaaagggagctagcatttcccagtgcctgtggtgtgccaggagctcctgcattttccattaattcccatcaccctgctatgaggtaggcattttctccccattttgcagatgatgaaactgagccccaaacaagcagagattatagagctgggtttgaagctagctctccttgcttggggcctgggattctgtccacagcagccactgggccatacctgcaagggtgtcagaaggtttgtgctggcgtcagtgtcgccaaggactctgggagccactcacattttgggcactgcctaaagttgattactttgttaaccctgcccaggccccaggcagaggctttaaattgttagaacaatgaagaagggagagctggataaacactggccaggcttgagggagtcctgggacatagttggggtaaaggactgatcagagcatatgctgaggctcaggaattcataggcatcttcctccagctccctgacacagggtacctagaagactaacgatggtggtgctgagtactagaaaggttctgtcccggacacaaatctagacaccaagtctggtcccccgaacaaggcagggacccaggttattggagcaaggctgtgagtccctgaggtgaggaactacagggcttggcctgaagatggagcttggcacggtttgtgcaggagcaagcgggtcaacaacaggccagcatcacaggtccacaggactggcccagccccacacccatgccaggtttctgccctgccacctaaggtgaggctggctctgccatggtgcccatgggtggtggggcgggggatgaggaggtctagtgcccacagagctggctctgccaccactgggcattttcagagatagagtcttgcccaaggattaccccatagaggttttaccaaggaacttctggagacagaagggcttgacccaaagacatcgtgttgacataaaattccaagcactggcagaccactcattttctctcaaaacccacttttcctgagcaactgttccgagccaggccctcttctggaacacagaagcaaaccaaatctactcccttaaacaatgggactcacaccaggtgctcaggaatgggacggaggggaggaagcagaggagctctgggactgtagcccagccagaaggagcccagaagtaccaatccagtgtgggatcaggggtcagggaagacttcttggaggaggctacctaaggttgag

SEQ ID NO: 154 - DNA, 1064 bp, Homo Sapiens
gcacttactgggaattcctcattcatggggaaaaattgcaatccctgatcaccatcgccaatgaggttcaacaggttacccacatctgccacatagggtaggcacacgctgagccagtcagtgtagcgcgcgtgcagccctggacatttaagggcatcacagacctgttattgctcaatctcaggtggctgaacgccacttgtccctctaagaagttgggggatgccgaccgctccagggtcacataactagttggcatgccagagtctcgttcgttattggaattagccagacaaatcactccagcaactaaggccatgcaccaccacccgtggaatcgagaaagagctatcaatctgtcaatcctgtccgtgtccaggctgggtgagttttcccatgttgagtcaaattaagctgcaggctccactcctggtggtgcccttctgtcaattcctttaagtttcagctttgcaaccatactcccctcggaacccaaaaacccaaagactggtttcttggaagctgcccagcgggtcatgggaataacaccgccacatcgccagttggcatcgtttatggtcggaattacaacggtatctgatcgtcttcgaacctccgactttcgttcttgattaatgaaaacattcttggcaaatgctttcgctctgttccgaaaaccaacaaaatagaactgtggtcctattccattattccaagctgcagtatccaggcggcttgggcctgctttgaacactctaattttttcaaagtaagtgcttcgggccacaggacactcagctaagagcatccagggggcaccgagaggcaagaagcagggacgggctgtggctcgctagcccacccgctcccaagattcaactacgagctttttaactgcaacaactttaatatacgctattggagctggaattaccacggctgctggcaccagacttgccctccaattgatcctcattaaaagatttaaagtgcactcattccaattacagggcctagaaagagtcctgtattgttatttttcgtcactacctcccccccaaccg

SEQ ID NO: 155 - DNA, 12952 bp, Homo Sapiens
gaccccgcagcgtcgtggctagagtagggtctggagagagctcccactgtggcgagtcctgtcgttggattcccgcggcgccccgtaaggctccgccccggcggtgctaccaaaccctgttcgattttagaatcgtacattcccagagggaatcctagacccctcattttacagttgaggaaacaggcccaagtagcatgacttgttcgcgccgctagtcgaaggagcagcagccccgatcccttgactctggggcactgctttccctttagctcatttttggaggaaatgggtgcgcccttgctcgacctttggtgattgccgccacaggccttcccgccggctaactcagcgtgcccaagtcccgtgacttagtgccaggacggtgctgtgacccgttatcccctgtcgggttttacctccccccgggagagctcagccctggatcccggcgggcggcggagcctctctggagcccggacgggacagcccaccagggtctgcttctgtgaggggccgaggcgtcattccgcgaagccttctccttgctgttgccatgtgaagaaggatgtgtttgcttccccttctgccatgattgtaagttttctgaagcctctccagccatgccaaactgctcttcattcgatgtacaaaaaccacaagattatctaaatagatgcagaaaaggccttcgataaaaatcctcattccttcatgttaaaaactctcaataaactaggtattgaaggaacatacctcaaaataataagagccatttatgacaaactcacagccagtgtccttactgaatgggcaaaagctgaaagcattccccttgaaaaccagcacaagacaagtttgccctctctcccaacccctattcaatatagtattggaagttatggccacggcaatcgggcaagagaaaaaaatgaagagtatttaaatgggaaaagaggaagtcaaactatctttttttgcaggtgacataatcctatatctagaaaacccattgtctcaacccaaaagcttcttaagctgataagcaacttcagcaaagtctcaggataaaaaatcaaagtgcaaaaattgctatacaccaacaacaggcaagccaagagccaaatcatgaatgagctttgattcacaattgctacaaaaagaacaaaatacctaggaatacagctaacaagggaagtgaaggacctcttcaaggagaactacaaagcactgctcaaagaaatcagagatgatgcaaacaaatggaaaaacgttccatgctcatggataggaagaatcaatattatgtaaatggtcatactgcccaaagcaacttataaattcaatgttattcccattaaattaccactgacattcttcacataattagaaaaaactattttgaaatttatatggaaccaaaaaagagcctgaatactgaaagcaatccttagcaaaaagaacaaaggtggaggcatcaggctagctgacttcaaactatacgatagggctacagtaaccaaaatagcacggtactggtacaaaaacagagacatagaccaatggaaaagaatagagaatacagaaataagactgcacacctacaactgtctcatctttgacaaacctgacaaaaacaagcaatggagaaaggattccctatttaataaatggtgctgggagaactagctagccatatgcaggatattgaaactggcaccttccttacgccttacacaaaaatcaactcaagatggattaaagacttacatgtaaaaccccaaactataaaaacactagaagaaaacctgggcaataccatttaggatataggcattggcaaagatttcatgatgaaaacactaaaagcaattgcaacaaaagcaaaaattagcaaatgggtctaattaaactaaagagcttctgcacagcaaaaggaactattaacagagtaaacagacaacctacagaacgggcgaaaattgttgcaatctatgtatctgacaaagccctaatatccagaatctataaggaacttaaacaaatttacaaaaaaaagcaaccccattaaaaagtgggcaaaggacatgaacagacacttctcaaaagaagacatacatgtggctaacaaacatgaaaaaagccttcacatcactaattattagataaatgcaaatcaaaaccaaatgagataccatcttacatcattcaggatggtgattattaaaaagtcaaaaaatgacagatgctgatgaggatgtgaagaaaaaggaacactttaatactgttggtgggagtgtaaattagttcaaccattgtggaaaacagtctggtgattcttcaaagacaaagaggcagaaataccattctacccagcaatctcattactggttatatactcaaaggaatataaatcattttcttataaagacacatgcacatatatgtttattgcagcactattcacaatagcagacatagaatcaacctaaatgcctatcagtgatagattggataaagaaaatgtacatatacaacatggaatactatgcaggcataaaaaggaatcaggtcatgtgcttcgcagggacatggatggagctggaggccatcatccttagcaaacttacacaggaacagaaaaccaaatactgcatgttctcacttacaagtgggagcaaaatgatgagaatacatggacacatggcggggaacaacacacactagggtgtgttggagagtagggagaggatcaggaagaataactattggataatgggcttaatacctgggtgataggatgatctgtgtagcaaaccaccatggcacacatttacctatgtaacaaacctgcatatcctgcacatgtatccctgaacttaaaataaaagttggaaataaaaaaaaaagagtgattatgtcagggactaggtggtagctgtggagatgatgaaaagtggtcagagtctagatgcattttgagggtgggcttgattggctggtggattagatgtgaaggatgagagaagaaaaaggtactaggatgactctagagtttttgccttgaacaagaaaaaaggatgaatgccatttaccaagattatagaaaatagccagtctgtttattcttacactatcaattgacacaacttccagttaataagttcactttattttctgaaagttacaggagaagactttactggttatgaccttatactgctttaatggtcatctgtagccaaaatcatggacataaattctgaggagggttcctggtaagcctcccattcctgctatgagaagaaaccagcatgcccatgcttcccagcagcatactgtaattgctaagtgtcaatgatgatgtcagttttagtgtctcagtaacagttgctagaggaaggaaggaaggaaggaagggagggagggagggagggagggagggagaggatgaagaaaaagaacgaaaagttagaaactatgtagtcccagcctctagaagccagaggcatgaggtctacttagggtcctcttgagacaggtgaagacttttcagtgtcacaaaattaatatcacaaagtgatattatgttagtattatgacatcaaaatgtgtgggcaggctgggcacagtggctcacgcctgtaatcccagcactttgggagtctgaggcaggtggatcacctgaggtcaggagttcaagaccagcctggccaacatggggaaaccccgtctctattaaaaatacaaaattagcggcgcatggtggagcaagcctgtaatcccagctacttgggaggctgaggcaggagaatcacttgaattcaggaagaggaggttgcagtgagccgagatcgtgccattgcactccagtctgggcaacaagagtgaaactccatctcaaaaataataaaataataataataataataataataataatgtgtgggcagatgtcatctacaccatagtttcagaatgcaataaattcacatttaaaaaccttgaagtacaccgtatcaaaactttacttcatctttcattcttatgtgattcagttgataggctggaagaacaatgaaagtgagttccatcatgctgcctggtgtccgtgtccttaatgataaagactttgagtgtatttgcaaactctctgttaatgacagcatttttttttattctgagctttattaaggtataattgacatacaaaaattgtacatatttaaggtgtataatgtaatgttttgatatacatatacattctgaaatgattaccaaaatcaagataattaacacatccatcacctcatagttatccatttagcaaatcctttactaggtggcaaaattgattttaaaatcacatttttatccccttgaagttttttcatctgtaaattttcaagggcagtcttttaatagaatacaaacagctcattccttatgtggctccaagctggcatttcagcattgggtttaaactttagagcaacatatgaaaatctcctgaataaacttgtcaatgattatggtcatcaaaacttagtatgatcaaggaaactggtttttgcataatattctgaatatttaaactccacagagcttgaataaatgaagtacaaattaaacatatcgatttttttcttttggtacatggtctatgttattgcagattagcatcccaaatcccaaaatcccaaatttgaaatgcttcaaaactgaaaccttttgagcactgatataagtctcaagggaaatgcattttggatttcagatgctcaaccagtaagcacataatgcaaatattaaaaaatctgaaatccaaaacacttctggtcccaagatatgggatactcatcctgtaccatggtaaatggttagttcttccttggcttatgccagtggttcttgatttaagccccaggagatattggaaatttctggaaacatttttggttgtcaaagcttgggggtggagtatgtttctggcatctaatgggtagaggccagggatgctgctcaatcttataatgcataggacaggccccagaagaaagaattgcctggcccaaaatgtcaatcactagtgctgaggttgagaattcttgacttaggccatagccgttccacagctcaagtcacagttgcattcctttagttgaaccttacagttcagttgttctactcaatatttgaatgctgaaggaagactggccctctagggttgtatttctagaacagggagaatgtagtactttgaggttgcatgctttagaattagtcattatgtgagttggaagaccatttgattctttattagaagttagcaagtgtgccagattagaccttcacccaagaacgtcatgagggttaatgagaggtttttaaaagataatagttatctttgtttcatgtttaacaactttatgcattggctggtcattccagctccacagaaagctcttcagttgagtttcaattacagcccgcaattccagatgctacaacattttaactgtggctgccagatatcagtgagattcacaggcctggagtacaacattctttacaatgtgtgcttcatattttgaaggccatctgtctcattttcatctacaattggctctgccgaagttttgcatgccaaatgatattttttaaaataagcttttgtgctactttaaaaatgtttcaaaaatatcttcgagatacaattcacacaccatgaaattcagccatttaaagtgtacaagtcagtggtttttagtagattcacaaagttgtgcaactatcactacagtctaaatttagaacactttcattactccataaagaaaccccatgcccattagcagtcactccagttcctctcctagtcctgggcaaccactaatgtaatttctgtctctaaagatttgcctgttcttatgaggagtggcggtgtacacctgtagtcccagctacttgaggaggccaaggcaggaggatcatttaagcccaggagtttcaggctgcagtgaattatgatactgctactgcactcccatctgggtgacagagtgagaacccatcctctaaaaaaaataaagatttgcctattctagacatttcttataaacagaaatatacagtattttgggactgctttttttcacttagcataatgtttttaaggttcatccatgttgtagcatgtataagtatttcatttcttttttgtccaaatcatattccattagaagtataaccatatttgatttatccatttatcgtttgataggcatttgggttgtttccacatttgcctactataaataatgctgctataaatattcacatacaagtttttctgtgaacacatgttttcatttctctccattattattataggctgaactgtggctccaccaaattcataatttgaagtcccaacccctagtatctcaggatgtaactgtatttaaagataaggtgtgtatagaggtggttatgctaaagtaaagctgctaggatgggggctctaatcccgtatgaatagtgtccttataaaaagccatcaggggcctgtccgcacagggaaacaccatgtgaggatacagaaaacaaccatctgcaagaaaggagagagatcttagaagaaaacagacctgccagcactgtaatcttcaactgccaggctccaaaactgtaataaataaatttctgttgtttaatttactcagtctgtggtattttgttatggcagctctagcagactattacaggtaaatacctaggagtagaaatgttgggtcatgtggtaactccatttaacactccaggtacctgccagactgttcatatgagtttttgtatgaatatatgttttattttctcttaagtacataggagtggcatagctgctaggtgtacatttaactatttaagacacggataaatggttttccaaagcagctgtaccattttacattcctaccagcaatgtttgagggttccaattttctgtatccttaacaaaacttgttattgtctatcttttgactatagttcagggactaagctctgatttttatcttgcccaaattcctacctaagaggtctggggagtcatgtcctacaaaccatggatcctcatcagatggcttttatttgaccatgtatattgtgacttgcttttcaatctgactctggcgtgacattatgagacaaggaaataatatttagccccataatatatttccttgccatgcctcgaaattgccctgcaaagtctcttgtgggaaaaatccacattccatagaaaatctccttccccttttattttctttcctttctttgcagatccagtggataatcaactaagagctaggcatccttttagatttgataagaaacattttacaacctaccctctctctgaagtctgccatctgagagattcttctgaacaataaaactggttctccacaatcctttatcttaacctgaacattcctttctattgatcccaagtctttagacaaattcaaccaactgtccacccgaaaatgtttaaatttacctatagcctggaaggccccactttgagttgtctcacctttctgaaccaaaccaatgtatttcttaaatgtatttgattgatgttttatgcctctctaaaatatataaaaccaagctgcaccccgaccaccttgggcacatgttctcaggaccacctgagggctgtgtcacgggccaaggttgttcatatttgactcagaataaatctcttcaaatattttacagagtttgactcttttcatctacaagtcatgtggtgtaaagtgatagctcattgttttctaatagactattttctacgaaagttttaggttcacagcaaaattgagcagaaagtacacagagttctcatatacccctgcctccccccaaccccatgcacaacctttcctactatcaatatcccacatcacagttgtacatttgtttcaaattatgacacatcattatccaaagtccacagtttatattagggtccatttttggtgttgtacattctatgggtccagcaaatgtgtaatgacatatatccacccgtgtagtagcatacagaaggctcactgtcctaaaaatcccgttttgtttattcattccttcctcctctccaaaccttcatatttcggttttgatatctactttcccagctgctaaagctgttgatcatcttttcatgtgcttattggtcacttacatattatcttctttggagaaatgtctattcaaatcctttgcccagttttaaattgggttatttgtctttctgttgttgactatcactttttaaggttgagtttgctccctgccaaggaggaaaacccatgacttttgtctactatgagaaaaacgctaatactttattattctggagaatggcttcctcaggaatttcactgttcctttctacttgagattcactaaatgttaatacagccactttgtggtttcggagcagagccatcatttttcttggcagccagatttataggactccaaaagaaacaaccagcattaggcagtattaaataaaatttggagataaaagctaatcagtgtgtataacaattactgatatcaaaatcaaggaataagaatcaaatagcacttcttactgttcatggacttcaaaagatttatatgaatttggtactattaaaacttcctctaaatttaaatatgaaacagatgggaataatacagttacatgagaaatattagtcatttctcagtgcttatgagctgggtccctttggtggacagtatttgtgcaaatgttttagtaactacatgactctgctctgttgtgagccatagttatcatatttttatttattctaaccagttaaattactatttactgaacacccactgcctcttgtactgaagtcattaaattctttgatacattttaaaaaagaaatagttgctttttctctgtttactaactttaaaaaaaaagaaaataacaccccccattcctccttgtatttcttagttggctgaagatattctggaacttaacaccatatattttgggagaaagaaaaacaaacctaaaacagaaaataccatagttatttaaatataggacttaaactcttgaagtttatctgcacttaaaaaaattctttccttttcttaaaatttttcagaaaggatttcactatctcctttgatagtttattctgcattctaaaactctcttttctcatggataatcaaaaccgatcctataggcgcctcttctgtattcagtagaaaaggtgactagcagccgggtgtggtggctcatgcctgtaatcccagcactttgggaggccaaggcaggtggatctcctgaggtcaggagttcgagaccagcctggccaacatggtgaaaccccgtgtttactaaaaatacaaacattatctgggcatggtggtgggtgccttgtaatgccagctactcgggaggctgaggcaggagaattgctggaacccgggagtaggaggttgtggtgagccaagatcgcaccattgcactccagcctgggtaacgagtgaaactcaatctcaaaaaaaaaaaaaaaaaaaaaaggaaaaaagaaaaaaagaaatggtgactagcttccccccaccatcttgatataatgatgaaattcttcacgccttctctacccaatgagggagaaaacaaacatgaaaatattgcaagacacaagactaagtactaacatttgttgacaatattaattttctcaatgtttaggtttctgaaaacagaacatttactgttgactttttccctcatgttaccaggtgtatctccaaacattctagaaacttcatgagataataaattattattaagcctaaattaggtgctttatctactttttgactgaaaaaattgaaacatggaataaattcattatttaatattaacataggtctacatttcctctgcaaaattcttgacccataactgccaattttaagattaaaaatacaggctgagtgcagtggctcatgcctgtaatcttagcactttgggaggctgaggcaggaggatcacttgagcccaggagtttgagaccagcttgggcaacatggagaaaccctgtctctacaaaaactacaaaaatcatcctagtgtggtggcatgtgcctgcagttccagatacctgggagattgaggtgggaagatcaccagaccctgggaggttgaggctgcagtgagtcatgatcatgccaatgcactccaacgtgggtaacacagtgagatcttgtctcaaagaaaaaaaaaaaaagttgaaaaggaaagaaaaaaacttttcaggaagggtacacatgcaaagcaagcctggcacgtaatgagtataaattagaaactatataaaatatatacattacaaaatataataagttaatgtatataaaatagaaaatatacttttttggttaataaaacaaaatgatgtgaggttatgaagaaattgtataatttcttaattggctttgaaagcaatttcaagcatcctaaaagagtttcgagtgataaaaacttaactagaataaaagcttctcacattcgtaagagcaacaattacttctcttccagtgatctccaaacttatttaattacatatctcaccagtaaaaggtttgtgcaactatatatccagtgcacatttatttaaaatgtaaataggttattagctatttctattttaaagcacgcataaattatagttggagtaaaacaatgtaaaagattgtgtttttacttactaatgggacagaatctttttgctgttattaaaacatagatttttagtttttaaataaaaacaggctatggaatatatttcattatttaaattctttgttgttgtttgtattagtccattttcatactcttatgaagaaatccccaagactgggtaatttataatgaaaaagaggttgaattaacttacagttcctcatggctggggaggcctcacaattagggttgaaggtgaaggaggagcaaaggcatgtcttacatggtggcaggcaagagacttgtgttgagcatgttgtttttgttgacacatatgaagaaaatcctagggcccttcagactccttggtcttggagatccctaaggaccacacttggaaactgatggtctatggcaatgggtccttttaggccttgaatccctttaagaatctgacaatatgaaactctgtctctaggaagctgctggaaggtacacatcttgggagtttgccctttgaagctcacctgtggaccttttttcctttcgaaaagaagcataagctgcaataaaaatttggtttcaagataacaaagtcagtccccaaaaatcagtattgagagtcactgacattaaatgatgaagatacgaggatggtgtggggacctttactcttcgaagatgagctatacatgcccctgaaaaggctgtctgaagacaggggaaggctggagatggcaactttggcctctgccaagtactcgtgctattttctgtatgtgatactatctgttttgtaactcagaggcaacaccacatacctagcataaggcttgaactccctttggggttatcaattacttacatagccttcctctaagggaaggcttgcaagtggttcatattcgacccttccatgtgataagcattcatgtgggcttcacaatgtaacagaggtacacagagattcttgtaaacagaaaattttataaaactgttaactgatctcactttgaagaagtcttactgactagatgtcatttatcagagtagacaggcttaaaatgcattgcttgtactagactgttgtaatgcatttttttgtttttgcattggtttttaattcatttaattggtttacactcatttttttttttacattccatttttgcatttgtatgccagttaaaaattatgaaatggcacattgtgggattttgtttagctaaattctagaaaaattgaaagataccttttattcgacttaagcctgaggttattcagcacggtgatctctgcatttttgaaaggttgtctcgtcgtttaataaacgtaaataacttaagcacattggaagagctattaaatgagagcaggagattaaaaagacatgatttcttactttatccacctgacaggatagcttgcattggtgattaaccttgcattgttaaattcatttcctaaatatttaggtaagtagttggtttgatcattatttgtaaagtattagtagttgcatgttgaattatcatgttaagatttttagtttgttgttcatgtgatatgaaagataacaattcctaaaactgaatgcatgcatggcttattcagctcaggtcacatacaaagagaaatgtgacgctgcaataaacatagcagagctatctgggtttgaagcaaaaaggctatgacgttaggtatatgcactttacattgtatgtatctttttagttctagtgaactcatctggaatcatgttacagaaaatgattctccaggtccaaacacatttaagtttaatgactgggactactctaacaattgcggctatctcattttgtctcattggttcattagcatagcacccatttaagaacaactacttctaaacacagtaatatttcagaggctataaaataatagagaaagaaaacttaaaaaatcctttgtttgcagccaagaaaatgtgaggatcagatttgtacttgttttgaacaattggaaactgtcacaattgtttttaagatgtaataaatgtatataaaatatgggattctatagtattagccattttgatatcttttgttgaaagaaaaaaccaaaaaaccccatatgttctaagtctcagaaatcaaagaattccac

SEQ ID NO: 156 - DNA, 12856 bp, Homo Sapiens
gaccccgcagcgtcgtggctagagtagggtctggagagagctcccactgtggcgagtcctgtcgttggattcccgcggcgccccgtaaggctccgccccggcggtgctaccaaaccctgttcgattttagaatcgtacattcccagagggaatcctagacccctcattttacagttgaggaaacaggcccaagtagcatgacttgttcgcgccgctagtcgaaggagcagcagccccgatcccttgactctggggcactgctttccctttagctcatttttggaggaaatgggtgcgcccttgctcgacctttggtgattgccgccacaggccttcccgccggctaactcagcgtgcccaagtcccgtgacttagtgccaggacggtgctgtgacccgttatcccctgtcgggttttacctccccccgggagagctcagccctggatcccggcgggcggcggagcctctctggagcccggacgggacagcccaccagggtctgcttctgtgaggggccgaggcgtcattccgcgaaggctcttcattcgatgtacaaaaaccacaagattatctaaatagatgcagaaaaggccttcgataaaaatcctcattccttcatgttaaaaactctcaataaactaggtattgaaggaacatacctcaaaataataagagccatttatgacaaactcacagccagtgtccttactgaatgggcaaaagctgaaagcattccccttgaaaaccagcacaagacaagtttgccctctctcccaacccctattcaatatagtattggaagttatggccacggcaatcgggcaagagaaaaaaatgaagagtatttaaatgggaaaagaggaagtcaaactatctttttttgcaggtgacataatcctatatctagaaaacccattgtctcaacccaaaagcttcttaagctgataagcaacttcagcaaagtctcaggataaaaaatcaaagtgcaaaaattgctatacaccaacaacaggcaagccaagagccaaatcatgaatgagctttgattcacaattgctacaaaaagaacaaaatacctaggaatacagctaacaagggaagtgaaggacctcttcaaggagaactacaaagcactgctcaaagaaatcagagatgatgcaaacaaatggaaaaacgttccatgctcatggataggaagaatcaatattatgtaaatggtcatactgcccaaagcaacttataaattcaatgttattcccattaaattaccactgacattcttcacataattagaaaaaactattttgaaatttatatggaaccaaaaaagagcctgaatactgaaagcaatccttagcaaaaagaacaaaggtggaggcatcaggctagctgacttcaaactatacgatagggctacagtaaccaaaatagcacggtactggtacaaaaacagagacatagaccaatggaaaagaatagagaatacagaaataagactgcacacctacaactgtctcatctttgacaaacctgacaaaaacaagcaatggagaaaggattccctatttaataaatggtgctgggagaactagctagccatatgcaggatattgaaactggcaccttccttacgccttacacaaaaatcaactcaagatggattaaagacttacatgtaaaaccccaaactataaaaacactagaagaaaacctgggcaataccatttaggatataggcattggcaaagatttcatgatgaaaacactaaaagcaattgcaacaaaagcaaaaattagcaaatgggtctaattaaactaaagagcttctgcacagcaaaaggaactattaacagagtaaacagacaacctacagaacgggcgaaaattgttgcaatctatgtatctgacaaagccctaatatccagaatctataaggaacttaaacaaatttacaaaaaaaagcaaccccattaaaaagtgggcaaaggacatgaacagacacttctcaaaagaagacatacatgtggctaacaaacatgaaaaaagccttcacatcactaattattagataaatgcaaatcaaaaccaaatgagataccatcttacatcattcaggatggtgattattaaaaagtcaaaaaatgacagatgctgatgaggatgtgaagaaaaaggaacactttaatactgttggtgggagtgtaaattagttcaaccattgtggaaaacagtctggtgattcttcaaagacaaagaggcagaaataccattctacccagcaatctcattactggttatatactcaaaggaatataaatcattttcttataaagacacatgcacatatatgtttattgcagcactattcacaatagcagacatagaatcaacctaaatgcctatcagtgatagattggataaagaaaatgtacatatacaacatggaatactatgcaggcataaaaaggaatcaggtcatgtgcttcgcagggacatggatggagctggaggccatcatccttagcaaacttacacaggaacagaaaaccaaatactgcatgttctcacttacaagtgggagcaaaatgatgagaatacatggacacatggcggggaacaacacacactagggtgtgttggagagtagggagaggatcaggaagaataactattggataatgggcttaatacctgggtgataggatgatctgtgtagcaaaccaccatggcacacatttacctatgtaacaaacctgcatatcctgcacatgtatccctgaacttaaaataaaagttggaaataaaaaaaaaagagtgattatgtcagggactaggtggtagctgtggagatgatgaaaagtggtcagagtctagatgcattttgagggtgggcttgattggctggtggattagatgtgaaggatgagagaagaaaaaggtactaggatgactctagagtttttgccttgaacaagaaaaaaggatgaatgccatttaccaagattatagaaaatagccagtctgtttattcttacactatcaattgacacaacttccagttaataagttcactttattttctgaaagttacaggagaagactttactggttatgaccttatactgctttaatggtcatctgtagccaaaatcatggacataaattctgaggagggttcctggtaagcctcccattcctgctatgagaagaaaccagcatgcccatgcttcccagcagcatactgtaattgctaagtgtcaatgatgatgtcagttttagtgtctcagtaacagttgctagaggaaggaaggaaggaaggaagggagggagggagggagggagggagggagaggatgaagaaaaagaacgaaaagttagaaactatgtagtcccagcctctagaagccagaggcatgaggtctacttagggtcctcttgagacaggtgaagacttttcagtgtcacaaaattaatatcacaaagtgatattatgttagtattatgacatcaaaatgtgtgggcaggctgggcacagtggctcacgcctgtaatcccagcactttgggagtctgaggcaggtggatcacctgaggtcaggagttcaagaccagcctggccaacatggggaaaccccgtctctattaaaaatacaaaattagcggcgcatggtggagcaagcctgtaatcccagctacttgggaggctgaggcaggagaatcacttgaattcaggaagaggaggttgcagtgagccgagatcgtgccattgcactccagtctgggcaacaagagtgaaactccatctcaaaaataataaaataataataataataataataataataatgtgtgggcagatgtcatctacaccatagtttcagaatgcaataaattcacatttaaaaaccttgaagtacaccgtatcaaaactttacttcatctttcattcttatgtgattcagttgataggctggaagaacaatgaaagtgagttccatcatgctgcctggtgtccgtgtccttaatgataaagactttgagtgtatttgcaaactctctgttaatgacagcatttttttttattctgagctttattaaggtataattgacatacaaaaattgtacatatttaaggtgtataatgtaatgttttgatatacatatacattctgaaatgattaccaaaatcaagataattaacacatccatcacctcatagttatccatttagcaaatcctttactaggtggcaaaattgattttaaaatcacatttttatccccttgaagttttttcatctgtaaattttcaagggcagtcttttaatagaatacaaacagctcattccttatgtggctccaagctggcatttcagcattgggtttaaactttagagcaacatatgaaaatctcctgaataaacttgtcaatgattatggtcatcaaaacttagtatgatcaaggaaactggtttttgcataatattctgaatatttaaactccacagagcttgaataaatgaagtacaaattaaacatatcgatttttttcttttggtacatggtctatgttattgcagattagcatcccaaatcccaaaatcccaaatttgaaatgcttcaaaactgaaaccttttgagcactgatataagtctcaagggaaatgcattttggatttcagatgctcaaccagtaagcacataatgcaaatattaaaaaatctgaaatccaaaacacttctggtcccaagatatgggatactcatcctgtaccatggtaaatggttagttcttccttggcttatgccagtggttcttgatttaagccccaggagatattggaaatttctggaaacatttttggttgtcaaagcttgggggtggagtatgtttctggcatctaatgggtagaggccagggatgctgctcaatcttataatgcataggacaggccccagaagaaagaattgcctggcccaaaatgtcaatcactagtgctgaggttgagaattcttgacttaggccatagccgttccacagctcaagtcacagttgcattcctttagttgaaccttacagttcagttgttctactcaatatttgaatgctgaaggaagactggccctctagggttgtatttctagaacagggagaatgtagtactttgaggttgcatgctttagaattagtcattatgtgagttggaagaccatttgattctttattagaagttagcaagtgtgccagattagaccttcacccaagaacgtcatgagggttaatgagaggtttttaaaagataatagttatctttgtttcatgtttaacaactttatgcattggctggtcattccagctccacagaaagctcttcagttgagtttcaattacagcccgcaattccagatgctacaacattttaactgtggctgccagatatcagtgagattcacaggcctggagtacaacattctttacaatgtgtgcttcatattttgaaggccatctgtctcattttcatctacaattggctctgccgaagttttgcatgccaaatgatattttttaaaataagcttttgtgctactttaaaaatgtttcaaaaatatcttcgagatacaattcacacaccatgaaattcagccatttaaagtgtacaagtcagtggtttttagtagattcacaaagttgtgcaactatcactacagtctaaatttagaacactttcattactccataaagaaaccccatgcccattagcagtcactccagttcctctcctagtcctgggcaaccactaatgtaatttctgtctctaaagatttgcctgttcttatgaggagtggcggtgtacacctgtagtcccagctacttgaggaggccaaggcaggaggatcatttaagcccaggagtttcaggctgcagtgaattatgatactgctactgcactcccatctgggtgacagagtgagaacccatcctctaaaaaaaataaagatttgcctattctagacatttcttataaacagaaatatacagtattttgggactgctttttttcacttagcataatgtttttaaggttcatccatgttgtagcatgtataagtatttcatttcttttttgtccaaatcatattccattagaagtataaccatatttgatttatccatttatcgtttgataggcatttgggttgtttccacatttgcctactataaataatgctgctataaatattcacatacaagtttttctgtgaacacatgttttcatttctctccattattattataggctgaactgtggctccaccaaattcataatttgaagtcccaacccctagtatctcaggatgtaactgtatttaaagataaggtgtgtatagaggtggttatgctaaagtaaagctgctaggatgggggctctaatcccgtatgaatagtgtccttataaaaagccatcaggggcctgtccgcacagggaaacaccatgtgaggatacagaaaacaaccatctgcaagaaaggagagagatcttagaagaaaacagacctgccagcactgtaatcttcaactgccaggctccaaaactgtaataaataaatttctgttgtttaatttactcagtctgtggtattttgttatggcagctctagcagactattacaggtaaatacctaggagtagaaatgttgggtcatgtggtaactccatttaacactccaggtacctgccagactgttcatatgagtttttgtatgaatatatgttttattttctcttaagtacataggagtggcatagctgctaggtgtacatttaactatttaagacacggataaatggttttccaaagcagctgtaccattttacattcctaccagcaatgtttgagggttccaattttctgtatccttaacaaaacttgttattgtctatcttttgactatagttcagggactaagctctgatttttatcttgcccaaattcctacctaagaggtctggggagtcatgtcctacaaaccatggatcctcatcagatggcttttatttgaccatgtatattgtgacttgcttttcaatctgactctggcgtgacattatgagacaaggaaataatatttagccccataatatatttccttgccatgcctcgaaattgccctgcaaagtctcttgtgggaaaaatccacattccatagaaaatctccttccccttttattttctttcctttctttgcagatccagtggataatcaactaagagctaggcatccttttagatttgataagaaacattttacaacctaccctctctctgaagtctgccatctgagagattcttctgaacaataaaactggttctccacaatcctttatcttaacctgaacattcctttctattgatcccaagtctttagacaaattcaaccaactgtccacccgaaaatgtttaaatttacctatagcctggaaggccccactttgagttgtctcacctttctgaaccaaaccaatgtatttcttaaatgtatttgattgatgttttatgcctctctaaaatatataaaaccaagctgcaccccgaccaccttgggcacatgttctcaggaccacctgagggctgtgtcacgggccaaggttgttcatatttgactcagaataaatctcttcaaatattttacagagtttgactcttttcatctacaagtcatgtggtgtaaagtgatagctcattgttttctaatagactattttctacgaaagttttaggttcacagcaaaattgagcagaaagtacacagagttctcatatacccctgcctccccccaaccccatgcacaacctttcctactatcaatatcccacatcacagttgtacatttgtttcaaattatgacacatcattatccaaagtccacagtttatattagggtccatttttggtgttgtacattctatgggtccagcaaatgtgtaatgacatatatccacccgtgtagtagcatacagaaggctcactgtcctaaaaatcccgttttgtttattcattccttcctcctctccaaaccttcatatttcggttttgatatctactttcccagctgctaaagctgttgatcatcttttcatgtgcttattggtcacttacatattatcttctttggagaaatgtctattcaaatcctttgcccagttttaaattgggttatttgtctttctgttgttgactatcactttttaaggttgagtttgctccctgccaaggaggaaaacccatgacttttgtctactatgagaaaaacgctaatactttattattctggagaatggcttcctcaggaatttcactgttcctttctacttgagattcactaaatgttaatacagccactttgtggtttcggagcagagccatcatttttcttggcagccagatttataggactccaaaagaaacaaccagcattaggcagtattaaataaaatttggagataaaagctaatcagtgtgtataacaattactgatatcaaaatcaaggaataagaatcaaatagcacttcttactgttcatggacttcaaaagatttatatgaatttggtactattaaaacttcctctaaatttaaatatgaaacagatgggaataatacagttacatgagaaatattagtcatttctcagtgcttatgagctgggtccctttggtggacagtatttgtgcaaatgttttagtaactacatgactctgctctgttgtgagccatagttatcatatttttatttattctaaccagttaaattactatttactgaacacccactgcctcttgtactgaagtcattaaattctttgatacattttaaaaaagaaatagttgctttttctctgtttactaactttaaaaaaaaagaaaataacaccccccattcctccttgtatttcttagttggctgaagatattctggaacttaacaccatatattttgggagaaagaaaaacaaacctaaaacagaaaataccatagttatttaaatataggacttaaactcttgaagtttatctgcacttaaaaaaattctttccttttcttaaaatttttcagaaaggatttcactatctcctttgatagtttattctgcattctaaaactctcttttctcatggataatcaaaaccgatcctataggcgcctcttctgtattcagtagaaaaggtgactagcagccgggtgtggtggctcatgcctgtaatcccagcactttgggaggccaaggcaggtggatctcctgaggtcaggagttcgagaccagcctggccaacatggtgaaaccccgtgtttactaaaaatacaaacattatctgggcatggtggtgggtgccttgtaatgccagctactcgggaggctgaggcaggagaattgctggaacccgggagtaggaggttgtggtgagccaagatcgcaccattgcactccagcctgggtaacgagtgaaactcaatctcaaaaaaaaaaaaaaaaaaaaaaggaaaaaagaaaaaaagaaatggtgactagcttccccccaccatcttgatataatgatgaaattcttcacgccttctctacccaatgagggagaaaacaaacatgaaaatattgcaagacacaagactaagtactaacatttgttgacaatattaattttctcaatgtttaggtttctgaaaacagaacatttactgttgactttttccctcatgttaccaggtgtatctccaaacattctagaaacttcatgagataataaattattattaagcctaaattaggtgctttatctactttttgactgaaaaaattgaaacatggaataaattcattatttaatattaacataggtctacatttcctctgcaaaattcttgacccataactgccaattttaagattaaaaatacaggctgagtgcagtggctcatgcctgtaatcttagcactttgggaggctgaggcaggaggatcacttgagcccaggagtttgagaccagcttgggcaacatggagaaaccctgtctctacaaaaactacaaaaatcatcctagtgtggtggcatgtgcctgcagttccagatacctgggagattgaggtgggaagatcaccagaccctgggaggttgaggctgcagtgagtcatgatcatgccaatgcactccaacgtgggtaacacagtgagatcttgtctcaaagaaaaaaaaaaaaagttgaaaaggaaagaaaaaaacttttcaggaagggtacacatgcaaagcaagcctggcacgtaatgagtataaattagaaactatataaaatatatacattacaaaatataataagttaatgtatataaaatagaaaatatacttttttggttaataaaacaaaatgatgtgaggttatgaagaaattgtataatttcttaattggctttgaaagcaatttcaagcatcctaaaagagtttcgagtgataaaaacttaactagaataaaagcttctcacattcgtaagagcaacaattacttctcttccagtgatctccaaacttatttaattacatatctcaccagtaaaaggtttgtgcaactatatatccagtgcacatttatttaaaatgtaaataggttattagctatttctattttaaagcacgcataaattatagttggagtaaaacaatgtaaaagattgtgtttttacttactaatgggacagaatctttttgctgttattaaaacatagatttttagtttttaaataaaaacaggctatggaatatatttcattatttaaattctttgttgttgtttgtattagtccattttcatactcttatgaagaaatccccaagactgggtaatttataatgaaaaagaggttgaattaacttacagttcctcatggctggggaggcctcacaattagggttgaaggtgaaggaggagcaaaggcatgtcttacatggtggcaggcaagagacttgtgttgagcatgttgtttttgttgacacatatgaagaaaatcctagggcccttcagactccttggtcttggagatccctaaggaccacacttggaaactgatggtctatggcaatgggtccttttaggccttgaatccctttaagaatctgacaatatgaaactctgtctctaggaagctgctggaaggtacacatcttgggagtttgccctttgaagctcacctgtggaccttttttcctttcgaaaagaagcataagctgcaataaaaatttggtttcaagataacaaagtcagtccccaaaaatcagtattgagagtcactgacattaaatgatgaagatacgaggatggtgtggggacctttactcttcgaagatgagctatacatgcccctgaaaaggctgtctgaagacaggggaaggctggagatggcaactttggcctctgccaagtactcgtgctattttctgtatgtgatactatctgttttgtaactcagaggcaacaccacatacctagcataaggcttgaactccctttggggttatcaattacttacatagccttcctctaagggaaggcttgcaagtggttcatattcgacccttccatgtgataagcattcatgtgggcttcacaatgtaacagaggtacacagagattcttgtaaacagaaaattttataaaactgttaactgatctcactttgaagaagtcttactgactagatgtcatttatcagagtagacaggcttaaaatgcattgcttgtactagactgttgtaatgcatttttttgtttttgcattggtttttaattcatttaattggtttacactcatttttttttttacattccatttttgcatttgtatgccagttaaaaattatgaaatggcacattgtgggattttgtttagctaaattctagaaaaattgaaagataccttttattcgacttaagcctgaggttattcagcacggtgatctctgcatttttgaaaggttgtctcgtcgtttaataaacgtaaataacttaagcacattggaagagctattaaatgagagcaggagattaaaaagacatgatttcttactttatccacctgacaggatagcttgcattggtgattaaccttgcattgttaaattcatttcctaaatatttaggtaagtagttggtttgatcattatttgtaaagtattagtagttgcatgttgaattatcatgttaagatttttagtttgttgttcatgtgatatgaaagataacaattcctaaaactgaatgcatgcatggcttattcagctcaggtcacatacaaagagaaatgtgacgctgcaataaacatagcagagctatctgggtttgaagcaaaaaggctatgacgttaggtatatgcactttacattgtatgtatctttttagttctagtgaactcatctggaatcatgttacagaaaatgattctccaggtccaaacacatttaagtttaatgactgggactactctaacaattgcggctatctcattttgtctcattggttcattagcatagcacccatttaagaacaactacttctaaacacagtaatatttcagaggctataaaataatagagaaagaaaacttaaaaaatcctttgtttgcagccaagaaaatgtgaggatcagatttgtacttgttttgaacaattggaaactgtcacaattgtttttaagatgtaataaatgtatataaaatatgggattctatagtattagccattttgatatcttttgttgaaagaaaaaaccaaaaaaccccatatgttctaagtctcagaaatcaaagaattccac

SEQ ID NO: 157 - DNA, 987 bp, Homo Sapiens
attggcagttggcccttcagctgctgtacagcctcggtaggggcccaggggtattgaatctggttttggaccacaggaggagagtgaagtgaagtacaaccaatattgtcaacagcaagatcgtcaagtgagtcctgataatatattcatggaaagatatattgttctgcttctaggttctgtagggaaggagggcccagggagaatgcatgttgcaactctgcaagcagaatctacccctctgcccatagaagctggttgtggttgttcagttttcctttagctttttggtttcatttctgcaagtggcatgttttggttgctaagcaaggtgttgcaaaatatgaggtgagatgtcaatataactttaaaaggggagatgtggtcagaagggacgtaatactcagattttaagaagaaaaaggatttttgaatttggcattattaacagagagctgtcatgttcctttccctcaacagagaaaataagtgacccaaaatagaaaataaatgaccctttctgtgattagcaactcactgtgtttgtttagtgtcaagaatgctattagtaactaataaaaatttataatcatgagatcacctccccaaacaaaaatgaataaacagagaatacatctttatagcaagtctaatgacacctttgcagctaaggagtctggacctagcagagtatcctgcatgcctagagcaggcatttcataaatgttgaaaaatgagtgttgtttgctgaatattgaacttgcctttgcagtctatatccctccccaaataatcagcctgttgtatgacctccagatttatattattgcaccgtcactttggtgctgagatttggcataattactttaggaaaatatcccttattgatacacacattagtccactgtagtgagtggcacctggtatgggaccctaaacctgatacattctcaataaatgcttgttaacctgaatagtcactaggaa

SEQ ID NO: 158 - DNA, 3141 bp, Homo Sapiens
ttaacaccacttgctcaatccgtatgcaaatttcgttgtctattttgttaaaacatgtccatatacgacccttttccaccactgttcaagccactgtcatcatattatatatctcatgcacaggactgtttaagataggccaacacgatgccccttcacaaggacccaataaaatctacattgtcttatggccctacagatacctttgcctcttacccttgcctctcatttggaaaaatgtatctagattttaggttgggaaaaacagttcttattaataaaatgcatattcttctgaatctgttgtttggtcaggacctactatgcagtcttgacttttgacattcaatagcctagattttaaaaatcccaagtttcctttctgtgttttggtgctttgtcctgtggcagtgaatgctttacaaattctattttaagtggaggaagaacacgtttaaaaataatttctggaaatgaaaaaacatatcataaaatgaatgcctctccccatatataccattcgaatatttttattattcattaacattttgatgtattttcttccatccttttttctctgctcaattttgaaaacatttgcaacaaaataaccatttaattttatatcctggatttcttccaatttatcattataatctgaacactcttcatattattaaaaacgttctataaatatcatttcaataattccaaaatattatatgaatgtacatagtttatttaaccatgatcagttagaatactttaaacattttaatttgtatgtaatattttgtatgttcaaatttaccaaaatttctgattactcccgcagtatagaaaagttaaattgctaggtcaaagtgctttaacattttaccattcttgatattatagcttcatgattaagtgcatgaatttttaaagtcagatataccctatatggaatcccgaatccaccaaaattatgagaagtactatgttgaagaggaacggtgagagtaggcatcctggtcttgttcccgttctcagagggaatgctttcaacttttccccattcggtattatattggctgtgggtttgtcacagatggcttttattacattaagagaagacagctataactccaaaagtgagagaaagtagaagacatgccagtgctcaaaagctacaaatgtaaccagagccgtggcataaaatgaaatacttctggttcatatacttccactgagcagcattgcattttatacacttcttctttaatggttcagacatatagttcttaacatcacatggagactcataaccttcagaatacagcatgaatcagctggctgcactgcaaagagaatacaaaataccatcaagaatgtcctaactggaacagtaaacttttaaagtacaaacaactcatctgttagcagcctggcattttgctttctggaaagtaaatacattagagagatatctttaaagagagtctattacctgtgtaagtcagcaattttcaatcatgactgtagcagatccaggtgagagacactgcgacctggccttatagcaggaccaataagcataagcaatcccttggtcctaagagtttgtgcatacttatatatacatgatgtctcttaaataacccagaaaaaatgctctgagaagacctgaattacaagtgtgtggaatacctccatcttctgcttaactgatgtccagcttagtgagagatgttttctatttaatcccacaccttgtgtaggatgggataagaattataaattaacaagtcaactatattaaaagagaaattgaagaatgacttaaaccttctcagtctcaaattactccgtcctggatacatatagttgaatcctgttaagtaaaatacaagtgtaatatgtcgtccccatgctctaaaacactacaataagaaaggagacaaaagaaagaaaattataataaaatcttatcttcaggaatccttaagagaatacatcattctgaactgtcaaagatttgctcacttgaatcttcttataaaaatctttctaaattgcattgcttatttcactacattcttaaacaacgtactctataatttaatctgttcttagatgatataagattattgttattttaaaataaaagtccactctagtgtacagcaatggtggctgcatgatctactgtggtggataagactgagtattgctgagctttgtgagttattttgttttgctttatggatactgttttttttttttttgctgaaggaaaccagtattgttttctgttatatttgcaatcaaaagcatcttaactgaaagaatttggaatcaggaagtagggtgttacataaagccatgaaagtgtccttaatattttgggaagataatgtagaagtatatggcgtaaaatgactaaatggtaattaaattatcttccttggtcacctgagctcaactgcccaacaggatataaagctctaggagacaatgttgccaccaccagtgaagaattcaaacaattcagtgactatcagtagaagtcagtgtttctgatgcattagtaatattaaagaaagagattatcaaattcaaatacataaatttttgtctcacggtacgaactaaaacctaggaacttttagttactgggctaacagcacctctaatgtcttttatttccccaaatcacattgtaatgatttggcatccagtaagagtaacgaaataggtggtcagagtaaatagaaaaccccactgattagaaagaggaatcagtgataatacttctttcatttaccattggttactgtttttcaaaaatgagaacatttagagatttagcaaaagcattacgcatctccatctgctttccatgtcaggcaagacagatactactcactacaaataattatttaaaggatggagggaggaggaggaaatccagaaacaatgtttatttgaacatcttgaaagacagcacaattatgctgttttataagacatgtataacttattattgtaagaactttaaggttttttttttcatttttttttttgctggtctgtatattctaaattttatttatacctatgtattatatttgttataagaatataagcacaatagaaaag

SEQ ID NO: 159 - DNA, 874 bp, Homo Sapiens
aagacaccgaaacaaggatttcagtgcaagttgtttcatgggagacttcaagaagcatcagggtcgatcccagcactttgggaggccaaggacatctttcaatggctcctggccaactggcagcagaattttaccttcctgtgcatgaatgaccttggatattattcttggtggcatgactggacacctgcagcctcttgatgtttccagtcaaaaaggtatttaagagccatttgtcaggcggaccacttgagcccacgagtttgaggccagcctgggcagcatagtggcacgctgtttctaaaaaacaaaacaaaacaaaaacaaaacaaacaaacaaacaaacaaaaaacgaaagaaaggaagaaagaaagagaaaagagcagtaatatcttcatcactggtcattggtcattgtctttaaaacaactttccatcgatatcttctggggagaacaagagagcactagtgtcaaaacttcaaccagcttggaagaaaattctggagataagagagcaataattttttaggttgaatcacataagtttgccatcttttggtcaaaaacagtctaatgagcaatttcacttggttccacttacaagaaaagttccatctctaacactcttgatgggactgtgtgcagaaataagggcattgacaagtcggaattaaaacataatctagaagggttgcattctgaatataaaaagttttaggaatatttaaaccagtttgttttacttatattttccttctttatacatatgacaagagtaatattttttaaaaaattatttaaaggcctattcatagcttgaaaaaaaattcttgcagtaaaagcatttgcaaaaatatgaaataaaatttgac

SEQ ID NO: 160 - DNA, 1628 bp, Homo Sapiens
aatgggctgcattaaaagcaaagaaaacaaaagtccagccattaaatacctgaaaatactccagagcctgtcagtacaagggtgagccatgggagcagaacccactgcagtgtcaccatgtccatcatcttcagcaaagggaacagcagttaatttcagccgtctttccattccattataccatttggaggatcctcaggggtaacaccttttggaggtgggcatcttcctcattctcagtggtgccaagttcatatcctgctggcttaacacgtggtgttactatatttgtggccttatatgattatgaagctagaactacagaagacctttcatttaagaagggtgaaaaatttcaaataattaacaatacagaaggagactggtgggaagcaagatcaatcactacaggaaagaatggttatatcctgagcagttatgtagcgcctgcagattccattcaggcagaagaatggtattttggcaaaatggggagaaaagatgctgaaagattacttctgaatcctggaaagaacaaaacaaaacaaaaacgagagagcgaaactactaaaggtgcttattccctctctattcgtgattgggatgaggtaaggggtgacaatgtgaaacaccacaaaattaggaaacttgacaatggtagatactatatcacaaccagagaacaacttgatactctgcagaaattggcaaaacactacacagaacatgctgatggtttatgccacaagttaacaactgtgtgtccaactgtgaaacctcagattcaaggtctagcaaaagatgcttgggaaatcccttgataatctttgcgactagaggttaaactaggacaaggatgttttggcaaagtgtggatgggaatatggaatggaaccacaaaagtagcaatcaaaacactaaaaccaggtacaatgatgccagaagcttttcttcaagaagctcaggtaatgaaaaaaataagacatggtaaacttgttccactatatgctgttgtttctgaagagccaatttacattgtcactgaattgatgtcaaaaggaagcttattcaatttccttaaggaaggagatggaaagtatttgaagcttccacaaatggttgatatgcctgctcagattgctgatggtatggcatatattaaaagaatgaactatattcaccgagatctctgggctgctaatattcttgtaggagaaaatcttctgtgcaaaatagcagattttggtttagcaaggttaattgaagacaatgaatacacatcaagacaaggtgcagaatttccaatcaaatggacagctcctgaagttgcactgtatggtgggtttacaataaagtctggtgtctgctcatttggaattctacagacagaactggtaacaaagggcagagtgccatatccaggtatggtgaaccatgaaatactggaacaggtggagcgaggatacaggatgccttgccctcagggctgtccagaatccctccatgaattgatgaatctgtgttggaagaaggaccctgatgaaagaccaacatttgaatatgttcagtccttcttgggagactacttcactgctacagagccatagtaccagccaggagaaaacttc

SEQ ID NO: 161 - DNA, 1852 bp, Homo Sapiens
catgcgtggctgactgtgggcgagcgaatcctggaacatcacatgttttgtttgtggagtggtgtgtacattgtttgtagagtggtgtgtacattgtgtgtagagtggtatgtacattgtagagtggtacgtacattgagagtggtgtgtacattgtagagtggtgtgtacattgtttgcagagtggtgtgtacattgtgtgtagagtggtgtgttcattgtagagtggtatgtacatggagagtggtgtgtacattgtagagtggtatgtacattgtagagtggtgtgtacattgtgtgtagagtggtgtgtacattgtgtgtagaggggtgtgtacattgtagagtggtgtgtacattgtgtgtagagtgctgtgttcattgtagagtggtgtgtacattgtttgcagagtggtgtgtacattgtagagtggtgtgtacattgtagagtggggtgtacattgtttgtagagtggtgtgtacattgtcgagtggtgtgtacattgtttgcagagtggtgtgtacattgtagagtggtgtgttcattgtgtgtagagtggtgtgtacattgagagtggtgtgtacattgagagtggtgtgtacattgtagagtggtatgttcattgtgtgtagagtggtgtgtacattgagagtggtatgtacattgagagtgctgtgtacattgtagagtggtgtgtacattgtagagtggtgtgtacattgtgtggagagtggtgtgtgcattgtagagtggtgtgtacattgtgtggagagtggtgtgtacattgtagagtggtgtgtacattgtgtgtagagtggtgtgtacattgtagagtggtgtgtacattgtgtgtagagtggtgtgtacattgtagagtggtgtgtacattgtgtagagaggtgtgtacattgtagagtggtgtgtacattgtgtgtagagtggtgtgttcagtgtagagtggtgtgttcattgtagcatggtgtgtacattgtgtgtagagtggtgtgttcagtgtagagtggtgtgttcattgtagcatggtgtgtacattgtagagtggtgtgtacattgtagagtggtgtgtagagtggtgtgttcattgtagagtggtgtatacattgtgtgtagagtggtgggtaaattgtagagtggcatgtacatggtgtgtagagtggtgtgttcattgtagagtggtgtgtacattgtttgcagagtggtgtgtacattgtgtgtagagtggtgtgttcattgtagagtggtgtgttcattgtgtgtagagtggtgtgtacattgtgtggagagtggtgtgtacattgtgtgtagagtggtgtgttcattgtagaggggtgtgtacattgagagtggtgtgtacattgtgtgtagagtggtgtgttcattgtagagtggtgtgtacattgagagtggtgtgtacattgtgtgtagagtggtgtgtacattgagagtcgtgtgtacattaagagtggtgtgtacattgtagagtggtatgtacattgagagtggtgtgtacattgagagtggtgtgtacattgtgtgtagagtggtgtgttcattgtagagtggtgtgtacattgtagagtggtgtgtacattgtgtggagagtggtgtgtacattgtagagtggtgtgtacattgtgtggagagtggtgtgtacattgtagaggtgtgtacattgtgtggagagtggtgtgtacattgtagagtggtgtgtacattgtgtgtagagtggtgtgttcattgtagagtggtgtgtacattgtggagtggtgtacatggtttacacacgtgtgtgcatggggacaagacttggatggagtttgccatcccctgtta

SEQ ID NO: 162 - DNA, 1395 bp, Homo Sapiens
agacagagtctcgctcttgtactatcttggctcactgcaacctccacctcccggattcaagcgattcttgtgcttcagcctctcaagtagctggaattacagatgtgcaccaccacgcctggctaatttttttgtatttttagtagagacggggttttgccattttggccaggctagtctcaaaactcctgaccttgggtgatctgtctgccttggcttcctaaagtgctgagattacaggcgtgagccactgcaccatgctgtttcttctgctaataagacttattttattttatttttttaaatggagtctcactctgtcgccaggctggagtgcagtgctgcgatctcagctcactgcaacctctgcctcctgggttcaagcaattctcctgtctcagcctcccaagtagctgggactacaggcgtgcaccaccatgctgagctaatttttatatttttagtagagacagggtttcaccatgttggctaggatggtctcgatctgttgacctggtgatctgctcgcctcggcctcccaaagtgctgggattacaggtatgagtcactgtgctcggccgagtatcctcttttttttttttttgagacagggtcttgctcagtcacccagggaggagtgcagtggctggaccacatctcatgtacctgaacttcctgggctcatgcgatcctcccacctcagtctcccaagtagttgggactatgggcgcatgccaccacgcctagctaatttttttttttaagtagatactgggtctcactatgttacctaggttggtcttgaactcctgagcttaagcgatcctcccacctcagcctcacaaagcgctgggatcacaggtatgagctactgcacccagcccatcttggatttcttttgcttttttttttgagacagagttttgctcttgttgtccaggctggagtgcaatagcactgcctcggctcactgcaacctccatctcccaggtacaagggattctcctgcctcagcctcccgagtagctgggattacaggcgcccgccaccatgcctgtctaatttttttgtatttttagtaaagacgggggttcaccatgttggccaggctggtctcgaactcctgacctcaggtgatctgcctgactcggcctcccaaagtgctgggattacaggcgtgagccaccgcgcccagccctcttttgctttcttaaataggtctgcttccttctaactacaggcccgttgcacatgctgtttcttctgctaataacactttttctctcctctttgcctggcaactactcatctttcatgtttcagtttaacatttctccagggagactttcctgaaccttcaggctactttgaactgtctggtatagcacactaaac

SEQ ID NO: 163 - DNA, 16209 bp, Homo Sapiens
agcttctgcccgcgcggagataaacaagcaccgcgaccgccgagcagcgccgaacccagcgcgcccagtcagaccccagggcctgtgtaccgagcatgcgcagttcccgcccaagccaggagcagcgtcaacctgagactcccgagacattaagaattcggaagggatgagatggtagaggggctagagctacctccaagctttatcctgaggcggggagtgaaggagagatgcccaaggcccaagaggggccgcgagggcctttgtccgatgccacccagtctgtcagcactcctagagctttggttttatcttgtattagcatgtgaagctttaaggggggggcacctacaggcttctgactgaagttgtgtaaacgcaacaaaatgaagctttggagcgttaggacattgatgggagggtgacgcccccctctagcagcgcgccagaggggcgagtcagaggcggccacacaccacggaagtcgggtccaagcccgctgacgtcgccggggtcccgcccaccaaccctctggacccgcccacatttcttctagacccgcccctttcggtgccgaactgaagtcgagctcttcccacgccctgtcagccacgggtgagttgaaaacctggagagcggaatcccgaacggcagccggaaggccctggactcctcatagcaacagccagctaggggcatctagtgggaagctgggattcattctagccaaccacatcacgtctctgtaccacaaggtaccattcacgaccaataagagagcgcccccataccacgtgcctttactccttcaaccaatcgagaaaaacgctagtcgtaggatccgcaagcccacctcccagtgccttgccaggcggggctcttcgcgcacgctctgccaaccaatcgtaggtgagctggcgagtgacggaagcttcggccaagccaaccagagctcgcgagccccttgccaccgaggccggcgggatggagacagggaccggctgctggggtttgggaggggcagagattgaggagccagttgctgtgccctgttctggcaaaagaacaagatgcgttgcaagccagaatgatgaattccacttttcacgtcgcctccgtggcattctgcctaaatgatgggcatggaaatggtgctgagggatgtgggctgaatcgagaacacagggacttttgtcttcagggtgagaaatgttccggtccttaaggaaacatcgtgcagcagttgcatgggtcttccaggcgttcctcccaaaacattattttttttctttcactattgagttttaaaacttagcgttctgtcgctagcattgcatcttagttacacatcctctcccacccataacgtcaaatttaggagacgatacatccccaagctttcctgcattattttttgcagtaactggttattcagtttactttctttaaactatgtccttctcaaactagtctcacctgttcgttactgtcgcacatttcctgcgaataacacgtttctgtagttctgttgttagagcctggcatacctctccccgttcctctttcccacaaggtcatcatgcagaggggattttggtctgagttaaaagccaggtattctttcaccatcttttctgtcgatagtcaaactactacaaagactactcaaatttagtagtttcttatttccctatagcttcgttatattagaatggataacttatatttgcattaccttgctgtaatgaacacacaccaagttttcatttaaaattatcaaggacaaatgtcctctgaatttaaaaatgtgtatgtagtaaaatataactcagcatttcttgattacatatcattaaaatatgaatggtactatctgagccaccagaatcagcagtgaaggtattatattaataaaaaggactaagaatcaggactgttttaagggaactggaaccgaagaggatctactatttcatcctaggctagttaacatgaaatagtgaattaaaattgaaagagcttacatggatgcttcatatctgagctactttggcagggatgtttcaagaggatgtaggtaagtatggtgttcacctagctttccagaagtctcatattttgtgtaaaattggtatgcttattcatggttactttgggttagtagaagctatacttcttttccaaggaaagacagactgtcttaagattctaactgtgcatcttggtgataagaagttcttagggttgttaaatagagccaggaagcgtgaagctttctctctagatcatgacaactcatctagtaccttgcattacaaaggagctctaagtccatttactttgcaaggaatgaagttccagtgattaatgtttttgagaaatttgtattgggattgtggggtccagaaggttgccttaagtaactgttttcatgactcctaggtccctagatgttgagaagctctggattgaagctgtcacaaaaatagtgagtgggctccgtagtcactccatttagcataatacagagtaggacagctttgtgacatttctcaggctatttcccctgacctctcatcaatgctgacgtttttgataagaaggggtatagagactgcagcccttggggtggttacagttcatttatttacaggccttatattgacaggcctcagatttcatgctcagtaccataaaggttgatttttaaccaccaagaggcaaaagaaacatgacaggtcggagcatattttctcacctattctggcttaaatgatggtacttacctgatttgtggttgtaggtgaaatgttgggtgaaagattagctgctataaaaaggatgtcaggacgtgtagagaatttagaggacttgggtgggagatggatgtctattttctaaccccttagtcatgttcattccgatgccagcataaactctattttgagatgattatagaaataacttatatcttcatttgtttgtgggaaataaaaaataaaaatgatataaaagaaatttgaattattcccaagagctgtaaatctgtaagatagtgaaaacttaacgcagtaactgacactgcaggatccctttagtttccaaagtgcattgccaggagaataaaaagaaagaaaatcttcatttctcctctctccactaaatctgaaagggagttatctcacctatagccagataccttcaattatcgcacttgtgttaccgtggaaacccaagtccatcctttctttctgtaaaaggtgttggaaaaggtggtatgaagtgggaaaggtactgtattctgggacttcctgacaccagcaagaagcaaatatgcagataatttaatagaaacaaattagtagaggatgtttgtaatgcgaggggtacttttcgactgtaaaaccctgattcctaatgcttcttattaaagcctgcatgcctctgattaaacataaaggggaagggcatgtcaagtacatttagcacctgtgaaacgctgctggcaagtataaggagagcagacgatggtttcttgacctgtgaggctcctaatacagttgagaatctgcagtatatatgtggagtggaaaggaaggggcaaaataaactttgttcttcctttaaaaaatgtgatatgtctcagtgcttttgaaaagaaaaggaattagaatgcagaaattaagagtatggaaacaactcaataaaagaaacgtatgggtggagagagtagatgtttcaaaaggccattttaatcagaaaaaaaatctgaaagaaaagacgtaatgattaaaatgtaggcagaaaaaagaaaaagcctgaagaatcttaagagctagaggattctgcggaaaacagagcttcagtgtggttcatttaacaaagcagaagagcaggcacagtgttgcttgcgtacccagcagtttccctttatttttgccaaagaagctgggatgaatcaggattggactttaatagcattgctttccctctgcccacggttagtccaaaagtaggcacgtgactcagttcttgtcattggaatggggagaaggctgctagggctggagggatttctaggatattgacaagagtgaggaaatatccccgttttctgatgtcgctctctttgcttcctgctttacacattgaaatatgagaatgtggcctccatttgggggctatgatgcattatgacattatggtgcaatactgtagaaagccagcaacttcggatggccagggaggaggatgggaagaacctaggtcctgcatgacaacattggacagtcaaaccaacattagaactgcccacatttggacttatggctaagtaaacagctggtgtctttcaatttaagtgtgtgttggtaaggttttctgcatcttacagcaaaatacatcccacctgttaacaaaaagtatgagggattccagccaaaatcgggctttaaaaaatcagcaagcatttgtgagcactttcatttcactaatatctgaacgatagttcaaagatactataatattaattgagtaattactgtgtatattttttaggctctggggataaaacaataagcaattagccaaaagagcttgtattctagcaggagagacagatattaagcaaccaattacatgtttatattataaaataatggttatgcttaaaactaataaggaaaaatcaggaattagaaagggtatatagtaattatataaataataaaatattacaaaatatataactaaataactgaatgaaattacaaaaacaaacactttccaagtaaatgagaatgaaatgtatagtttttactgacattcccagaggtcgagagaaacagtaaattggagtaggttagtccaggagagttgtctgaagcaaattaatattgtatcaggttttgaaggaagtggcgaaaggacaggctagatggggcagaagagagcactctagatgtaaggaaccagaagagcaaaggaagaaagcaggaatgaagtaagagtgaatgagggaaataccagaatcacttgattttttaaattccctgtagcaacagcattctaggggcatctctcagagaaaaagacagaaagatgccagaagtctcaaagcaagattatttaaaggtataaaaataatataggagaaaaatacagaagacaaagtaggagtacaagagtgcatttgaaattaaggcgtcattcaaaataatgaataatttataatgtgggcgtcaaaagagttgtcataagaagtaattatggatttaagggcatcaagaaggagggattcaaactttcacaaatagaaatagaaggaaacatgaggagtggcaaaaaatgaagacaggtagaaaaacagtttttgcttgttatttttccatgatagctgttattgacatgcattatgtagaaatgaatggaatttgtttgaaaagaaaaatttcaatagagcagtaatacataaaggtaggctttttggtaaatagtgtaatttaaaatgttttcactagaatgcctttttgtaccttcctgtaggaaaatcttttcaacaaaaaaagctgtaagtcataataagttacagattagcaaagcatttttgaaataaaaaaaaacccatagatgtgccaaatgtaatagtagagcaacaataataaatatttgtaataaaaatcagaacttgttaggcattatgtggtttctggtcaaatatggttgtactaatttttctaatgctattttctgtacaaatataagaattttttaaattaagctatggtaggtatatgaacacatcttgatattactggaggtaggatttaccactcactttttgtgaccccaagtgtaaccctgaacagacttctgtcttaacaccaataacacatgattgcactgtcttctccagtgactggggaaagggacagtgctttgttcatttttgctttaccagcattcagcacatcgcctaaaaacaattgtgggaattcataaaatgtttgtaaataaatgagcaattgagtggactataatgttgcttctaaaaaccctgggttttgaacacagagaagatgagaataaaaggaaaggaataaggattttccccaaatcaaggtgaggttgatgtaaatgtcctccaaagttggtctaatctccaaagaagcttgtatctcaaaaacagtaagtctccaacaggcaaagtcaatggcagtttgtagacctggaatttaggagtgccaggaaagatctgaaaaatcatgtcttctatcaactgactgttgtctgaaattctgcacttaggttttagtcttttgatgtaaaagttatttttttccaattaaaatgtaagtaggagatatacagttaaattgtaccatcagtctgtcaacttcggggcatgcaactatgcttacctggatgaaaaagaaaatgaagaaagtaaaatagaagaacgtagtttaaattgggggataagtcatggcatgagtatgtgcccagagcgagtataagaaggccatggaaatccactgtatttttgtcatacacttattaatttgtttcaataaggttaatcactccacatggtgtaacaagaaaaataacagcctttacaattactagattcttaaacttatttcaaatactttttaatttttatgagattataagaattttttaaactttgaagctgcatgccttgtctgattccttccatttctcttctgcttctcacattattgtgttcagcaatggtttggaggcatcttggggaagacagagcagagttatggtgtaaggaccatccaactcttctcagcagccatccagttatcttgtcaagggaagttactcatcctgctctctagaattatctcctcaaaaatcggtttcctgcttttcacagaacagtacaccatcttttactattatcctaattaatgcttctcacacagccttacaaaatattagtcacttaattattaaccacattcattgggctgcactagttgaaaaagatgtcttgtttacttagtcaaagcgctgtctctgtgcaatggcattgatggtgaaattgatcagagtctacgtttgaatgagagaagctgagggagacatttcagaaatagtaagcctttttatttccttggtgtaccaggtagtcaaggaaagttaaagtatttttttatactttgtcttgattacattcttttggggactggtctctggtgttaggtttttaataaagattttggccattttccatgcaaactaatgtttccaatgaaaagatacaacattgcatgtaaattacctaagaaatattaatctgtcaatgtaattaaattatataagcaacaattagtttcaaagctggaatggattaagtcagttctatactgcacactgacaaagtgaaaggaactaaaatggacaaattgtggtgctgtaaggttatgattcttaagatttttatattaaagttgcagagtttcaaagtgctcagtgctgctctttacattagggctgtagactctcttaagcccgaggattctatctggatatgtgattgatagggtggaggctgggctgaggcttagtaagacatttaaccatgctttgtataatactccttaaatgttggctctcacaaacatagaaatagcgaacattaactagctctctgtttcaatgtctaccatctacctgtcaacttaaaatcatgaaatctataaatttggagaggagagctttatttcttaccaagagttgcagccagcagggtggccatcctaactggctgggaagtgtaacctcaggcagagaccaaaagcaagttattcaagggaggatgagataggaatttatgctgaatggattggccaagtatatttatttaacagattgtaggaggagctatacatatccatgaagagggggcatgtgcatgaatagtaagcaaacatggatgttacatgcatcccttgttcactttggggtgcagacttcacatttaaatgcattccaattaagccctatatgtcaaaaggtgaagcagggacaggaaggcactcagtgctcagcctctgtaaaccagacagaaccagaagatggtcagtggtctcttatcaggagaaagttactgaaatcagtcttttatccaatcaaagctgtagctgtggcttgtggaacagaggggtcagttagtcagcatctggtgctcagtgagctacgattgtttcaatactgcttatcttgaggccagtgcttgtttagctgctagagaataagaaaaacctgtggcaattagagcatagtttattctataagggtaggggtacgtgacttcagctttttctggcatggccttaggtctcatttattatttggtactttattgccacaaggagtctgttccattagtcttatgatctctattttaacatatctattttgtttttttcctccacttgattccagaaggactaaagtacatttcataaatacatacaagataaataaaaataagaaaaccttcaataaaaatgatctatattaatacatttccagttttagggtcaaatagattgtttcaagaaaccttaacattatctattcaaaataagttttttcagaaactgtgttgcacattggtgtacatctctttaaatagatttcaccttggcattcacactttgtctggctctgtgtgtgttagggttggggtagggggagcattgttaatgcccaaatccttcccaagtctcatcagtgaatagtctgggggaaggagggttgggaatgtgtatattgaacaaaatcctctaaatgattctgacttgcctctgggttgaaaatcaatttaacaatactatgtgttttctgaagtaaaagtcacacttaaagtaactggtgatcttggaaatttttaccaaggatactgactaatgagatggcctaccccaaatccagaatttaacttaaattccacctccccctgttttccttaaactaatctctcaccatattttccaaaaatgttatacttttcttctcatatgtactgcaatttgtcttgcattgtatttatctttgtgatttcagctagtatatggactcatggatgtctgatggggaggagggtggagaatctataagttttttcatctttctaatctttattatgctttagtcaatagtatatattcaataaatgctgaatgaattggattaaatataaaacattaaatgttatgaaaagtatgcttaattttcaaattatcaaatgattctctctattgaagggaaatcaatggtgtttttcaactttgaactgaaactctaaactatatgaaatcataacaatgtgaaattttaaacagtattattcttcataaaacagtaatataggctttaattcacaagaactgcaatggggtctcatcctttaagcagtcatttttaatgttctaaccaaatccttatactaaaacagaaacaactgctgaatgtgataaagtaatggaaaatatagaaaaactcccattttctctatctcattgtgtgtgaaatcattcttaaaaagaatcacttccacttctatttgaatcaaaaatagccaatagggcaattctaactggttaaaaaaaaaaaaaaaaccaacgagaataaaacaaatcaccaaggcaaacgagttttaaaagatatgagtcatcaaggttaaaaaaaattagaaaaatatataaaaacttacacatgtccttgatatagttttgtcttgtgtccccttaaaatttcagtagcttttcttgttgcttagaaatcaaggacatctgattggcaggactttgacaagctgcctaaaggaaactatgatgttttcagtccccatattaaagacccccttttacattccagctgagggctggtataggcaggataggaaagcttacagatggtgggaggcacagaaccttcataggggctgaggcaagaatatccagaagacaggagagagaatgaaagatgccagccgcctcattgtgagttcacagtggctgccttggtcgggagcttttggcatggttctcatgaattacacaatctaatctacttctgtacagaagattttagaggcacagttgagtgtgctaaaatggcattactacctactcagaacatgatgcttctgtgtgcccatatgcccaacttattttcaaatgtatttgagaaaaatagaaaataggcattcttagtactagagacatacaataaaaatgcgcatgactctatccatttgtaggtttcttgggagttttatcaggctccaggggacccatgtttgtagcacatgagttctctggtcgtagatcgttgatgtggtcattggcacacggtgcctagctcatgagccagtaagatttgtttcctcctaggaatttagaactggagtccagagggtggggctgggcatttgaactaggaagtaaggaaagccacactgggaaagcctttgatgggctgtgtgtacaactcagcggaaatgccaatatacagagaaatgtcaaagaataaagtcgattcttagagaagtagtgatggctcacttagttcctgagagctttcctactcatgaggagatccaattgcattttctaccattggcattgagatccccgcctctaccccaacattacactaaattttcctttaagttagtatcagtggttttctggttttctattacaaccagaaggttcctgaaaaagacaaaattatcctgttagatcatgttctcttatatctctgttagaagtacattggaaatgaacagcattctattgtcagtttgtcagcattaattataaagtatggcccaataatttttcagaacctaattgcatatagctgatgacagtggcttctggagctgttttatgatagtgttagttagagagtcctgccagattccctggaggagatagtttgtcctttctgtaatgttggaaataatgtctctcgtgcaggtttaataacaagatgcagtgcaaaagctccaggcactagccaggtcatgtgacatgaggcttgggatcagcttatctcacaaacccagacatagaaccccgtgccagccccacaacaagtggacaatccaggaggatttgagtatttcctcagctattcaacaaatacagagaggtggtttgcttcaataacaataaatagttatttattgttgtccttatgcaacaacaattctccagttgtcatctggagaaactgaaaagtaatatgaaatcatctagttcctctttaagacagtacttgggatcctgtgaatgcaaggatttccttattgtcctacctgcagggaggggcattcagggcttctggatcatagcctcggtcacattttaaaacttgacataatgtctaaaatagctgtatttatattttaaattaacttgaaaatgaaactgctagaccatataatttacctactaaatttggacacttttgagagtaaaacgggatgctattaataataaaatgaaagcaggccttggaactgacccaggcaaactggatgatagtattaccctattcttaggttttgcattcttggtttgtgagtaactcacatattgggaagcccaacaatttttggcacggtttttgaccaaatcaaattttagccgccattttggagtatggcccacgatcccaccacgagtcactagctatagaaatgagcttctctagggcttcagcttcttcacctttacaattgaatgggtaactccaaatccctttcagcactgaatagtccgtaatcaatgacacatctatgaaagagttttactttttggagaaatttgtattattttgattcatattcaatataagatacagaatatgaatatccataaaagaatattatgaataaggtttgtacacattataaaatcatactgggcagcatggcgtagcaacaaacacctggactggaatctagccacttatttcctctgtgaatttgccgaggtttccaaaccatcctggatgcctaaactggaatactttcaactgtaaaatgggcgtaagaataacaactttttagtaatgttatgagaattaagtgatatgtagtgtgtgaaggtatcaaatatataccacataaatagatgtatatgatcattaaatactagttcctcttcctattagaaggttagtgtcattattgaatatttaggtcataaatgtgcactgcaccttcttataactaaagtaagaatattgccaatgagtttctctattcccaatattggcttttattgacacagagagcaattacgtcggatggaagcacatccatgattacaggcatcatcaaagtcaaacacacctggacccaaaagccctctttcttcttttagatatatgacattgggaggttacttaggcttacagagtctctcttcccttatctgcaacaatgaatgagataatgtgtatagatcacgtggcacaggtcctagtgtatattcaataatatgcattattgttactcattattgttaatatgggagaagagaaattaaaagtctccatttaaaggtgagagagatgtttccataagaagagcttatagtgcatgtggacttcagaagtgactataagtgaagaataatagttgagaaagcaaacccatgagcatgtcgtgggtttagcattatgctaaacagcagcattgtgctattcccactgagaataatgtctttcatggacattgtggaacgattatggactggtcatgatactatgactcctgagaattctaacaccttcagattcacagtagggctgcagatgtgttttacccatccagggctcctgacagtgaaatcaaaggcttggattgataaactctgcgaacaatgtgtattagtccgttttcacactggtgataaagacatacccaaaactgggcaatttacaaaggagagaagtttaatggacccactgttccacttggctggggaggcctcacaattatggtggaaggtgaaaggcacgtctcacaggtggcagatgagaaaagtgagagccaagtaaaaggggtttcctcttataaaaccattaggtctcatgagacttattcactaccacgagaacagtatgggggaaaccacccccatgattcaattatctctcactgtgtccctcccacaacatgagggaattgtgggaactataattcgagatgagatttgggcggggacacagccaaatcatatcacaatgttaagttgctcttaatcgttttattgatgaagtacaacaggttgattagtaatacaacagttttatctgagcctcacttatctgttttgtaaatgttattttggagaaagccactcctacaatttgtttataagaagtctagcatggagtattggtgatcacatttagagaattataactgtgatattaatgaagactgacaatgtggatgatgacgatccaattcatgtgcatcagaaaaaaaaaaatcacaacttgatttttctacctgctttgtttcaattaatcctaatttttagaaaacagacaaatgcaagacccagacaagggtctttgcttagtaaagatttggaattttctcatgccaagagatccttttctgaggccttttccaattgaatccaaagtttgccatccaattcttccagaggagaggggtctagatttagtagagtattattattattattattttgccaacttctagtctctccttcatgtatttgacagctccttaaagtttctggctatagcccagccctccagctccctgactgagatgggacctatcggaagcatgttggtgttaaaatcccaacttgcctccattcctcaagccctggacttaaattggggtcctctggccctgtggatagccttaacctcactacctaatttccactccaggtttgaatttcttctctgtttctgtatctagtgagttcccattctatcttccaatcccggctttaatgtaattatatttgctatatgttgttcaataattacaagtgtttggaatggggccaagggccctttctcagcagtttagtctccagattttggtataagtgaagattagacttctcctgatcttcacatctttcagaatgccatttctaatttttttcatgaacagaattaacagaggaaaccagagccagtatctaaaatctcaaagtccatcactatatagcagcgccaggatctaaaaatctcagagtccattatatattgtgatatagtccatcacaatattttgggaaaacaaaataaaacagtctcctaccctaaaatacttagtatcttgaattaaaaccaccaaccttaaaccctgatggcagtgaaactgcgaattttaaactttgccaaggagctggggttatttgttttactgggaataatcacaacgggtcaggtagtatttgtggagggttcacttttgagtaggagtacgggggtcaccacaagaagttctgtccacatcaactcaacccttgaaggacatggagcatgcatcaggatgcagatgtatgcttgcctttatggtgtgcaagttcctatcagtgagccacactgttctcagatcctcagtgtccacagtgttttagcacgttttttatttggtaccctgaactataggactgggtaccttcacggtagcttcagtcaagatgtgattggtgtagaggcattcactgacctgtgtagggttttcctggatttgttttcctttgcagttttggatggctggttctcttgggatcagtgatgacaccaggcagtcagagtaaggctgtgctctggcagggactgatgaggcctggaggagcagggatgtgcacgactcacaatatcttttttctttttcctttttggcatttaaaaagcatcagattacattgtgaataaatccatattggaaggttatttaagtcattaagcaccagtctgccaaccacataagctgtatagtagcctctagcaggctgcttaaaggaaagcggcctgaagattgatccaggatgccaggacttgcatcctaaaagtcaggctctttgtattcttctgcctttactactgagggaaaggagtaggggaaaccaaggtagagtttcacgaacctccactttccccctcacatcagctctcagcaccaaagaggcaagttaggaaacaacacaagtgtccatcaacagactaaatggatgaacagaatgtactatatccacatagccgagtttcagccctagagaggaaggcaattctgacacatgctacaacatggatgaaccttgaggacattatgctatggtgaaataaactcatcacaaacaaacaaatactgtatgattccacttatataaaatatctagaacaggcaaattcataaatatagaaagtagaagacaccaggggctagggggagaagggaatgcggaattgttgttgaatgggtataaggattctgcttgagttgatgaaaaagatcaggagagggatgatggtgatggttgcacagcattgtgaatgtatttaatgctgctgaacttaaagccacttaaagtggcttctgtctgtaaaaccacagttcttaaaaaggcaagttgaggggattaccacttctggaaagatggagtggattcacttttctctatttctcactgagcacagctaaaacccctggacatgcatgatatgtagaacaaacagaagagtctaaaaggtggagaaaagaaaacaaagcctccagggaccttgagatccaataaatgacacaaatgtgagtttcctcggttttctttttgcttcatataacccagactgcgtgctgcagaagtctcccgcttggaaacacaccaataattgcaggcaaaaaaaaaaaaaaggccctgagtaaaaggcttgacattgaaggtgctggtttcttatttgttgagggaggggaggaggtggagctacaatagggtgactcgatctctaggcctagggagtagcccccagatcactgtggatgcaaacttgctggaaggatctcaaagacacccattgactcccctaaatttttcctttattcagattatgtaaaacttttgttttactctattcaggttaaat

SEQ ID NO: 164 - DNA, 1409 bp, Homo Sapiens
agatctgtatcagaggcacgggcctggcagccttcactgcacttgggctctgaaagacgttctcactcttgcaagtcacctgggaaagccagaatcgatactgtatggtttaacatttgaaactgacttgcaggtaatggcttctgcatttccagaaggcacccgtgtgcctgtagggatctcattttaaggatcactgctttttgtttctcatctacaggctacagagacccatctctcagtttggattttgattaaacagttatgcagagtagaaaacttgggccatacacaaaacttaattaaaataagcctccacttgggattaatgtatgttattgactgaatcgtgtccctccccgctcccccctctcctgccatattcatatgttcaagtcctaacctccaatgtggctgtatttggagatagtgcccttagggagataattaagattaaatgaggttctaagggtagggctctaatccaataggacaccagagagcttgtgctgggaatctctctctctctctctctctctctctctctctctctctctctctctctgtctctctctctctctgttgcctccctgtacaaggccatgtgaggacacagtgagaaggcagctatctgcaagcccggaagagaagcctcaccagaaaccaacacgattgcaccttgatctcagactttcaggctccagaactgtgagaaaattaatttctggtgtcgaaaccacccagtctgtggtatttttttatggcagtcccagcagatacaatgtgactgtttactttcttctctactacaggcaagctgcaaagtgctgctaagtaatatcacacagccactgctgattgtgtgagttgagttggggagaggttgttactatgagacctattccagagcagaaacaggaagattgtgaatctcatcctcgtcacttgcccatggcctgcagcatccagacccctcgaggtcctctcctatcttcttgccaaagcttactttcagggaggacttggaaattcattccctctaggtggtaaataatgtaacagcataaagtgttatgtcacctagggacatgtaaattgagccgagagccaagtgttaagctaaagggatgacaatctaacagggaaatatcatctagcatctacctgtccaacaatatgaatctactgcgagctcaggaacatccccagtatcagatgtaaagctctggggataagagggcaaagaaggcaattacctgaattgtggagctcacatgtgttgagagaaacagacaaataagcagattacgatacagtgtgataaaggctgtaaatgtgaatgaagtgctataggaacatagagcttcaggctcaggccaaataggcaggggggcatgtgtgtgtgtaga

SEQ ID NO: 165 - DNA, 3414 bp, Homo Sapiens
acctgggaggcagaggttgtagtgagccaagatcgtgcaactgcatgcctgggtgacagagcaagactctgtctcaaaaaaaaaaaaaaaaagaaaaagaaaaggaagggagctggcatgtacagagctcacatggtgacagagctgaagcaagagagaggagaaggtgccaggctcttttcaacaaccagttctcacaggaacaaagggttagagaactcatttacttccatgagaatggtaccaagccatccatgagggatttacctccacaatccacacacttgccatcaggccccacctccaatgttagaaatcaaatttcaacatgagacttcgtggggataaacaaaccacagcagtccctgaaaactacatatgcttttttcgctccgtttgttattgggttctgccctgagctcagtggcctagttggaaaatgaagactaaatttaaaactaactgataaataaaattggtttccttgtaaaatcttatggtaaattcttatgatttatttttattcctatgattttaccttgatacccatttttaatcttcctttaatatacccaaacttctttaaagagcttaaattctctctgtgttttaatatgtaaatttgctaccttgtttactccaaaatgtgataagggcttctagccatgtggaacaaactttaacccattccatttacagaggcaaaatttaactatccttttaaactagtgagttttacctgtttcacggctaaaatttttaaacgaaagctacaaaatctatatttgtgtatttttctgtgcacatatgtacatgtctgtgtttgcatattgtgtacatggtaccagattgacataaattaataagtactcataacgtaagtatgtccaaatactttcaagttagtgtgattttagaaatctttaataaataaagctagtttaaaaattattagtaaaataaaataaaaacatcttcaaaatttaattcagacatgtttgcctgggtctgttggtcagactggtttatattgtctctagttgatgttttagggtcataaaactcttatttctgtaatattaatactagcttaatttgtctctgaacttatgtcttggttttgagtgtttagattctggagtctagacaagtggccatgatgaggactggggacacatgtgtgttcacagtgcctgggccctattctccctggtccagctgtttccaggctatgctaataggggtcagatcctccagatactgtcttcacagtcctgttctctgtacttggctctgcacctgacacataacaatcacagttacttacttcccaggttttccattaaaaatcagggttattaagagctaaaattgtaattaatatattattgaaactactaaatattttaaaattctatacacaaagtatagatataagaaaagtaatgtctttttaataaaacattacaaaaagacatcaacatatggattttgttaaaaagaaagtaattttttctagtgtaaaggttttcaaaaagttgttttaaatttaaaatacagttgaaatgaaataaaatattttataaaatcttatttacagaatcttattttgtgttgccaaaactaaaattagatgtttataaagttttcttaaaattaactttaatattaaggatacataaaaaggataaaatttgttcttttcaacaaaatttttatgtcatattaataatagataataaaatatttttgttcaccttttaaataaactacaacccctcccccaccccaaaactaggagcacattttcttattctgtctttatgaaatcttttaattatttggaaaactgccccatcaaaggagtaaaggttttgctttgcaaatctttaaggttggtatggtggatcccacctaatgccagcactttgggaggccgaggcaggtggattgcttgaggccaggagtttgagaccagcctgggcaacatggagaggccctgtctctataaaaaatacaaaaattagccaggtgtggtggcatgtacctgtagtcccagctgtttgggaggctgaggtgcagtgagccatgatcatgccactgcactcagctgggcaatagagtgagactctgtctcataaaaacaacaacaacaaaaagtttaaaagaattgatcaagataggatcaacataactgtaaaatagtagtcatttagccaaagcaataatttaaaaatttattttctttcttttttctttgagtcagagtcttgctctgtcacccaggctggagtgcacccaggcatgatcacagctcactgcagcctggatctccttgggctcaagtgattctccagcctcagcctcctgagtagctgggtctacaagtgtggaccacgatacctggctaatttttgtattttttgtagagacagagttttgccacattgcacaggctggtttcaaacaccaaatctgcctggttggtctcccaaagtggtgggattacagacatgagccaccgtgcctggccaaacctttcttttttaatatcaagtgtttcaaaccattgatatttgacaaacttcccaaaattaattctaacatgtccttttgaactcaagttaacttttagacattccaaaaaaaaaaaaaaaagcccctggaagtccaacagagacatgttagtcttatttggtatgtaaaagtcatacaggaagtattgttaataagaaatagtgtttaacaatctctgagttatagttgtataaatgtgttaatatgtgttccaaaattgtgttagattccaaaaattttgatatgtcttgttatatgttatcagtcatagttatgattatcctgttaaattgttgtttgctacagaaataacaaatttccttgtcaattgtatctttaatgatggctattctaaattttggttattcacaactattgtttcactctgtttcttcacaaaaatgcagtttataatcagctactattcaaacattgtgcttcttcaagtaaattcatggataggaaagtgacagatactctgaaataatgacctctgcttatgactgtgagatcatataattggatcgggtaaaaattctaaaaccttcaaagagaaaaactggactcataaaatgctaacctaacatcaagcagaagaactaattacatgaaactgaactaatgcaaggcaaatgattttaaagttttcactttaaaacattactggttcttgccaggtacagtggctcacgcctataatcccagcactttgggaggccaaggcaggcagatcacctgaggtcaggagtttgagaccagcctgaccaacatggagaaaccctgtctctgctaaaaatacaaacttagccaagtgtggtggtgcatgcctgttatccc

SEQ ID NO: 166 - DNA, 1249 bp, Homo Sapiens
cttctgccccagagaggacaaatatgaatacccagacaacagtctcatctgtctttttgctatatgtgagtcaaggcaacaggaaaacactgtggggcatcgagctgtggtgggtgcaagggcttcttcagatgcagcatatgcaagagtaacgtttattcttgcaggttccgtcggcaatgttttgttgacaaggccaaaagaaatcaatgtagatacagtcaattaagaaagtgttttagagcaggaatggaaaaagaagttgtgcataatgaatgcaatagaacaagcaccagaagaagcacatgtgatggcagcaatatcccctccattaacacactggcacaagctgaagttctgtcttgccagatctcagtctcaagccttggggcaagtactgatatacatgttaaaaaaaataaaataaaagtgttggtgatgtctgtgaatttctgaaacagcagctcttagtcttggtggaatgggctaaatatattcctgccttctgtcagttaccattggatgacaaggtggcgctgttgagatatcatgcaggagaacacttaactgcctggagctataaagagatccatgatgtataaagatattttgcttttgggaaacaactatattattcactgcaacagctgtgaatttgagattagcagtgtaatcagtcgggttctagttgagctggttcaaccatttcaagaaatccaaaaggcaattgtattttttggcccagatgtgaaagggctacacttaaatgggctacatagatccaataaacattaagaacatgcaattccaagggcggatgggtttggagaactccgtcaatgatccgcacgcagtatggctccctgggggaggtttggagagttgcttctgctgctgcccacactgctgcgcatcatttggcaaatgattgagcaaatatagtttgtttaaaaaacttttgcggttgacttaaattggccacctacttcaggaaatgttaaatggggcttccaatgatagtagtcatctccatcatccaatacatccacattcatctcaagatccattaactggacaaactgtacttttaggtcccatgtacacactggttcttatgaagaccacatctgaactcctgaaaccccactcccttccccaccacaaggctttgcacaagaagattacagaacagctacaaatcaagcttcagtcatttcaccagcctctcttcaaacaaaaacaattgtga

SEQ ID NO: 167 - DNA, 1283 bp, Homo Sapiens
cttgagcttcaccacttgctccacattctccaccaactaccgatccctgggccctgcccaggcgcccagctacggcaccggccggtcagcagtgtggccagcgtctatgcaggcactgggaactctggttccaggatctccgtgtcctgctccacgagcttccggggcagcatggagtccggaggcctggccgcggggatgactggggtctggcaggaatgggaggcatccagaacgaggagaccatgcaaagcctgaacgactgctggcctcctacccggacagagtgaggcacctggagaccaagaaccggaagctggagagcaaaatctgggagcacctggagaagaagggaccccaggtcagagactggagccattacttcaagaccatcaggaaccagagggctcagagcttggcaattactgtagacaatgcctgcattgttctgcagatcaacaacacccatcttgctgctgatgactttagagtcaagtatgagacagagctggccatgtgccagtctgtggagagcaacatccatggactctgtaaggtcaatgatgacaccaacgtcactcggctgcagctggagacagagatcaaggctctcaaggaggagctgctcttcatgaagaagaaccacgaagaggaagtaaaaggcctacaagcccagattgctagctctgggttgaccatggaggtagatccccaaatctcagcacctcgccaagatcatggcagccatccgggcccaatatgacgagctggcttggaagaacggagaggagctggacaagtacttgtctcagcagattgaggagagcaccacagtggtcaccacgcagtctgccaaggctggagctgctgagatgacgctcacagagctgagatgtacagtccagtccttggagatcaacctgaactccatgagaaatctgaaagccagtttggagaacagcgtgagggaggtgaaggcctgctacaccttgcagatggagcagctcaacgggatcctgctgcacctggggtcagagctggcacagacccaggcaaagggacagtgccaggcccaggagtatgaggccctgctgaacatcaaggtcaagctggaggctgagatcgccacctactgccacctgctggaagatggcaaggacttcaatcttggagatgccctggacagcagcaactccatgcaaaccattccaaagaccaccacccaccagagagtggatggcaaagtggtgtctgagaccaacgacaccaaagttctgagacat

SEQ ID NO: 168 - DNA, 2710 bp, Homo Sapiens
gcagtctttccgggcaggaccccgcacccaaaggctcacctgtgggaccgcgttgtcagtctcggcgcctgcgctccgctccaggaagaaagcgccaaggcgaggcatggcggtctccgtgcgcaccggcagcttctcgtgggacatcaggatgtcgtccaaagaaagaaagttctcctcaggccccagcgcacccgactccactcggaaataagcctctgacatggcggccacttgagcttctccgcttccactcgcgtgattcggaggagcctcaggagttaggggtgtacaagacggggaagcggagactgggcaggatggttggggtcaggaaagtggattgaaactcgtttcccgcgcccggggacgcatcagacaggagcagtcaattcgggcggtaccgcccaggcagaagcaatcgatcaagtctgcagatttagagcagcgggacacggctggggagcggtaggtgggggcgccggaagttctcttccctccgcttgctgcacggtgtgggaacgttacgaagaagctggaacgctcgttgaagctcctggacccatttgtactggattgtgttcatgtgatccttaactatttatatgaaattaaaaacactttgcaacacttttaggggtttaaaataaaagcatcttgtgcccttcactccaggcctaagtccgaccctttcctacagtttttttcactatgcaactccgttaatcttagtatttgaaagaaatgttaaacaaacaaaaacttccagcactatccccagcgagttattatggtctagatgatgaactagtgtgttgtattttgttagtattttggtgggggttggacggggtgggtagaggggtggagcactagactgcacatggcttgctaaggttgtgagtatacttcagggtgtcttagctcatcatcaactgacaatctccttttgtggctctgaatttaaatccctaaaaatggaaatccaattggtccagtttattgattggtccaggtacgccacaatggtcatagatctccagccaccctgtagatgggggtgcctgtgttgggtgcgatcactatccagtgaccaggggaaggaccatggtcgcatagtaccaggtttggtggctctcctcagccagggctatgggtggcggcatattgttgagagatgcactacagaacttacttcgtctagagcatttctggggctactggagccgggagtaaagggtgtgtgtgaagggaggtgtgtattaaccatggattttagtttctgttttctgtattttatgatgctttgacatcttggggccttggggacctggggaggaattgcccctttcagagttagctaattcctagagatagcaaacaacttgcttgtgaacacccctttcatttacaaaccaaccaacccaagcctatatccccacaccatctttatccatctcacacaccaatattttccctgccccaagtcactgtaataaaccaccccatggccaagtaccagacaactaaaattcacctctatatcccagagcttgccaacattattcaaattattcaatcctaagcttgttcagacttcccttccctgcttcgcccattccttcccacggcaataaaggctctgggctttctcctcgctctctctacctcctcattgaccctaatactttctcgtgtggccgtaggcacagccccttctcttgagaactataataaaattttcaaaggcattggccactaactcattgattgtcatcacccagtcacctttataaatgaaattctgaggacaatgaaaacaaggtgcagtggggtggaaaggaatggccaaactgtggaaaatcttggtaccattctaaggagttaggccattccatagaaaatgggaggaaaatgtaaggcaaataataacataaatctgggcttcaggaagagaattccagcagtagataaagaagagagagattagatgcttggaagctgttcagtgggcagtatttggcaaccaattggatataggaagtgaagtatagtgagtagtcaaaagattcaagttttgaacgtggctgaccaggtggatggacatgtcatgaatagatacacagaacacaggaataggggcagctggagggaagggatgagttcagtttgggacacatggtgtccaagagctactagacaggaaggtctgcagcccagtggagaaagcagcctagaagctttagagaggaggcacactgagaggcagttatatgaaggttttttcctttttcatattttaaatgttcagtttgtgatacagtccaatgtaaaaataaacacaatctgcagtgataatttagaatttctctgatgacatggaatatatggtactggatgtagtttgagacagaaatataatttggctaattgaaggcaatgttatttactgccaaggagagtaagctattttttatgctgatataattaagatagatgcatactgatttattgatgccaaagaaaggcattatttttgtacagagaccacaatactggctccaaactcaaataccactattattttaataatacagtaacaggccaatgtttaacataaaatcagattgccttgtttgtcttacttaatgtcttggctcatcatgaaactatcattgtgtatatattgttctatttaaactgtcctctc

SEQ ID NO: 169 - DNA, 3943 bp, Homo Sapiens
ataaaattaatgtttcagtttatttttcagattacatgcctttctttataagggatgctggcacagaccccctaaaataagcttttggtagtactgtacctttgaagagtggtgaaggatgctaatggataatctcctgaaagttgtggcttttgatacccttactgtggactgtagagttgctaaacgttgtttagcaaataatgttgcttagtttcaaatgacatttgactttcatcactaaaacagcaatgtactcagggttgtaagcttactcaaatagactttcaataagtcttcaatgtatatatgatagtttttagcctaatgtgaatttaaataatcttaatagtttcctaaaagtcgatctgaaacttggggtgggaaaggggaggtagcaatttttgaagtattttagccatttttttcatttaaagaaaccacttgtccccatttcctcttctccactttctcataattttgttttaagaggaacactggttgttttttatacttctcctaatctttaaaaactgcatattgttaagaccccagtgtatttaataggtattttataagcatagcccattggctcatgttagtgaaaccataatcctctttgcttagaacattaaactcataagaagtactacaaaccccaccactctttatagatgtattgtaccactaatataaacagctaaaaaatggggaaattgtaatgttacgcctgtgcaatttttaagtggcatattatggcagattaaaatttagatacttggcttttcttgggcaagccactaagttgtggcggaatgttttctggtgttcttggactgcaattatgcactattaaagtagtggcctgctacataactgcatttagccagcatttctgcagtgcgtaactgtgaggaacgtagtaccgcaaatggcaatggacattaggacccggatgtagtattcctgcttgctccaagattctcattgccgactgcatacaggtaggtaacaagcaatataatctaacttggtgacttgtatgtacttttattccgtgggcattctggcatcacatttctgacaatgaaattacagtgcagcacctaacacttgtatggtaaagcttttttaaaaacatgggcttcatgaaaacaccattgttactaacttgggcttagatgggaatctaatgtgaatagttcaagttatgggacttgtctaaatgtgtctatactctaaacctgggggaaggtggtgtggaacattgacttgactacagtcgaatacatgttgggaatcattcccaatcataagacatcgtcgtttctgtaggatgactgcatatgttcagagtagctttttgaatttggttcccttagctttagggatgtgatgttatagtccaaaatgtttacaagaaaacctaagtcttcaaaagcacaacttttgttgcttaggactttgcatcaactgttgttccagacctcacttcaacttcttggtctctgaactggttttagctagcatgcatgagagacagttttcatgtataatgtttctgctctgtaactggaaagtggtttactttgcataaatgctgatgaaaacttcatgactatgagacttttcttctgtgtatcaagaaaaagcttgctcgttggcaagcaattcacaaggtggggacagacttgtactttaacatgtagtccattcaagcaaacaactttggactctactgatagatgaaagagcaaatgatgactagtttagcctctgcatatcaacaatataatgcagatcaagtataatgctcaatattagtgacatgagtatcactaaattacatagaaccctgatggggtttcctgtgtcgtaatccattaaatcggtggccagtgcttgctgccgtggtttagtgattgggtgttagaaataaaaactcaggtctatttcttaccagtcagtaacaatttttagagaatgtacttggtatataatatatggacttcaggaactttattggggtggggggttaattttgccttaccctgttcactttcagatgattaggcttttgcactttagaatgagaaacttgtgacgttagtgtgttcttactagctttaatttgtatgtagcaatgaattgtgaatcttagtgcagtgggtttttttaaaaaactcaaaaagctgggaattaagtggtttcagtaataatgctataccgaggtgcttgcattgtatttcataattttgttacaaaccaaaattatttttaatgagaacagtcttgggttcagaggtgtgatgccagaatgtattttcgtactgttaggcccttggaacagataccggtgctttctgaaagatgaaagaaatgcaatgggtgctcttcatgcaaggttgcaaacctaccaagaatgcataatagtctcacttttccccaataaagagatgcgtgtgactagttttggacttttaaccttaatgggggttgcatgtctcctattgttaatcattgtcagctgcagtgacatgatccacagtcctgcatttactgcctttcacttaatgattttggacaggttttagagagccaggatgttggtctgggcctttatttggttttggctttagctgataatgttttagtgatgtcagctagtgcagttctcaaatggctgcctattagggaaagaattcagaggatttgactgctcctaatcatctgtcattgctgctagataatgattggcaatttttaagactcaactggaaatctcaacagttgctggtaaaccattaaccataaaaacgttgcttttgaacaccagtgctgaaaaaaatatttttttttttttttttgagagtgaaaagggcttggacttaagataggacaatgtggagaatggggggaagaatgcaaaacgatatagtatcccttatggatggtacatgtgcaacagggaactcttacttcatataccctttgcagtaatcattcagggaggaagaaaaacctggaacttgaatgaaggctgatctttgttttgtgcactgtggccctgccaggcatatagtgaaggtgaatgtcttctccctcagaaaaaaattggttccttgctgtcccagtaaggcatagcttttccagccctaactttaaaactcagtgaggacttagatgggaaagaatgaggtaaatacaaaggattgcaggacaacaactacagcgttgtgtactgtgggaaggggagttgggcactcttggaggactcctgctgaaggtggtcagcctgcctgacaatggaagacatacttgaatggggagcagggtatgtgctttcatatgaaaaaagagctgatgttaaaactcatttggtgaggtcaacgttgtcacataccttcacataagggatagtatattttgggttgcagtcaaacttgtgctcagactggtgaaactgagagtcaggcttttacattttaaagaaaatacagttttcattctaattcaggtgtctacttattttatgtaagaataattttagatttcccccccaccatgaagtttcttcctatttttttatgctgtaacttacccccaatctttatctctggatttttactctttaaattttgaagttgactagcattttcaaacctttattttatacccttgtcttttatattaactttttcttattattctttaggtaagaatgattgatgttggctgatattggagtgctcattcacatgaaaggtggatagatacttctcaagacatcacacagcgtgagtcaatcaaggagggaagccacaagcagactgacaacgtttctagagcaggatcaggtgagctgtgtccagaaaaccaacgagaaggagtggaaggaggaatgaacgtttcattctcgttaataaaggcattatcctaatta

SEQ ID NO: 170 - DNA, 2218 bp, Homo Sapiens
cagggtttcaccatgttgcctaagctagccccgaactcctggactcaaccaatccacctgcttcagttggtcaaagttctgggattacagacatgagtcaccatgcccagccaagttaaaatttattgagacttgttttacagccaagaatatggactactttggttaatattttatatgcacttgaagataatgtgttctgttgttgttaagtagggtgttctctaaatgtcaattaggctaagttggttgatagtatggttcaagtaatagctatattactaattttctgtttactttttctatcaattattgagatggggtgctgaaatctgactattatggatttctctatttgtccatttgtccttttagtcctgtcagtttttgcttaatgtgttttgaaactctgtgattatgggtccataaatgcttagaaattttgcgtcctcttaatgaatttactcctttatcattatgaaattactctatttgttcctggtaacattctttgctgaaatttactttgtctgatgttaatatagccatcctagttttctttgattagtattaacatggtgtatcttttcctaatctgttacttttcaccctgttgtgtcttcatatttaaatattttttcattttgagggggttatttttcagttttttttttccctttttgtagtggcatatagttaggtcttatttttttccttatttgataatcactcccttttaactagtgtgttaaatgtcatatatttaaaagcatttggcatttaatttgtttattgatatcattgagtttaacttgctgcttattttgtattagttccatctgtttatagatccttttgcctggttttggattaaatgagtatttttaatgatcccatttaaccgcttttgtttacttattagatatcactatgtatgtatatgtgtgcgaatgtgtgtgtgtgtgtgttttagtggtactctaaagatgttgctccactgtcttgtggcttcattatttctaacagtctgcttataatccttatcatgtttcctgtatatatgacatgtgctctttgctctggttgcttccaatgttttgtatttatcactgttatttatttatttatttatattatttaaaagttttttgagacaaagtctcgctttattacccagactggagtgcagtgacaggatcatggctcactgcagcattgatcctctcacttcagcctcctgagtagctgggattatagtcatgtgccactattcctgaccaatttcaaagcagaagagagaggcagaagcagtataatcaaagatatgacagtatcgcactatgttacccaggctgctctcaaactcctgggcttaagcaaaccatcctctttggcctctcaaagtgctaggattacaggtgtgagccactgcacctggcctatcactggttttgagcaagtaagtttatgatgtttcttagtcttattttcttcaggatttttgtgcttgtcctgtgttgagcttcttggatctgtgagtttatggttttaaccaactttggaagtttctggctattctttcttcaaatactttttcttcccatttttctatctcctctgtttcatgattccagttatacgtgtctgctttttgcgggaggagggttctttttgctctccttgtgtcaatttaaatagcttcagttaaatcttgaatttaacaaattatttcttctgcagtatcaaatctgtccttaatcccatccagtgtattttttatcttagaagtatttttaacccctagaagttcaatttgggcattttaaatatctcttgtgttgcttcttaatatgctcaatctttcatctacatttttgaatacataaaacatagtgagaataattgtttttgatgcccttgtctactaattctacaacccatgtcatttctgggtctgtttctattgactgctctttctcttagtgatatgttatattttcctacttctttgcatgcctggtaactgtttggtcgatgacaggcactgtaaattttaccttgttgggtgctagatatttttgtattttgttatatttttgtgctttcttttgggatacaggcaagttacttgaaaacagtttaattattttggttatttcttttaagcttgtgaggtgggaccagaccatcatttagtctaggacaaatttctctccac

SEQ ID NO: 171 - DNA, 7025 bp, Homo Sapiens
agtgagggtgaggcggagagacagagcgggaagggaaacaggatggggagagtcaagaggggaagggaagcgggagtcggggtgcgagcctgccctttcccccgccgagggcctgtgcggggcgcggcggccgcgccaactccggcgtcgggaacactcaccgcaggacgctttgccctccttggaatcgcagtagccgcagtggtagccggccctgaggcccttgtattccaccaccgacgccatggccgccgcgagggtccgctcgggccgaccacgcctcttggcgcccggggccgacctcggcgaagcgctggggcccgcggcgggaggggtggagagcgaagcctggcgcggggacccgtgggcggggatggtggtcgtgtccccaagccctgcgtttgggccggtgcttcccacagctgtgcgttatcagccccatttcacagattggcctgggctaaaaatactcaagaccctcagattgcagtagggtcctattccccattagaaaagaagattcagtttgctaaagcagaggcgtactactatcaatagcatcaagaaatgatgatggaagaagcatggaaatacaatatggttccaaaatgggaaactaaaatagaggaagaggaaaagagatcacaacgtgagaaaacagaagatactaaaaaatgggactatctagtgcctgagagggaactgagtcttacaaagaaacatataccaggctgaacaaaccagaggcctcagagaccacaaacaccgactgctccctcaaagaattcccagtgaaatactttcccctaaaatactaacacgggaaaaggatggaaagcatgaaaatatccagaaaacacacaaaactgaaaccagtaagcacaaggtggcatggacaaaggaacagatgaagggacaccaagaccgaatgatctgagggagagaactcaaagcaaagacacgctcagaagcgctccagccccgttccatctttcctaaaatctcaagtggaaaaagagaaggtgaaagagtttgaatgggtcacagcttatccaattttgcaaccttaccagaaagcacttaggaaagtgatgattctgatggagaaataagaaaaaagagagtataaaattaagaaaccactctgaagggagctcttgagtatgccaccatttttgagaagtcaactagaaaaaaataaggtttaaattattttatattttttagactagcatacttttaatcattaatgcaataaaacatatactcccctggtttttttaagtgcatcaaactggcaaaaattaaaaaagccacaagcacagtatttccaagtgtttcagctggctgtgtgacaactctaaaacttagtgacttaaagcaaccaccactttattatatctcgcagttctatgtcaggaaatcagacagagctcaactggacatttctgtcccatgaggtaccaccagagctgcctggggatattcaggtgatgactgggctcatctggagggtccaagatggcttccccacatgcccttggcagggaaggctagaaagctgggcctccctggcccatctctcatttgcagctctccatgtggtttcagtgccacgtggtagttggacttattattcggtgactcacgactccacgaatgtgtattccaagaggcctgttggaagctagaaggcttcttatgacttagcctcacaagtcccagaacatcacttctgtattctactggtcacataagtcaccaagaccagcttaaatccaaggaaagggaaagcggactcctatcaaaaaaactttgggctgggcatggtggctcccacctataatcccagcactttgagaggctgaggcaggcgttatcacttgaggtcaggagttcaagaccagcctggccaacaaggtgaaaccccatctctactaaaaatacaaaaaaaagtaagacgggtgtggtggctcgtgcctgtaatcccagctactcgggagtccgagacaggagaatcggttgaacacaggaggcagaggttacagtgagctgagatctggccactgcactccaccctgggggacagagcgagactctgtctaaaaaaaaaaaaaaaaattgtagccatttttaaatctccccctccaagaatctgaaaagtcttaactcacacaccttcatccttcactatgcttttcattattcttttaacattgctaatcgcaacacttttctagaaatccagaaacctacaatttcacagcctctgagttgatcttgactaaagcggcatggctccctctctgtaggagtaaatatagcagaggatgtacaagcctgttacaattatgcagaaacacattgtcttgtactctccaatccacctaaaacttaatatcatattcctaagcctaaaccctaactctgtccaggagatgtagcccctctgtacttcaaggggtttacaactcatgtggggaagaaaacactgaagaaaaaaaaatagcacgtccggttatgcagtataaagtgttttattgaaaatatggactagagtagggcagcaatttagggggaactgagaatggagcttggatgataacttcttaggcagcggagacaggaggaaggcatggccacaattccaccctgattcctaccaccctcagcacagaaataaggctcctccccagccgttggagacatctatggaaaagatttgtgaatacatgagatgagaacagacaggacaactgatttaagaacaaggtactattgacaaaaccctggaggaaaagaaaggctttgggaaggtgataagttttatttatttatttatttttgagatggattctggctctgtcgcccaggccagagtgcagtggcgccatctcagctcactgcaagctccgcctcctgggttcccgccattctcctgcctcaacctcctgggcagctgggactacaggcacctgccaccacgccaggctaattttttgtatttttagtagagacggggtttcatcgcgttagccaggatggtctcgatttcctgtcctcgtgatccgcccacctcggcctcccagagtgctgggattacaggcgtaagccaccaggcctggccaagttttatttttaaaagataacatggccgggtgcagtggttcacgcctataatcccagcactctgggaggccgaggtaggtggatcacctgaggtcaggagtttgagaccagcctggccaacatggtgaaaccctgtctctactaaaaatacaaaaattagccaggagtggtggcaggcacctgtaatcccagctactcaggaggctgaggcaggagaatctcttgaacccgggaggcagaggttgcagtgagccaagatcacaccattgcactccagcctaggagacaagagtgaaactccatctcaaaaaataaaatataacatgtatttttcagttcagaaatttaaagaaaaagtagctcataataaccactgttgattattttatctttacttgtttgaaatggagtctcactctgtcgcccaggctggtgtgcagtggcccaatcttggctcagtgctacctccacctcccgggttcaagcagttctcctgcctcagcctctgaggattacaggtgcccgccaccatgcccagctaattttgtattttttaataaaggatttcaccacatgggccaggctggtcttgaactcctgacctcaagtgatccacgcgcctcagcttcccaaaatgctggattacaggtgtgagccactgcgctggccactgttgataactttaaaaagtaaaaagtacaggttagaaaattcaatagttggccaggcgtggtggctcacacctgtaatcccagcactttgggaggccgaggcgggcagatcacgaggtcaggagatcaagactatcctggccaacacggtgaaaccccgttctctactaaaaatacaaaaaaattagccaggcatggtggcgggcgcctgtagtcccagctactcaggagactgaggcagaagaatggcatgaacctgggaggcggaacttgcagtaagacaagatcacaccactgcactccagcctgggcgacagagcgagactccttcccaaaaaaaaaaaagtaagttcaatagttacaaaaaggtacaaaatgaaaagcaacatggccttggtttgcaaaatgtaaccacttttaagtgtctcaaattaggaaagtttgaaacaagtagaaagtagaaaaatgacagataaaaaggggggcaactttagacaagaacttagaaagttatggtgttaagactacatgttatataattccatttatgtgcaatgtctagaacaggcaaatttacagaaagtagattagtggttgcttaggggtaagaggtcagaatggtaggtgaggtagagtgacagctaatgggttcagggtcaggggaacaaaaatgttcaaaaattagattgtggtaatggttgctaagccctatgaatagatgaaaaatgatttatacagtttacatagaaattgtaggtatgttaattatatatataatatatattatatgtgtgtgtgtgtgtgtgtgtgtgtgtatatatatatatatatatttttttttttttttttttgaggcagtttcattcttgttgcccaggctggagtgcaatggcacaatctcagctcaccacaacctctgtctccctggttcaagcgagtctcctgcctcagcctcccgagtcactggaattacaggcatgcaccagcatgcccggctaattttgtatttttagtagagacaggctggtcttgaactcccaacctcaggtgatccgcctgcctcggcctcccaacgtgctgggattacaggcgtgagccaccgcatccggtgtgagttatatttcactaaagctgtttaacaaaaaaataaatgctagagtttagagtcctgaggaagcgggcctggaaatgtagggaaaggacctgagcattcgaggctttgaacatcactaaagagttcagattttttttaatcttgaaggcaatgggaaatctgagtaatatgacaagtggttctgaagaagcagaagagacctgaaggacagaagtaggcgataacagattggagtctgtggtagtaacctgggcaaactgagagaagagatcagatggggattagtgactggttaaggtaagggcttggagggtgggggcaatcctagttttccatctgagaaaataaagtcgtaaaagtgccagtataggtcttctagggagatttgaagggctgttttgtacatgtctaaaataacccacaagctgtccagtgagcaactgattgcatgtatctgtaacattttcaagaagtttaggcatcaaagttgtcagactgttcatggtgtaaatgtcagcataaatgatgacagtgactgtgaaaggggaaccagggaaagcaacagacatcaaggatacacagtttcaaggcatagatctccaagtgtcaaatgcacggccatatatccactggagttaacaatttggaaaggaattaggaaagctggcatacaacagactcaatgagtgggaaaggaggtgccacactgccacggactgacatgaggggagacaagtgattctcattaaagaggtgataggatagcagcttgaagagggtcatggtaatgtttttaaaatcagagatgggcttggttgaagggaaaactccagatacaggtgaaggggatgactgagagagcaggctcccctaggaggcaggaagcactggagcccagagtcttccacagaaaagacgcctctacccctgatgccagagggaagcagtgagaaaacatgaaatagcaaagtgggaactgggagaagaaactgactagacttgaaagcatagccgagatgagaagcatggagtagcatgctggtaagatggaaccagggctgatgttgctggggaaagtagtccagcctggcttgccagaggatttaatagtttcttgtgtgtaaatcagaggctgaatcataggaaattactcatatttgaccgtattttacctataaaaacaacagtttcatatgatacaacctatttgttgacttgactagctagcttcgtggcaaaaaagaagtaaaaggaatcataatggtccgcagggcattaacaacctaagtaaaactttcactgggacaggaatagacaaaggagacactctccaataattagaaaataaagagcaactacaattatttgtgaatatggcggtgagtttcctttaatcaaagacaaccatgacaaatttattaactatcaaaagctacattttactaaaaacaatctgcctttaaaaatgttgaatcatacaatatgtacgatacatgccgctttccgttttggacttcactatccatttgagtcctaaaaaggggaagaatagctggttaacagtttataaatgataaaccaaaagttcatataatatacataaattaaatccaacaattagccctcctcagtgagtagggcccaggttaatccacattatatatcttaaatttattccatatttattcccttcttcttttttctttttttttttttttttttttgagacagagtttcgctctgtcgcccaggctggagtgcagtggcacaatctcaggctcactgcaagctctgcctcccaggttcacgccattctcctgcctcagcctcctgagtagctggaactacaggcgcccaccaccacgcccagctaatttttttgtacttttagtagagacggggtttcaccgtgttagccaggatggtctcaatctcctgacgtcgtggtccgcctgcctcgccctcccaaagtgctgagattactggtgtgagccactgcgcccggcctattcccttcatttaaaatatttttacaacttggaacaaaagtatttcaattaattgaagcacatattaagtgcttacattaagtacaaaaaagtttattttaa

SEQ ID NO: 172 - DNA, 2672 bp, Homo Sapiens
ttggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggagacatcagggcagctgttaattccaaatatttgttcccaagtagctactgaactgctcacaccattggaagattttgtattttcataccaattagtaaaaataagaacattgaggagcagtcagagcccagtgttaatctccggcagagatggggtttatgtatgttcagccagatagtaaatgggatttttggagaaataagataactacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgct

SEQ ID NO: 173 - DNA, 4450 bp, Homo Sapiens
agacaacctccagagcagggcagcaggcagctgctagagatttatttctccacttagtcgtctccgcttgcggcttcctcccatgagtgaggaccaagagaagccccctgtctctgatgaaagtgggggatgaacactgaaccaaacccacactgctcagcacatttgatgcggccagaaacagactgcaaaggctgagaaagcttttcaggggccgtctggctgtgtgggtgcgaagacctggctgtacttggaatcacctgggaagacttacaaaaatggtttccgagcctcacccgcaaggattctgacttgtggagaaactccaagatgaaccccaaagatctccatctccagctgttcacactcctatgtaatctctagcccttgggtgtggaaaggacttgtgacttactttaaccaacaacagaatatagcaaagatgcctaagaactgcaaatgagaaataattttctcacctggtcacagcatctaccaagaatggcgctgggggagagatcagtgagattccatctttattaccatgtccctccttccctgtcaaaagcatttcacatcccgcaagtccattagacatggcaccactctgctgtgggagatacacacacaactaaatacagggtaacaatacctgcctggtcagcacttcagctccaaatcaagcttcactaatgactatgagattaacgaagatggttttgataattatgactgtttgttttgtttttcttaactattcttcatctgagacttttacttttgtttctgccagcatcctgacaaacatttacaaccagaaagggtaagccactagcttgaagccattaagttaagttcagttaacaaggctttgataacaaccctcatgtttttaaggaaaaacaaagaacctagtaatcctttaggccttaccctgaaagggtagccagaagaaaaatcacaaataacatgaacttaccggaacaatccaccggggtgtgatcatggatgtggaagacacctgaaataattttatatgtatgtatttactttttggaaagactgacttattttcatacttataatacttacttacatctattatgaaatccattctaggagggcaattcttaattcttaatggtgttccttgagctgacatggacttctaaatccaagacccttttctgttatacaacacagatgctatccctcaccacttaagaaagtgtcataattttgagaatctcttatctaaaaatttaccattcaagaatctattactactttcagttcacttaataggactgcccctacctcacacccagtattcagtttaacattttattttctgaaatttcagttaattaattacaaataatgatagccttcttggtagcagcctgaacaatggattgtgactaatccaaataaagagcaacaagaaagtacacagaaaaataatctgtttagatacagatcattctctaattatcatgtatgcatgaagaaagcgcaataaaaacacccatattgctcctggttcacagggcctttgatacattatttttatatgtttaactttctattataggtcatctatgtgtagaattataaactaaggaaacccacccattttactagtaatttagactagtccttgcattggtggccttacatactcataagaaaaaactaatgtaagtccaggtattagtaaattagataaccaccaaaagaataaaaacacaggctgggcgcagtggcgcacgcctgtaaccccagcattttgagagggcgaggtgggcagatcatgaggtcaagagatcaagaccatcctggccaacatggtgaaaccctgcctctactaaaaatacaaaaattagctgggcatggtggcatgcgcctgtactcccagctactcgggaggccaaggcaggagaatcgcttggaggcggaggttgcagtgagctgagatcacgctactcctggcaaaaaagcaagactccatctcaaaaaaaaaaaacccacaaaatctgactttcctaccaatactttttagatgcatgttaacagcaggaaataagagagaaaaaatatcataaataatagtaaacaaaaaatagtttgacagacttttccacacttgcagttaattcttatccttggtaaagtctttgtttattaatctaagctggtcattcccaacgggtggttcccagaccacatctgcaccacctgggaacatgttagaaacacaacttttcagaccccacccaagatataccaaaattagaaacttggaggtggggcccagcaatcttgtgtgttaacgtcccctccaagggattctgatatacacaaaaatttgagaattaatgatctatgcaaacattcagtatcatgtgtatttccaagccttcaggatggcatctagcccctacagcaattctcgtcatatcactcataaggtacaaagttagtcatttctgtttttttttttttttttttttttttttgagacggagtctcactgtgtcgcccagactggagtgcaatggtgctatctcggctcactgcacgctccatctcccaggttccagcaattgtcttgcctcagcctcccgagtagctggcgctacaggtgtgcaccaccacccccggctaatttttgtattttcagtagagacagggtttcaccatgttggccaggctggtcttgaactcctgacctcaagtgatctgcccacctcggcctcccaaagtgctgggattacaggcgtgagccaccgtgtccagcaaagttagtcatttctatctctctcatccctggagggaaggaactgtttcagttggccctccatatccatgagttgtgcatctgtggattcaacaactgtaaatcgaaaatatttggagggaaaaaaaggatggttgtgtctgtactgaacatgtgcaggcttttattcttgtcattatttcctaaacaatacaatataacaactgtttaccagcatttacactgcattagatattagaggtaagctagattatttaaaatatactagaggatatgtgtaggttatatgcaaacactacaccattttatatgagatttaagcatgcatggattttggtatccaaggggagtcctggaaccaatcccccacagatactgagggacaactatacttaatacagtatcttccagactgtaataatgattgatatgttcaatgccattcttacgctctcatctttctataaaactttttaaaaaattaaatatatccttattgtctcaagaaactgctttatccccatgttttctctcatttaatatgatgttgaattataaaaggcttatagagacatgtgatttgtagacagtgatacacaaattcaaagtggtaaaattttaggacagagaggcaatgctaagtggttattaaaacataaactcttatcaaatgaaaagtttaactgaattattaaaaaggaaaaaactggaatctagcaggaacatttttcaaaacagaaatttctttccatcatactattttaaagcatatttacctgaggtgcaactgtgtgatcaattagattctcagttagagatgcaagcaaggcatccaattcatctgtagcttcctatggaagacaggaatctagaattgttaaatgacccctttatcatcagatgttaagttttttccatatcctctcaatttataattctgacacaggcctgattagtgttaatcctttaaatacacagggacactcataaatcatggttgttaatgattccacttctgcatggagggaaacctatactacaatcaggatgtgaaaaagctgaagtgctatgtaaattttcaaatagctattctcctttggtaagacaaaacttgggtagggttatgactattctggctcttaactttttctttttaattacaaaaaaattattttggctggatgcagtggctcacacctgtaatcctagcgctctgagaggccaaggcgggaggatcccttgagcccaggagtttgagaccagcctgggcaatatagtgagacctcatctttacaaaaactgagctaagctgggcacagtagcactcagctgtagtcccagctactcaggaggctgaggtgggaagatcacttgagcccaggagacagaggctgcagtgagccaagattacaccaccgtactccagcctggatgacagagtgagattctgcctcaaaacaaattttaaaaaagtaaatacagccgggcactcctggctaacacggtgaaactccgtctctactaaaaatacacaaaattagctgggcgtggttgcgggcacctatagtcccagctactcgagaggctgaggcaggagaatggcatgaacccgggaggtggaggttgcagtgagccgagatcgcgccactg

SEQ ID NO: 174 - DNA, 8046 bp, Homo Sapiens
caccgcactccagcctaggtgacagagcgagactccatctcaaaaaaaaaaaagattctgaaccatccattctctgggttgcacttaaatttttggcttcattagggatgacttggagctgctatgcttgtcatgcaaaatatattcctccatgttattttccatttgctaatcagttggatccatttgagtcaaactgtgcctttgtagacttggttgcttcttttggaagcttctttcaaagtttctttctttagttgcttctttcaaactaggttacagaaacaagagctgaattagacagctgcagaaagcagatttctactttcaaatttaagatgaaaaatatgaatattgagagtatttctttcatgttgaaatcaagcaactttcttggtaaaattctatttcttaacgcagtcagtaattggtgggtgaggtgaccacatgccctgaggaggcaggtaggcccatctagagcaggagctgggctcatgcagatggatctttgaccctacctctgttcctcatagttggatgaccctggccaactcacttcaccctgttactttccttatctgcaaaattcatgtctccaaaattcccttgtggggttgctgtgaggatgagttgaaatgatgtgtgtggtgtcacagcatgatttccttgatccatggaagttattaagttgttggcagtccacttcttgcttttgtggagttgtatttttgttctagctcttttgttcacagacggggtgactatgtaatttatcatccaaactgggaattaataaatgaaaatgaaagactaagtggaggagagtctgggctcaaaggtgtggtcaggactcttcccaggcaaacctgaacatgtatggtcaccttccctaatactaatgcgtagtcagactgagcagcctgtgggagaaagctggctgccatcattctgccactcactgctggagggacaacaaggcagaagcagtctggcgggccaagctagaccttgtctgtgtcgggaagacttacatcatgtgctggtaaagaactaacaactgctgggcacagtggctcatgcctataatcccagcactttgggaggccaaggtgggaggattgcttgaggccagaagtttgagaccagcctggaccacctagtgagaccttgtctctacaaaaaaaaaaaaaaaaaagttaaaaaaaaattagctggtcctggtgacatgcacctgtagtcccagctactcaggaggctgaggaaggtggatcacttgagcccaggagttagaagctgcagtgagctatgactgcaccactgcactccagcctgggcaactgagcaagacactgtctcaaaaaataaaaagactaacaacctggtctttgaaaaatattgagtggccaggcacggtggcccatgcctataatcccaatgctttgggaagccaaggcgagtgaatcacttgaggtcaggagttcaacagtgaaactccataaaaaaaaaaaaaaaggaaaaaagaaaaagaaaaagaaaaggaaaaattattgagtgaagaagcctcttcccttcctcccccaccaccttataatttggcaaagggcctccatctgtggggcctagattgttttctaggagataaaaatagccagcatgtgtcaagatagcatcaaacctgcaggggcaggtgaggactccagaatggggttataagcaggtcttttttttttgtgagccaggctacatgccaggctttatgctactgtgtttatttctctttgttacttgccagcacagtgatactagaacttgcagaaatttaagggtaaccggtattactttaaaataccttttcccaggctcccactgcagaccttcaaaatccatgtcccccaagattctgtatatttaaactggtgtccagagcagtttctatgacctcaaaaggttgggaaacattgccctcatgttcagaaaagtcctttaaacttttcagctttgacttagttgtggagagatgttgaaaaatgccttttgtcatcccattgcctgtacctcagatatgaaggaagaaatgacccaaggaggcttcgatggagccaaaatcatcagagggagagtctcgggagaaagatgaatctccagggcaggggccagggtttgttggtctctctgcttctggcccctgcagttactctttttcagtgtcaacctcagaggagctgagctttatttttattataaaagcagagattatctgtcactatactttatcaatcctttctcttctttccccatcattcttccagaaagaattgttcatactccttgtctctgcttccttaatcttcattcacttctgactgcagtggaatgaagactgacctgggtaacctgccctatgtgactgtgggcaggttaatgaactactccaaccctcagtttccccactgtgacttgtaaaatgaggtaatgcaagaaaaatttccaacatagtccctggcagatagtaaatacttattttttttatttttatttttttgaggtggagtctcgctctgctggtctcgaactcctgaccttgtgatctgcccacctcagcctcccaaactgctgggattacagatgtgagctacctcgtctggccagtaaatacttaattttaaccctttccctttccctacctctggccccaaaacagagataaaatttcttttcctaaaatcattagtaacataattgatttttttttctttttttttttgaaacagagtcttgctctgtcacccggtctagagtgcagtggcgcaatctcggcttactatcacctctgcctcccaggttcaagtgacttttttgcctcgcctcctgagtagctgggattacaggcgtgtgccaacacttcgttaatgtttttgtatttttagtagagatggggtttcaccatgttggccaggctggtaaaatcattagtaacctaattggaaaattctatcatttttcagggctcaatttacttttttttggtcaacatttaagactatactcaattcttgaaattcctattcttttcctatatttatgccactttttctagcttttccctcctggttccaaaaacatcatctctagcctgcctagtatcagaggcactccctgcccagtgtcacatgggcagtcatttaacagccatgatatcctggccccacataatcatttgctccctaaatagggacttgtatgaataaccacacaaggatttcactgtctttttcctttacatacaccttacatttaggtgtattaatgaaattatgcagccattgaaaagtatcatgttgaaagctatggaaagatgcagaagtgattaacatcttcagtagatatagtgcaatgcaaaatgctacatgttaaaaatcagggtgaggtgctattcaccttaagaagacaccataaaggccaggtgcagtggctcatgcctgtaatcccagcactttgggaggctgaggtgggtggatcacgaggtcaggagattgagaccatattggctaacatggtgaaaccccgtctctactaaaaatacaaaaaattagccaggtatggtggcaacccaggaggcggaggttgcagtaagctgagattgtgccactgcactccagcctgggtgacagagcgagactctgtgttaaaaaaaaaaaaaagaaggcactataggccaggcatggtggctcaggtctgtaatcccagcactttgggaggccaaggcgggcagatcacctgggatcaggagttcaagaccaccctggccaacatggtgaaaccctgtctctactaaaaatgcaaaaattagccaggcatggtgggatacacctataatcccagctacttcggaggctgaagcaggagaatcacttgcccttgggaggcggaggttgcagtgagccgagattgcaccactacactccagtctgggcaacagagggagactttgtctcaaaacaaaaataaaaacaaaaacaaaaaacaaaacaaaaacgaaaacaaaggcactacagccgcctaacacaaagatgatagaatctcatccctacgctgtagccacacacaaccaaacccaagatcccccaaggaaaacggatgaatagagaacactagcaaatgagaattaagcatcactttgctacaaatactccagtaaactgggcctgagcactgctttgggcttccagactgtaggcttcctctatctcccaggcataaatagactcttaccttagtgagagcacatcagacattagccaagtgtggtggtgcgtgcctgtaatcccagctacttgggagactgaagctggagaatcgctttaacccgggaggtggaggctgcagtgagctgagatctcaccactgcactccagcctggtgacagagcgagactctgtcttaaaataataacaataataataataattctctgatgactcttcaggaaattctcctcattttaagagttatgctatgttgttctgtgaaaatgaagactaccagcacttctgtgtaaactctaggaagagtttgactataggagtatggtaatacttgctgtgtaaagaaaggatggaaagctactttgttttgataaagtaaaatgtattgaagtgcctattttgagtaaattaaaattcagagtacttaccatttcagctggtctcaacagcaaatttttagaagtctgaaatacatcaataccgtgaaataggagactcttacttccttaagacattcatgaaatcactgggttaggtgctagtaatgcaatgatgagaaaacacacacacacacaaacacacacacacaatcccagctcttatggggtttacagtcaagtggggagacaaacattaatcaaataattacacaaataaatttaacaaactgcagagtgcatgatggaagagcagtattagatggtatgagatgattaacagggtctgttaattggccagaaacatctgggaaagctcacctgagactgtcagttgtgctatggttggaggatggggatgggaggtggctggtgagggcctcgttagggaaggaactaagggtgcaggagccctgctgctggaagcagtatgagcctcgggtaacacaagggctaacccaaatgcctacacagagtaaggattgtgggagaggaagaagtgacatgcctctcaagtattaaaattcagttttcatcatttaaaaatagagtaacaataggcaaacagtttgtgtttttgacagggattgtaagagtcaataaatgatcactgaactcctaggagggtcctaaaactgagcgtttgaattccagaatttaaatgctgggtagaaaaggatgacccagcaagtattcctgagtctgaagaagaaaagccaggagtgagtttagtgttactaatggcagaggaaaagagggccttttaaaaaggaggcagtggtactcagagttgaaggctaccaaaagatcaaggaaaatgagaactgaaaaaatatctgttggagttagcaacatggaggccaatgacattcacaaaatgcttaaaatgcactgatattgtataattagtttcaaccatcttctgaattatctgtgtcttttgcctgactgggaggggtgtgggttgctttagatcaaattccacacttctggagatctgggggcattctagcaacaatccagatagtgttacaaacaagaccattataagataaacacattttaacaaggcatttattacccaatgctttaatattagagagactcaactgggctcatgttaaaaacaatgaagcatctatgtcttatgcaatgctgtataggaagtatctgataaagtctagatcctcagaacaaaaattctatgcattggtctattgtctttatttaagacaaagagtgtgcttaaggtacaggtatctaccagctactgaaaactgcagaacccctatccatgatgtatccttatttatagaatgctctaaaaatgctctaaaaatctcccataaaacaggatgaaagtagttttctaatccaaaatgttatcataattgacacttctcagggtaaaaattagcacataatggtgagtgagctcagaaagattcaaaataaacaatttatacaaatcgagctctccaacaattgcaaatatacagtatctattagtctttagctgaattaatcatttattttttatttttatttttatttttgagatggagtttcgctcttgttgcccaggctggagtgcagtggagtgatctcggctcaccacaacctccgcctcccaggttcaagtgattctcctgcctcagcctcccgagtagctgggattacaggcatgcgccaccacacccagctaacttttttgtatttttagtagggacggggtttctccatgttgtcaggctggtctcgaactcctgacctcaggtgatccgcccacctcagcctcccaaagtgctgggattaccagcgtgagccatcacactcagcctaaattaatcatttcttaaggccctcataaagttactgtttgtaaaaaataaaattctacatatatgggaatttagaaaaacatttaattgtcataattgaatgtaattaatcattgttaaaatatcaaagcaataatacatttcagaggatatatatgtaatgatttttaaggctctagtgaagcatactctaaaatgtagctaagcaatctattaacaccggccttttacagaatacagttacaatcattctaacaagataaattggctgggcgcagtgactcatgcctgtaatcccagcactttgggaggccaaggtgggtggatcacctgaggtcaggagttcaagaccagcctggccaacatgtcgaaatcccatctctactaaaaatacaaataattatccaggggtggtggcaggcacctgtaaaccttggcaggctgaggcaggagaatcgcgtgaacctgggagacgggggttgcagtgagccaagattgcaccattacactccagcctgggtgacagagcaagactctgtctgagaaaaaaagaaagataaattatacatatgattgatatacaagcaaattatatgtattcacacatatatagtttccttttggaagattttaggaaaatatttgtcacaattaatgatttttatattttatttataaattgagtactttgacaaaatattatattaaatggttcagtaagactgaaccatatatgcttggtttggcacagtggctcatacctgtaattccagcactttgattggccaaagcgggtggatcattggagtctgtgagtttgagactagcctaggcaacatggcaaaacaccatctctacaaaaaaatacaaaaattagctaggtgtggcagagggtacctgtaggctagggaggctgaggtgggaggatccattgagcccatgagacctaggctgcagtgagctgcaactgggcaatagagcgagagcttgtctcaaaataaataaataaataaataaataaataaatttcttctctttaaatcttggacctagtcatcagatcaatctttctaaaattttgttttcattcatgcatattattcagtggctccccacttcctacaaaatgaagttcagctctttgttctgacatgtaaaccatttcaatatttggcttcaaacattatttccaaagcaggccatgctcctcatctccaccctgagcttgtggtgtgttcctcaccttgaaagctcttcctctttctcttcttcaaatcttgtgatttttaaagatgcagttcaactcccacccacctcccttatgaaatcttcccttatgcttctagtgccttcctctggccttgtcttcatcacttattttgggttttaaacaacgactattatgtacttagtaacagtacttgtgtcccttttttttttttgagacggagtttcgttcccgttgcccaggctggagtgcaatggtgtgatcttggctcacgg

SEQ ID NO: 175 - DNA, 1202 bp, Homo Sapiens
acatggattcagacacactgcaaaccttccagagggagctctgttgctttatctgcaggaactacttaacggacacagtcaccattgactgtgggcatagcttttgcaggccctgcctttgtctacgctgggaggaaggccaagctccaaagggctgtcctgtgtgtgggaaaatcccccagaagactgacttcaacaccaatattgttctcaagaagttggcttctcttgcaaggcagcgcagacctcacaacatcaacagctcagagaagcagatctgtgtgctacatgaagaggaaaaggggctcttctgtgaggcagaggagagactcctctgtgggccctgctctgagtcacaagagcatgaggcttatggccacagcccaataggatgggctgctgaggagagaaacttctgaagaaaatggatcatttatggaggagcactcaagaaatgcaaaacaatctaaatcaggaaattagcaaaatccattcattaacggactatgtggccctcaggaaagggatgatcagataacaatatcagaagttgcgccaatttctcctggaggaggagcaacgccatctggagacaatggacagagaagcagaagagattgttcgacaactccaagacggtgaagtaagaataacccaacatataaaaaagacgaaaggcatgtacagagagctgtgggagatgcgccacatgccggatccccagccagtgaacccagaactcacttcctggcacatcaccggacctttctgaggatgtgagaaatgtggtatttggagatgaccatgatggtgcacccggggagtcccagagagcagagaactttgcagcatggggagctcaggccttctcctctggcaggcattactgggaagtggatgtaacccagtcctccagctggattctaggagtctgtaaagattccaggacagcaaacacaaatcatgttcctgcttttgaggaagcattttttcaattttcttcaaagagaaacagcctttatagcctctccaacacctttcttcccttaactcactatgtgcaaagacctttgggtcgggttgggatgtttctggattatgacaacacagttgtgagcttttatgatgtttcaaaaggttccctcatatacagccttttccctttctctttgtcttcccttttgacacctttcttttgtttt

SEQ ID NO: 176 - DNA, 2000 bp, Homo Sapiens
gaggctgaggcagaagaatcacttgaacccgggaggcagaggttgcagtgagctgagatcatgccattgcactccagtctggtcgacagagcaagattctatctcaaaaaaaaaaaaaaaaagctgctgcaaatgctcattccgtcacaaccatgctagtgaaaaaagaaataatgggttagaaggtaattttagagtatatctcttactcttttgccctgtaaaatttttgtatttattacttgccatatagaagcctgtacttcaacaaaagatgtcattaatttcaagtaaatatgctcccacatatattctccctagaaaggtactggtgtatttccagtcaagttgtagcatttctggccttttttgtgctgctgtgtttgtgtgaaataaggcaggaagtaaagtggagtcaaccatgacatttcttgtttctaaagccacagcctctaaaattgaatgttaagtcaactagaaataatgacaatatttaagaaataaaattctttttattttttatagtttataaaaaattatttttgaattataagttaaacaacttgaacatgcagatacctaaaagtgtcatctaggtgatagtattaatattttaatagcttataattgtgagtcacagttgccccattgggtttactgaaaagcagttatttatcttatatgtgtgaatggagaataggctttttataatcctaagcatacagatcttttaagattagcgctatatttagatctgaataaaattgataggcttgtaataacaaattttaatacttttttctaatagaagtgaaaaacagaagtcatttgttaaaatgagtttaagagaaacttcacatgtatttattaaataacacttaaaccacatggtaagttactaatcagtaatttcaatctattttattttagtcactgaaaaagcataacattctttaattattcaatcagaaacagtattcttattagtgtttctgaaagcaactgtagaccactcagtggatgacaaggttcatgctgacaacaaattttctatataataataggctcattttaactttaaatataaacactcattatttcaaaagtaaaattaatggttcttttaagtcataagaggaataatgttataattcacttactgaagtgtttgtctcagactttgtaatgaatactttaaaccaaaaattaagttctacatactatctatggataaaaagaagtggtttgtaaatttatctttatttttactaaattaaaaaatttaaagccaaaatgttaggtcaggatttaaaacaagcattgggtgacagggtgttgggcgtaatggttagattgaaactcggtgtcagctggttactgattgcatccccaactttaggattttggtaaaattaaagcaattaatgcaaataaaggtgcccgaagagcacccagcatatagctctcatttgttgattctgttagatcatgatcaatgttaagcctaaaaacaaggtggccacatcagtggtttgtaacccatgtttattctaatcagtcaatctggggctatatataatagtagttgaatgtttatagtactacccttggaaaattcccatatattcacacccagcatggatataaatacggaaagatttcccattgagtacttctctttagcactccagtaacactagacaaataagcacctaaatgccgagtgtttgtcagttttaaaattagaaaagaaggcaagttgttttcttgtctacctgtttaataaattttttattgccaagtacgtatgttcatttgatttaatacgttgaaatgtagtttaaaatatatattcaaataactaacaagtgaaggaataatttatttagaaacgtagaaataatggtactgtaagcagttgctttagagtcttttatagtattgtattttgaacattaaaaataaacattttatttctgagtgttgggtttagactattc

SEQ ID NO: 177 - DNA, 1889 bp, Homo Sapiens
gcccattggaagcagggcctcagcaccaatgctactgaggatgtcagagcacaggagcagggccttgggagattacccagcattactcaaaccttctgccctgatgggtctgggtccttggaaatcaagctgtctcaggctgaattgctggatgattctgttcacacttacaatgaggtaagggaaaccagaaggcccccaggtcgatctctggtttccacacacacttccgccctcattgtgtgaaagtagccatgccttctcctgaagatgaggatctattacctgggcctggagaggaggagaatcctcttttcaccaggtggtctctgggcacatactaatcaaaacttctctcgtgacaatcggaatgtgtagttcagtgggctgtcttttgtatccttttaagggtaccctccttggaaaccaggacctcgtaccctgcacagcccagtgttggaagataaaacgtgcaaaataccccattgggtgaatctaagggattggacgtggagccaaacctgcttccatcttttgattcctggacacacatgttcttcctattgagaacacagcactctagagacatctctgattcaaacaatgcacggtgtcctgaaagacggcacccacctctcagagtgcttcctccaggctggcactgagttttgcctgtagaagacctgtccagcattccttgtggctggcagcctctggatggtccagatggtgataggattagtggaacccacagccatggaaacactgaaactttcccagccaagtgggtccttcaggcagataatgggctaggagcacctcctagcctgcagatcaggaatgtcaacagcacccggagagtggtgctggctgagtttctgagagcaggacatgaaaacacccatggaatagaagcctatccctgtgaagatgaacctctggcccttccaggatggaagtagctaaatgtagtcaacttgttacttagtggctagttagtcacctaaagaaatagtgccccactggggcacatcatgggcctcaattgctgatgagttggacattcagaggtgtcgacagctggatctgccttggtaggggggagtcagtgctgttggccccatatgtagcctcatgcctgccactgtggttgctccattcatgaactcatcctaccagaccagggctgacccatggtgaaggctggctaacttccatttgtctgtttggttgttcagtgccacttcagacttgggtattttctgtgggtgtaaacatgggattcaagctcaacccaggtggaccattttcacctcatgatggatgctgttgggcctgtccaatctatgactctgtgggtcacacaggcacttggaaccacatagttgcttggtgtcccgtggtcaaacattctatctaatcaggacaagggacactaaaagttgcttctaataggtggcatatgtctctgctgtgaatgacatgaccttactccagaatcccaggcctttcactgtgactttcccactggtgcttggttcagctccatcctgcatctttccccaccaatggcatcaccagcaccagggggtctgagagatggtggctgcttgcaccatggcctggatctgctgcagggtccttttctgtgtgggccccacttgaagctggcctcctcctatgtcacctagagtgtgggccaaagcaacatacctagatgtggaaagtggtgttgtcagaactgaaagaggctcatcaggcagtgtgcttccttctttctggtgaggatgcaagatgaaacagtttgtctgttaccttggaggggacacacctgcattcccctaaacacttggccattgttcacccataaaactttacttcaatgccca

SEQ ID NO: 178 - DNA, 20140 bp, Homo Sapiens
gcttctagtaggccaaactcccaggtgacccccgcaagaaacgcggtccggagagggtctggccccactgctggggcaagggctctaggcgcccggaccccacgcccgcagcctgcggagaacgtgccgacaaggacctgtagggccccactccccctcctccctccctcggcgcagcccggcccaggggtctgtcctcccaggcccaggaaaggaggaaacccacttccgccgcgtccatgatctcccgcggcttctcctgactcttgcggctggcgctggcgctgggcatcgggacacggaactgggcagtggacaccaccctccctcgcaggcttccgtaaggcaggccaaaggggcttctccctccctcccagtctccgccctcccgaccctggggtctcagcacacgcgctcggactccgcgtggaggtgcggctccagaaagatcgcgagagctgcggctatctcgagatcccggagcgctggcggccgcgcgcagggtctcctcccactcttgccccgcccctccgggagttttcccggagttggagggaattcccgggaattcgcggtagtttcgctggattggctctgggggcgggggcaggggttaccaggtggctggctgtagacctgggcgaatgccagctctcttcagcttcgtcccaactgcgacttctgctccattcttctaacagccctttcaactccgctcggctgtaaccgcagactcgtcactaaaacacccacctaagcgcgggccttggtttctcctctcttggactttcccgccttctctcttcccctgggcgacgtagctgcttggggacggaggaggcctcttcgcaatccattgccctgcttgttgggacagaggagtgcagttggcttgccaaggcagcatgggttaccagtccctgtagtgttctttcttggaaccatctgccaagctgtgaggaagctccagagccatatgacaagacctgatggaggataactgaggactttggccaacaaccccagctgagctccagttggaatgtgaatgaggccattttgagtgttccagcctattggagccctagccaacactctacaaactagaactgcctgattgacccgcagaatcataagaaatgtaaactgctgttttaagccagtacattgggaggtggtttgttatgcagcaatacctgactgaaacactggggctcctttgctcagcttggttttgaggccttgcaccacgttcacctgctcacctcatcaccctcaaacctctgcagggaaatacaacttactttctgggttttcacagtcattttagctcatggacaaagtggttcactcatcagtgactatgaaagtggccaaatgatgatcacaatactaattaagactttttgaatgcttatgatgtgccaggcactgttttaagtgtaatatatttattcatacatttaatttttagaacaactttttggctgagaaagacaggattcacttccagtgctttccaaagcagcattctctttgtcttaagtcagggaaggccttcaaattactttcattagaagaagatttaaaggaatgtttctgtttagggtttttcagtctaaacaatttttagaacaattttttgagctaggcactattattatttccattttatgataaaacaactaaggcacagagaggcaaaataacttgtaaaacagtaagtgggtcaaatcaccatcagaacccaagcatcggcccccagagccacatgcttagctactgtgatgtcctgcctcccataaataatatctcaagcttatttttatttttttaaaaaacgtttttgagtcaggatcttgctttgtcacacaagctggagtgcagtggtatgatcatggatctctgtaaacttgaactcctgggctcaaaagatcctcctcccttggcctcccaaagtgctgggattatacaggtgagccaccatgcctggccctacttgagttaagaaaatcctctaaggctttgattgcctcgttcatttattctaggttccaggctgtgtcccatgctggcagttacatttagaaaactctaatgttagagaagtctgaattaactattcctacattcacagttcagggtaggatagagtgtttgcttggttttcccaggtttctcatccctgtgtggccaccgcagagggcagcagagtgacaggctgagggtgcagagggggcagagaagcagaactgatggagggcccaggcagggcaggggtgggcggagctatttgcacatctcaggagtgagagctaggcgggagctcagccctaactctcaccaaccacccactgatggagagggcagcttcttccaatagcaagggctgtggctgccaaaactgtgccatttgacttgaagcggaggaaagtctccttgcttgctatgcaattgcaattgcagccttaaggcaagctccccacggccttcagatccctcccaggcagacatcctggagctgtcactgcaaagcttgtgattttgcttcaagcagcccttgaagttctcctgcttcctatttgcctgataactgccccaaggactctgaaggaacattttaaaagctaattataaaatttagtaggcctgcattcttacattgtattaagagtgaggcctttggagacagccctgggtcagagttccatctctgctgcttaattgctgtgtggctttgggaaagctgttttcttctcagattctcaatgttcttggctgtagaatgggttagtgatatttaccctgtgtgcttgttgtgagcaataagtaatcctatagtcaaagcccttggcctcatatataccaggcaaccatcagggtagctattaattacaaacatagaatatattgtggatctatgagaccattaacataccatgcagtcttagcatgtaagcagcaaagggtaaagctggtgtttcatgctctgctgtacaatgtttgcagaggaaaaaagacaatcaccctgatctattttagaaaaatgctatattttaatcgcttctctttttactttcttattttagttttgtcctttaaatgctttggagcatttaatagctcttctgctttcaacttctataaattcacaacttctataaatttaaaaagtgtctaaatcttgattaaatgctcttaatctgaggcttatgggtttccaggggtctgtgaactttttgaaattgcatgcaacattgtttgtgtctacacatatgtgcatttttgaggggaaatgattcataattgtcaacagactctcaaaggattctgtagttggacaaaagatatagaagagtccttggacaaaagactgaaaaaccctaaacagaaacattcttttaaatcttcttctacagaaagtaatttgaaggccttccctgacttaaagtggatgctgctttggaaagcactggaaaaatggatcctgtctttcttagccaaggactggtctcttttctccaatgtgtccctaacagagtggtgaggctggctcttcccaccagtacaggtaatgtggtaaagataggaccacgtggacgaagaggtattaccttctctaattacagctaacaaagacctaggcctaacctcaactgcaccttctgtctctgggaagtcacttatagagtagacctataattaggatttggtaccggaaacataattctcaggatggtgaatctctaaattatgtccccagagacatacctgagacaaaaccctaagggctgttggccgtaagagggtgtgtgtggtattctacattcagtagggatttataaatgaggatgatatcactcagaaggggcaggtgtccaagaggcccttttgacttctgcaatggggcctgacagccccgtgaactgagctccataatttatgcctccggcatagaatctgtgcaaagcaggaatggccgtatcagcatttggggatttaaagcagcttttttttttttttttttgagatgaagttttgctcttgttgcccaggctggagtgcaatgacacaatctcagctcactactacctccacctcccgggttcaagcgattctcctgcctcagcctcctgagtagctgggattacaggcatgcgccaccacgcccagctaattttgtatttttagtggaggctggtttctccatgttggtcaggctggtctcaaactcccaacttcaggtgatccaccctcttcggcctcccaaagtgctgggattacaggcgtgagccaccatgcctggctaaagcagctttttttatccacagacctctttcccaaattgtaaggaggattcagctcattgatttcactttattttaaaagaaaataattattgatgtgtaaagtaaatgaaaacacagtcaagtgggagtgtaattgaaagtaatttaagagttcaatggttgatgacttttttcaattatgatatctctttattaataggaaattcataaattaaggagtatgcaatataatcattgtggaatatattagggaaacatttttgatccatgcaagtaaattgagatagactgggtgcacctgttcctagtcatgcccagggaatatgtgaaactctggctcaggatgaacgtctgttggtgtcagcacaacaataatgaaacaaagttggcagtagggtggggaagtgtttggtgggtgggagccaccatctgcagccagctcccagcacggctgtgtgttcggatacccatcaaccaggaaagggagtctaaggcctccagatgattttcccctttcacaaaactgttgtaaaatgaaatacaaatccttcctgaatgttcctagcttttcttcctttcggaagttttcagtcaatgggaaacaaagccttattcaaaggattaaagccatagtcattctattgtttggggcttcaataatgtggctttccttccacagacagaattttcaattcacaaatcatctgaaaaacaggaaattttggagaaacatgcttatgataacaaacaagggatctatcgtgtggtatagaagtttacacaaagaggcatctgattttaagtttttgtttttttttttttttttttttttaccgttctgggcttctggctgcattctaggaagatcattccttaaaagaaatagccatatggcttataaggtaagactactcagttcccatcccaacccccagaagagaatggaggaagggaagcagactctggctatatttttatggctgcactccaggcagtactgcagaggcaacaggcaggctctgaaatgccttcttccccctgctatcctcaggcctgtgtttctctcttactccacccaagtcctgggcccttacatggcagagggagggagaagggccagcaacattggttaacaggaatagagaatgttcgaggaaggcagtggcaggcaatagccatagagagtcacagaaggttaaagaggttgtggaaacagtcatttgtttttcaagcagttccggtggggtttgagaaagcagcagcactcaactgtgagcagacaaactcactttggaaacctatgcagccacttctaagtaaactaccaagagaattattattttatttaggttcctcatttcagtgacaatcttttaatcctttgaactgtatgctgaaaaggacattatagatcctcctgaaagataatttttagtgtccacggttccctcaatatgatgatttttttccttggtccctatctttcaccattccctttaccttttatccatgcttttccctgattgaaggaagacagagtctatttgcttcctagcatcttcttctatggctcttgctactgaaagtgtgatctagattccagcagcagaacagcagcattttgcttctgagaagtgcagaatctcaggcaccatcctatgactactgaatcagaatcagcattttaacaagatccttggtgatttgcatgcatgttagtttgggaagggctgatctgtacagatctgccctataggcctgactcataacccacactccccaaaacctgcaagatcctacatttctggccctgtatacttctctagtctcatcccatgtcactctacctctcattcactagttccagccccactagtctttctcgttctggcctccaagcctttgtacttgctgttctctctgcctggagtgctcttgtcccatctagtatggctgactcttttatttcagcttaactgttacttctggctgtgagcggtggctcacacttgcaatcccagcactttgggaggccgaggtgggcagatcacttgagcccaggagtttgagaccagcctgggcaacatggcaaaaccccatctctacagaaaatacaaaaattagtcaggtgtggtggcacacacctgtggtcccagctgctcaggaggcttgagcctggaaggctgaggttgcagtgagccaaaattacaccactgtactccagcctgggcaacagagcaagaccctgtctcaaaaaaaaaaaaaaatttacttcctttgaggatgctttcctgacccctctatatgaagaactacctccaacccagctactctctattccattaccctgttttatatttttatggcacttactgttatctgaagtaattttattcattcatttttgggtctattttattcaggattgtgtgtccagtgttcagaagagtgcctggcacatcaaaagtgctgagttaatgtttattgggtaaatgaatacagttttgggaatcatgaacattgagaacctaggcccagacaattctaaggtaaaatatgtcaccctctgaaccaacccgacagctttcagctgattgacctaagaccagtgcttttgggtgcccggatgagcatatcaaagcctggtcccctgagcagttgcatcaatatctcctaggaacttgatagaaaggcaaattcttgggccttaccacagacctactgaatcagaaatcttggcaatagggttcaccattctatgttttaaggagcctgccaggtaattctgatgcactgccccacacaataccaacatcttaccagtgtggagaacccacagtgttcaaagctctcttacatatatcgctgttgttctggacttcataaaagccctgagaataggcatggcaggtgtcattatttcccctttacagatgaagaaattgagccctaggaaattattccatttgtgttggtaatacttgctttatcagaatcacttggaacgcttgttaaaattgcagatacctgggctctaccctagacctactgaatcagaatcattggggctggggctctggaatctagatgaaaaaaaaaagaagctcctaggacattctaaagctaaaagtttgagaaccaattgcaacaggaaacagtggaatagatatcagagcttatagcccctcattcctaaggcatgctcttagagagtcttgagaagagtaagtaatgataaagaatgatattgatctttagtatcttttagtgaaaatagttaaaacaaactggcagtaattctttcacctttattagaccctaaccctacttgctactgttgtaaaccagggagaatcaaactccatgacaatggactgtttctttgtatataatttagttgtgtatagaaccaactaactggacatcaactaaggggtggcaggttttcctgattagtttgtgatacaggaatttttatttattattaaaaaaaatttttttttgagacagagcctcactctgttgcccaggctggagtgcgatggcaccatcttggctcactgcatcctcacccactgggggcgatcttcccacctcagcctcctgagtagctagaactacaggagtgcaccaccacacccggctaatttttttttttttttttgagatggagtctcactcttgtcacccaggctgcagtgcaatggtgcgatctcggctcactgcgacctctgcctcccgggttcaagtgattcttctgcctcagcctcccaagtagctgggattacaggtacgtgccaccatgccaggctaatttttgtatttttagtagagatgggatttcaccatgttggccaggcttgtctcaaactcctgacctcaggtgatccacctgcctcagcctcccaaagtgctgggattatgggtgcgagccaccatgcccagtcctggctaatttttaaaaaacatttttttgtagagactgagtcttgctacgttgcccaggctggtctcaaactcctgggctcaaggggtccacttgccttggcctcccaaagtgctggaattacaggcatgagccactgtgcccggcctaaaaacagtaacttttaaaaatacttctccaaatgggcaagtaactcccaaatctcttctcctgccccagcttccctggctccaggcccatacattgaactgcatatggaacagttctcttctagatgacctgcgggcatcttcatcttagtatgtccaaattcattactttctttcccaccccatccattcttcttcctggctacactctatcagcgaatgactacatatatcacccactgtgtcatcttagccaggaatccaggcagtttctggattccttccatcctgtctctggatagctaaccagtcatttcattgtactccttagattgctctcaaatcaccaccccttccttcatctctactcaactccagttcaagccctcatcatctcttgcttgggttgtcatgatggcttccaaaatggtccctttgtcggtgcttctagttgacctcatttctcctcttccttccttttggctctatgcttcagtgctgtcaaattgctttcacttttttaaaaaagagttttccattttaatttctgagacacatgacacatctttgtcaatgttaggtctgggaaagtttctattaacttcacaagacagaaaggacccttctctccagcagtgaaaaattcaaaagaagagagcttcagggagttcagttgctacccagcagaagcttcaatttctaacaaaactgtgaagtttcaaataatgaaggggaacttcaccccaagatggtactcacttaggaacattattttccttcagctttcccttgaaatattcaacagcttttttttttttcgagacagggtcttgctctgttgcccaggctggagggcagtggcatgatcttggctcactgcaacctctgcctcccaggttcaagcgattctcctgcctcagcctccctagtagctgggactacaggcatgcaccaccacgcatggctaatttttgtatttttagtagagacagagtttcaccatgttagccaggctggtctcgaactcctgacctcaggtgatctgcctgtctgggcctctcaaagtgctgggattacaggtgtgagccaccgcgcctggcctcaacaactttcttctccccattaggattacctccattgtgggctcttttcgagggaggaggcactgcattctcactcccagtctaaagctgctttcccttctcggtgatgttttctgcttccatgcctttgtacatgctgtgtctgttctattgattttccttttcccatctcctgtgtatggcaaactcccacttgtttttcatgattctgctcaagtgttctttcctgtatgaagcccaagctgtccacttggagagacatctggccagccccccgttgttccagccatccccagttcaggcatcagacatgtggtgaagaagccatcctagatgcccagccccagctaccatctgatgcaaccacactgctcaccccgagcaagaactgcctgcaggagcctagtattatcctctctcacagaaccatggcagggaataataaattgttgtttgaagccactctgttttgtggtggtttgttaggcggcaataggaaactagaacaccatagcttttttttttttttttttttttagaaaataacttgatattcataagcacagctttttaagctgcttttattatttttccctttatacgagtgcattctgcaacataaggagatttctatctcagccctgaacaagatttatgatcttgatcaagtctctttataataatgtcacagaactttacttgcttcaattctaatatgaaggattgaactagttaatcactaaggtccactctagttccaaaattgtggcattctcttctaactatcagggaaaaattgacttattctttgttaagttgtagcttgcagtaaagttttttgggcatgagaattttcagcaaggtggtgagtgccaggaaagtgctgactcagcacaatgctgtctgttagccaggaacaaaaatgaggagcaaccataaatttaatcctttagctccttctccctgcaaaattcagaagatgttttatctgtaacaaaagacttgaaagaggattctcactttttcccttaaaagttgttactcaagtctgtaggtaacttcaggatttttgacagaagattcagatttgcatagttgactcagtctccggaagatccctacactcaaattctaagtttagggcaagtgaactgagtgattcctagaggaaataaactctcgcctgagaacaacagctgaaataaaatcccataagccaggaaaacagccacacaattacagtaacaggtggtcagtttcaaaacaaatttcaaggtctgactcgcctggcacctgctctagaaccacagacagcagtttgacactgtctgggtccaagttaggtcatccctgccacaccataaggaagattaactacctttattagcagagctaagtcatggtaggttagaggactgcttctctgtggtagtaacccctgtgttccctgtctgagaagagggaataagagagaatttgggaactggacaggaccttgcagattaaccattaggttggtgcagaagtaattgcagtttttgtccttaaaagtaatggcaaagtgaagccgaggggagctaagcagagatttgctcagaatcacatgacctgtagaagcagaacatccccacccccattttattgtgaaaaaattcaaacacacagcaaagttgaaaggatttttacaagacacagctgtatatgcatttcctggattctactgttaatattttattaaacttgtttattttctaactatccctctatccatccttctatcaccttatttcctggatgcctttcgaagtgaattgcagacatctgtactccttcccctaaagcagcatagtgttttatcatcatttaataatttaatacctcaattttgtatacattatggaaccaggaaacattataagaaatcactggaccccaaaaatgttaattagccttggctagcctgaaagagaacacaatttcctaaggtcctaactttaaggcacttgaggattcttactaagggcaaattcctgagatgacagaaatactagtcaacacacatcaatgcctatgtttttccctcctcctggaatcctgtgctttccccttcctgctccacctgttgaaatcctctcttcattcgtccaagaatgatctcagatgtctgcaaggaacataaaccactgttacacacgtattgttttaaggaaaaaagttactgaagaagtctgaactgtcacctccttcccaatccctttcctaaaccccgagttttaacttttctcattttaatgcccataaactttcattgctatttttcctccctcattctaccttgttgcagtttagtgtttatttgtttgtttatcacgactactgctcctcctcctaataatacttatggttaatttctttttaagggactatatcttaagactatgtgtcttctgcagttctttgcatagagtcaacgttgaaggacaagcaacttcaaatttccaagcaacaaaattatgttcgggtggttttctgaaagcgagatcttaagaaccacctgtatcagaatcccatgaagagcttgtttagtgtgcaaatttacagattgtcccccctcagaaatgctcatttaggagttcctgtcctttgcggggacatggatgaagctggaaaccatcattctcagcaaactaacacaggaacagaaaaccaaacactgcatgttctcactcaaaagtgggagttgaacaatgagaacacatggacacagggaggggaacgtcacacaccagggcctgtcgggggtgggaggtaaggggagggagaggattaggacaaatacctaatgcatgtggggcttaaaacctagatgatgggttgataggtgcagcaaaccaccatggacatgtatacctatgtaacaaacttgcatgttcagtacatgtatcccagaacttaaagtaaaatataaaacaataataaaaaggaaatgctcattcaggagttttggggtgggggttcaggaggctgcagccttaacaattacctctggtgattttgacacaggtagcacagcagccaaacttggagagatttgttcacagcactgcatcaccaaccttactttctgttaggcctttaatcactttttttttttttttttttttttttttctgagacagggtcttgctctatcacccaggctggagtacagtggcacgatcttggctcactgcaatctctgtatcctgggttcaagcaatcctctctgccttggcctcctgagtagctgggaccacagacatgctccattatgcccaactaattaaaaacattttttttagaggcaggctggtctcgaactcctgagctcaagcaatctgcctgcctcggcctcccaaagtgctgggattacaggtgtgagccactgcgcccggccttttaatcacttttaaaccagcaaccctaatctgcctgtcccttgaatggatccggataaaggtgtggcaaacaagcctcctgtcacagtggggtgtgacagtcacggcatcaccccttcaccacatcatgtgctgccagtcatcacttctgctgttgccaccaacccttgcgtttccctttgtcacttcccccttgccaccaccaacggccactgtccctctgctcctcaccctccatagctgagtcagatccagcattgggcacttgaggaagaagccactgtggaaggcgggatgagggtgttcccattctacattcacaagcccacagcttggagaagaagcacacctaattctgaccctggcttctgaagaagctctgcaaacctggctagaaagttgggcctgtggtttgaggttcctgctgcctttgattttacaatgagtggaaattgaggttgagtaacaggtctcttgcccaagtattaagggccaccacgaagcatacagcaatgaaggcaggagctgatgacatgtggttggttcccccctctaggccaagtatctttgtatagggaaggccgacatggccatcttcacggtttggtattagtggagtgtcttatacatactgaaatttgtttttgttttcaggtgctaaaaggataataccaaggaaaactatgggtgggggcagtgaatggccagcatgcctataatcccagcacttgaagccaggagttcgagaccagcctgggaaacaaagcaagaccctgtgtctaaaaaaatttttttaaaaataagctgggcatggtggcacgtgcctatagtcccagctactcagctactcgggagaccaaggtgggtggatagcttgagcctaggaatttggggctgcagtgagctatgattgcaccactgcgctccagcgtgagtgacagagtgagatcctgtctctttaaaagaaaaaactatgattcaaagtgttgttttatgaagcataacctgctttatgttttgagtttaatataacttgaaatcagtttctctaagacagtgccagccttgccatttttcagttcaacatagatttctctattacagtggttcccaaactttaggaggcatcaaagtcatctggagggcacaaaaacacaaatttatggatgtcacccacagttcctaattctctctctctctctcttttttttttgagatggagtcttgctctgttgcccaggctggagcacagtggtgtgatttcggctcacttcaacctccgcctcctgggttcaagtgcttctcctgcctcagcctcccgagtagctgggattacaggcttgcgccaccacaccaggctaatttttgtattttagtagatatggggtttcatcatgttgttcaggttggtcttgaacccctgacctcaagtgatccacccacctcggcctcccaaagccctgggattacaggcgtgagccaccatgcctggcctgtttctgattctctaggtctggaaaggggcccaataattttcacttctaacaagtggcaggatgctgctgctgctgctggtccagggaccacactttgagaagtatggtactgtgtggtacttaccggaccatttaccatacttcctgcctgcctaattgtgtcacaatatagccgtgcttctcaggcctagcaattcattagaattacctgtgaagcttttaaaatgtaaggtttggatggaatgctcagaccctaccttagacccaattaagcccacagctttgagggtgaggcttgggtattgttcagaaagatccccaggtgattctaatggataccgagggttgagaaccacaggcatatagcaaactctggccctattctaccttaacatatgattctcatttgacaaatacatattgaccacctaatatatgtcttgaaaatgataaagtatgtaagaaatggtccctgacctcaagcagagatacatcatatgcccaaatatttaaacaaaaagctggtgtgtggggtttgtgccaattagaggactaaaccattactgaaaacagaaggctggatgattcagggtaaatcaatgctgcacttgatcctcacattgtttgagataagttatgtatgcctctgctgcacatgaaacgtatccctttggtgggggaaattgctcatttattggttcgttgaggatgttccaactgattcaccatggtaggtgtgattgaaccatggaaatgatggaacattaaatcaatagctagtcagctggtgactattccttggctaagtatgctattaaggttctgtttcagaagtccctgtgctcaatggaggtgaacctttccagtggagaaatacaacatgaattatgtttagaaaatgcttcaatctggggttttaaataaacagtccttaaatatgtataaaaatctgaaattattttagaatcgaagggaaaaaacaaccgggtccaaaaaccaaaccatatttagcttaaaaacacgttcttatttgcatccactagaatacaatataatttaatgattcaatgacagctggcccatgaagggcagagtttctagaaaggaggaaataccctctttgggtgttacttaggtattaagtgtattatttaattcattgttttatttaatttggttatatcttttttttttgagattttgttttcatgttgggtgggtagtttttctaagaataagaaatcccaatgacaacaaaatgtcattgtttttaagagaaggagataaatacattttaaactgttatatttatttattttcaaaaaatgctggaggcatcatgttagcaattgcaggggataacatgaatatgacaaagctgctctcaaaaaacttaccactttgtagaagggaaagctaagtgcctattccaagcaaaatatgatatgatacatgcctttagagaggagtaaattttaatgaggcttcaaagagctggaagaagaggtcaaggttcaaagagcctaagataaggcacagaactggggttctggtacaatgcattacagcatggccaattttcaaaggccagctgttcccagtcaaacgaagatgaagctgagggcaggtgcaatcaatgggaaaatcaggccaccctctcctattttcccatagatgcagtttcatgatcaatagttttataatctcattttgggtagcaaaatgaaaatgaatctgaagcattctttctagtttatttcacactaataaaatccaacctgaaggattttatatgttggctctatggccgttagtatttgattaaggtgtttagcctcattagtaatcaaaggaatgaaaactagaataaaaattcagtcattgtttttggtttatcaaattgataaagacttaaaatggccaccaagcattggggaggttaggagtgataggctctctccttctatctatggaatattccttggctcaccatggctggagaacaatccacatccaatagctcatcaagtctacttccaggaatgtattccagaggaatagtatggacctatgcaaaaacttgtgtacaaaattattcctcagagctttgcttattattgggaagaatgagtaaagaaataaatgcccggccaggcgcggtggctcatgcctgtaatctcagcactttgggagccaaggcgggtagatcacctgaagtcaggagttcgagaccagactggccaacatggtgaaaccccttctctactaaaaatacaaaaattagctgggcgtggtggcaggaatctgtaatcccagctactcaggaggctgaggcaggagaatctcttgaacctgggaggtggaagttgcagtgggccgagattgtgtcattgcactgcagcctgggtgacaagagcgaaacttcgtctaaaaaaaaaagaaaaaaaaaaaagaaagaaagaaatgccccgaaacaggttaataaatttaaaagtattatgccaggaagggaacagtagcagtccactatgcctagaaactaagcctagtaacttagaaaaaaaaatcttccaagtgttttaggtaagttagtattaataattctacccaaggtcaatcccctcccctccatttcctcctcttcagatattctgtgcttctgccaaataggacaacttgctatttgtgtcctgaactgaccttatacactttcttgcctctctgcctttgctcgtgctttcccactgtctcaatggctttccttaatctctgaggtctcacctcttcaagacccaattgtgtaagccaccttacataatgttattatgatgtcccccttcctcatccagccagaaggatttacttccttctctgtatgctcatagcaatttgttcattttctattcttctcacccttgtcctgtgttagagttaccgaaatatatgtatatgtgtgtgtatatattttttgtcttgttttgttcctgttagattttgaacaacttgagggcaggggccaatcttgttcagatttataccccccagagttataaagcatgctgtgaaaatgattgttgactgaataagcgagtgagtgaatgcaaaagtacacttggagccaaatgcttatattctctgcagacatggaataaacttgacaagtgctaaagatgctctttgatttttgtgtggcatgagacctcaggctgaaacttctcatctgagccattgaagggagcctctcatctctccaccgagaggggagaccagaatgctctgtttctggcaggaatctgacaccacttactccttgggtagaaactcccccaagtctgaactatgtgattgcctgagccctgcttcttgttcattaagactgctcctctgaaacggaattgatgaatttttagtggctattagaagcatttgggatccataggcatcagggtttgatgcatggccctcatctctgtgggctcctgtgcaatgattctcatctgtcttagttagaaagtgaattaatcttgaccttggcctcaggggtgtggttctctgccctcttacacatcttcaattcgcttctttatcagaagcacttgttttaggcccaggctcccccaattttaatgacatttagacatttgtctttaagttacattgctttgattttaatcaaaatctatatttctagtattatatgtttccagaaagttctcattctggattgtaatttaattacatggatcattaaagctttgaaggatgctaatgggcagaaaaaagagacttaacaaaacgaaagttattattaggaattacaaatcacttaacatttcaacatcactcgtcggatgtgggcattttgttgaaagagaccttgttttgaacagtgacagtgcagaagacctatggaagaaacaagcttccaacttgatttctattgttatgcatgcatagcaaattattaattctattctaatagggtaatagatttagaaatactattagcagaaaacttgatgtattaggcaatactacataccacattagtctaaccgctcaactgtaatttttcatccatactttcttgggatgtaaataaaattgatattatacaatgaaaataaaattgcccactagtcttgcttattctcttggtgggctgaagagttaaactgtggtgaatgctgttagataggaaggtaatgaaaacttcagttagcttaggattattcttaccagcaagcattagttaaaagttaaatttagcaagtggttacccaaatgttaaaggcatttaaactggctgggcacagtgagtggctcacgcctgtaatcctagcactttgggaggccgaggcgggtggatcatatgaagtcgggagttcaagaccagcctggacaacatggtgaaaccccgtctctactaaaaatacaaaaaattagctaggcgtggtggcaggcgcctgtaatccagctacttgggaggctgaggcaggagaatcacttgaacctgggaggcagaggttgcggtgagtcgagattgtgccactgcactccagcctgggcaacagagtgagactccctctcaaaaaaaaaagtatttgaaccattctttctgtgctgcataaggtattaataataaaacattacatgactgcatgtataattctacctaattgaattgagttttcaaattattttttgtgtgtgtcttagacagtggcgcattgaaagtactgcctgtccaaaatcaggaacagaaaagtatttcaattactcagaaagtagacatggctggaaaatcataagtaagtggttattaatgtcaagtttaaagctctcaggctcttctgtcaggccacgcagggcaaatgagatcaacaggatggtttcttgtttttttttgagacggagtcttgctcattgcccaggctggagtgagagcagcggcacggtctcggctcactgaaacctcctccgcctcctgggttcaagcaattctcctgcctcagcctcctaagcagctgggattataggcaagagccaccacgcccgactaatttttatatttttagtagagatggggtttcaccatgttggccaggctggtcttgaactcctggtctaaagtgatccacccttcttggcctctcaaagtgctgaggttataggcgtgagtcactgtgcctggcccaacagaatggtttctaataaaaatatttattaccattgcatcctaccccattcccactcagtgtgccccttacttaaatggccgccttcacccaggccactacagggagggcactgacttggaaggacagaacactcaccactacctagccttcaccctggtcatcagttgcacttgatatggctatagctggtatatttctataatgatgggaatcatagaaattgttagtattgagttgcaagtcattggtaatgttttccaaggaatgaccaagttctgtgataatatatgcacagacaggaaaaaatacaaataaatttaacagcacatataaaaatactatcaccttatactgttcattttgtgccatccaggcatgtaagggagagagaaataagataaatttgctggtgggagaagcaagcaaatagagagaagtttagaggcaaagaatttgggaggggctggtgaaaaagaaggggaaggaggaagtacaacc

SEQ ID NO: 179 - DNA, 1637 bp, Homo Sapiens
atgcgcagccctcgctctcgcacgcaactcgtggccacctagcctagaggcggctgccaagcgtcctggctgagggatggcgggaccccaggcggctggagtggagaaagttgaccgcccccgtcttttctgccccgtgggtggctactgcgtgcccccaagtaacccagaggttgagggccccccagtgcgcggcggccgggggtcaggatgcgggactcccctccaccgccatgatctcgcagtgtgggggagcgctcggggacagaaatgaggcccgagatgtgtgccttctccttgctcctgaccgctgacttcgttattccaaatacgcagccgaaaccatcgctcttgcaggtgcagcttttctctgcctctcctatgtggaaagcagcgcagcgtggactccagccaaactccctcgattggattgcagctctctggctctctgtccctgtgaccttgggcagtttacctcctctatgtctcagtttcctcagctgtgcaaaggggttactgatcctgcttaatggggtgggttgttgtgaagaggaaatgagttaacataagtagagaaagagactggtgcctggcaagcactatgtgagtgttttgatgttattattgctgtttttattagagctgtgtgtaacgggacgtttaatgagccttttcctgttaccctggaattagtgagtcagggcacaaaggtgagtacccagaggcattcagtatcccacactgtaaaggcagcacaacatggcagcacccagagcttattgttagagggctgaagagccagccctgccattctgaaccaccaccaccctaccctcaggcttacataactggacaacgggggagggatggggcgggaggaagggtaagagtttccctaagcagcttcctgggtgcagaaatagggagggtgcggtgctattactaaagccaacagggtgtagctcaaagagagttaccataatgacttcagatgcctaaaaaagagaggctggcatcttccctgattggatgtctgcttggacagtgtgagcttgctagactgcctttatacctggctttgaagaaatctagaaaactcagagacctctgggcaagggtcttcagggggcttccctgtcattgcttgtgctgtccaatgccagaccacatccactaggcaagaggctgtggagcaaacagcaatagggagtaacactgatggcaaagctagttggagttgggagtgaaggaggttgagctagagctcgtttcccatatcagaacactctatactgaagataccctgcagagcctttggaaaaacttacatgaactccccatgaaagaaggtcagtggggctgggcgcggtggctcatgcctgtaatcccaacacttcaggaggccaaggcgggcagattacgaggtcaggagttcgagaccagcctgaccaacatggtagaaccccgtctctactaaaaatacaaaaattagccaggcgtggtggcacttgcctgtaatcccatctactcaggaggctgaggcaggagaattgcttgaacccaggaggcagaggttgcagtgagccgagatcacaccactgcactccagcctgggtgacagagcgagactccgtctc

SEQ ID NO: 180 - DNA, 2839 bp, Homo Sapiens
agatcagcagcaacacctagccaacccacagcttacttacagcagacatgtgaatcaatctagccaagactaaaagaatcactaaaccaatatgtcatcctatgaataatagtaaacgtttgtcttaaactatcatattataggaaaaaaacctgatatatgaaattaccctgtgagtttatattaaagatacacttaccttctccaacaagagttgtaacaatttttttcttattgcaaacaatgctatggggatacttatagtagcatttctgctcaacgtaatattttattgtagcactgtttgcaataagaaaataattggaaactgcagaaacgatcactaatgaggtatgggttaaaaatcttttaagttgaaagcaacaaatgtgacaattaaaaggcataaattagacatatattttacattatcacaacttgtattactaaatgataaaaatgagttgcaaaataatatatagaactttatattttataaatatgcacatgaaaaaatgtttgtaagtatgcacaaactgttaacagttattacttcagaggagtgaaaaataggttgaaaatgagaatgactttcatttttagtatacttaagtacattttcaattttcaattatatgcagtgattttgtcctttaaaaaataggatggacttttttaaatataaggaagacattttctgtgaaacaataaattactcagtatatacttaatgtgcatgaagtatgaggtaggaatacatccactgacattcttgcatttgcataccacttccccaaatatgaactcacttctctgactttgctagggctgaggaatcatcattacaatatctgtaaaactggatttattaagtgcatccatattgtttatgagtcatagaaaatatgttcattttcctatccatgttaaaggctgcttggaggattgacggagcattgcttagaaaatgttctggaattcagatgaagctgtgttagtataaatcattactggttaccatatactcacacatacttaggggataaagatcagaaattacttaaatgtactttgtcttcttcaatctttccgtagcagcacatgggtcaaaatctcctgaaagttgagcaggggagctgtagaagaattcctccttttctcgcagatgaaatcttatgatatagcaggggttacctggccaagaaggtaagtctgtcatccagcagtgcttgcagagggactaaaatgaattaggatgttcagagttgtatgttaggtgctgcagaaaggaagaaaagatctcatccataaaggggtctttgaccctggggaatggcagttggcaattacgctgcttctcagttccatcctgtgttgccccaggtttacttcatggtcacccaaactttctttgccatgtcttttgtaagacttctacttattactatgtatcatcatcttttggtaaatataaattctggctaggagaactaggacagacaggggagctgtctgcacactgtgattaggcatgcatcaattcagagctccatgctgctagctcctgtattctgctgagctcccagggaggaaataggaaaagggaggagaactcacctgtccaattacaacctactctgcagtacaaagtactgcaaattccacacagtggatctctgtgattgaaggagcacttgtaaaatctgagacatcctagtttttgatttggtatccaaaacaaatctgaacttttaattaaatattgttctttttccttcttgtttccaaatgaatagttacaccagcaaacttattggctgaaaagttgtttcctacatttgcactttgaagtgcatcagacagtggtgtgtttggatgtgggtcttgttgagtttggttagtgagttattattggttgggattgcagtggtcctgccaatggaagagaagtaggtgtgccgagtactgtcatgttcacctccgcctttcacagaggcatatttagccctcagttggtaagtgaactttttgacaaaggtttaagaggtcgtagagtctgtgtaaaagacaaaagtccaaaagtgaagcagaaggaatccagcttcttatttatgtctggcatgggaagcttctggatttgatagtgggtgcaccgaaatttgcatcccaagtcatagcctttgctctgccctaccttctggtatgttgtttttcaagttacttaacctctcagggctgcaacttacttatttgaaaaatgaattctagaatcacagagttggatacaatcttaagggccaattagtcaaactttctttccagaggtattctgcatgatctgaaatgtgtctctgaactatagcttcctgaaatttcattattcttgtaggaacacagaggagaacaaagaaaattcaaggaactaaattccttctccacctcaaccaccagcattgatactccatcacttatgtactgcatcaagccgtcctcagaggtgaggaaggtgctgtcaagactagaagcatgtgtccctctctccattgcaagatgggacatagagaggagaaaagtggcagacagaagtcttaggtatgtctttatcagcagcatgaaaatggactaatacagggaccaatgattgcatctacctcatggactttttatgagaattgactgatttaataaatgtaaaagacttagaacactgcctcatctattgtaaacagtcaataaatattagtatcaattttcattgaatcctaatcagtataactataatgttacattcatgaataagacaaaggctgggacaaaataaatgagacacttcactcag

SEQ ID NO: 181 - DNA, 23424 bp, Homo Sapiens
atgggaaagatctaccttctggaagctactactacgtggtgcttggaaaggtgaggatgggggactgaccccaggaaattgctcgaaactccgcatctggtgggatttccagaaaagtcagtgggagacgggaggtttggaggccccgggttagaaaggtttgtcagtctagggaatgaggagaatcagaataaaactagggcagcaggctgtccgcctttggttgggggagggaggcctcgaaaaatcagggtcccggctctctaacctgtctttgtcgcaggtctcacgtttgtggggagggggtttaccaagccctgcgccatgcgcagtggcccccacccgtgactgcgcatctggaagcgcagtgcgccctgggtctctggcctaggacgagcaccgcccttcttattacataactgagggcatggcacgcgccttctcggcccttccttgcaaccctaccttcttgctccccagggcccatagagctggggagggtctgactgggtagcagtgaaggactgcaatccctgggagggctaactcttgtctagttactggcaggagccaagcttgaggacaaaagtggtggttttctagcctcatcttggggaagaggctacagaacatccttctgagtgccccataccacctatggcccctagggcctctctggtggagggggtggcacccttctttcactcatgtcccatctgatttttgagaggatgtttctgaaggaaaagatgtgatgattatcgggggcttggttgggaggtagttttgacagtttactccccttgtcactggcttcccctcttttccctgggtgggtttatgatctttctggactcctctgatgagctgccattttggagccatttctgctggtctccgacatggtggcgttggtttttctgtcctgctgtgccagttccgcagagtgggcggggggcgggggctatgacggaggaggggaagggggggcaaaagcacagcagaggcaggcacagtggtggctgccgcaatgaaggtggctctaggggcagagccgcctagtcccacccttggacacagtcctgggtggggattcaggtggaaggcgtctgggtaggggttcaacacctgggcccggctttgccagagcgtgggtttcccatgtcctcatcagcctggtgcttggagtagttcggaaaagctgagtgtctgaatgagagtggaggcagaggctcggcagctcatctcagacgtgtcagacccgtggtttgtgttccccaaataggctctgtctccagcagcctccctgtggggacagggaagtgaggtccatggcagctttgaggatctgttcggatggtcctgcctgcttactgtttttcttctctttctcctccatgccccctgccagtgccatggttccagctgtagtcctcttgtgaggctccccgctgcccgttccccctctctccaggcccttctgcgtgcagcggccatcttgtctttcttgctcagaaacttaaaatggtttctcataattcccagagtaaaattccttccctttagcgtgatgctcaatgctggccgtaactggccttaggtttcctgtacagtcttacctctctcagtttcttttggtggaccataggttccaacaaaaccaggcaacttccttttcctatctgttttcaccagtgatgttttccatgcctcttctcctctgcatccacctgtggcagtctcactttctccgtggacctctcctgatttccttggcaagaagcagttctcataaccacccctgccctttcagccaaacttccatacagtctgtccctttttatggtacttttgttgtgttatgattatttgtgtataagtcttatgtcacctatcagattgggagctccaggagggaggctagagaaaggagaaggaaaacaaatacctatttggtgccttctgtttgacagataccatgttatacactttccctgcagttacttcatttactcctttccacagccctgtggggagcatcccatgtctagtaagtggcctggtcatgactagagccctggtcttccaaagcctttacatttttcctctctgaattactggtgtttacaagatggctgttatgaagtagatccccaaaatttgtctatttaaggaattttgtaagtccctaatgctctgagggagtttgggtggtcaatcttgtgtccatggtctgggtccctcagctgttccttgacactgtcattaactttctcctcttcctttgtggtcaggttcactcaagatgatggcttttttcttgtagctgaaattgatggattaactgactcagttatcctggttgccttcctcgtacaagaggagggagaggtggagtgggatacagcatcttcaaagccagaataagctccagaattagagagcagggagcagagacactggacttgaacagacctaggttttcattgtgatccttcttcttagctgagtgactttagacaagtcatatgatttaagttttcagtgagatggagctactacaactgttatacagaaatgcctaatatattggcagcaaataggttcccatccctacccagtggtttatcagggacttaaaatgggagcatagcagggggctagagaagaaatgggggagacaggagctcctgtgccctaagtggtatcacagcaggggcgcagaggaggtaacctaggcgttacgcccttcaagcctgcaaggtgtactgtcccccacctgccataaatacccctttacttctgcatcaggaacatgccatggcatctgagtggtgggggctggtgacggcagagggagggtcagtgagctttcctgggagccttttgatgccaggttagtttcccttctttctgaatctcagcagtggctgcctgcttccctgacgctgctgagtcccacgggaggggagctgggcaccctgaagcccctcgttaccaattcgggggccgcggagcagagtgtgacgacagccagtgagtcgtcagtcgacggcaatggggaccctggtgacggctgctttgttgttttttttcctctttggaagatgactcagtgtatcgggagccgggagatggagctctcagcagagtggccaggatgttctgtcaacatgaaagctacaaaaacagctcggggctctgagctgatccttagcctggggtcattttcagggagggctggacagagaaggcggccaccgcccgggcatcaggatgggagcgacaccagaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtgctgttgagccaccaatttttgtggttttgtgaccacaagtgctgactgatgcgacatgaccccagtcttgtcagtgaatcatcaccaggctgcttactggaaactggatgcagcaaggaaataggatttaaccgctctctgcctcccaggtaagtccagtgtgggctgctccctccagccttcccccatcctccttccttcccacgaacaccattttccttattccgccggggaatcctcagacgtctccattcagaatctcccaaacgattgttctcttttttgcattcttctccttctggcttttctgtgtggggttagtaaccagcacagggttgggggcagaatgggcagctgaagtggtcgggctgtgcggacgtgtgggagatagctgggtagtgttgctgggtgtggcagttggcagagcatttgggcctcccacagtaatagaaactctctttggctccagcatccagcaggaggttctgggtttaacccctcggtaatcctgggagccttcctggtgcctggggattctctcccctgtgtagtctcagtggatggcctgtcttaactctagatacattttgccttgagggggcttagtctaggttggtggtctggagtttggactgggctgagcagtgagctttgggactctccctaattttggggtttctttgaatgagccactttcttcctctaggccttcattacctttgccttaaaaaacaaaatccctggtccagtaagccattgcaaagcatctctaggaagttgacaaagaaatgcttttcttctgcctcacttgctgccgatcacagtaatagcaatggtgattaaaaatgaaaaatgatgacggcctgcagaatcagggaggtcagtggcatcattgatacaattcacaaagcagactctcggtgcccacacatcactaggaagtctctctcctatcgagtagatgactacagcattcttggccagtaaagccagttggaattagccaacagcagattggtctgggctctaaagataaaaggaattatgttgggtaattttcggaggtacctatgggatcctacctctggccacacagtggtcgcctctctctgctcatatgtttcggtgggggtggggggttcctcttccccatgctgctcccgttgctatccagggaagattggccaattctgcttcctgttatttcttcttctcctctgtccatttgaggtgagtctctaggttggctgtgaacagcctgaggaacccagggctgtttggaagaatctgatgtctcttccttcaaggaccctgacaggtctcagccctccagcagtactgcagtgagggatggcagggggtgttggagtggagagatatcgacttgggtgcagctggggagactaaaaggagtgagccaagtccctcaagaagtgttggctagagtctggccagccctggctgtagggctggagccagacgtagctgctggctgtgcttgggagtctcagccctcatatgtgcagtgtgtccctgggcatggctcttcgtgatccccactcccacgaatagccctgtccttggttagattgggaaaaccagggtgggaagtaaaggggaggttggttttgctcgtggtcatgcagttatctctctggcctctgatgtttccagaattgggattggtgcttccctgctgattttcctatttttgtccctcatctggttcttttcctccttgctcaccagcctgggttctacacacatgacatggggcattgtgtgttcccaatgaggatagcagaacagttggtatctcctgagagaggggccagcatatctggcacttttttcttgacctttgaatttctgaggtctgggagtcaggaggcagcatggggcctctccatccgggatccagcagaggttaacagagttggtggctctggagctgaggtggtgtggcttggctgggagttgtgggggagaggccctgccaggggccctgattggtcagtaccttctctattccattgaatcctggtccggtcagctctgtgaattgtttaatgcatatcttggctctgtcccctggctcgagtgtccctaaggctgcagccacagctttagagaggatctgtaccttgtgctggtcactttttttgggcgtgttacctccctctgagatatgtaagagataccaccctttcccaccagccggctgtctgtgggaggccctcattttgctttgcttttctgagacttggagtgactgtgaggaaagcatggactgagtttgctttcttgctggttccttccacaagagctgctcatgggctgataaagccagagaacacctccagggccccatggcctgtgcggagcctggtaccatagtgtcaagcctacagggatggactggggacatgggggcagatagagccacgtggggaggtggtatgtgtggttagatcacaggagcaagtccaggagggtgtgggaggacaagtccagtgctcagccagggctgcctgtcatggcccaggatggatgtgtgcatctcctgtgaaggatttgcgtctgagtgcctggtactgaaggtaggatggtgccccgatcagggtctataatgaggcatgaaggtatgagatgggcatcagagttgttggtccaagggaaactgacctttttaaagggctctcctctccttatctgatttcatcctcagaacaaccatatgacatagggatcacttcccttttatagttaaagaaacagattaagtgacttaacccaaggttatgcatttggtaagtgaggttgttgagatttaaatgcatgcacttcttattccaaagcctctacgttatctttactcttttgggctgaagtcagacatttttgtgaactaagattctcagaggactgatgtgaaccagagtgaaaaggcagacacccgaaggaactttccagtcactggggacggttgtgccgcattcctttagggggaggcagggcagacccaaatgccctttggtagccatggacaggcagagctgagtaaggccagtacatggcgtctgctgctgtgtacggagcctctgctatgtgccagggactgtgccaggcgctagagatacagaacttgacaaagccaactttccactttcatggggcatacattctagtgtggagagacaccgctaataatgatttttaaaaagaatttaaaaatgtacagggtagacatatatggagattgtgtggggatgaaaagggggaccccccacacacataaggaggagaattcagatgatggtcagagggttctagagacttaggacctcagccatctgaagccacatcaattgagctttccttcagggagttaggactgacacaaactaaccccctcttttttcctaataacttgggaaatccatccaaggtccccatggcttacaggaacttgtcgtgagtcagggatcaaggtggagtagatgtcaagcctttggtctccggcagactggttctctcctgtctgccatggttgctgttggccttctgcctcacaccctcccaggcaccagctgacttctttcctcagcctggtcactgtgccccacacttgtccatgcagcacagggaaacgtgcaggttaggtctttgccgagccattggtcaaatgttcctgcaggaggctggttctgaactcagcctgtcctgccagaacgagccgttcccagagctaatcgtctcacgatagggaagggatgggcaccaggcatagagaagtgacctgtgccagatgcttggttgagctgtgtcttgagaggcggaggcaggttggtggtgctggggacagggcaggcatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaagttgcacagggatgaggtagtgtagttgggggtgctcagggaggaggagggtcaggaaagtggggtttgtgttgctctgtgttgagtcagccgaccctgattctggtcctagctcttgttggtaaaaactcactcactttcctcctttcagctccagtttcattatctatgaaatgaggggatggaaccagaatctctttggaggttccagctgtatcctggggcctccctgaatgttcatggagatgttccttagccagtaattcaagatgaggaaaactaggcccaggtttccacaagagaaggggagggatcttgatgacctgtctcagagcggctgaagtggtactgttggaattagggtgggtgggtgggaggaggtagtttttaaagacctcccagaagtggaagcagagggctggaggtttcgtgaaggtgttgatgaggatccaccgggtggtaggggacatggctacgcgcttcccccgggaggcttgttggagatgggtttatgtgggagctgctgggggtgcctgctgtcctgcaaggggctgacccaagggaccctgctctaggaaagatgctccgtcctgtctggccctaaaccctggagagagaatgcagctgtggtttgagggagggtctgtgccccttgctgtcaggaagttttcctttatatttagccttctcttttcatgtattttttgaggccctcgactaaaaaattaaatttaattttaaaaaataacaatgaaaaaaataaaaaataaacaaaaatatctcagagccactggttccattttggctttttagtcttgagtcactcttaaaaagatagcaaaataaaacacatgcaggaaagccgaaggtcccaggcccagccagatgggggctaggagtggctgggactctggcctagcttctccatggcagcgttagtcccagacgtacaccacttctgcaaggctgtgtgggtaggagcccctggggctgagggggcacattgtgcaatctgctaagcagaatgtagagttttaaaatagctacctttctccaagacactatctgcttgccgctttgtgggatgtttacctgggattaataatagctgagtgccaccccactgccagtatggaatagcaaacagcgatctgggctaggactcaggcaggagaggaatggagtaataaccatcgtatcagctcacatagttcttttcatacttgctggctcatttggtcctcacacaaccctgagagggtaggtggtcttatccttgtcgttggtaaaactgaacctgagagtcaatcctgccaagatctgactgcttgtagccgcttctcgtgggtctcccatctaggtcctctgacttcagctgttatttctctgggttctgactagtggggcagggacaggagtaggggagtggagtctttggcagtttccttaatttctgaaggccttagagggcctagagatgccttttctatgtgttgaatgggaaacggaacctcagcatgtccaggttctccaactctctgattcttcagacttcttggagctcttgtgagaactggcttgcactttttggctgggaagccagccactcaccatgtgttcttggagaggtttcctgtatttggaagcttctggaatatgtgatgcatcaaaccactgtgacacatctgtatggcacctcatgcctatgcacacaggcatgcttctgctgagtgcagctcacttagagatgaggcccagtgtagggtttttgaaatttttccaacacatttgtaagagatgccctgagccttgcccagcatgcatgttgtgtgtatgctacctgtttgctggctaatgtacagcgcctgctggaagccttggctaatgtacaatgtaaagtaagggactagaaacactggctttagttctgagtgtctgcttcatgattgacttgaaaaagtagggcttacccacagagagaaaggtgggtaagagaactcgtgggtgtcagttttccttaaaggcagagcataatcccccactctttataagggctggtaaggcagagtattggacagcaggacttcttggccagttagccctcttgagtgacctttgtttaaatagacccagaacttgtatgaaggaggaaataatggtttatctttatttacagcggatttagccatgatggtttaggctttttctgggggtattcctttaggacagttgaggttggacaggggcagcatgcatatgtgtctctaaatgtctgtcctttggtatttcctgaatgcatccttggctcatactgaaaccctgtgatggggaatccacagcggaattgttttagtggataaagccttctgtagcttcatgtgtgaagatttgtcatgttggatccagttcattctgtccacttgaaggatggaaaagagagtgggcagaacttgcagcaaggagagtgatttgggctagacttctgggagaactgtgcatcacctctgctgagggttcctgaggaaagatgaagcctctttatttgaggtaggagactcggtgtcctccacaggatcctcccagtcccaagtctgtggcactttgagacagtccctggaacagcatgaggtttgggtgccaggatctagagcaggcatttctctccatctttcccatctgtcttcaagacaggcccaagctggatgcaattgaggggatgcatgggcagggtacaccaatgtggtcatcgaatctggaactttgaccttgtttccctttgcagagagaacttctggcactgatcttataggaactggtgttatttgcatataaaaaaagagaaaggcatgttgtccctcatcttttccaggaaagagtgctgagctgctctaatcctatggtggggagggaggagggccgtgtagaggacgcaaggccagacatggtttgctgggaagaaggtaggaggtgggagaggaacatcccagggcaggcccacaactctgggagccacagacattgcctgctatactaaaggcaaagggatgtgttcaaataggcctactatttagcggtaacccacagtctgaaataaatcagttaatggctaaatgagagttgtattaaatatggaaaatcatattttttgtgtgtcatcaccacctacagatttagcatcaacaggcctgaaaggctgaggatgctgaaatgggccctgtccgtaagatcatgcttattttataatgactttttgtctcttttcattactatttcccactcttattccttaggtctacgtgaatatttatttatgcagttgtgttatttccttggggtacagttcttccagtgtcattggcatcaatgaatatgtgactttgatttcaagtgtaaacaaaccactggttcacggcagggacaagccatctctgagacaagggctccagcagctgcctacagatgcccttcccccaatagccctggactgtttcggccagacgcctgagacgagagtcaagggtgttcttgcagggacctgcccaacgctatgtcatgtgtcctgcctggagggtggtgctcacacatgcatcttccagccttattagctggtactgcttttcagcttgacccgaggagtggtattggaagtttgagaccgtacatcccttgctaggtgagaagggggtcagagaggtcaggcacagacagagaagggaacgcaggctcctggccactagcctctctcaagacaggtgaactttgtgttaagcgaactcatttaatattttgggcctaatagaagttatttgtattttctctcctctcttttccctcctctctctcactcaccctccccccactccccagcctccaaagaatttaatctgctggacaacaaacaatactgttataaaactttgaaaacaagagggcgcggcctccctgacaaggagaagggcatgttgggtaacggcctgagggagcgtgccaggcctgagatggagccgggcgagagcccagttggctgggtacctgggcgcctgcccctgcatagcccactagccgcgccatccccaggccagaggggaaggaaccaaaacaaaatggggggcagagaaacgcttgaaaagggaagttgcacatgttcccctctctctgatctgatgggaatgcactagactgtgaaacttcctcctccacctcttctcccgagtccctccctccctcttaccctccttcctcctctctcctccctcctttctcctccttcctcctcctgctactcactgttcttgagtctggcagacagaggtcctgatagcagaatgaggctggaatagcaccataggtgcagctaccagctgggccagccaaagaggaaggagagaaagtgggcttgcagttggctttggattcaaatctaccctctgtctggcccagcctccctccattctattagggaagtggaactacatcacgccacagggtgtgcccagtccatgtgtgtggaccaggtgtgtgcccaggtactggggagaactgccactcagagattagttcaggaagcaccctgggcttcctggtgccccccttgggctgtgctctgctctggggagagtgtttgacttgttgaaatgctctctcctttgagatgctgtgctctccctccagggaggagcagaggctgtgctgcaagaggctggggcatgtctctggaggagctcttgggaacaggaacgtgcttctcccagcgagagcagccatgccgtcttgtgagtgtggtgcctggtaggatactgcatctgttagttacttcccagtggctgaaggaagtggtcaccagctctgcctgggggaggtgggggagctgggctttggggcgtctccctccctacctccagagttaggtttcacctgagactgtggtttcacttttgactccatcttcactgagtcaagcagatgatttaggaatgaccagggagcagcattggtggtttgcctttggatctgcattggtttggacccatgaactctgtggtgggcattgtgtttgtgtaatagaccattggtatgctcatttttcctcttgcagaaagcactagctttcttgaaagcagttcagggacatgcccatccttctgtgccagagctgagcccttctactgggggaacatggagacacgcgagctccagtcttcattccactcctcctccttccctttgccctccactgtctcctgctgtccccccagctcatcccaggggcagggtaaccttggtgcatcctcccatccagccagcagtcccgacccagggcccccgtgcctggactgagtctggggtttatgtcagtagtgttaagggagggatggaaaactgaacttttaggagtgcagctgcctaggaacatagacctccatacctctgacgcaggggaaaccagaaaaaccgatgctgggtccacgtaggcttggaaggctgttactttttgccttcttacctgaataggaatttgaggggcactgtgggtttggaggatgtgattcccacactggggctcagggcctgggaaatgcagtggtccctgggttctgagtcctcctttgaaggccaccctgccagaaaggaagagcctgatggaggtttctggggactttgggccagccggtaactccatgctccctctgctccacccttggcccctcatgtgtataccattccttttatcacccttccctctgattcacagcccccaccctgacagctaaagacagaatgcccaggctgctgcctagaatgacaggaagctggactgccctttcagtttatacatgcaatggcctgggactgtctcttgagggcaagacattccccttttacaaaagagccttccccaggcccctctctcaccaagatgagctcttccttgctgccaggagccctgaaatcagcattcccagaggaaagaagatggccatctgggcttggcttccggctccccccatctggctggaacacacatcagtcacgtaagtagctgtgactcagcacccagcactgccttggcagaaccttcccacgttctggatttgcacacactgtggtagcgcagcacaagcaagcagggttaggtaactggggaccagtgtctgtttgttcagtgggtttgcctatggatttcagaaagaaggattccctcaccttcccattttcctcccatgttattttttaggtaccatgctaggctttaaagacaaagcatcatttatagaatgaagtagaagctgtctttgcagtctccaaactatttttaaccaacagcctatagatggtatttaaccctcaggtgtgtttggcctgcacgggtttttgtttttgtttgagacagggtttcactctgtagcccaggctggagtgcagtggcacgatatcagcttgctgcaacctctgcctcccgggctcgagcagttctcatgcctcagcctcctgagtagctgggactacaggtgccaccacacctggctagggttattttaatgtatctgattttgcatgcatttagacaaaatatggcctctccagttcactgtatttctgctgcatgctgttgctgcttctctgtctcaggtttcctgcccaagccctccgagcatttgaatgtgctgtgagcagcctacctcagcctcctctctttacacatgaagacactgaggcccattcagggcaagtggcaggtccctgttctcagagttggggccaagcagagagtaaagagttaaattttagaatccaggagtggggacccagactgtggcttctgttaactccctcagtggcagtggcgtcctgctatgcacagcccctctgctgtactccgaatggtcccttacgggtagcaggagagacattaaataatcacactgatgaccaagtgagataagtggtttttgaaggaaagaacttgaggctggcgaggaccacttaaccttctagcaagggctggactcagggaggctttcctgagctgcggggaggatgacaggttccctggagtggtggtgggtgggggcggggctgaggggtggtagccaagggagggtgaaggagagtattccagaagagacaacagcttaggcaggcaggacctcgccatggaggaaggtgctttctgatcactgcgggacacctgtgtgatagctcatagggagggggtactggtaactaaaagttgataaggaagagtggctaaaatgaaaagcagaaaagtgagaatctcatcaaatcccctcatttgacaggatttggactcccagtagtaactgtccttaaacactcactcctgaccttacaaccctggctgttacctggttaacaagccccaggtgttggctacaggtgtcatcactgagagcccttgtgtgcagatctgccccagctctcccacctgtgactgaggctagcaagtcccccgtgggctgtagagcctagcgctggtgtcagaatcgcttgttgcaggttcatcttcagtgtctttcccacagccacatgctggggaaagacggcaaaggcgctagaggagcaggagaacaaagcaagctgccccagaccacccggctttcgcagaacccagatgatgctcctgtctccccctaagtataacgtgttatgtagtcagtatgatcccattcagtgcagaagtatcgcctaggaatttcctgccccacccaccctgttttgttcttaatgaagttcaagaacaaaatgagatgatagtcaagttatggagcaggctgcagtggatacaagggcagaaacacagtctttggagttagacctgggatctgcattgattggttgtgtgactgcagacaagttatttagcctcattaaggatgaatttcttcgcaaaaattggaataatacctgccccatacgactgttgtgagaattaaacaccgcaacttttgatgttcaaattctatttcttctccttctagcaacacatactgttagtgccaggaaccataaaaattataaggctgtatctagaggcctgaaaggaagctaaaatatacagtgtctactctgtctcttttctcttggttatggtatcagaggaaatacacatattttcttagcttcaaaccaccaaaaaagatgatgcagtaaggagatgggaaatctaatttggaatacagtgtgcaaatcttattttcaagcagactttgaaaataaaactcaattcttacgttagaggattatctgcttaatacaattatagggtaccagtttttgaagtcacatcggggttaaataagattgcaggttcatggggtcatatttgaatgttctgatacttacatatggggtgggaaggaggaatgcatgcttttctcaagttaagacacataaaagagttgtcctggcccaggtgagactcgcctttgtgtagcagctggagcttcattccacaggcagatagggtgcttgtgtcctgatgaagtaagagaatatatctggaaacactttgtgtactgtgaaatactatacaaatgcagggcagtacaaatgtaaatattaatgtattttagtaataattttagcttttatttcatcatatataataatttgtagtgactggtgtgaagttaaatagaattaacctagaattaatgagttttgtattgctctcatctatttgaagcatcagctgtgcctttcatgttgccttgtgcagccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagtttatcatgtctgtgtttttcatctattatttcccattcataattctgtgatgataagaagtgggtcctgaaaaattaattggctgtgcagatcttgcctacttcataaagaatttgaagtaggttacagccagccagacattaaaaatgaagcccattaagagaagaatgaaattctatgagccaagaaataaaatgagagaaaagattagggaagagaagaaatgttgaagatcaaggctgagggatgctccctactgaatgggaaaactccttagttccacatgggctgtagacacagcccttctgccagcaactgttcctgcaaggaactggtgctcaactaaacatactgtcacatggttccttgaaggggcacagcactgatttcacttgcattataaaagattgagtggtgcttttgactattagtttatgtcaacacttcaaaacaagatgagccagtttttttttgttttttttttttgtttgtttgtttgttttagacggagtctcaccctgtcacccaggctggagtgcaatggcactgtccccgctcactgcaacctccgcctcccgggttcaagcaattctgcctcagccttccgagtagctgggattacaggcgtggcacctccacgcccagctaatttctgtattttgtagtagagacggggtttcatcatgttggccaggcttgtctcgaactgctgaccccgtgatccacccacctcagcctcccaaagtgctgggattacaggcgtgaaccacctcgcctggcccagtgagccagttttgtaaagctattcagagattagccagatttgatttgataggggatcaagcttgtaggatcttcaggaaggcgggctgtggccccttgatcaggctttttgcacaggaggtgcatgactatgaactaccctcagtagaactcttttaagccagtggcttgcaataaatgatggcaaatcagccacctaggaagccatttctaagcccaaccccctgccacagtcttcctctagatggctgccctgcccagtgggctgagagtggggggcggaagtagcatttgctgggaagacttgccagtacatatgttgcaccccctcactgcagctgcagtgctatttcaggctgttgatggaagaacccatgttctaatccccaggatgtggtgggaagaccctaagtggtggtgttagttaagaccctaagttatattgttttgttcacttcccactgagataggctacaatagtattaaatacctataggtcagacatttttggggtctgttgtactacctaccaattaaacagtttttgatccgcccaccacgctcaaagctccagcctaggtgttgcaaatacagacgacagatttttgctctcaggaggccctgattccagtcctcaaacgagtaagtgtgaaattgagtgcagcattaaagcacaaaaacaatgatttgagacgtcttttctataaaagaagtttatagcactctcattgaatgcttaaatagtgccacactgctaagtcgtgagaagcaaaatgtaactgcggtgcctcaaacaggattattttgttttattcatttggatgcggacagctctttatctaaaattgccattctgaggtggttttgcacaataaattggtaattatgtagactgtttcttccagagacagcatcttgaatcgggtttatgaagccatgctatcaacctaggtagaaaatgctttgtaggacatgggtcctgcttatctaaattttaccagattttattagctgtaaatttataagcgggtcttggtgaatagataatgaaaaaaatattgagtggggaggcttattagactgacagcaccttcaagactcatgcaagttggactggaaaatcccacctgtggaagtaaaacactgatgagtccttaataaatatggatgagacaagtcaaatatttggccaatttaggtgaaacagaaataagtctagaactggacaattatttgtgtaacatactggcccagaccttcactttgagaagctggtgtgtagtttcaggagagtacctggcagactagtgtgtccatacttcgatggagcttgagagttttccttgaacacaaaagttgtatttttgagtttattctagtatgatggtgccctaccctatcttcctattcagttcacccaaagagcctttaaattagtgttcccttggtcccatccctacagtctctggttttgctggtctgggaatgggtctggacatcactgttgttttaaagttgagagcctctcttctgtggtcttgttcctaaaacgctttactactcactgtggtctgagggcccccagcactggtgtgttagtttcctgtggctgccctaaaaaattaccacaaacatggtgtcttaaaacaacacacatttgtacagttacagattccagaagcctgcaatcagctcactggactgcaagggccacccgccctctcagaagcgccgggagagaacaggttttcttgccttcttcagctgctagagctgcgttctttggcttgcacccccttcctctgtcttccaagccagcggggcagtcttttgcttcagtggccatgttgtcttctggcacagtcacatctccccctgcctccctcttagaaggacccttgtggttacatttagggcccccacctggataatccaggataatctccctatttcaattttcttaatctcatctgtaaagacccttttgccatataaagtaacattcacaggttccaggtattaggacttggatatctttagaggccatcatacagcccaccacaaacagctccttaggcactcattagaaatgcagaacctcaggccccaaccgataccttttgaatcttctgattctaatttaagaagatcaccatgtaactcactagcacactaagacttgagaagcacgatgctatgggaacctaaccaaagaattctcaagtcccaacttaaatacaaatttacagagtatttttcctaggaacgctttcaggtggaggagattaatcagacgatagataattttcctgaacaccattctgaagtgcttctctaagcatttgttcctgaattctctctcaatgaagccacaagccccaaacaccaggattactgtttacaggggttcctgtttacagtagtttagcacagggtttgccacactgcagcatattattatagtttagttttgtaaaaagctacatgagagaggtaaatcttataaatggaggtggagtctcctaacaccagttttaccacctctgtacaggtttccctgggctatgtactatcgaatcaggaatcaggaagggcggctttttcaaatgttatctatacttttggcaatttgttcaaacgttctgctggtatgtgagagggaaggaaaaattgtttattgaccacagatccacaatattatacttctcctatacttaagcaataagggacagcatttaaaactcttttaaaaatgttaatcttggctgggcacagtggctcatgcctggatccccagtaatttggaacactgaggcaggcagattgcttgaggccaggagttcgagactagcttgggcaacatgcgagagcccgtctctacaaaaaaaaaaaaaaaatacaaaaattatccaggcatggtggtgcacacctgtagtcccagctgttggggaaagctaagttgggaggatcccttgaacccaggaggttgaggctgcagtaagctgtgattgagccactgagctccagcctgggtgacagagcgagatcctgtgtcaaaaaataattttgatttcacggaaggagaagaggactagtcttataccatatcccaaatgaaattgaaaatgtcttctgggaatcacagcaatgactcaaacttctgaatagtgactaggtttgagctggtaaggaagggattgtcaaatgccgtgacagtccacaggagggcagcagtgctccgatttacaaaggattagtcatactagtgtaaccttttctgagtgagcctagaaattctgatgaaaacagtgtagtccaggaaaaaaaaaaaaaaaatctgtatgtacaatcactcaattttgaatcatttctggaagttattagactccatgttaaatcctacttaagtacaagtatgcaaaatttaaaaatatgcagaaaagctcattcttggttaaaatgttagctgaaagacattactaagttttagaataccatagagttgactatttcccacaaaccctaaaatctacttgaacaccacaaattcatattccttctaatcccaagtcccttcagcattcttacagatttattgttagttaccttacaaagtaactaactgtccccatgtattttatcccaatttaaaaaatacattacagtctcaaggtcacataagattttccaaaatgctctattcatagtcaatataattttcaggccgggtgcggtggctcatgcctgtaatcccagcactttgggaggccaaggtgggcggatcacctgaggttgggagttcgagaccagcctgaccaacatggagaaaccccgtctctactaaaaatacaaaattagccagacgcggtggtgcatgcctgtaatcccagctactcaggaggctgagtcaggagaatcgcttgaacccagaaggtggaagctgtggtgagccgagatagtgccattgcactccagcctgggcaacaagatcgaaactccatctcaaaatatgtgtgtgtgtgtgtgtgtgtgtgtgtgtgtgtgtgtatatatatatatatatatatacacacacacacatatatatataattttcacctagtgttttattaaacagaatgcttctgtatttttatgtttatttgagacaatgcttctgtatttctaaacaacagctagccttgttcagttagccaaacaacaaaaccttaattcaagtcttcaatgaaattttctgatttaataggctgaattaagaaagccataattttcttctataaatataagcctttaacttctatctttacaagtttatatagaaaaatttactgtggggcttgagatttactaatgcatgggttttcaaccttagctgcactttggaatcatttaggacgcttggaaatccctacacccaaaccacatcccagatcaattacactagaaatctctaggggtgggacccaggtgtctgtaaatatcccccggtgattgcaatgtgcagccatggttgagaaacactgaagcctgctctgagaaatttagcaatccgacttaattcaaatctgcagagagagcaacaatgatttttgcagaaacaaccaaatcctactagttacataaattttatactttgttaggacttgggtttttatttagctctacatatgcgatcataggatgcagaagatatatcttctactggacacgtatatatagatgcttaaatgtggctatcccaaggttaggtaataataaagactataagagctgggcagaaatcaggcacagtttcatgaagggtaatatctgagctgggccttggaagatgcataggatctcaacaggacagtaggtgtttcaagcaacaatgaactaggaatacagcagaaagcacaggggaaatggtcaggcttgactgagagtaggttatttgaagaagtgcaatagaaaatgcttggggaagaaagttgggatttaattgtaaaaggtcttcaagtatcaggctaagaaatgtggacttcatccagtaggtaatgtgatgtcactggatatctgtgcagtatctatgtgatgggttgggagtggagaagcctggggatacttaagggtctgagctaggagggacaggaggaatggctgtgggagtggaatggttagaagatgggcccaattagaaacatacttcaatttgagacaaaacccactagaaataaacacatcatcatgaaacatctccaaatgtacaat

SEQ ID NO: 182 - DNA, 1470 bp, Homo Sapiens
ctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaagaaacttaaatcctcagtgtgacacaactcagtccttctactgcagcagctcttttataaaagcctcccaaagctccaagaaggaacaaagaatgtgacccagtaagctcacaccataagtctatattgcagaaacctttgttcaacaaaactgcagatgctctgttgaatccactggagattgtcctgatactaaggacaagtatcaaccatctttcctgtgaaaaattccctctcctagtactttagttctgtggatccaaaatttatagcattcttctaccaccacaggggtgagtatataataaaaaatgtcagttattcaagtatgtaagaaacttgaaagtcatcactcccatccttacaacaagaaaaatgctgtacaaacagactatcaacaactcattttagatccattagaggactgaggtcacagaaaaactgctgcgcccaccctaaatccccattaaattagagagatgggaaaatgcaaagaattatagcctagtggagcaaaagcccaggagcccccacaggagttagtaatggagtagaaaactttaatatgcagttgattaatttctggaagcacattgtggacaagcttgagaattaactttgaaaaatatataacatgataatactaattaaaagaaagctggattaatatattaatttccaacaaaaagacttcagagaaagaacaattatagggggatacaaaggggtattacatagtaacaaaggatttaattttccaagaaaacgtaacaatccttaatgtgtttgcatgtaacaggctgtcaaaacacatgaggtgaaaacagatagaactgcaggaacagacagataaatccactatgataattggaggtgttaacacctctctatcaataatgaatagaaccagcaggtggaaaatcagtaagggcatagttcaactgaatagcaccaaaatcagtgagtcccagtctctcttcccggaagttgattcttgagcagggacgtcaggagtagagtgatgtccaggccatatttaataacaaataaatcagagtctggacatgatatgtaggcattcgtttctttaaaaaaaaattgccccaggtgattccattgtgaatctaatgttgagaagaaatatgtgcagtcgttttctttgaattcattctgcctgagatatctagagttgttctggttgttgacatcgttttgtttagcaattcattcattcaattttgtgaattaactttcaagaaatgcct

SEQ ID NO: 183 - DNA, 3504 bp, Homo Sapiens
gatcgtacaactccgtgaatatactaaaaccccagagttgtataccctaggaaatttttttttttttggagacaaggtcttgctctgttccccaggcttgagtgcagtggcacaatcttggttcacaacaacctccccctcctgggttcaagtgattcgtgtgcctctccattagctgggactacaggcgcatgccaccacatcccattaacttcagaattttttttttttttttcagatggagtctcactctgtcacccaggatggagtacagtggcgtgatctcggctcactgcaagctccgcctcctgggttcatgccattctcctgccttagcctcccgagtagctgggactacaggcgcctgccaccacgcccggctaatttttgtatttttagtagagacagggtttcaccgcattagccaggatggtctcgatctcctgacctcgtgatccgcccgcctcagcctcccaaagtgctgggattacaggcgtgagtcactgtgcccagccaagtttagtattttttgtagagacagagtttcaccatgttggccaggctggtcttgcactcatggcctcaagtgatccacctgcctcggcctccgaaagtgctgggattacaggcgtaagccactgtgcctggccttaaatgggtaaatttcatatggtatatgaattatatttcactaaaactttaagaaaacattatacagtactgttcaaattttaagtggtccaatttaaatgcactattgtatacaattctatgtaatgtccttaccatggtatatgttaactataaatatctatgcccctacccttagtatcaaagcatatattatatgccagtgagccaagccccacatgtctgtgaaatgtggtcttctagccatagaagtagcttgtgctcctagggtattccttgaggctctgtatgaagaatgtccatttgtttgagtccctaacctacagaatattcctgaccatggaaatgtgatagataggagtaagcacatggaccaaaaggcctggaggctcatcatttaaggtacaagccaattatgtagtctttgaaagaatgctttgaaattcagcttgcttgattcaattcccaatattttcatttgtattaaaagatttggcccttacaggttaaaaacaatgtcagtgtaaccaagtgacattcaaattttggctcccaacatgtgatatgacatcacttcatgtgaaaatagcgaagctccaaacattttctttcagtcaccttattaagctcgctgagccctgacagcctaatgaaaggctaagggggaagaaaatgtcccaacttctacactgttgaagatgggctaatgagaggttagcttgcaagaatcattctttcttggcatcctgcttctgactgcttggctttcagcttatacccagcatgaaaatttaatttcctcgcagttgaaggtagtttaaagcttattactcacatgctaaaatgttgatgtatctgtttttgtgcttgttttctggatgattggaatgctctgcagtgatgttcatatcagcagtacagcgctggacttcctagtgaagaaaacagcaagattatagacacagtttagaaacaaaggaacaccatatacatttaaaggcataaagtatttactcactccctggccacagccaccgttaccttctcaatcccaacttcggatataattattgatatatttataacgagtttatgaagaatgtgaaaaaggtataaagatttcattatttactatttcatcaatcatctacttttttctagtttttgacctagtccctgagatgtaaaacaatatctctttttgaatacatcatagtctatgggtgagaaaaatattcaaaaagatagtcaaacatgatgaatacaaaagaggcctgagaaagctctgatgggagcacagaacagaggaaggctttagacaggtgaaaaaatttacctaagtcttaaaggaagaaagggaatttctaagaagtataatctctaccatgatttgcaatatgcttacaggccttatagcctcattttataattgtgagggtgcattgactctaaagactcagtgctgaaataaccctaataacagcccaactaatggtcatatctcatatatacagtcttgacaaattatttgtgaactctagtattttaaaagttatccttctttggaaaaatagcagtagcagaaataacactcttatcctaccttggccgtggatttaaacgtcatccattagcctaatacaacgttgctgaaaagccaaatttttctacactatatgcttcaaacccaagaaagtactggagctgactaataagggaagtcattagcagtacacagctgctacaaagagcctgaacaaagtaacacaaaattatcaggagaaatgttttacacagaacagatgtagcagagtttagaagcatgcagactttttttttccacaaaggagttgcctagtaattatgcatgttttccatagtatttacattaaacataatgaaaacaatgaactggttgtcttttatattcacaaagtacttccccagggagaagtacacttcttctctagaaggaggaagttactgtactcaaagaatttaaggtataaaagcaaagaatttctgtgtgttcaaagaaacagtattcaatgactctccaattgttggacactgtaaattgaagtttccataattatagtccttcccagctgtccatttaaaaaaaaaaaaaaaagccccacaggcattaattcaatccacctttctgggaaagtgtgtttaatgacagttcttaccctttccttactcttactaaactccaatatattctgttctaacatagtttataacctatggtttggaaaacactggtttaaggagctttaaggctgccctttggctcttctctaaaatgagataataaagtgtgatcacaaatcagtctacgtaagaacatgagcaatgctagccaaacttagcacgttgggacctgccttttgaaactgccttataagctctgagccatgctcttttgaagagtttcaagggcagacaacttttgaaaatggatttgaaacaagttagtcttttgttttcgggttttgaaggtcacacctttggcatgtacttctttagggttgagttgttcaggtatcttatgctgagagattttggcttttagtaccttagtctgagatttactttgtttattgatttttttttcctgttgtatagatctgaccaccctagctatggactgaagttggagcctcttttctaatataatgcaattgaccaagactgcttgggagcagctgtcagtattgtttaaagctgtcattcaatatggccaaactctttgttatctaaaaccccttgtctgatctgttgcctctgtttcacttttccaattagatgaatgacagaaacaaaaaatcgtaataaatattgtca

SEQ ID NO: 184 - DNA, 11580 bp, Homo Sapiens
ctctacccgcctctgctggaaaacaggccgcagaatataggtgttctcgggctcccctgcgttcttctcagcctcaggcaccccgtcgcccaccgagaaggacactccgatggacgtggccatgccggggcttctcggtccgggcgtagctcgcgatgaaggcctagcgggttgcggtcgcggccggcagcagggaaagcgtctccagggcaacagggccgccctcccgcctcgctgaagcccgcgagcgccccgcacagccgccctccctgcccgcgcctgcgcaccggctgctgggcgggaactggtcgcgtccggacgcgcgacagcttccacccgcctcaggcagtatcagccgcgccgcagtcggaggaaatagacgcggggcctgaggctcctggacttgagaaaggattcaagacagccgatgatgaaaacacccatgcttgcaagtgaaggttctgcctgtcacttctcgcagaggctgcagaaaaggcccaggaggctgttgatgacatgaacgaccaccaggagaagctggagcaggctgatgcacagaagggcggagaagagggacacgtgccagacaacagctgcagagggctccaggcagacggagttccagagcgaacggtcatacagataattcctatcccaaaaaataaggagaccaggggtcaggcgataagtaaggaaagccaaacaggcaaccccagtagaaaactggggtctcccctgaccgggtcatgggactgggctcatgagggtgaccgttactgctccatttgcaattttctgagtatcagaggagcaagatgctaggatgtgtgacccaaaggagcttgtagttcgtctgtgtgtctttttgtctctctctctctctctgtctgaaaagaccaagcccaagcctccacccatttacctactatgcaggtctttgaatgggtaaccatatttccaagcttgtgtctgattgaaggatgaaacatcaaacatgcaaaaaggaccatctttcagagcaactccagaagtgacaaagcaaatcagggctccaagtaaagccaggccacctgacaacagagcaccattcagcctctgagctaaagaagaagctaccacaggcccaccactgactcttctaaggaaaagctgcattttcaaaagttccaggttcccaactctgattcttctctatttcaaatcaaggataaaaaaaaggaagggagggaaggaaggaaagaaagaagcaggaaagaagggaaggagagaagtgggagggagggaaagaagggagagaaacagcgagagagaagctgcagccaagctctgaaatgactccacttctgtcgctgtgtttctccagctgagagctttcttggccatcagtctgtgctcccactgccctcccagaaaataactgggtttccttccttgacaggtttctagcctgcttctacattggcttctttctcgttccttccttccttcccttccttccttctttctctctctctctttctttttgagacagagtctcactctgtcgcccaggctggagtgcagtggcacgatctcagctcactgcaacctctgcctctgagttcaagcgattctcctgcctcagcctcccaagtagctgggactacaagcatgcgccaccacacccagctaatttttgtatttttagtagaaatggggtttcactgtgttggtcatgccggtctcaatctcctgaccttgtgatccacctgcttcagcctcccaaagtgctgggattacaggcatgagccaccgtgcccggcccatattggattctttcttagggttctagatttttttctccctcccccaaaaatgcctattttaaaaatgtgaataacacctacatagcgtttttctgcagagtcatggagtcattctcccactgaggtcaagctggtttggagttggggagggatcagacaaaggtgcatagtaagttttgactctgagttaaaggagtcaagatgaatcagtaagcctagggcagtggttcccaaaatggggtccctgcccagccgcatcacatcacctgagaacctgttagaaatgcaaaacttccccgccatcctgaatcagaaactctggggagggagcccagcaatccgtgttccggcaaaagccctccaggtgattctcatgcacattcaagtgtcagaactacgtgccacggggaaaaccagaatgagaacagacagtgaatgaaatgtgcaagtgtttatttatttatctatgtacttatttatttatttattttgaaacggagtctcgctctgtcgcccaggctggagtgcagtggcgccatctcggctcactgcaagctccgcctcccgggttcaagagattttcctgcctcagcctcctgagttgctgggattacaggcgcccaccaccacgcccagctaatttttgtatttttggtagagacggggtttcaccatgttggccaggctggtctcaaactcctgacctcaggtgatccgcccatcttggcctcccaaagtgctgggattacaggcgtgagccaccgcgcctggcctatatttgattttttaacatgtaactgagtcagtgggcttcccaacatgtgggctgcagatatcagagcaggctgtggagttaccataaggccacagattcatgtctgagaacgagtgtgtgtgtgtgtgtgtgtgtgtgtttgttacacacacatatactgagatctttcaagtttatacagttgctgctgtaattaataaggtagaaatttattctgggcctcagtttatctgtaaaatggaggggttagattagaatctagtgattagatgatctctggaaaactttcctgttctaagaaaatattagttaaaataactaggaaaatttccatcaatgacacatgattacagtgtcataactcatgtccatattgtccaacaccctaagagagtaacagtttctcacactggtacagacgtctgggtcctcacactggtacagacgtctgggcttcactaagcactactcccttgacttgatcagctcccattttacagatgaaagcctgaaactggaaagatgaagcaacttgcccaagaacttagcgttactgagggtcacagtgaggacctgacttcaggccccaagaccaaaattgcctctttaccgccctgcctctagagtaatagaggtggagacattctgggtgttagaagagtggaatctggtgcttacgcttcgacagagcccactcttactgaagcagccgtatctccagcccatcaaggagatgaggatagctgcagtgagtacctgcaggagagagaagaatgttgagatggggaaatcgactttgccggctgtttctaggtgctgcccacagctgttagagtggctggcagctcacatgaacgcagtcctgttgactctgactctggggacccacatttgtatgacgagcctgatctaacgctgtggatgttaactttcacacccgacctgcctggtcccaagctaggcttcctgtctcttagagcttctacagacccaagatcagcttgttagaataaacttttctgcaaggaatcaaaacactcttcccatgccaccttcctgctccccgccggggtctctttgagagttcacgttcagggaaccccggacacttaccatgaggcctcctccccagagcccagttcccagcatggcatgcctgccaaggaggcccctcaacaggtaggtgacatcccagttaggaaggaggagtgccacgttggccccagcagcaaacagggctgcagtcccaaggctcagtcccaggatacgggagcaagtccgtgagcttgcctgcgtgcagggagaggacaccatcctggaacagatagaaagggagtcgcagcagctctgctgtggggggatggggaagggaactccagcagcatatcatgggtgagggaaacagactacagaaaccgccaccttccagggtcagaccaatgagagccaagcaacctgcttaaaaactctgctccttaggaatcttccccagtgactaggatttaattgtttccttttctgctaacccctgttcacacatacatagtttgcattccatcatattttgtttatgcctctattacagccagtgattatttctgacaaaaagaaatgtttaaaggtgtcttcatgatgtccattgtctccacttctattcaacgttgtactggtcctggccagtgcaatacgaaaataaaaggaagcaaaagccacacagataggaaagaaagaagtaatattgtcggccaggcatggtggctcaggcctgtaatcccagcactttgggaggctgaggcaggcggatcacgaggtcaggagttcaagaccagcctggccaacatggtgaaaccccgtctctactaaaaatacaaaaattagctgggcacggtggtgggtgcctgtaatcccagctactggggagactgaggcaggagaattgcttgaacccgggaggcagaggttgcagtgagctgagatcatgccactgcactccagcctgggtgacacagcaagactccatcttaaaaaaaaaaaaaagtaacattgttattattcacagataatgtgatcacattatgtagaaaatcctaaagtttattagaattaacaggtgagtttagcaacgtcatagaataaaagattaatatacaaaaattatattgtatttctatatacaagcaatgacaaattgaggattgaaattaaaatatatcatttacaatagcataaaaatataatacatatggatgaatttaacaaaatatttgcaagacctatatagtaagaattgcaaagcattgctgagaaaattaatggagacctaaataaatggagacatataccatgttcctgaaccagaagactcaaaatagttaacatgttctccctaaattgatgcaaagatttaaagcaatatcagtcaaaatcctaggagagttttgttatagaaattgacaaactgaatctaaatttatatggaaatgcaaagcaattgtgaagattagccaaagcaattctgaaaaacaaacaaagctggagaacttacgccatgtgatttcaagacttacaaagctacagtaattgaagacactgaagccacgcgtaaggaaacacatatggactactggaacaggctggagctcagaaacagacccggtccaggaaaaatgattttttttttttcttgagacggagtctcgctctgttgctcaggctggagtgcagtggcgcgatctcagctcactgcaacctctgcctcccaggttcaagcgattctcctgcctcagcctcccaagtagctgggattacaggtgcccgccaccatgcccggtaattttttgtatttttagtagagacggggtttcaccgtgttagccaggacggtcttgatctcctgacctcgtgatccgcctgtctcgggctcccaaagtgctgggattacaggcatgagccaccgcgcccggccaataaatgattttttaagaagatgacaattcagcgggaaaaagtctcttccacaaatggtgccggaacaatgcacatgcaaaacaaaactgccttcactattacttcacaacatattcaaaaattcacttgaaatggagcatgggtctaaaagctttataaaatttctagaataaaacaaaggagaaaaacactgggaccttgggttagataaaggtttcttactaaaatgcaaaaagtacaatccacaaaacatgattaatcagactgcttaaaaatttaaatgtcagctgggtgcttgcctataatcccagctactcggaggttgaggcaggaaaatcgcttgaacccaggaggcagaggctgcagtgagctgagatcgcgccactgcacttcagcctgggcgacaagagcaagcgactccatctaaaaaaaaaaaatcatgctaaaagaaataagccagacactaaaggacaaatattgtatgattccacttatatgaaatattcaaaataacaactttatagagaaagaaagtagactggaggttatcagggactgtggggagggaggagagaatggggagttattgtttaatggttacagaggttttcaggttttgttttgtgttgttttgttttttttttttgagacagagtcttgctctgtcagccaggctggagtgcagtggcgcaatctcagctcactgcaacctctgcctcctgggctcaagcaattctcctgcctcagcctcccaagtagctgggactacaggcatgtgccaccacgcctggctaatttttgtatttttagtagagacagggtttcactatgttggccaggctggtcttgaactcctgacctcaggtgatctgcccgcctcggcctcccaccgcgcgcggtggttttggggtttttttagagatgcagtctcactatgttaccccagctggtcttcaactcctggactcaaatgatcctccagcccgtgcctccagagtagctatgaccagatctgggccactgcccacggtttaagggttacagactttctgtttggggtgaagaaaagttttggaaatagataatggtaatggttgcacatcattgcaaatgtaattaatgtcactgaattatacactttaaaatggttaaaatgacaaatctgatgttactttaccacaataaaaaatcaattaaaaaatttgtgattactcaaatccttatcagtaatcaataggtgaatcaagacaaattgtgttatccatacaaatgagttctattaggtaataaaatgcgtaaatttctgctacatataacatggatgaatctcaaaagcattgtgttaagtggaagaagccagaaacaaaagactactcacatgtttctatatatacgaaattctagaaaaggcaaaacttttaacggagagcagatgagcggttgccatgggctgagaatgggaaagaggattagtatggggcatgggaagctttctgaaggggtggaagcattctgtgtctagattctggtggtgaatacataactgtacatattgacaaaactcattaaactttgcacttaaaataggtgaattttattgaattttaactatatatcaataaagctaattacaattaaaatgtcatatctagataaattataaaatgcctcttccactccttatgttcctctcttttatattttcattgatatgtgaacttcttgttttttagaaaaatatgaattaaggccgggcacggtgacttacacctgtaatcccagcactttgggaggccaaggcaggtggatcgcctgatgtcaggagtttgagataagcctggtcaacatggtgaaaccgtgtctctattaaaaaatacaaaaaaattgctggacgtggtggcaggcacctgtaatcccagctactcgggtggctgaggcagcagaatcgcttgagcccaggaggcagaagttgcagtgagcagagatcgtgccattgcactccagcccaggaaacaagagtgaagctctatctaaaaaaaaaatatatatatatacatatatatatgaattaaaataggactagtaatatttgggcagactcatgtcaatgtggatctgaaaaaagtcagcgtcatgacatccccaggaagtggcctgttcccactgtgcagttcagttacacgtctgtctccccttaaggctcgctatttatttatttatttaatttatttatttattttttattgaaaaaaatttatttttagccgggtgcagtggctcacgcctgtaatcccagcactttgggaggccaaagccggcagatcacctgaggtcaggagttcaagaccagcctggccatcatgacgaaaccccatctctactaaaaatacaaaactagccgggcgtggtggcgcatgcctgtaatcccagctactcggaaggctgaggcaggagaatcacttgaacccgggaggtggaggttgcagtgagccgagattacgccactgcactccagcctggacaacaagagtgaaactccgtctcagaagaaaaaaaaatgtaatagaggtgaggtctccttatgtggcccaggctggtctcaaactccttggctcaagggccctcccacttcagacacctaaagtgctaggatgacaggcgtgagccactgcacttggccacttgaggctcttgacacgcctataacacactgctttgcacctaatcagaaaatatgtgtatagaggccaggcacggtggctcacgcctgtaaccccagcactttgggaggctgaggtgggtggatcacgaggtcaggagtttccgaccaacctggccaacatggtgaaaccccgtctctactaaaaatacaaaaaaattagctgggcatggtggcgggtgcctgtggtcccagctactcgggaggctgaggcagtagaatggcgtgaacctggggggctgagatcacgccagtgcactccagcctgggcaagagagtgagattcggtctcaaaaaaaaaaaattaactgcgtggtggtgtgcgcctgtaatccaagctactcaggagcttgaggcaggagaatcgcttgagcccgagaggcagaggtggcagtgagcccagatcacgccactgcactccagcctgggtgacagagcaaaagagagagagagagaggagggagagagggagggagggagggaggaaggaagaaaggaaaggaaggaaggaaagaggaaggggaaggggaagggaagaaaaaaaatatatatatatataaaagatatggatcagaggctctatatatatgcacacacacatatatatcatatacatataatgtataatgtgcgtatatatgtgtgtacgtacacacacacacacacacaatagtcccccatatctgcaggggatatgttccaagagctccagcggatacctgaaaccacagatcataccaaactctgtatattcagatgcttctccacttatgatggggtcgaactcctataaacccgttgtaagtcaaaatatcctaagttcaaaaggcatttaatgctggcaacacagtagactgtccctgactcacaatggttcaacttacaattttttttttttttttttttttgagacagggtcttgctctgtcacccaggctggagtgcagtagcacaatcattgttcactgcagccctgatctgggctcaagtgatcctcccacctcagtctctcggatagctgagaccgcaggcatgcgccaccatacctggctaatgttttagttctatagagacagggtctcactatgttgcccaagctgatctcaaactcctggcctcaagtgatcctctcacctccacctcccaaaatgttgggattacaggcgtaagccaccacgcccagtcccaatttacttttgactttgtgatggtgcaaaagcaatgagtattcagtagaaaccgtaatcccatcataaagggtaaggagttcactgatgatggagttaggtccctagaaacctgtcgtaaagttggaaacttagaagtcaaaccactataagtagaggactgtctgtactatgctttttcctatacatacatatctgtaataaagtttaatttataaatcaggcatagtaagaagttcgcaacaataataataaaatagaacagttataacaacatactgtaatgaaagttatgtgaatgtggtctttctcattgaaaatattttatgtaagttttttgaactgcagttgaccacagatagctaaaactttggaaagcaaagcttcagttaaggggggattactttacatcacacataaataatgaaatatttcacagcatgaagaattaaacattgggggagggccagggctgaaaaactatctgtaggtaccgcgctcactacctgagtgacgggaatcactcataccctaacctcaacatcacacaatagacacggaacaagcctgtatatgtatccccggatctaaaataaaagttgaaattatatttttaaaatttgcattaaaggccaggtgcagtagttcacgcctataatcccagcactgtgggaggccgaggcgggtggatcacttgaggtcaggagttcaagacagcctggccaacctggcgaaacctcatctctactaaaaatacaaaacttagctgggaatggtggtgtgcgcctgtaatcccagctactcaggaggctgaggcagaagaatcacttgaacctgggaggcagaggttgcagtgagccaagatcgcaccactgcactccagcctggaccacagatcgagactccgtctcaaaaaaaaaaaattgcattaaaaaagaattaaacataatgtgtaaaatatatttgtaacttgtgtgagataattaacacccatgtaaacacaaccaatatcaaacatacgtcattacccatcacatcactgacactcaggtgtgccctctccaatcctgccttctttctggattccttcctaggaactactatcctatatttcatcttcaacatatccttttaaaaacagttttacgacttaggaactcagaattgttttagaaacttgtttagtcgggtgttttccatttttcaagactgtagcttttcttttctttttctttttttttttgagatggagtcttgctctgtctcccaggctggagctcagaaacagacccggtccaggataaataatttttttttttcttgagacagagtctcactctgtcgctcaggctggagtgcagtggcgcgatctcagctcactgcaacctccgcctccccggttcaagcgattgttctgcctcagactccccagtagctgggactacagctgcacaccaccatgcccggctaatttttgtatttttagtaaagacagggtttcaccatgttggccaggctggtcttgaactcctggtctcaagtgatcctcctgcctcggtttcccaaagtgctggaattacaggtgtgagccaccaaacccggccagactgtagcttatggtaaagaagacaaggggaggggtgccctgggagggtgggggtaggagagaggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggatgccctgagaaggtgggggttaggagaagggaggggtgcactgggagggtgggggtaggagagggaagggatgccctgagaaggtgggggttggagaggggaggggtgctctgggagggtgggggtaggagaggggagaggtgccctgggagggtggccagaggacaggggaggagtgcacagggagagtgggggtaggagaggggagggatgcacggggagggtggaggtagcagaggg

SEQ ID NO: 185 - DNA, 10304 bp, Homo Sapiens
agtcctggtgcccgccttggcctagccccggccccgggacggaagggggcctctggggtggcagcctgggcccagtagagctttgcatctcttggatatctttcccgggcgcagaagctgcggggcttagggagtcgccattgcgctggaaagtcctcccgcccacggagaccccagcaaactccgagtgtcacacagtcgcctctggcgacccgtgcgggccggagccgttcgcgcacaggcagggcgggtgctgagcgtggaaacggggctggaattggccgagccatgcctttccgggatgcccaccgccagtcaaagggttgggggtggtctctgcaccttaagtactaacctgccgcccacgcgcctcctgaccacagcaccccgtcggctttctaattctgtgagctgccctcgtgggcgtggcctccctgtggagctccccatgtgcctccccttggtccagcctgcagctaggaagtgggtcacagcgacggggctgggctgggccaggccaggctccgggagatgtggaattggcgaaacaactgccccagtagtatcctccgcctaggactccaagaggtggcgaattggggcactacgcccgggtaaggcagtgcctgttcagggctgccgacctgtctccccagggctgtcattctcagcaagtactttaggagtgccttagatcggcacattctcccattgaaatatttttgttagtggagacaagggaggtaatggcaaggacacggatcatcacagcccctagggatttgttgaatgacctttggcaaatcacttcccttctctgggcctgtagttcttggctgaatatgagggaatggatttcaaattatgctccatgtaatacccgtgtttttacctctgtaaacagatttttttgttttttttgagacggagttgcactccagcctgggcgcatggtggctcatgcctataatcccagcactttgggaggctgaggcagtcagatcacttgaggtcaggagttcaagaacagcctgaccaacatggtgaaaccccatctctactaaaaatagaaaaagttagccaggcgtggtggcaggcgcctgtaatcccagctactcaggaggctgaggcataagaatccttgaacccaggaggcggaggttgcagtgagctgagattgcaccattgcactccagcctgggcaacaatagcgaaactccgtctcaaaacaaacaaacaaacaaaacaaaaaaacttaatgaatacagtccctcctaagattttcaaataaatgaaataccacattaatcatattgttttatttttatcattacattaaaaatcaaatagtatcactaggtttataatgaaaaacagcagaccctgtcccagccctccacactctcagtttctactccctagatataatctctattcacccagctacctcttctggtatttatctccgtatttctaaatagcatgcttatactactaattcttaatttttcagtttgggccattattttactttttctataggaaataagatatgtgtttatactctgaagactggtaatacacacatgtatttctccatcttccatccttcagtttatctatatcaccctatataggtagagtactattcattatactattataaaggtatgtaattgatccagttagcataatatgattatatttcctttattttgattgaagttaactattgcctctttctccatgcaactttcttaagtacctagcattcaagtgtctataatcaatttattccaaactgtcctttcaaaacattgaaacacatcaagtagtctatcaatcagtttattttttaaattggagacaactctctaggagcccatcatcctccttcactgtggactagtttttctctaagcctactgcacagcttttgtcctgaaataattttatcctttctaccctgttttccacttctttttgtttttctgaaagatttccaccttccagcttttcttttgaattttaaaatttctgttatgttttaaatttgccagaatactttcttgtcaacctctcttttaattaaaaatattttttatttttgtaatttaaaggtttattgtaaattgacaagtacaaattggatatatttatggggtacaaagtgatgttatatgtatacaatgtggaaagattaaatcaagctaattaacatatccatcactacaaatacttctttgtggtgagaatacttgacatttaccttcagcaattttgaaatatacagtacattattattaaccatgctatactctttatctcaaaaaatgtattccctttatctaactgaaacttcgtactctaaccaacatctccttgtttcccctaccaccccttccccctactctctgataaccatcattctactctgattctgtgagtttgttttagattctacattaggaatcatgtgactttgtctgtctgtgcctggcttattccattcagcataacgtcctccagggaagcactttcttgtccacccccttcccctttttaaatagcagtctgttccatttggtggatgcagtatcttattactctaagaatattgctaatgttttcttttgtttcttgaattgtctgtgttgaatttttaaggcttgtttctgttttgtgttggaagcttttcttaaacgtctagagatccttggccatccattcatatgtaagagtggggcactagaaagccaatagaaagttctgtgtacactggccagtgaggtggctcacacctgtaaccccagcactttggaaggccaaggcaggcagatcacttgaggtcaggagttcaagaccagccttgccaacatggtgaaaccccatctctactaaaaatacaaaaattagccgggctggtggcgcacgcctgtaatccttgctacttgggaggctgaggcttgagaatctcttgaacccgggaggcagaggttgcagtgagctctccagcctaggcaacagaccaaaactctgtctcaaaaaaaaaaaaagttctgtgtacatacttaggacttgtaattggtaggacatactgcagtatttttcaaacttctggtcgcaaacccattagtagtttgtgaaatcaatataatcagttttatttcccccaaatgacagaacagaatagaaaacaccacctcagaatacatctacatagaaagagaattattttatgaaactttggtttcttacacatatcatatatacatattatgtactggtttgatcccataaaatgggagttttttttttttattgtgggtgtttcttcaaagaaatttgaaaaagtacaacttaggataatcaaagagatctccaactgtcaggacaggtaggtcttttctcttagagaggttaagttccggcccagtgcggtggctcatgcctgtaatcccagcactttgggaggctgaggcgggcagatcatgaggtcgggagattgagaccatcctggctaacatggtgaaacctcatctcttctaagaatacaaaaaataagtcaggcatggtggcacgcgcctgtaatcccagctactcgggaggctgaggcaggagaatcatttgaactcgggaggcggagattgccactgcactccagcctgggcgacagagcaagactccgtctcaaaaaaaaaaaaaaaaaaacggagataagttctcctggagtaaaattctctaaacttttgcctgcatgctagtctgatagacagtactcattcattcaggtattggttgaggacttactatgtgccaaacactgttccaggttctgggtatacatcagacaaaactgtctcctgggactagattctagtgagggagataaacagtgggttatatagtatttagatcttgcgctaggtaacacagcaacagaagggaaagctgaacatatgcatatagatgctggtaagagggtggatgtggtggatgaatgaagtagaaaacaaggtcatcatctgagagtgaaaatggggaggaagtgttggaagaaaagagaaggtgtgaaataatttaggacacagcacagcaaactatagcctttggtcaaatcctattttggtgcaatccacaagctaaggatacttttttacttttaaacggttgggaaaaaaatttaagatgatattacatcatagcatgtaacaaataaatgcaattcaaatttcatttatttacatattgcctctggctactttcatgctacagtgacaaagctgaataattgcaaaagagactatgacctgctatgccaaaaatatttatctggccctttacagaaaaagttggctgactcctgatctaggaggatgggaaggtatatagagtagggaaatatgattatcaggcagcattaaggcctgaaggttatggacatgaatttaaagtaagactaaacagcatagttgctgcacagaagtaggtacaaaggcaaagagctggctttaaagttgtgattttgcaaactgaaaatgacaaaaaggggtagactaagttaaaagtacatgcaagttgcatgattataatgagtgatcctgggatttaagttgattatgacaggaacagaaggaacttggagattagggacaatgaaaaggtggtagtgaaaggagtgttggagttaagttactagatgtctggaagacagactgtggtggtcagataatgagatagattatggaggggttacagtttttggtaataacgagagagatctaaggtatgactgagagtgaatggatgagaatagcagagaacaaggtcagtggaaaactactcttcaaagaacctatagtcagggtgttgaaagattaaaaattgctaagaattaaatcaggagtagtgctgcgggaaatgaaatgagcagtgaactaaacttactgagaaatgagaggggatgacccaggggtttgtagattttgtagatgatagcaatgaagagaagagatattatttgatggtatggaactcaaagctgagagttttaagggaagataggagacgtgtctagaagtagtaatgaggagcaagaacatcatctaccccatctccaggaccagtaataggaggactgtgggagaaaaaaatcaccttgagagggctgtagtgaaagcagtatcctaaggtagcagccaagtttcagactgctgggatccaagccagggaaaggtttctgactctttagaatgctgagctttaggctgggcacagtggctcacgcctgtaatcccagcactctgggaggccaaggtgggcagatcacttgagtccaggagttcaagaccagcccaggcaacatggtgaaatcccatctctacacaaaatacaaaaattacccaggtttggtggttcatgcctgtagtcccagctactcaagagactgaggtggagaatcacttgagcccaggaggttgaggcagcagcaagccatgatcacaccactgtactccagcctgggcaacagagtgagaccctgtctcaaaaaaacaaacagaatgctgagttttaaatccctatattcagtaggatgtctcccctcagctcccagttgttgttggtggcttcaactagttcatcttccccaggagataatgaatgaacaaatgaatgaatgaatgaatgagtttataaggggcgaggatctcaggacttcatagtctttcaagtaatcatcttgtttttagccctctacctactacctcttgcttttcagataactgatgcctccaattcctaagccttttctggggttctgtggtacaaacatgcttgcttattgctagtaacactccaccagcccctgccccagacttctgctttctctggtctactcagtttgttccttgttttttgctttccggattcaaagattttgttgacattgcctggatgctgccatcttttgtctcatattctttgtccttaatcatttaacattcctttactgtcattttaatggcatttcaggaggaagccatgtttctagtccaccgttcttttttgttgtttttgagacagagtcttactctgtcacccaggctggagtgcagtagcatgacctcagctcactgcaacctctgcctcccgggttcaagcgatcctcccacctcagcctcccgagtagctgggaccacaggcatgcgccactacaactggctaatttttgtatttgtaagtagagatgaggtttctccatgttggccaggcttgtcttgaattcctggcctcaagtgatccacccacctcagccttctaaagtgctgggattacaggcatgagccaccacaccgggccaatccactgttttttaaaaagttgtcaagagttttgttaaggggtcagacatgtctgactggttgacttttcccagaatgctgcttagtccctcaaacacacaaattcctgatgggtccacccactaggcttctggtatacacagacagatctgaatcccagtggtggaaacaacctaggctgattctgagtttcccactgcatttcttcttctaattgtccctcttttccattcctgtcctttccctcatcccttacctgctgaaaatgaatcttaccatttctaaaattccactcttccgggggcatccacagctggatcctcttcttcactgccattcctcaggccttagaacaggtccccttcttacacccttgtgctccaactggtctttatgaaacctgttcacttcaatatacttttaggccaggctcacgcctgtaatcccagcaccttgagaagctgaggccggtgcatcacttgaggtcaggagttcgagaccagcctggccaacatggtgaaaccctatctctactaaaaatacaaatatatatacatatgccaggcatggtggcatgtgcctgtagtcccagctactcaggaggcagaggcacgagaatcacttgaatccaggaggcggaggtcgcagtgagccgagattgtgccactgcactccagcttgggcaacagagcaagactccgtctccaaaatatatcttatctatatatagatatagataggtatatatagatctatatatagatatatactttcaattctccaattgttcccgtataccatagagaaactcttatgagctcagtttctgcaggacttacaaaacagggtaattgcctcctcattatggtcagctccagcaccattcaaattctctgtccttacccatttccagaacaagcaggatgaaaatcacttatcactatagcacccacccttaagcacaaggttatccaatgttttcaaggagtccagcatttcataacagaaccccctgattagtttgctaactgatgaaagcagagttaaattcctgttatgcaggtttagagtacaggagattctatgtccccatatcctctgccccccaatctatcccttggcaaacacaagtacctctactagaataaccatactccctcttcccaacccacttctcttgtttaagggcactggcagtgtttgtgtatgtcaacaacatcggagtatctggggtccctggagagttagattttctgtattaattacagactgggagattactctggctccagtaaaagcaataccaggattgaagtcccctctctgattatggtggctgggatttgctggaagaggcataggtccagaaaagaatgtaaaaaaggtactagaaagaaagaataaggcctatagccatcaggctgctagaacctttggacaagtcactatctaaaagcaggtaaagacccagctttttgtccatctggtcaggcacctggtggcgtgagtctttcagaacatactggtcaggcggtggctcacgcctgtaatctcagcactttgggaggctgaggcaggaggatcacttgaggtaaggagttggagaccagcctggccaacatggtgaaaccctgtctctactaaaaatacaaaaattagccaggtgtggtggcgggcatatgtagtcccagctacttgggaggctgaggcaagagaatcgcttgaacccaggagtcggcagttgcagtgagccgagatcacaccactgcactccagtctggatggtaaagtgagaacccatctcaaaaaaaaaaaggaacataccacaacccttcaataaaaaggtctctgagaaaacagttgtcacaatgtccatgtacttgtacttgacaccatgtgagaaacagcctccagtaggtcactggccagacaggtgagtatgaaataggacaacactgtattatagctcaggatgcattgataatagaagtttgaagcagcagctgacagacgagtctaagcaataacacacagactagtttgtctctgctcttgagaacagcagcctgcaacccttcaaacaagccataatgtgtgagtcaacaagaagctacatttgattgacaatgccattttaataaagatgttctagagtcaaagaatttggcgtgagaaattgtgcccaggctggggtgcagtggtgtgatcatagctcactgcagcctctgagctcctgggctcaagggatccccctgccttagcctctgaagtagctgggactacaggcatgcaccactgtgcccagctaatttttaatttttttgtaaagatagggtctcattatgtttcccaggctggtctcgaactcctggcttcaagtgatcctcccaccttggactccgaaagtgctgggatgtgctcaatattaaatgtcatgaagatactgttaaaataataattgtgctcaatagttgtatctttatactattctgagccttaggtttcttttctgtaaaactgaacaatactaccttctttgcaggggatagcatagtccctggtttacagtaaatgctttcctccaattgaatcaagatatacctctctgctacctccccatctattagaaatgcttgccttctggtaccagaaaaaaaaaaaaaacaccttccacatgacaactctgaagacaataatcacactaccattgtgtttttctggatgtgccacacattgtatacatgtccctgccttacaaatgacatctcctatacacagagtccttaatatttctacatgcaatgtataatcaattaaaacatcagtatcatcttaatgtgaatttctgttaatccaagttctcccccactatgcaagtgcaataaatatttaaaaatgaaggtaacaatatatatatatatttttttgagacagagtctcgctctgttgtccaggctggagtgcagtggcgtgatcgcggctcactgcaagctccacctcccgagttcatgccattctcctgcatcagcctcctgagtagctgggactacaggtgcccaccaccactcccagctaattttttgtatttttagtagagacagggtttcactgtgttagccaggatggtctccatctcctgaccttgtgatacacccctctcggcctcccaaagtgctgggattacaggtgtgagccaccgtgcttggccaacaatatatattcttaactgtgtaaattttaatttgttggttttattcttttgagattattatgaatattgattctgtcattcatcgcttaaggaccaggcaggtgaaccacttgacattttttatcatcagaataaattgacaaaaacaaaacaaaatactttgaggtggaatggaagtatcttgagtagtagtaaaaccatagttctagatggtgataatcattgtcataatgaaagcgtgttgcttgttgactatttaaccatgctgtttaagtcatattaaaaacatcaatacgtccctctccctctcccctctcccctctcccctctcccctctcccctctcccctctcccccttcccacggtctccttccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttcgttttttttttttttggtggagacggggttttgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatcttggctcgctacaacctccacctcccagccgcctgccttggc

SEQ ID NO: 186 - DNA, 2770 bp, Homo Sapiens
ggaagaggggctggctctcagtccctgcctcgtggggggtgcctcccccccctgcgatgggggtcctgagagccggggaggatgaggggctggctctcagtccccgcctcgtggggggtgcctccccccctgcgatgggggccctgagagccaggggggaagaggggctggctctcagtccctgcctcgttgggggtgcctccccccctgcgatgggggtcctaagagcctggggcggaagaggggctggctctcagtccgtgcctggcggggggtgcctccccccctgcgatgggggtcccgagagccagcgggggaaaaggggctgactctcagccaccacaacatggggggcctttatgttcaggttttgcccaagagtcagctgatttgcttcttgtactagcagggcagttgctgccaaggccctcaaacaggggagccatccttcagaaaccctgtctagttgttcagagacgtaggccaccggcctcagccagggccccacagtttgggttaaaagtccagctgccatcttttctgtctataacgcatacaatggaaaaggctttgtcagatcgggtatccccagggctggggctgccagacatttttcctttaactcatgaaagacttgctgttattgggttccccattccaaaggttccggtccacgccccctttgtgacctcatacaaaggcttggctaatactgcaaagtttgggatgaacagtctacaaaaccccacagcccctgagaattccctcacctgccttctgcccttaggctccggtagattgcaaatgacctgctttctttctgttcccgggcggcatcggacccgtcggagagtaaatcccaagtaaggtacctgccgttggcagatttgagctttcttcttggacacctaatacccacagtcctccaggtgagtcctaagtatcttaggatccgcgatgggggtcctaaggcagggggggaagaggggatggctgtcacccaacccaaaatgggcggcctttatgttcaggttttgcccaagagtcagcttatttgcttcttgtactatcagggcagttgatgccacggccctcaaacaggggggccatcctttagaaaccctctctagttgtttagagacgtaggacattggcctcatccagggccccagagtttcggttaaaagtccagctgccatcttttctctatctgacgcgttcaacggaaaaggctttgtcagatcgggtagccccagggctggggctgccagaagtttttcctttaactcatgaaagacttgctgttgttgggatccctattccaaaggttcccggtccctgccccctttgtgacctcatacaaagacttggctaatactgcaaagtttgggatgcacagtctacaaaaccccacagcccctgagaattccctcacctgccttctgcccttaggctccggtagattgcaaatgacctgctttctttctgttcccgggtggcatcgacccgtcggagagtaaatcccaagtaaggtacctgccgttggcagatttgagctttcttcttggacacctaatacccacagtcctccaggtgagtcctaaggatcttaggatacgcgatgggggtcctaaggcagggggggaagaggggatggctgtcacccaacccaaaatgggcggcctttatgttcaggttttgcccaagagtcagcttatttgcttcttgtactatcagggcagttgatgccacggccctcaaacatgaggggccatcctttagaaaccctctctagttgtttagacaactaggccaccggcctcagccagggccccagagtttcggttaaaagtccagctgccatcttttctctatctgacgcattcaatggaaaaggctttgtcagatcgggtagccccagggctggggctgccagaagtttttcctttaactcctgaaagactttttgttcttgggatccccattccaaaggttccgttccccgccccctttgtgacctcatacaaaggcttggctaatactgcaaagtttgggatccagtctacaaaaccccacagctcccaagaattcccttacctgccttctgcccttaggctccggtagattgtaaataacctgctttctttctgttcccgggctgcgttcggacccctgtcggatagtaaatcccaagcaaggtacctgccgtcagcagatttgagctttcttcttggacacctaatacccacagtcctccagtaaatcccaagcaaggtacctgccgtcagcagatttgagctttcttcttggacacctaatacccacagtcctccaagtgggtcctaaggttcttaggatccttgatgggggtcctaagctgtgggggacggggggctggctctcagtccctgcctcccggggggtgcctccccccctgcgatgggggccctgagagccagggggcaagaggggctggctctcagtccctgcctcgttgggggtgtctccccgccttcgattggtgtcctaagagccagggggagaagaggggctggctctcaatccctgcatcgttaggggtgccttcccccctgcgattggtgtcctaagagccagggggggaagaggggctggctctcagtccccgcctcgtagggggtgcctccccccctgagatgggggtcctaagagccgggggcggaagaggggctgcctctgagtccctgcctcgtggggggtgcctccccctcccctcctgcgatggtggtcc

SEQ ID NO: 187 - DNA, 1955 bp, Homo Sapiens
atttactttgcatcttgtagtgtctctgccagctttattaatagcagtcgcagtataccaggcagaatcttggctgacagtggaatcgattttaagggcagcttctcccttggttccttcaattctataaaaagttgggggagggaataatcaatatagtggtatagcttccctggttattggatttgtataatgagcttagctttattatttccatacttacctgattttgggatatttatgaggcacaatgatgtcactgtttttcaaccatacaatgtcagggttggggttacccgtagctctgactttcatttcaagtcgggaaccttcctttatattgacatttttcagtttttctacaaacatcggttttacctgatgttccacagctgaaagagaaaggtcatgatttagagggagtaaggctgaaatacctgtttataacccaagtgataagaaaattcatttatttttattttatctcattttaccttccacagttaaaatcactgaaattgaagatctgcctgccctgttttgggcaaccacagtccattccccagaatcactgggtgtggcagggacaataattagtgattgagtaccatcttctttaatgactactttatgggtatagtcattgacaatttgctggcctgtgaaaatatgtttaaaagaaagtagattttaaaatagtttttaaaaattgttagatgcatacataagcttgtttttgtgtttttatgattcatgagcaaaaacttatcacgcttaccatcatgaaaccagaacgtctctggcataggtctaccaacaacctttaagtcaaatctggcagtttgcccttctaaacatttgaaagaaacaggttttaacacaaagactggtttatatagtctctcaagttgtgactcatctgtctcctccagcctacgtccaggggacattcttgcaggggacatccgtgcaggagacatccttgcaggtgacatccgtgcaggagacatgcgtataggagacctgctcactgaacgtggagagagagatctgcaaaacaaagacacacaatactttcgtgaggcataaagaaaactcagcaaaacaaacttcattttgtcttattcattattcatgttattttagaatttacttcttgcacgtattagaaggcacctcaaactcattcagatctaaaatagaatatattattgttgcccccacaactatgtttttcctatattctcaattttagctggtagtcattcagtatatccaggtacccaggctcaaaaatcttggaataatcctcaatactctcttttccttaccacttggatttaatcagtcactagacttttttgatttaactactaaaacatcctaataaatgttggttggataagtaaaccaatgaatacatttatggaaaaataaaaaatacacattctttatctcagaggaggaaaacatagaaatgaatttggaaacaaaacaaagcaaaacaagactccatctacacattgcagccagactgacttggagtttgaatgctggcaccaccgcttacaggctggatgaattaagacaattttcatagattcccagggcctcagtgttcctatttccaaaccaataatagtcatctttttattgcagggctgttgtataaatttacatatgtaaaaatcaggtgtcaaataagagctattgtgatattagctatagcactaggaaaataaacagtatgttacactgatgaaaattctttgctcatcttacacaggggcaagaaataaaaacttctggcaattgttggtgttgccaatggtgcaacataccatgaagattaaggaaacttagcaacagtgaacttggaccttctaatagctgtctaaccccgagctcatcacttgaaaatgaaaatatcaaataaaaaaaggaaagtataattt

SEQ ID NO: 188 - DNA, 1956 bp, Homo Sapiens
atttactttgcatcttgtagtgtctctgccagctttattaatagcagtcgcagtataccaggcagaatcttggctgacagtggaatcgattttaagggcagcttctcccttggttccttcaattctataaaaagttgggggagggaataatcaatatagtggtatagcttccctggttattggatttgtataatgagcttagctttattatttccatacttacctgattttgggatatttatgaggcacaatgatgtcactgtttttcaaccatacaatgtcagggttggggttacccgtagctctgactttcatttcaagtcgggaaccttcctttatattgacatttttcagtttttctacaaacatcggttttacctgatgttccacagctgaaagagaaaggtcatgatttagagggagtaaggctgaaatacctgtttataacccaagtgataagaaaattcatttatttttattttatctcattttaccttccacagttaaaatcactgaaattgaagatctgcctgccctgttttgggcaaccacagtccattccccagaatcactgggtgtggcagggacaataattagtgattgagtaccatcttctttaatgactactttatgggtatagtcattgacaatttgctggcctgtgaaaatatgtttaaaagaaagtagattttaaaatagtttttaaaaattgttagatgcatacataagcttgtttttgtgtttttatgattcatgagcaaaaacttatcacgcttaccatcatgaaaccagaacgtctctggcataggtctaccaacaacctttaagtcaaatctggcagtttgcccttctaaacatttgaaagaaacaggttttaacacaaagactggtttatatagtctctcaagttgtgactcatctgtctcctccagcctacgtccaggggacattcttgcaggggacatccgtgcaggagacatccttgcaggtgacatccgtgcaggagacatgcgtataggagacctgctcactgaacgtggagagagagatctgcaaaacaaagacacacaatactttcgtgaggcataaagaaaactcagcaaaacaaacttcattttgtcttattcattattcatgttattttagaatttacttcttgcacgtattagaaggcacctcaaactcattcagatctaaaatagaatatattattgttgcccccacaactatgtttttcctatattctcaattttagctggtagtcattcagtatatccaggtacccaggctcaaaaatcttggaataatcctcaatactctcttttccttaccacttggatttaatcagtcactagacttttttgatttaactactaaaacatcctaataaatgttggttggataagtaaaccaatgaatacatttatggaaaaataaaaaatacacattctttatctcagaggaggaaaacatagaaatgaatttggaaacaaaacaaagcaaaacaagactccatctacacattgcagccagactgacttggagtttgaatgctggcaccaccgcttacaggctggatgaattaagacaattttcatagattcccagggcctcagtgttcctatttccaaaccaataatagtcatctttttattgcagggctgttgtataaatttacatatgtaaaaatcaggtgtcaaataagagctattgtgatattagctatagcactaggaaaataaacagtatgttacactgatgaaaattctttgctcatcttacacaggggcaagaaataaaaacttctggcaattgttggtgttgccaatggtgcaacataccatgaagattaaggaaacttagcaacagtgaacttggaccttctaatagctgtctaaccccgagctcatcacttgaaaatgaaaatatcaaataaaaaaaggaaagtataattta

SEQ ID NO: 189 - DNA, 24910 bp, Homo Sapiens
aacccgtgattgctgggactggctcaagctccaccaggagccgtcgttcttttacaaagaggggtggaggttccagtggaggctgttgttgcctttttttttttttttttaatgaatggagggcggcggcgactgctgcagctgggccagctgcgcgggctgcaccccctcccagcctgcgagaggagctagtagaagatttgtaccaacaaaaccaaggagtaaacaacttgagaataactgcatgagctcagggcttggactgtcagattccatttctaagcttccagaagagcgacacatagacactggggaagtcagagcctttgaactccaatgccatccccgtcacccacctccaccaccagcaccaccaccgaatggcactttggacaatttttccctctcatgtgacttttgtcatttcttacgtcagttggagccagcacctctcaaatccatcttctaaaacccagaaaattgtgtgtaacacatgatgactgaaagggagtaggctgaccagttaagagcctgccactggaatggaaggctgtgggaaggtgaggggacggtggacatcaaccgggaagagctgaaagatggcgttaccagataaggaaactgagtctcagggaggtcaagagacatgccaaagcacagcttggaagtggtaaggtgaagaacagagtgctggtgttctgcttcctggtttgtctctctccctctggtttatgtcatccagcccatttctccctgtacctggagatgctccctaagcaaacttttctgtgcagatgcagattgaatacagatgttacaatagggttagtcccacatagctgaactctttctaaagaaagacagaatcgtttgcagagaaaaccagagcttgtttcctaaaaacttccctggtagagggtgggtttttgtctttttggcccaagacagagatggtggatgaagcttctccttcaaatcttcaagatttaaagaaattgctccgcctctttgcctggaggaatgccgtgctgctcaaaacacacttttggacacggcacatttttctgtcacagtggaaagacctgactccctcaaaagggtgtttgcaaaaagcatcgcgttctcagaatgacaaaacagttttaaaagaaaaaaacattgtgtcagccctgcagcttatcaatataaaatgaagactaagattcatttatgtgaatggatcattttttgggggagggagttgttaaaaattcatatatcttggctaatggaaccacttccatatccacaatgaaaaaaattaaaaaggaggcttataaaacctttcctggaacaaccagaaaaggagtgagtccctgaaaatacaaattggtggtgttatctttgcatatttgcaaaattctttgaacttctgaatagtctgttgtggacctagtctgctgttactttgacacagggtcttgctctgttgcccaggatgcagtgcagtggcgtgatcctagctcactatagtctcaaattcctgaggtcaagcactgcttccacctctgcctcccaggtaggtagaattacaagcatgtcaccacacctggctaattttttttttttttctttttgagtaagtgtctcacactgttgcctaggctggagtgcagtggtgtgatcttggctcactgcaacctctgcctcctgggttcaaatgattctcgtgcctcagtctcccagtagctgggactacaggcgtgcaccaccatgcctggctaattttggtatttttagtagagatggggtttcgcatgttggcacaggctggtctcgaactcctgtgcctggccctagttatttttatattaacagtaatgaccaagctctgagaggttccttaatattagtagcaaaggtaggattcaaatgcaggtctggatgacccataacacatatcgttttgcactactcggtttgccttaaattagccccttctttggaataaagcaccctgttaagaagacaagttgaaggccgggcgtggtggttcatgcctataatcccagcactttgggaggccgaggcaggcagatcacgaggtcaggagttcaagaccagcctggccaacatagtgaaaccccgtctctactaaaaatacaaaaattagccaggcatggtggcgcatgcctgtagtcccagctacttgggaggctgaggcagtacaatagcttgaacctgggagacgcaggttctggtgagccgagatggcgccactgcactccagcctaggcaacaagatcaaaacgccatttcaaaaaaaaaagaaaaaaaaaggcaccttgaatgtcacatttgtcctcttcaaggtacttgctatctaaggtgggggtggagaatcctttattttacagaaacagtgattagttcttaagccttacttcatagataaggaaactgtgaatcaaagaggtcaagtggggcaggcgcggtggctcacgcctgtaatcccagcactttgggaggccgaggcaggaggatcacgaggtcaggagattgagaccgtcctggctaacacggtgaaacctcgtctctactaaaaaatacaaaaaattagctgggtgtggtggtgggcacctgtagtcctaagtagcttacttgggaggctgaggcaggagtatggtgtgaacccgggaggcggagcttgcagtgagccgagattgtgccactgcactccagcctgggtgacggagcgaagactctgtctcaaaaaaaaaaaaaaaaaaagaggtcaagtgatgtgttcaaggtcacagctatgaagtgacaagaccttttttttttttgagatagggtcttgctctgtcacccaggctggagtgcagtagcgtgatccccgttcgctgtagccagcgtcaagctcccaggcttaagcaatcctcccatcttagcctccccagtagttgagactacaggcacttatcactgtgcaccactaattaaaattttttttttttatttagagatggggtctatcaatgttacccaggctggtctcaaattcttggctttgtgatcctcccacatcagcctcccaaagtgctgggattacaggcatgaaccaccacgcccggccttcacatattttacttacttcccacttccctccttacctcccttccctcttaatttctggctggtcagtgagcccagtagggctatcctgctgcaatcacatctgcagtgacagcgtttccctgcttcacactctgggctccctggtgactgtcctgctatgtacgaagttcattggaggtgcacacattaagggtgaaaaaatgctgggacctcctaacatacaggggaggtgggctagtgaggccactctgtatttgggctttagagtcacccagcctgggtgttaatcctggcctgtgccacattggcagtgtgaccaaaggtatgttatttaatatatctgtgcctctgattctgtatttgcaaaatggggatgagaccagtacttacctcgtagagatgcaggaagttttagaagcattagttcatgacagccctggcactgataagtgttagggactattatccaaaacaaacacaaaacattaggtcctaccttgttagttttagagttaattgatttaattaactgacaataaaaacaactaataataacaatagctaacatgtgcctggcatagtgccaagtacctttaattattaacttgtttaaaaatctgaaggtacaagagggatatgtctccctcctaccctgtattatttagggttctacagagaaacagaaccaataagatatagagagaggctgggtttggtggctcacacctgtaatcccagcactttgggaggctgagacgggcagatcacctgaggtcaagagttcgagatgatcctggccaacatggtgaaatcccatctctacaaaaattagccgggcatggtggtgcacatctgtagtcccagctactcgggaggctgaggcaggagaatggcttgaacccaggaggcagaggttgtagtgagccgagatcacaccactgtggtttagcctgggtgacagagtgagactttgtctcaaaaaaaaaaatatgcatagaaagaaatttattatgagggattggttcatgacatggaagcggagaagtcccacattctgccatctgtaagccggagaatcaggaaagccggtggtggagttcctttccaagaccaaaggctggaggaacacagagcaatggtgtaagtcccagtctaagtctgaagaccccaaaaccaggagtgcagatgtctaagggcaggagaagatggatgtcacagctccagaagagagaattaactcgtcctctgcgtttttattccatgcaggtcctcaacagattggaggatgccagtccaccctagtgagggtgatctttactcagtctactgattcaaatgctgatgttggccccagtacagtggctcacacctgtaatcccagcaatttgggaggctgaggcgggcgaatcgcttgagcccaggaggttgagaccagcctgggcaacatggcgaaacctcatttttacaaaaaatacaaaaattagccaggcgtgctggcgcatgcctgtattcccagctactcaggaggctgaggtgggaggatcagttgaggccgggaagtaaaggctgcgatgagctgtgattgcaccactgcattccggcctgggtgacagagtgagaccctgtctcaaaaaaaaaaaaaaaaaaaaaaagctaatgttttctagaaacacagacacacccagaaagtattttgccagctatctgggcatcccttatcccagtcaaattgacacataaaattaaccatcacgcccccatggtttcctccatggaagcagccattattaccaatactctgcgtatcttttcagatatcttctgtgcagacgattatttaaatatctttctaccccttcagctttaaatgtaaggaaacgggctcagagaagtcatatagtgaattgtaataatagctcctattctgtgtgtgaggctctgccctgggcactgtgtgattttgaatcctggctacaaccatgcagcatgagacttattgtgtagaatagatgctccaggcctcagtttgcctcagtgggttgactgaggattaaatgaaataatccatgtagaggggcttctcagatcctggcacatcataactgctgagtaggtgatgactgcaggggaggggaggatccgaggtttttttttttttttttttttttgagacggagtctcgctgtgttgcccaggctgatgcacttagatcctcggccgggtgcggtggctcaagcctgtaatcccagcactttgggaggccgaggcgggcttatcatgaggtcaggagatcgagaccatcctggctaacacagtgaaaccccatttctactaaaaatataaaaaattagccgggcttggtggcgggagcctgtagtcccagctactcgagaggctgaggcaggagaatggcgtgaaccctggaggcagaggttgcagtgagccgagatgacgccactgcactgggcgacagagcgagactccgtctcaaaaaaaaaaaaaatactaggaatgtaagtgaatatttatttcaagtgagaaacagagctctaacaatttacacattttatcttttttttttctttttaaaagttttttttttttttggctgggaccggtggctcatgcttgtaattctagcactttgggaggccgaggcaggcagatcaactgaggtcaggagttcaagatgagcctggccaacatggtgagaccctgcctctactaaaaatgcaaaacttagccaggtgtggttgtgtacacctgtaattccagctacttgagaggctgaggcaggagaatcatttgaacctgggaggcggagtttgccatgagcagagattacaccattgcactctggcctgggcgacaagagactgtctcaaaaaacaaaatttttttttttttcttttgtagaaatggaaccttgctatattgcctgggttggtctcaaactactgggctcaagcattcctcccacctcagcttcccaaagtgtccgggccagtttacacattttaaaagccaacaaatacctcaaacactacacactccagaagaataataggacattttttcttaatttactgcctgacacacttctgtagcactttttattcctatattatccagcttcatactctttgatcacttcttcatatgataatgattttctaaaataattttctgtagagcgaataaaagataattcagtcttttctctagcatgggtgatcaaaatttgcttttagttattgatagtctagacgcaaaaaataaagacattcatagacacaaacactgtctgtagtattactacgtgtttgtgtctctcagaggaattttagtaaattcagttttgtgttattcccaccaaaaatgaaaaaagaatctaaggtgggccaggcgtggtggctcacgcttgtaatcccagcactttgggaggctgaggcaggtggatcatgaggtcaggagatcgagaccatcctggctaacacggtgaaaccccgtctctactaaaaatacaaaaaattagccgggcgtggtggtaggcacctatagtcccagctactcaggaggctgaggcaggagaatggcgtgaacccgggaggcggaggttgcagtgagccgagatcgtgccactgcactccagcctgggcgacggtgcgagagtctgtctcaaaaaaaaaaaaaaaagaatatgaggtgcattacaattaaatgcacgtgttaatagagtgtatttcttttttattgttattatttattgaggcagagtcaggctggtcttgcactcctgaccccaagtattccatccacctcggcttcccaaagtgctgggatgacaggtgtgagccaccaagcctggcctagtggagtatatttctgacagacgagaacttccattttgattgactcttcacctatttttcatgtctaataacgggaagcatttttcacaggcgagcatctaactatatacattttaaaccttccttcttccccaccacatccttcaggattgggccctgtaggatgtgttcatatggtgatacaacttctgatgaggtgtcaggaccttggtggggggtacttgctactggagttttactgggagctgttcctaccctgggagggttagcaatactcagcttaatgatctgctaaactcaatgtaccagcgactcaactcccatgtgcgtgcatccctgaatgcccgtggccactcttaacgtcacacaacaggaagggagaaggggcagaagggagactggagtggagagagatggaggtctttccacttgtggttaaaagacttgatgctggcaaatgttagagaaaccaaagaccatccgatggatgcttttctttccgggccctttgcaagaccttggaaggggctgatccaagcagggatcctgaagcttcagctgtgttagcctcacggtggacctggttagttatcacttatattcatggttcagggcagtgtcatttgagagcgagccgtggagcccactcaggagctgcaggcctcgctggcatgttaacatgctccataaaccttggttcctcagcaggaagcatgacactattaatagtctccacctcactgggaatataaagtccacgagggcaggcactggtctgcttattgctgtgtccttggtgtatagaacccatgggccgcactgaacatatggtatgctaggtgttgggtggctacccccaaactctcagagaaaaggaaactgaggcacaatgagcttacataccttcacttgaagccagacgtgtccagctccaaattccttttcctgtacaacatgctgcccctagtcaactggatggagatccggggtctcggcctcctttccttcctgcatattctcccatgcaaactgaacaagcaggggaaacttagcccacctctgagttcctgagatcatcatctgagttattctctcccttatggatctgagaaggagtccctgggatttgttctgatccatggaatacattgttctagagactctttggactccaacctgagtccctgggaatgatgtgaggtaggagatgtggaagaacaaaaatgaatggttttgagccataaaatagtgagcctgaaaaacgagtttggaagatgaatggctttggggcttctggaacttagcaggggctatcctgggaattactgacatttctgcctcagacctctgggaggccactggtaaaccagaggccacccccctcccttcacaggtccattggattcgaaggggtcctcacacgaagcaggaagtcaccctgtatctcagaactgtggagatctcagtccgtggtcatcttgtcatacatgacatggcaggagccatggtccagggaaccaggtggctgccaacttgcagaacaggcgacaaaaccccagcctggacccccagaccatgcacttctccctttgccctgcttctcctctgcctggtacaggtttccagccaagctctgcaccggcttctatgtctgtttgttttccttagaagcttcctatagaaagcaccaggtaaggctgaagatgctcacttccccctgttgtttaacaacgcaactgggattttgcagcctctgcttccagcctaattctccattgagccctgggataatatttacacacaaatgctggctctaatctccacccaggaaaacactagctgctattgaaaatcttttcacccgtgatagaaagcagagcggccaggcctcacgcaggcaccctcgagcttctctggagagtgttagggaacagcaagtgtgttttatttatatttttttaaagtcatcccagggctgtgtccaggcaactgagggcctgtcaaagaaccgaatgtctaattccctttagaaaaaacaaagggattaggtgtccctgggactttaacaaatgcattgttggtggttttgatttaggtttcatttagggaaggcaagtgcagaaacgaggatgccaaagatccaggctaccagtgttgcgaagatgcctggagacaggcatgcataaaatgttggcggggatgtaaattagtgcagccttttggagggaaatttggcaacatctttcataaaaaatgagcgtgacctttgatgcagtaatttcatgctttgtaaactacactacgttaatagttgcacgtgtatacaaaaacctatgttaaaaaatgctcactgcagtgacaaataggaaatcaccatgaatctatcagtaggggcctggtttgataaattatattttatccacagagtggactactacatggccagtaaagaaaagaacaaggtggggccgtgtgcggtggctcaagcctgtaatcccagccctttgggaggccgagacggcggatcacgagatcaggagatggagaccatcttggctaacatggtgaaaccccatctctactgaaaatacaaattagccgggtgtggtggcgggcgcctgtagtcccagctactcgggaggctgaggcaggagaagcgtgaacccaggaggcggaggttgcagtgagccaagatgacaccactgcactccagcctgggtgacagagcgagactccgtctcaaaaaaaaaaaaaaaaagaacaaggtagattataacaatggccaacatacatatagcacttactgtgtacacactagtctgaaagttctatgtattttagaatatctgcacatttataatattaactcatttgattttctcaacaattatctggttactattactagaatttttttaaatcaggaaagagatgttaagtaacttgtctaaagtcacatagctggcgagtcggggagctgggcttcaagtcatctggcctcagggtctgggtcaataaccactacccaaatgcctgtatgtacaggcatggaaagatgcttttgacatatgattaagtggaaaattcaagtagcagagaagtaggagcttatctttttcaggtaaaaagaagctgcatgtgtgcatgcctacgtgaatatattttatatatttgtaatagtaaaggttctggaaaaatacgtgttcaatcagcaattctcaaccaggaagggaggtgagatgggctacataaagaggattttggctgggggcagtggctcatgcctgtaatcccaatactttggtaggccgaggcaggcttgagcccaggagttccagaccagcctgggcaacatattaagaccccatctataaaagaaaaaaatttttggctgggcgcagtgcctcacacctgtaatcccagcactttgggaggccgaggcgggcagatcatgaggtcaggagatcgagaccatcctggctaacacggtgaaaccctgtctctactaaaaatacaaaaaattagccaggcttggtggtgggcacttgtagtcccagctactcgggaggctgaggcaggacaatggcgtgaacccgggaggcggagcttgcagtgagctgagcttgtgccactgcactccagtctgggtgacagagcgagactccatctcaaaaaaaaaaataataataataaataataaataaaataagtgcagtggcacaatcttggctcgctgcaacctccatctctggggctcaagcaatcctctcatcccagtctcctgaataactgggactgcaggtgcaagccaccacccctagctagttttcatatttttggtagagacgggcttttgccatgttgctcaggctggcctcgaactcctgggctcaaagtgatctacctgcctcagcctaccaaaatgctgggattacaggtgtgggctactgcttcccgccaaatttctttttttttttttttgagatggagtctcgctgtgtcaccaggctgcagtggtgtgatcttgactcaccaaaacgtccgcctccgaggtttaagcgattctcctgcctcagcctctcaagtagctgggattacaggcatgcgccaccacaccctgctaattttgtatttttagtagggacggggtttcaccatgttggtcaggctggtctcgaacttctgacctcatgtgatctgcccgccttggcctcccaaagtgctgggattacaggggtgagcaatcatgcccaaccatttggttttcttttctaaatggtcctttcaaaagaagacttcctgttaatcgtgggctcagagtgacacttttgattaacaccaaagtaagagatgtggagccaagcctaataagtcttgcaataaattggatgaaggtagaccaattaattgttgttctgattggctgaagggatcctgagataatgactcttgtcctcattaccctctagtcttgccttctcctggaagctttggcccagatgttggaagagtaatgttgattttcttgacatacagcccctccacattccatcttcactcccatgcccccctgcatttaatgtgttcatttaatgcattattgcacctcatgtaaatacccctggtactttacttgggctgttgtttaaaccactgtcccttcagggtcatccagtaaaaaccggactcaggctgccttccatttgcaggcactttacaatctcctaatcttgttcccattcattattttggttaacggggtggagccttgtcactttaatgcaggttgtgcaatatctctttcaaagtaaaactaagcagggtcttaggagagggtctgatgaggacaatgagggttatcaaaattttaatccccatttttaaaccccagtgtttaaaccttgctttgtgaagtgtaacctatcacagtgaatatagaaaaatgacataacagcttctacttactgtgtcaggtcaaaaagcacccaaagtttccatgtgttttctcagttttgttcttgcagcaagtttagggggtactttttttttaaatctcccattatctccataaggaagccgaggctccaggagactaggtaatgtcctcaacaatacacgtgtggaaagtggaaaatggatttctcaaccaggtttgtgtatctgtctgcaattcccagtgctgagcctctcaatggatgaaataattgagaaaagaaaaaaagtgtaactcaaaaaccacccccctaatagatagtagtactcatataccatctccctaacatactgttagcaatttaggtttatttcctttgtgttatgtatctaaacaaaatgaaatttaaaaaaacaacttggtaactagaggatatgtaaaatgtttatatcctgttttgatttttttttgtcctactaacattgtcatcgtaaccatcttccttattgcttcgtgtcatcattttaaatggttgcactctatttagagagtggtggccttgggggagagattcctagatgtggaaattggtaggtccaagagtataaatgtttttatggtttttgatacacattgctaaattgctttctaaaagatctattttaatttgcacttcaatcaacaattttgagagtgtcattttcatcacattcttgctggcattagttattgttagaaaacgaaaccaaggccgggtgtggtggctcacgcccgtaatcccagcactttgggaggccaaggtaggtggatcacgaggtctcaagatcgagaccatcctggccaacatggtgaaaccccgtctgtactaaaaatacaaagaaaattagccaggcgtggtggtgtgcctgtagtcccagctcctcgggaggctgaggcaggaggatgggttaaacccgggaggcataaattgcagtgagctgagatggcgccaccacactccagcctgggcgacagagcaagactccgtcttaaaaaaaaaagaaaaagaaaacaaggccaggcatggtggctctggcctgtaatctcagctctttgggaagccaaggtgggtagatcacttgagctcagcagttcgagaccagcctgggcaacatggtaaaaccctgtctctacaaaaaaatacaaaaattagccagacatggtggcacgtgcttataggcccaattactctggagggctgaggtgagaggatcatttgagcctgggaggtggagactgcagtgagccacgatcacaccactgcactccagcctgggcaacagagcaagaccatgtctcaaaaagaaaatgaaaacaagaaaaagtcctaatatctaccaaattgttcacagtagttagtgtcgagagtgggctggggctggtgaagtgaggaggtgtctattttcttttcttttctttttttttttttttttttttgagacagagtcttactctgtcacccgggctggagtgcagtggcatgatctccgctcactgcaccctccacctccaaggttcaagtgattctcctgcctcagcctcccgagtatgtgggattacaggtgcgtgctaccacgcccagctaatttttgtatttttttagtagagacagggtttcaccatgttggccaggatggtctggatctcctgacctcgtgatatgcccgccttggcctcccaaagtgctgggattataggtgtgagccaccgtgcccagccaggtgtctattttctcctgtatctaatgtggtattattaaaaatattttattataggcacatattacttttgtgttttttatatatatacgtatatatatacactttttttttttttttgagacggagtctcgctctgtcgcccaggctggagtgcagtggcgccatctcggctcactgcaagctccgcctcctgggttcacgccattctcctgcctcagcctcctgagtagctgggactacaggcgcctgccaccacgcccggctaattttttgtatttttagtagagatggggtttcaccatgttagccaggatggtctcgatctcctgacctcgtgatccacccgtctcggcctcccaaagtgctgggattacaggcatgagacaccgtgcccggcctgtcatatatattttaaactttattttgaaataatttgtctcatagaaaagttgcaaaaataatgcaaagaattccctgtataccctttgtaacacatatttttttgttttgttttgtttgtttgttgagatggagtcttgctctgtcaccaggctggagtacagcggcgccatctcggctcactgcaacctctgcctcctgggttcaagtgatcctcctgcctcaccctcccaagtagctgggactacatgcccgcgccaccatgcctagctaattttttgtatttttagtagagacggggtttcaccatgttggccaggatggtcttgatctcttgacctcgtgatctgtccacttcagcctcccaaagtgctgggattacaggagtgagccaccgcacccaggctgtgatacatatgtttttttgagatggagtctcgctctgtcgcccaggctggagtgcagtggcgcaatctctgctcactgcaagctccacctcccgggttcacgccattctcgtccctcagcctctggagtagctgggactacaagtgcccaccaccacgcccagctaattttttgtatttttagtagagacagggtttcaccgtgttagccaggatggtctcgatttcctgacctcgtgatccacccgcctcgcctcccaaagtgctgggattacaggcgtgagccaccatgcccagccacttatttttaaatataaagtaattaaaataaatgttttctaaatgtcagtccttacatcaacttgtaagttgagatttcttcataggtaggctagggctcaacagcaacttggggaaatgcttattaaaaatgtaaactcttaggcctgagcaagacatcgaatcagaatgtttgggggtgagcttggaaaatctttcagtagcccttctcctgccctctgaggcccatcaggggctgagaaccagtgtcagacaggttcctctttatttcctccagcaatattgtggcttcttcaccttgagagccctccagtgtgcaagggtttggaaaagtgagtgaaatctgagcatctttgttgtgacttttcccacttggtgctgctactgctctgctccagccaagctgtctgtaatttgttttcacaagagcctgctctctccctcaaactagaaaagacccctccacaggaggccaggtccggaacgcaggtttaggtggtgtaggcccttctcaccctcaccccttctgtcctgagtgttccaggtggatgccaaggaggtggaggaggcttccctgtctcctggctctcctggaggagcaactgtgaggccccgagatggggagggagcccagattctggcttttggtcttcctgctgtttcttttgtctgatgctggtgcatttccatggacagtttatttcccttggacactgtgggcttggtttttccatgagtgtgtgacgctgtggtcattcaccaggccctgttggtggtctcggtgggggccacaaggctcagatctcacctgccccttttcctacctcctccactctttgctcagccatcaacattcctttctgtcccagaagtgttctttccaaaatgcagatctgcccatgtcccctaatgacgtcacttattgacttcgctatggaaaaggagcgatggggaatgtggccggaaggacagcagagagccagactgtggagacctttgaattccagaggaacaaaagtattttgggtggctcacacctgtaatcccagcactttgggagaccaaggcgggcagatcacctgaggtcaggagcttgagaccagcctgaccaacatggtagaaccccatctctattaaaaatacaaaattagccaggcagggtggggggtgcctataatcccagctgcttggaggctgaggcaggagaatcgcttgaacccgggaggcagaggttgcagtgagccaagattgcaccagtgcactccagcctgggcaacagagtgagacttggtctcaaaaaaaaaaaaaaaaaaaaaaagaccgggcgcagtggtggctcacgcctgtaatcccagcactttgggaggccgaggcaggcggatcacgaggtcaggagatcaagaccatcctggctaacacggtgaaaccccggctctactaaaaatacaaaaaattagctgggcgtggtggcgggtgcctgtagtcccagctacttgggaggctgaggcaggagaatggtgtgaacccggaaggcagaggttgcagtgagtccacatcatgccacagcactccagcctgggcgacagagcaagactccgtctcaaaaaaaaaaagtgtcttatataaaaatatatacataaaatataaaaataggcggggcacagtgtctcacacctgtaatcctagcactttgggaggccaaggcgggcagattgcctgagctcaggagtttgagaccagcctgggcaacacaatgaaaccccatctctactaaaatacgaaaaatcatccgggcatggcggcgggcgcctgtagtcccagctactcaggaggctgaggcaggagaatcgcttgaacctgggaggcagaagttgcagtgagccgagatcgcgctactgcactccagcttgggtgacagggcgagactccgtctccaaaaaaaaaaatatgtatacacacacacacacacacacacacaatatacaaaaaatatactgttttatgtataaacatacataaaatatacatatacatgaaaacatacatatcaatatacataagtatattatggactaatacaggcaatttggaaaaaaagaaagtagaaagtagggggaaaaaagttgctagtcgttctgctagccaagtaaagctgctggctgcatttgggtgtggtcgtgtgcaggataagggcacaggccctgaatcaggtgagtctgggttcagatgccttccttcttccttattagctgtaggcaaccatcgggcagcttaattatcctctgggtgcttcagttttctcattggtgaagtaaggataaaaaaaagttcctaatgtgtaggcttgccttgaagatgaaatgaggtaagtatggaaagcagttagctggctgcttcctaagtgttagttctgtttaatcttgttcatttcctttcagtccttttactctaaagaggggtgtgtgtgtttggtttgttttcacatagttgtgatcacattgtctatataattttatttactgcttgcttagcataacatctgtagccaagcattttccatgttattttcaactcctcataaacatgcatcttaatagttgcataataatccgatggatggatatatcatagtttaaccatttccttattgttggccataggaattgttccaggttttcattgttacagaaaactcaaggcatgactgggcatggtggctcacgcctgtagtcccagcgctttgggaggccaaggcgggtagatcacttgagtagatcaggagtttgagaccagcctggtaaacatggcaaaaccctgccccgtctctactaaaaatacaaaaattagccaggcctggttgcaggtgcctgtaatcccagctacacaggaggctgagacaggagaatcgcttggacctgggaagcggaggttgcagtgaaccaagatcaagccactgcactccagcctgggcgacagagtgaaactccatctcaaaaaaagaaaactataggcatgaacacctttatgtgtcagatatcaccagcaaaaccagccccacttttcccagcctgttagaacaagttccttgagaaaaattcttagaaaggatgttacaaagtcaaattatatgaatatttatcaagatttgtgacttatcctgccaaattcattcctgtaaagtgagttcccacttctatttccaagacagtggatgagactgtggctgagggatgtggattttgttctgcagtgctgctggtgagggcatgagaccagggttttgatggattcatccagcagccattgggtgggtggctgggcagagtcggcgttaggaggctctcagcggtgacttaactatctgcaaacctggccccatccccatgatgactagagctcccatccgtaggagagggaggccctgtggtcacagtgtcacattccttttcagtccagcataagcactttcacattgttttttccctccgtgattcaaatgacaagaactcttcatctttagggatcacagtataagacagtgaataagttcatgagccttggtgttatcctgcctggattgggatctcaactctactatttattagctgtgtgattctggacctcagtttctcaatctgagacatggtactcacctcctaggattaaattaaacaggtattttatacacaacataataagtgctgaatgcttcttagatcttcttatctatctccctctttctaaatgaaagcgcctggttgaaagaaactaattgaacctctgtattcaccactttcctcctcttgaaaatgcaacaagggaagctgtataaagaaacaatactgggccaggcgcggtggctcacgcctgtaatcccagcattttgggaggccaaggcgggtggatcacctgaggtcaggagttcaagaccagcctgaccaacatggcaaaacctcatctctactaaaaatacaaaattagccaggggtggtggcacatgcctgtaatcccagctactggggaagctgaagcaggagaattgcttgaacccaggaggcagaagttgcagtgagccgagatcgcgtcatcgcattccagcctgggcaacaaagagcgaaactccatctcaaaaaaaaaaaaaaaaggaaaaagaaacaataccagaaagcccatctctacattgctaggcaacctttccaaggtgtgtacccaccctgaaaccatggggatgaagggaaggaggttgggaggctacagtggtgcatgaccaatcatctcgggacatggtactgtcagtgctaagactgggacagtccctggcaaaccaggagtgttagtcaccctggcatggtgagagtgggtgaaggatctggtaaagttgtccaagggtgggagaacaagactctggagcatttgagaagggtttgcttttcctttaattattgtttggcaaatccccttgaagctcatttcacctgcaacttctgggaatgaattggctgccaaaaataagacccacgtggggtgggggcaggggggtaattaagtgcctcccaggaagcaggggcaaggatacttcaatatcttccagattcctagagtgtgaatgatgtgagcttgccttggggtgaaggctgctggagtcagctctttccgatcctggctagttttctgctcctaataaaggcttctttcatggctgggcaagaggaagactcagatggccctccgtggacaagggttggttcccgaatctgtcccaggtaacttcttgttcctctgggtctctgtgtgtaatatccccagagacagaggccaagagaggggaaagtgactacacttacactgcaggccagcggagggggtggtcaatagctggtacttcctcttccagctcttttaaagcattttaaaattggattagtgtttcaacaaacacttgaaggtttgctttcctcggagaggcccgaagggctgaggaagagccttcatctgtttactttttctttatgtggaaatctacttgggctgtttctacaactagcttgcccctctcccttggtgccccctccaccaggtaaacctcaccccctaacttccaggcaggtctgcattcaccctcagggccctggcccaccatggctttctgggttggctgaatcctcgtgccctccaggagcactttggagcagcagggctcaggcagctctctctgacctgtgccagccttgaaagttttcctggaatgaagaagtgagctgacagtggacagtcctgtgtacttcatctgcttcttgcagggaaaccaacagaagcggtctctttcctcctgtgggtagagaaagccaggaagatggggcaaagccttgggaaaacaggtggctctcagccccaccagagctctttgtcctcatcctttttatttaagcccctgcttggagccaggcagtgtgtgtgtgtgagagagttgtgcaaacagatatgtgcatggatgtatgtacagaggaaaaaaagactggggcagggcattgtggagctctgaaagggaaggagggcaggcggtcaaagtagacttctatgttttattctgtgtattagtatattatatatgaacacatttaaagtacatattgaataataagagaattatcctctgagatccatgtgatcactgttaactgaagtacagggtcaagccttggaagattcaggaatgacttcccagaggaggtggcgggcaaacagagatcacaggataagtggaggtagctggattcattttatagacatttgttgagtgtctgttgtgtgtcagatactatttttttttttattttttttgagatggagtctcgctctgtctcccaggctggagtgcagtggcatgatcttggctcactgcaactgccgcctcccgggttcaactgaggcaggagtgcctcagcctcccgagtagctggaactacaggtgtgtaccaccacgcccagctaatttttgtatttttagtagagacggggtttcactgtactggtcagactggtcttgaactgaccttgtgatctgcctgcctcggcctcccaaagtgctgggattacaggcgtgagccactatgcccagccccagatactattttagaagcaaaggatctagcagagaataaacacataaagatcttgccattgtggaacttacagtccagtggagggagaaagatgaacaaaaagatcatatgatgtcaggtggtattaaagaagaattaacacttatggtaaggaagactttattcaagactattgcaacaggagttgactttttttcttttttttttctttgagatggagtctctgtcacccaggctggagtgcagtggtgcgatctcggctcactgcaccctctgcctcccaggttcaaccgattctcctgcctcagcctcctgagttgctgggattacaggcacataccaccacacctggctaatttttgtatttttagtagagatagggtttcaccatggtggtcaggctggtcttgaactcctgactgacctcaggtcatccaccctcctcatcctcccaaagtgctgagattacaggcatgagccattgcacccggcctaggagttaacttttgcaatagaggaaggaggttgagttcatcactgaatccagcaaagacctagttgggcatttataatcagagtgagggggtcattgggtggaaaatcactaagagaagacacgaagggtaggggaactcttgctaaaccaactcaacaggattctgtggaaggcaggccaaggacttacacattaaaagtgggggatgaggaacttggtcagatattgagggtgggggaatgactcagctgaattatttgctaaaggcaggccacatgaagaagaggatctagaggagcctgtctaaagtttggtcaaggagagagtctttgttggtgctgtgaagcaaatgaagcagctgtgggatagtgaggctacagagtgacaggttaggccctttttttgtttttgagatgggtgtcttcttctgttgcctgagctgtggtgcaatggcttgatcatagctcactgcagcctcgaactcctgggcccaagcaatcctcctgcttcagcctccttactagcagggacaacaggcacctgtcattgtgtttggctcataggggtgctttttaaatttaatttagttttatttttgaggtgaagtgttcactgtgtagcgacacgatctcggcccactgcaatctccgtctcccaggttcaatcaattctcctgcctcagcattctgagtagctgggattacagccgtcctccaccacgcctcactaatttttgtatttttaatagagacagggtttcactatgttggccaggctggtcttgaactcctgacctcaagtgatccacccgccttggcctcccaaagtgttgggattacaggcgtgagccaccgcacccggcctgcagtgctttttaatactcagtgttagcaaggtctttagggctgaaatctggatcatgtgtcagagccagactttcaaatggcccccctagagggtgtgttctgggtaaaggaaacagcctgtacaaaggccctgaggggtgtgttcagtgtgtttgagcaacagtgaggaggagggggtttgtaggggaagagtgataggaaataaggttgaagagggtggggtgagagtagatcatgcaggccttataggatgtgataaaaaaggatgagaaagaaagctgggaggaaggataatttggatttagggtaagggacagcgttgctcatctacaggaccacaaggggttctgtgctgcaggggcataagaaggagcatgtgccatgtggggaatgcagggaagcagggcagagggacgtaggagaggaagattaagagccaagggggaggggcaggcaggcaggtccttttccatcttttcagtcagggtttctcaatcattttaatgagagcctcagcccttgcgtaaaaatcaagcaataaagggaggaatgcctctctgtttaacttgaaggagagctacagaagatggaaaagagggttagttgaaataaagttggagctgatctcgcttggctggctgccctttctataaatatcgccctcccagtcctggaaatgcagcagttagggtccttgtgagctactgaggaacatccttcctgttcaaatgcccaggacttggctgcctgtgcacttccatatgcaaagtgcctagaagctggggagagggagagtgcagggtcaaaagtggggaattctgagcccactccttttaccccctgggggtggcctcacttcctctgggggctctgacagctctctggcctgtcttcagcttagaaatctgcaaaagtcattggccaggctcaggagaactaatcctttgtgccagaggtatggtggtatggtggggagctagctcctcgctggtgctgagccctgctgcccctggggttttactgggagagagggagagggtggaggggctagtgtaattcggcaatttgtgagttaaaaagcagatgagaacccacagagtaacgagacattcttctctttgcatgcaagattctgctgaatgttggaagaggaaggaatatttttcttgcttttcagacatgacatcctgtgaggggaagatttggaacagatgggggccaggggagcctcactgtatttgcttgtttcaccaccacctcctccctcccacaaccagaaatgtctttttcttcccgcctagggaagttaatgtaaaggcaggtaggggggatgtcctgtagattaggaaagtaagttatcaggggtcagggaaaaataatccattaggtttccagaaagaatccacttttcattgcagtctccttctaggtccaaagatagacaactaactcaaaattgtatcttcgctttaatcactgctctggtgatatttgcattaatgaaagagaaaagaaagcatccccaacagatggaaaaggcggctctctgactagtgaaaggtaaggaatttttctgaaatcttgggtgcacaatgtgggaaaaacaaaattggtaatgtctcatgggatcagcgcaggcatctgcacagttttcactccgacttctgtctgtcagattgactgcattagagaagaccgtaaatgtggtgatggaagtgggctgtgacacacttgactggctgtagcagtgttcctggtagagccacattcccagcacagctgtgggtagctgggcagctagtatgatgttagtccccaaatcacagccgattctttctgctgtcaaatatacagcccctgagcccccttcccctgaacctggaagggggttctgctggtgaagtcagatggccttgttagccagggtgggccagtctaactgcctgttgcatcttgtctgttccccaaagacagcttggcttgatgtgatgtgaaaaggatggggcagaaggagaaggggacagattctgtgctttccttctgtcgttcttttttggctggtgggagcctgtgttgtttttctcttccttcgtaggaggggattttgagttctggggtctggctgaggagacacgtgccagagtgtctggcccttttgggtcaggctgcctgactctggcacacagttctggaaggatgtcctggagagctggtttactgaggcaacagctgcaagctaactagggaaagagaagaggaaagtactaggttgctgtgtgctcaggatccccggttgagatatggagaattatgtctggggaacaaaacctaacaggctgtcctcatcacatgagatatgttcccaggctggagtgcagtggcgtgatcttggctcactgcagcctctacttcctgggctcaggagatcctcccacctcagcctcccaagtaactgggactacaggcacgtggcacaccccatgcttggttctttctttcctttcttttccttcttttcctcccttccctcccttccctttccttccctttctttccctttccttccctttccttctctccttccttccctccttccttccctccttccttccttccttccttccttccttccttc

SEQ ID NO: 190 - DNA, 2810 bp, Homo Sapiens
ctttctcctgtgatcatcggcatgataggaggcgagtgaggaactcagtgtcttctgacacaggcatctcacaacaccagtgcagccggaccgttgtctggtaggtctctgtgcacccaggaggacctgggcctgcgagaagtctggggcccactgctgggtatgctcgtttcttgagcatccgagtcacctttacagtctgcgatgattgacgaggtcaaacaggactcacttgcattgccgggtctctgtggcgacagggaggacttggagatcaaagaaactctagtaacgtggaaattcatgctccgagtagtgacaagccagtgactttttctatagaaagggtacaagactccaatttgaaaatctcaagcagctttatattcaagcaagttcaatccaatctcttcctgactcactgtctcatcaacatgcaaagctctcgaagagaaatcatctcttacttgcctgagggagttctggcagacgttttgaatgtggatgtggaagttctttcctcgtctccatcctgtcaagagccgtggagcaaacagcaggatgaggaagacatggaagacaaaactgataacgcacgtcacctcgctgcagcgggagacagaatgtaacttcaattcagcctctttggggtttgggttctgaccaagtaaatcgggaatgttgttaacatatcaagccagcctttattgtttgtcttaacccaagaaaacacaaaatgacacttactttgttgctcatttaggttttaacttgttgatgtcctccccacaaaaatcaaacttgaaaatgcctggcagggacccctgagatctagggtttgaaatgctcttttgacaagttaagaggttaaaaagaattcaggaacatactgtagagtctcatgggggattttagaaaaaaaatatgcaaagcatctttaaatatgtggaaaatccttaggagtgaaattgcactgaagtcagattgttttcctattgaggttgcattgctcggctgcaagaggtggggtgggcacatcgtggggggagagcagaagtgcctgttagggtgctgccagacctcagtgtggaattctgcttctcacagttggccataatcaatcaatcagactctctctttctcctcccttctccctctccctttctttccgtggttgaagggcccctcttaaatcgctcttgagcctgcattctaatttgctctctctcccacgtgaaatccacttctcccagctaagctgcgttttgcagctttatgacggtactgaaagcactttatttccacttaaagagctgcctgttctatttaccatcactctcggggtacttaacctcatttaaaaggctaacttttctcctgcattataaagttgctcgggagtctcaaagcctctttctctgcccagcccgcagccagccctctccagccaccccagcctcgccctcacccctcccagcctctgttccaaggcccaggcgcgcccgcgtggggcacgtgtccctgaacgccccgcctccggccagcctgaccgctcagtgctcggtgtcacttctggcacgtctccacattcctcaaatcccagagaggacctcgaaataggatagaaaacaagaatttaaataagaagcaacagggctgcccgctctggctggggagggcctcggcccccgcctgcacctgcggcccttgtttcttgcgcggttttgcaacgtcagagccgtccacactcgcaggccatttttagcggcctgttggaaagggaagacgatgaagtcgggctaagcagggcaacgccttgccctctgagaggcgtggagggcccttgggaagctcagagagctacgataaaatggctaaacgaccttcctctcctccaagtcaccaaatacgaggcaggagaggtgcccgatgagctcccagtcatgtggttcagggcgggctctggaagactcacagaggagactcctccgagaaaccaagaaggtttctgtccaagtcgggatctgctctgctcaggatgctcctccaacacacacagtgaaaaactgagcacctagagagcaacaccaaaaacccatggccaataatggagagccaaatcaggagagcattcagcaaagcaattcttgctgtagaaggaacagcacaaaaagctggaaggaaactgaggcatgcgtgaaagataacttgtcagtgtttgcagtctactgagatccccgctgcaagaaaaggcaggatttccacttgcttcttggcccgcctctgttgtccagaatccaggacaggtgacaagagaagcagatgtgatctgcacaagctggctcagctgggttgggagttgctcttcctggacaggccgggaagggtgctggaggggagggaggaggagagaggttttaggggaggggtgctgagcagtcagggacctgtaaggtcacatttctttcaggtattctttctaggtgtactgaatgggaacattgtctgtcatccctagactgcattaaagacctaaactgcttccatttatctttggttgttggactgaagtttctaatgtacctggtgacacagagcacagctctgtgtttttatgggttgcttagttcaagatctggatgaaagaagcctgaacccatttttgtgcaaaagcctaagggtgtacagcagggatgctcaaacttttgtttttataagaacccacttttatattaagtaggttttctgtgtgtgagaagaaatgcttgaacatggaaatgaaaagttctaactgtaggatggagtttaca

SEQ ID NO: 191 - DNA, 2007 bp, Homo Sapiens
aatttagatattataaagggcaagccagtacatatcacaaaatatcagtataactcactgtttcacaaaaggggaagacgtaacagtcatcaatttaggaaaacaattgatatagagattttatgataagctttctgtttaagacacgtccttttatgtaaggtgatttttttggtgaaaatgtatcaaaatgctttacatgtctgtgtcttcagacacagaaagtagctgaaagagcttgtaaaaagtgaattaaatgttagccaggcgcggcggctcatgcctgtaatcccagcactttgggaagccaaggaaggcatatcacttgagtaggagtgcaagaccagcctgggcaatgtagcaagaccctgtctctaccaaaaatacaaaaaaattagccaggagtggtgacgttgatcacaaaaatatcttctgaacaatttaagttgtgtaaagaatgacattcttccagcttttcttggagctagggaaaaggagctttccatgtctagaacatagggacgatgagcactataaatatatctgcaaaatttggactgggtttaaggtgaatataatgatcaaaaggtgaaaaatccaaagattttaggtttatcagcttcaaatggcccaaaatacatagagcataatggatgagatgaatggaaaagagaataatggaaaacagttttactgtttgttaaacttaactaaaaagtgaaatgggagacagaacttaagtgcaaggttcatcatcagaagtagaagatctctggataacaggctattaatattaatcagtaaactcttaactacagtactgatgaacacctccagaaaacacttcctttagccagtgtattatacgatgatgatgtgcaatggccatggcaaagggtttgtaggtccttcttgcccagatgcagccacttaagcagtaaaataatgaatggtataaattcagccatcaagccactgtacacacattaactcaatagaaagaagcacattagggtcacctcagcaaccagtatatgcagaaaataacagaagtgagaggtgtgtccaccctgcaatttctacaggacacctctccttcaggttacttaccactcagatacaaaatcaggcctcactattctctccctggccaagctgctcaactgacaccaagtccctaaaatatatctcagggtgccagaccgcatgccttccaaattatgtctggcaccgtctaccagatgtacctagaaaaccattcagggctaaggatccatgaatcacgtcaaagagcatggggctaacggatcacagacaatggcccacatgttacggggcccacaaccaccctcaaccctgctgcttacaccacaacacacttcaaatgtgctacacaaatctgcaatcctcaacaacttaatgaacaacttcaaagtaccatgtagccatccgatgtgcctgcactaagtaaggcatttcactgtctgtgttggcctcagccttcccccaagcacaaaaacagatgcaggattaacagtcaactcctctactctaactgaaatccctgccacactgtcagagactaagaattcagaaacttctttgcagatctgtagtctctctattccaaggttagagaagttgtcactgttccaccagcccaccaggctaaggtactgctcagcaagtacttaacggtgccactgttaaaaaaaaaactgatcaggagccacagaaataaacttgtgcctcatcagagaaaaacatctaaatatcaaaaagccaaagcactgtagaaaaaaatctataaaataaaaaatatattaaaaaggcacatgggccaggcatagcggcacacgcctatagtcccactactctggaggctgaggtgggaggattgcttgggctcagaggattgaggctgtagtgagctgtgatcgccccattataccccagcctggacgacagtttcaaaaggcacatggaacatactgagccttatgtatt

SEQ ID NO: 192 - DNA, 3007 bp, Homo Sapiens
aagaaccttttattaacacaacaatgatattttaaaaaggaagaataataatttccaagaaaaagtacaggaatttattttatgtctttttgaatttagacagagaattatttcatagacatcatttagacaaagttagactggcctgaatttaactgcaggtcctgagacttattattaagggtcatatttgccaatgtctggtgagaaatagactgggaagatgaaaagcatcaaaagatttctaagggctaccaagattattgaggggatactgaagaacatgttttttatttaaatatttcctaggactgaccttcactcttttttcagtgaatctaccattaaaaaggggcttgagttgcttcaaagactgagtcccttaaatggtacctcatctattacactcaggagcagctacagctagagtcaccaagaagggtcgctgacatggtagttgatgctagcaggtcagctgggaggtcagctgcggctttctggcagagtatctacatgtggtctctctctcaaggtgacttggacttcaaacaggatggtacccatgtcccactggagaacaactcaagcatcaatattccaaaatttgtgatgcttcaagattgattgaggatcaatcacagtttcccagaactggaaaggtcctacttttcccctgctctacttgttaagctgcctccacagcctgctcatgttcaagggcctggagaaataaaatgtttcttcatgaaagcatggcaatgtcacattgcagaagtgcatgtgggaataaacatattgttgtggccaactttggaaaatataaattctcaaaatcactttggaaagggtttctcttttgacagaaatcaaaaggtaaccatctaaaagcacttctcctttcattctgggcacagagctggataatatttctaatttctgtaactcttaggaatggctatatcacttacatttagccaatggaatgcacacacaaatgtgtattccaccccctggtctgagccatagttctccgcagtgatatccctcatattatttctcttttcactttactattgtgacaatgcctagggaaacctagggaggcatatgttaaagttggcagaatttctgtgaccctgagtctaatttgatcctcaatgactttcatccctgtgttgagtgtgagcaaaatctatcaataggatgagatagtacttccatgagtacgttatagtttatagcaaatgagatttttacagtgtaattagagttggaaatcactgctttttaactgtgtcaaatgagtcattaaacttgtcctctgtgtaatttttgttgttttttgaagaatctgtggccatcctggaaataaacagagtgacatggtgacaattgtggatcctctcctttgggataatgcactgtgtatcccattgcaagtgcttctcagacatcagtgcaacgacctcttcagtaatctgacctaaaatgtaagagacttgagagcaaagatcatgttttgttcattattttactcctagtacctaggacagtccccaccagcaaatgcctgttcagtgatggatatgctaaaatctcctttattatagatgcatttatttcatggaaaaaggaactgttgagcaactgatttttgattatttcctgagttgttctgcaggcttgaaaggatagtttcttgttggtcaaatcacagaaaagtcttatacaagaattatcatcgggtcaagttctcagacttacattgtaattaattgcttagcctcattacttccacactatataatagttttactctttgttctttctattaaactggttttactttagaattttgtttcactgtaatgaatgccataagaatattctttaattcgatcattattattattattattttgagacggagtctcacactatcgtcggggccggagtgcagtggtgtgcaatctcggctcactgcaacctctgcctcctaggtacaagggattctcctgcctcagcctcccgagtagctgggattacaggcgcctgccaccatgcttggctaattttttgtatttttgaagagacggggtttcaccatgttggccgggctagtccccaactcgtgacctcgtgatctgcccacctcggcctcccaaagtgctgggattacaggcatgagccaccgcgcccagcctcggtgtttatttttacaaacaagatagctcacatttccctccaacaccattttaaaataaagcttgtcatttctatttgaccttttgttatctcttcctgattttctgagaatgatttatactaaatattatatcttttatattgtgtacatatatatgttatttataatcccatatctgaatatctgaattccaaaatactccaaaatctgactttttgagcacagcactgacatgacactcaaaggaaatgctctttggagcactttggattttggattttcagattagggatactttacggtttcaaaatctgaaaatctctgaaatctgtaacatttctggtctccagtgttttggattgggaatagtcaatctgtaacatacatgcatattacactgtgttttctttaattaaagtaattgcattaatttgtctaagctagggatgtatcaaaagtacatatttcattttgatccttaaatcaattttgacatatttcttcttatgattaaatacacatgattcatagaagaaataaggtcctccactgggatctttttgttttgtaaaagactttcattatacagctctgttggctatttatccagacccagctcctgtcataaacctttatgctttatgttacagtaataatgaattatttgcaattcctaaaatatcacaattgcattatataattccaattgttggcattgaagccaaggactgtgatttttccatagttattgtctcagcaactagcagtatggtggcataaatatctgttgaaacaacaaac

SEQ ID NO: 193 - DNA, 3464 bp, Homo Sapiens
gaaccaaagcaggaatttattgaaaacaaaagtacactccacagtgtgggagtgggcctgagcagcagctcaggggcctggatacagaatcttcctggtccaaatacccaccagaattttcccatcggccacttcatgctcacctcatgtaactgaaatggtagccgcaatcagtctgattggttgcagaaagcagccaaccagaggctgaagtgaagttacaaaagtcacactcctgtgcaaacaatctgatgagttgcaaaaagcaaccaatcagaggctaggatgaagttacaaagttatacttctttgcaaatgaagacttgaccagcaatcagtcttacttgttgcagacagccaatttcccatctgcctcacagaaaaggtcagaggtagtagcctctggttctttgttacttagacatggaaagttagggttttcttttcattttggttctaggaagtcagagcgaaagagccttaggttccctgcctccagaccctattttcctgcctcatagaggtttatgtcactgtccttttgagagaatccagattcagactttcagttctgtggctgtgggccaaaaccaacaaagacccaaatcctctgtccttgggagcttgaggagagtttaccagttcatgatcctagtgggtctgagaactttgcctttaaaatccactcctggcccctgcctactgcttcatggcctggggaatagagtggagggggccacccttggtcaccttcctttgactctcccaaggaaacagcacaaccaagaaattgtggatcaactagaatcacactagtaatgtaatttctttgctcacagcatgactgctgggtttggggggcactcagatgtagaggtgctagtctcgtcttgctgacccccagcctgggaagaaggctcaccccccaggttccacctcatccccacagggtccctgataacctggtcccatgggtgggcctgtcctggggcattggtggaattctgggggcatgtctttgctgtgccatctctgcctccccctagtaagagctctgtcttcctcttcctataggaaaagcaagaaagccagcaaaaccagggaaccctaaagaggcagttagaggtgagtggagggtgtgaagttccctcctgtcctctggagaatgttgctttccttctctttcagcacttgcttggcttttctcccaaaggttcaaattcagagaaccaacaaactgatgtctgagaaaggaaaattaaatactgaactgtatcatatgcaacgtgctgccaggcactttgaaggtgggaatctgggcaccctgtcatccttcaacctggtgctttgataggcctttggaccccatctcaacctctctcatttcaggagagtccatggatctggccagcggcctgcagtattcccagcagtgtgtgggagagttgtaatggactctttgctgtctccatgcagcagaagaacatggacagtgtgagtcctaccgcctgccccatcccttggcagcccagcttcccaggtggaggagtgagggacctttaggtcccttctgcaggatggagtgtcctgcccagaaagcagcatgggccatttctcattgtttttgtgtgtggttgttagaggcagcctgcggctgagttggctgctgtggatgagttggggagtgctgtggggagcaagcagagcttggacgtggagcactggatgcagagcttagaggccaagtgcctaccctgccttcacttggctgtggccttagccaaatcctaggtgtgggatatggtacttgcactgtgaaagtacagaagagtatctttagtatgttaccatttgtggagagagaaggaccgtgtgtgtgtgtgtgtgtgtgtgtgtgtgtgtgtgtgttgtgtgtaagtactatgacaatatacataaaacatgcttgaaagtggtctcagagccagactgggtctggctgcgttttcttgaggctcaaaaatgagaagcaaactaggaaagaaggggatttattgctgtaactggatacagagagaaggctggagataactccaccagaccaactcgaaatgttacagtattcttagtgtttatataggttggggttatgtgtctacgtacagtatagcattcgcctaagtccactgataactaattttgtttcaactagaaggtcagaggcaaaaaatgcttgctaagtctgattaagctgtgagggccctggtaccttcaaggtctgtctactgtggtacctgaatgattatttctatcttacctcccttacagcttggtctggagactgccttagaccctccgatgaatctattcaaacagctgcctctgttaccttgactcgtctcagattccgtcgacccgagacaaggaatataagactgtctctattattttgacttgctccaggttagggagaagcctatgcaagggtcctactgaccatatgtttcatttttagctttgatacctgggcacggatttccctaggtttaactatttgctcaatgttaaggcagctctgtggaaatttgtttgtataactggagtgcggtgcagggctctctgtgtgactgtcatgaaggcctgtctgtgtgactatcagggagaattggcctgccacaaaaggattcatacaaaactcaggagagagaaacagggtggctgggagatatttcacttctgtaccttctgagtttgggactatgtgaatttatcattctttcaaaaagtgaacaaaaagttaatttcctccttcctttctgtgtcccgacccccagtgaaaaaaagggttagagaatcagatatacctgggtgttcaaatcccagctctgtctgagtgatcttaggcaagcaattaacctctaataccccatttttttaatctacgcaatagaggtaaaaatagtaactgtctcatatggtggttgtgagaattaaatgggattgctagcatggtgcctggtgaagcgctcaaagcttcaaacagtggtagtaataagggtaataacaatagcaatattctctgatctctctgggcctctggtagccagctataaatttgatctctttccccgtcgcttccacccttattgagttctttgagaaacaaatgagactataggcttggaaatgccatgaaaacatgtcagctgtgattgagagtaaggaattgttgactggggaatagttattatagctattgttactggccagccagctgctcctctgcctgttttgtcctgacttaacctttctgtatttgcagtatatcaaggaggtaaccaaagacagagatgccctcaggctggagtcatacaagaataggtaggatgggggagggtgggatgggaggtgtggggcccttagcgtgggtgatgtgctgggaggtgggaaggctgcaggtgagcatggtgaggtgatcatacagg

SEQ ID NO: 194 - DNA, 3382 bp, Homo Sapiens
aattgatagaggaaagaggtttaattgactcacagtttcacctggttgaggaggcctcacaatcatggaggaaggcaaggaggagcaaagccacatcttacatagtggcaggcaaagagagagcttgtgcaagggaactctcatttataaaaccatcagaactcttgagatttattcactaccatgagaacagcatgggaaagacccgtccccatgatttaattacctcccactgcatccctcccatgacaggcgggaattatgggagctacaattcaagatgagatttgggtagggacacagccaaaccatatcattctgcccccaacccctcccaaatttcatgttctcacattttaaaaccaatcataccttccccacagtcccccaaattcttaactcatttcagcataaacttaaaagtccatagtccaaagtctcatttaagacaaggtgagttccttccacctaggagcctgtaaaatcaaaagcaacttagttacttcccagatacaatgggggtacaggtatcgggtaaatacacccattccaaatgtgacagactggccaagatggaggggctacaggccccatgcaagttagaaatccagcagggcagccaaatcttaaagctctgaaattatctccatggacaccatttctcacatccaagttatgctgcaagaggtgggttcccatggtcttgggcagctctgcctctgtgtctttgtggctgctttcactcctggtgttgagtgtctatggctcttccaggtgcacagtgtaagctgttggtggatctaccattctggggtctggaggacgctggccctctcctcacagccccactaggcggtgcctcagtggggactctgtgtggggtttcaagcccacatttcccttcttcattgccctagcaaaggttctccatgagggcgctgttcctgaagcaaacttctgactggacatccaggcatttctctacatcctctgaaatctaggcggaggttcccaaacctcaattcttgacctctgtgcacccgcaggctcaacaccatgtggatgctgcctaggcttggagcttgcaccctttcaagccatggccccagctgtaccttggccccttttatccatggctagagcaactgggatgcaggatatcaagtccctaggctacacacagccaaatcatatcacaaggggtggattattcatgaattttccaggaagagtgggcaattcccagaactgggggttcctcccctttttagactatatagggtaattttctgatgttgctatggaatttgtaaactgttttggtgtgggtaggagtgtcttttagcatgctaatgcactgtaattagcatataatgagcagtgaggacaattagaagtcacttttgttgctatcttggttttggccggcttttcttactacaacctgttttatcggcaaggtctttataagctgtatcttgttctgacctcctatctcatccggtgagttagaatgccttaaccatctgggaatgcaacccagcagttctcagccttgttttacccagaccctattcaaggtggagttgttctgattcaaatgtctctgacatttcccccctcccttttacaaggcaactcttaatcctaagggttgtggaaggatgaagatccatattctgtaacttcttcaggctgaataggggcaatgctttcctgcctaactgttagggtctcttgtattcagggtagagaggagctcagaaagcataattatggtgagggtcacttgtaactccgagttctgacaaaaggtggtatctgtcttgtttattctgaactgcaaccagagatcactggttggctcacaggaataagcagtcagtctaaattgcagaagaaaaccctcaaaaacaactgatgagattagaatctaataacaggtgtaccatagttcttgaaacataatttttctctctccagtctcccattttttactaaagacaaatcatggcaaaaccaatttgctttattatacttggcctaattatttgtataaagtgcagcaataataattatttttcacagaggcttttaaaattgactttgatggaactgtgtttcataaaatgaatctcagataagactttttaaaagctgagcccagccgtgagtttgcaccctcaaatacctgagttgggtaaattcctctcctcttgaggtcccaagataacctggggctcctgggccaatcagaaagtgacattctttacttaccacaggtcgggaaccctgtacagggactgtgtagacaaggcatgaggccaggtttcccaaggggcttttattggctttataagtcaagtttgattccttaaaggaaaacataccattccaatcaaagctttggtaaaatcaccagtttctccaattgtgtctgtttgcaaaagaaaacagatccttattgtacttatgcaaataactatattgctataagttaagaatactcacaaatagtttccaaattttggagaaatcaggcagagagaaacaaatatgctccaaattttgttcacaggagttaagctgtcagtagctcaaaagaaaagtttccttgactctgaaaaacaaaacaaaggatccgcaacattttaagcaaaaagccgaaaaagatcacctcagtcctctattagttcagtccatacagataacttctgttctgtttgatattcaaagaagatccagtagttgtaagattgttcatttgccagtttgttaattggattactggcagggtggagcctttggaggaacagggccaggaaagcatgcagtttctacagcctaacaagcaggcacagctggaaggcaaaaacagatccccaaaaattaagggcctcatttttacaccaggtcctggatccccaaaagaaatgctatagaacaagacagtacaataattttaccatgcatttaattgctaggcaacccaaagtcaatcagcccattctgtgattaacccatcccccataggagtcttatgtctgggtggggggaaagggcatttccatactttttaggtggtcaagagcatgcttttctgttccaagaaaaagcaaagcgccatatattcccaaaccactgccattagttatttaccaaagtatatttcctatctagttattacacaccagagttctctcataatgcaaagtaatttctgatattcccccaaatcaaaaccatcacataacacaatgcgaaacagaacagagtcttcgatctgagcatccctcgatgagggctgttgcgtcttgatttcatctgggtagttacaggcatcatccaccacgaagtttccaacccagagtcaggatgcagc

SEQ ID NO: 195 - DNA, 1305 bp, Homo Sapiens
gtctcaaaaaaaaaaaaaaaaaggtgaggtcacccagggtatcagtggacaagctgagaacaaaaccaaagtttctaacaccgaaaatttgtcttctgctcatcccagcctgaaaggaaggtgaaccaagatgcaatccatgcccattcaagtggggtctgtgtgtccaggcagaggtgtctgccctctacaaagggcacaggggagagagtgatgcttaacccaaaggaggtctcgctgatggtggaatttcaggcaccgtgtttatgtttggcctaattagcttgagaccagtgtccttgacgggaactaagacgccccccacgcccatccccggctcccaggctctctccacccaagttctgcccaccagggcacactgcttccctctgccacctcctcttcccacgagccctggtacaccctagattctcagggctgtggctccttgctttacaaatgagtaagttggtggcagggaaggaagtgggctgggccatgaccaagagtcactatgattcacggggaaaaccctgccctcccgattcaactctgtgtgcaaaaaggttttgtgcgggttcctagggtctcagggtcaatggatgtagatagaccactagaggtatacacagccactgtccaccaactctcccaccccccgggtctgcctacagccctggatggggatcctgtaccgggggggcggttggggggttggacaggtgtgggttgaggtgttgtttacatgttgaacacactggggttccaggtaagtttccgtcagaagaaagcacttcactgctgaggcagaaatttcaaaatattgaaccacttttcgatcctggcagaagggaattttcccagggtgataaaagtgttctaaaattagatttgagtgatggctgcccaaaaggaattatgatattattcaagaaatcatggctttgctgaacaacagaaaactcgaacactgagcatttgaagatattaaggaattgttgatttttatgttcactgtttaggtgaaatgatagcattgtgagtgtgttatttttaaatgagtccttatcttttaaagatacaggcagaaatagctataaaatgatctgatggctgggatttgctttcaaataatacaggagagggccgtgggtgaggagagggaaccagattgcctatgagctgagtgatgggtatgtggttgcgagggcagacaccattcttctctctgctttcgatgggtgcgtagaatttcccataataaaaagtggtttttaaattgttttgaccattggcctcgcgcgg

SEQ ID NO: 196 - DNA, 2437 bp, Homo Sapiens
aagtggggctaagggcagcctggcatgagcctgcaggtgcccctcagcatgaacggcctgggtgctctgaatggtggccagaagcagaaaggctcctgggtggaaaggggcaggtccccagtgaaaccccaccttcaagccagggatgacctgaagtctgggggccaggctgccagttccgtggactggaatgagaacttaacggtgttttttctgggcctgcccatggccacccatggaccaatcagcacatacttcctcacctctgaagcctgtaacaaccctggactcagccaggctacagcagataacaggacaacctgcctgtagagaagagctacccactgtgggtctcctttccactgagggctgcacagacaacaggattacctgtctgtgcataggagctacctattctgggtctcccctcttctgagggctgcagagctattgggatgtcctgcctgcagataggagctacccactttgattctcttgagagctgtactgttgctcaataaagcacctcttcgccttgctcaccctccagttttctgtgtatctcattcttcatggacaagggacaagagcttgggacccaccaaatggcgggcctgaaagagctataacacaaacagggatgaaacacacccccctacttgccatattgcgggcaacgagaaaaagagaaaataggagagaagtgctgcagccctttggggaacccagacctaggagctccccaagctaggggtgtgacaccctctttggggctctgtggttcctggtgtctccaagcttctgggcaccaccacgttacccggtgcccacagtggaagctgcttgcagtatacctggtccagctgtagccctgcagggagccggtacccatgccagttcctggagctgcccaccccaccacagctggcatgctaggctgtgtgcagtagccagactgcatacttgctcactcacacacccattgctgctctgtgcctggcttgcccttgacaggtgtgggctctgggctggtagtgcaagctgagcacagcccaccaggccaagtgggtagaatgagcccagtaggcccaaggaaaactcagataaaggcgccactggccacagaggtttcctgctggcaaagtgacaccccaaggatcctgagacatatacatgagactgtgatagagctgcctggtctattctagtccatggtcaatttttttgtttctgcactaatgtcatattttcttaattatgagagctttataccaagtcttgatatctaaaaattaagttctcctactttttttcttttgaggttctcttggcttttcttggcccttcatgttatatatccgttaactttcatagtcaatggtatgttgatctaaataggcaagtttttcattagtggaagcagaacattcgtagtaaaaaacttttaaagattttgattgtcataacaaatggccctctggcataggtgataccaatgtgtactccataaggagattgtaataatatttgaaatggaaaatgactatatcagactatatgtgtgttttgtgatttaatttggggaaaaatatctatttcatgcctctagtatttctcaaaaaacatgttgaatatgagtcttattaggttttgcttgtttggtgagtaaaaatgccaagcctcatgagaagcagaatgtattttctcttttattgtaactgcatgtacaatacctgctatggactgaatcgtgtcccctccaaattcatatgttgaagtgctaacctccaatgtggtagtatttggagatagggcctctgggaggtaattagggttagctaagatcatgagggtgggcccccatgatggaattaatggctttataaggagggagggagaaagagatagatcgatcgatcgactgatagagaccgatcgattgatcaaccaagagagatctctttaccacctgaggacagagaaggtggctgcctacaagctgcaaaaagggctcttaccaggaactgaatcagtgagcagcttgatcttggacttcacagccttcagaactgtgagaaataagtgcctgttgttgaagccacctagctcatggtattttgttagagcagctcaagcagactaataatatagtacccatgtgactctgaatttagaaaataattgattataagttattctgaaaagaaggtctatatacacttaaaagcaaagcaaagtaagagtttttaaaagtcttaaaagcaaactgtatgcatatgtagtttacataagcatttcaaaagaattctcagttttgggtgcatagggattgctatcatattttgcaatgctcatgagccaggaatggaaatatttaacattaagttaataagaaaataacatgaaaaagttgtttagtgagctggagtcagagctc

SEQ ID NO: 197 - DNA, 1192 bp, Homo Sapiens
atctgacctctaccccacccccccgcaacttcatggaaaaatgactttctcagcgttcgttcctgaaattattgccaaacccagtgttttattcttcaccctgtttgcctcctctgagcattgaatgttacctacctctctccttgaatcctggctccagctatcctggttacgttctgaatgtgcctttgcacggtattttctgactcttcttttctgtactgataccttttctttctggatactttcttctatggcagtctcatacattctcaaggatttaacatttactccacttaaaagagttccaagatcatctactgaatcattaagcaaatatttgttaaatccaggctctatgcccttccaagttgaggcaacagcagtgggaaggaggcaggaaacaaactgcatctgttggaggaactgcaagaagctagtgtgattgggagggctgtggggagcagagggaagtggctggagtctgatctctaagtgtctagccccttcctttctcccaaggccccagtccacactatctggcatcttcacttcatggctaatttaacactgtcagtgctgtcaattgctcttcccccagaactgtatttttcacatctgaagttctgttaaaggacaacgtttcacaaataaaaatgataactaatatgtccctatatgtatcaggccctcttctatgcactttatgtagtaaccccatttcatcctgaaaactaccctgtaatctagacactattattagtcccattttacagatggaaaagccgaggcatcgaggtcaggtaacttgtctaagatcatagcgctagtaagtggaagaggtccagttgaacccaagcagtctggcttcaccattataatgcaccgccttaccaccaagatcttatttattcattcaacaaatatttattcagctagagaccagtagagatagtgacatgttacgcctatggcctcacaaagcttatcttctatttttgccacgttttaaaattgtatcatctttccccagtaccatcttgatttaggcatctattacccctaactaaatgggacttttgcaataacttcctaactgtactatcccctttctcaacatttccagagcaatcttctcaactgcaagctgaatcatttctcttcactgtttaaatgcctctgtttatactca

SEQ ID NO: 198 - DNA, 3262 bp, Homo Sapiens
agctgccggacaccaggagacgatggaaggtctatagtgttacagctctgacccaggaagtcccagggtcttgccttccagaagggtcgcggctcttccctccctcagtccaacgaacaggagcacgtcacctcccgcagctcggggagctggccaggaacgtgttacagcccgtttcgctcctgtccgcagctgggtgaggcagccaggaaaatattacagctcttctcacgcccgccattcagcaggtcctgacttcttgtgtgacatccagaagaaaggggttacacagacagctggagggtgagcaaagtggagaagttctcagcagagaggagactggagtgagttgcccctacccgcaggtgccaactgtaatacatcagtagctgaacagctcattgccctcaagtgttcttgctcatgcctggctgagttattgaagaaattgctcagatctcaagcccttgtagatcactggtcctggcagatgttgaggcagagcaagatggcagaatagaagtgttcaccaatcatccttctcacaaggacaccaatttaacaactatctacacaagaaaagctccttcataagaacaaaaatcaggtgagcactcataatacttggtttttaaactttgtatcactgaaagagatgctgaagaggtagaagaaaatagtctggaactactgacaaccccccagtttggccacaagatagggtactggtcagagttgcaagaccctctttccaggccctagctcctggacggccttttttagacatgccctgggccagaagagaacctgctgccttgaaagaaaggaccaagtcctggtagcattcattatctgctaattgaggagactttggttctggaataaagagcagtgatacccaggtactatgttgagggctgtgggtgaaattctgagacttgctggctttaggtgagactcagcacattcccagatttagtggctatggggcaagacttgttccacttgagaaaagcagaaagaagactaaaggggactttgccttgcaccttaggaccagaatggccacaacaggatagagcaccaaccaggctcttgggttccctgattttaaaacatggctcttggatggcatttctggacatgctttccaccagaggggagcccactgcccaggagggtgagtcccaggccagacagtattcaccacaagttaactgaaaagcccttgggacttacgggaacattggtgataggctggcaatactctgtgtgggtctgtggtggtggtggccatagagtgagctcctctgcctttggaaaggagaaggaaaagtgggaaggactgcatcctgtggagtgagtgccagctcaaccacagaacaatagaataccagatagacttctaagccttttgattctagtctctggctcccagagaggacctctggacccacccagcacctgggggtactcactgcatgaaaaggaaggacacaattctgactgactttgctacctgctgaatgtagagcctcagagccttgagcaaaaataagcaatagccagggagtgtttacagcaggacttgggtaagacccagcactgtactgacttctggtctgacccagtgcaggcatggtaatgatggccatagggttgcttgtgtcactcccctcctagcttcatatggttgagaacagagggagagactcttgtgtgtttgaaagaaaataagggaagagtacaagagtctttgcctggtaatctagagaattctcctggattatgagtagaactatcaaaatagtacctgtatgagtctacaagaaccatagcattgctgggcttggggtgcccagatacagcttcgatcacaacattcaagttttttttttttttaatatttggaaattcttcccaagaaagatgggtacaaacaagcccagacagcaaagactaaaataaataactcttcaatgcttggacacagacaaatatctgcaagtatcaaaacattccagaacaataagatctcaccaaatgaactaaataagacaccagggaccagttctagagaaaaagatatgtgaccttttagacagataattcaaagtatctattttgaggaaactcaaagaaattcaagataacacagagaaggtgttcagaattctatcaaagagattgaaataattaaaaagaaacaagtagaagttcttgagttgaaaaattacaattggcatgctgaaggaatgcatcagagtcttttaatatcagaattgattaagcagaagaaagaattagtgagcctgaacacaggctatttgaaaatatggggtcagaagagataaaagaaaaaataaacaatgaaatatgcctatatgatctagaaaatatccccgaaatggcaaatctaagagttactgggtgtaaagaggaggtagaggaagagataggagtagaaagtttatttaaagggataatatcagagaacttgtcaaacctagagaaatatatcaatattctaataccagaatgttatagagtaccaagcatatttaacccaaagaaagttacctcaagggatataataatcaaattcccaaagatcaaagataaagaaaggatcacagaagcagtaagaagaaaacaaaaacacacaatgaaactccaatactactaacatcagacttttcatagaaggcttacaggccagtagagagtggcatgacatatttatcatactgaaggaaaaacgttttaccctagactagtgtatctggtgaaaatatccttcaagcatgaaagagaaataaagaccttatctgacaaacaaaagctaagggatttcatcagcaccacacctgtcctacaagaaatgctaaagggagtttttcaatctggaaggaatgggtgttgatgagcaagaaatcttacagtgcaaaactcattggtaataggagacagaaaaacacagaatattagaacactgtaactgtggtatgtaaactactcttaacctaagtggaaagactaaatgagccaatcaaaaataataactacaatttttaagacatagtacaataacaaatagaaacaatgaaaaggtaagaagtgggggggggtgaagtaaaggcataattttttgttttctttttgttggttaggccaacagtgtggttatcagactaaaataagggttttaatatagtatttgaatgtttcatggtaaccataaaccaaataaaacatagagtgg

SEQ ID NO: 199 - DNA, 2703 bp, Homo Sapiens
gtgagccgagatcatgccactgccctccagcctgggtgacagagccagactccctctcaaaaaacaaacaaacaaaacacaaagataaataatgcacattctattctgggtctcatcagcctcaaggtggccaagtttctatgctgagactatagcccacagttacaccagccatgatcctcagcagcagaggtagtgatgatgaagtctgatgcccaaagacaagcagaacagatttaggtgggcagttatatcactgtgagttttcatggactatggtatgctgaactcctttacctgcctgtggactggagttggaggactgtcattactggcttgttctgcagtgctgggttccccattgcaggagcagtgtctgcccttactgaagagggaaggattgacccagcctcctgctggtggcagaaaggaaagagagaccacagctgtccccacacatcacccttttgtttcctgaccatgaatagatatttatcaagaaaagacatacatacaaatggccaagaagtttatgaaaaaatgctcagcatttattctgggaatgtaaggttggcttaacatttgaacatcataatcaaggtaaatcaccaaatcatagactaaaaaaaacatgaatagaggcaaaatgatcatttgataaaagtcaatatttattcaggatagaagctccagcaaacttggaatagaaggagacttccttctcttaggatggggatctgtaaaaagctacggctaacattatactcatgaagaaagactgaaaatttctccctagaggagcattgggaggatgtctgctctcatctcttctgttcaatattgtactggaagtttcagtcaatgaaataagatagaaataaaagacatatacattaaaaagaagcaaaatcatcttaacttccaatgcaatgcttacttatgcagaaaatccttagaaatataaataatgctactaaaacaaataagtttagcaaagtcaacaaagccagtacaaaagcaatatgatttttatatattagcaatgaaataattgaggagtaaaatttaacaatgcatttacatgtatagttaggggtgcatttaacaaattatgtgcaagacctatatgctgaaaactaccaacattgatgagagaaattagataagatataaatatatgaagagtttccatgctcatggattgggatactcaacatagctaagatatcaattcattcccattgatctataaatttagtgccattccaatcaaaatcccaatatatatttcatagatgttgaaatactgattctaaaattaatatgaaaatgcaaagaacctagaacattcaaacttattttgaaaaagcaaaaaatgggaagacttaacactactggattatgagatttagaataaaactacattaatcaaaatagtgaggtactggcaaaaggacagacatagcactcaatggaacaaaatgaagaggctatacctaaaccctcatttatatggtcaacagaccctcattaaatgttcatgatttttctagaagggtgctgcataatttaataaaggatactctttttaacaaatggtgctgaataattggatatctatttgcaaacaaagaaacaaaaaaagaaccatgatgttttgttcactttgtatgaaggattttaatggaaatggacaatagatctaaatgtaaaaagtaaaactatgaatcttctacaagaaaacataggagaaaatgtccacgatttggattagacaacaaatccttagatggacacaaaaagcccaaagccaaatacaaaaaaatggataaactgtacttcattaaagtaaaaaacttttgctcttcaaaacatattgtggaaaaggggaagggcaggccacatgctgaatgatatttgtaaaatataaagccaataaaagactgtatgtataaatatatagaagtcatatatttcagacaatctgacaaaaatatgggcaaaagatctaaatctacttactttatcaaaattaaatggaaccatagtgagatattgctacacaaccactagtctaattatttagtctaactaaaatgaaagagtgacaatatgaattgttgtgtaggatgtggaggaactagttagaaggttacttcagtgaacctggtgagaggtgacatggcttgttccaaagaaagcagtgcaggtggtgagaggtcatcacattttgaagataaagcaataggattttctaatggaagaagtgatagagaagagtcaaggacaattccagaattttttgcctgagcaaaagaatgtaaccacagagacatacatggttcagctatacatcatgtttacataacaataatgatacaaacatgaataattatctccacaagtgtataacgattttgagaaaatgggagagggaagtaaggtgtgagggtgtgtgtgtgtgtgtgtgtgtgtgtgtgtggctagtgaatttaagagctaaatcttcatcttccataataaaattcaatagaaatataaaattaaaaatcaagtcaaatctaacattttatataaaatatggaagcatatttaaaaagaaacaaagtagctgaaagtatttctgaagacagggaattgaggttagaagtctaacccaaaagatgacttcacttgtatttaaaaactcgtgcagcctagaca

SEQ ID NO: 200 - DNA, 1194 bp, Homo Sapiens
gaaaaatcaggattcccttataaagaaagtgcaatgtctgaggaaatttcaactgtgaaaactacaacatatttactaaaatgcatgaattttcttgtttttagaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccacttcagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatatta

SEQ ID NO: 201 - DNA, 2435 bp, Homo Sapiens
ttccagttcattgcctttgtggggtttttttgtttgttagtttgcctgtgtgttttatactttttttctgccttctctggttttaactaagcattttctataattctatctcctttgttagagtatctattacgtttcttttttactatttttaatgattgctctagagtttgcagtactgcagtataaatttgcaactaatttaaaccaatttttaaataacactatactacttcatgggtaatgaaagcatcttataacatattatctctagttttttccctttcttatttcataactgccatttcacttcacatattcatagccaaaaccactgagtatatggtgctattattattttgacaaaaatctgtaatctgttagatcaattaaaacaaaaaaaaaaaaagagtctattataccttcacttattccttctctgatgtttttcatttcttaacatagatctgagattctgacctatatcatttttttccccctctgaagaattctaacatttcttgcaaggcaggtctattggaaacaaatgcccctagttgttttgtgagaaggtttttgtttctttttcacttttgaaggataatttcacaggatacagaattctatgttggtaatttcttctttatttttctttggacactgtaagtatttcactctaccctcttcttgcttgcatgctttctgaaaaattggatggagtgtttacctttgcttttctttagctaagctctttatttcttctgacttctttaaacatttttttatctttgatttcctatagtttgaaaatgataggcctaactgtagactttttatatttatcctacttggtattctgtcattcatttcagaaaattctctgccctatgactatgacttcaaacattttctctatttctttatctctttcttctacttctggtattccaattacacatataacttttgtggttgtctcacagttttgaaatattttgttttatcctttttttctctttgcatttcagttatcaaagtttctattgcattttctcaagcttattgattctttcttagtcatatccagtctattgatgattccttcaaatttctgatacagcatcttttatttctagcattttcttttgattctttcttggggtttttatttatcttctttcagtttctgtatgttctttcatattgttagattgtttctactttttccaatatcgccctttgcatattaatcagagttgttttaaattcccattctgatagttccaacatggctgccgtacctgaatctcgttctgatgcttagtttttcccttcaaacactgttcttaaaaatatatatatatacatacatatatatatatatgccttgtaattactcgttgaaagctggccataagctagcaagtaaaagaaacttaggtatatatgcctttagtgtgagtgtgtatgtttattcagttaggagttaccttgtatttactgtttgctctaggtgtggtgtcagggctaattttctctgatgctcttgtttttgtcttttttgttgtagttttccctagtgactcttacatgatgtttgacattttcaattccttcatctgtattatcctattatcttctaggagctccattgaggtaatgatagggtgttgggggagaaaaaatgttctgtaaaattatgattaggtctctttcttttaccaagcctgtgtccttgggctgtgaccttcacaaatgcttctcacttttactttcttttatttttctatgaaggtgaggccttttggcctcatctaattggagctgggcgtttcctttttgccatgtagaagacgagagtgggcaagagttgtatatttcccttcatacagtttgcttaggttctggtaaaacaccagtcatttaggctctggtaaaatagtttcccttgtgggcaggttttgttaaggagaacagaatattctaaacatatttttaaatggctattttccctttcctctgctggaaatactaggggtttgtttttttctttttctgattttcactgtgagaacatggtagagctcctagaagtaagcttcagaaaagtgtggaggccttcctatgactgagtctccttggagttttaactcttaagcttgtctacctttatcttccagcaattcaattacaagtttaagttttcttaaccctgtgctggctccagcaatggtttctgctcctcaacctttaccccagtaagctatgattccctttaacttcctgtctctctctctccaatttgaggggcaatagattgctctgtgagctcacatttctctaaagaatcctagaggaattgctgattttcagtttgttcagcttttttgttgttgttgcaaagatggaagtgaggccttttaaggtcattacat

SEQ ID NO: 202 - DNA, 2525 bp, Homo Sapiens
cgcgcgtgcacgtgtgcgtgtgcctgccgggttgctgcgccgcgggctgcgagtgcttgtgacccgccgcaccctcacccccgggcgcgccatccctgctccgccgccagcgagggagccccggagcctaagacgcccggacccgccgcctcgcagacccacccttgcccctgcgcctcgtcatccgcccgccccagccagcccgcgcagggtccgcggcccgcttttccgcgagaagccccctgtggtctttcctcgtacccggggactcggaccgagaagccgactgagcgaggtcgccgcccggcctcacggacacagagcgactctgcacctttcgcctccaggagctgaaaacattttgtcacttgtgcagtgtactcaccagtgcccccaacatcttctcccccgaaagcgctttcagattcgcgccgagatggggcgacgcggcggctcttgagcggaataacccgaagggccacgcaaactggggcttccagccgcgagcatgcggcggggcgcccagggcctggggtcgcgcgctcagggcctgtgctgcgccacgcaggaggaggagagggctggccctgccgggcgcgggtgcgggcccgactggctgaaggaggagtggggactggcttggaagtctccgaagcagaaaagtggggccgacaggatggaattgggggaggccgattttggctcagagagatttctctattaaggaaagcagtccaagaataggccccctggaagaggaatgcgctcaaacccagagggattctccttagagctacctcttgagattctgtacttcgaggaaattagaggtttttttaaatctctatttttaataaggtgggaggaggctgttgctcctttctcctcaacaacatgaaatgatcctgtgcctctatccaacaactctacaacaaagcactgaatacttccctgactggcactttcatggctgttcatgggcatctcttggtctatgacgacgatgttggagagttcctactccgtgataactcagttctaagtgcaagcagtcacgtgaaatgagcctgatagtctgcgaatgaagaaactaaaacgaactatattatatacttcataacacaagacaacgtgctcgtttgttcattctgcaagtaaatgcttaatgcttcctaggtggcaggctaaagaatatgatcattttaaagcagtcatgctttgaaaataaacaacccatcccagctgtaagctttttgaaagtgtacaaaatatgtaattgatgactccctaaatggtttgcagctttggtatttgactgaattgtaaaccattagttaaactacatttcagttatgctttgtaggaaaaacactttcctatgcattgaatgttctataactaaggagcttagtaatctactgctaaaaatctcactgaaatctccagtttaagcgatttaagcaatttacagctcttggcaaatatttgttttgggttataaaacactttttttctgactagtaaattgttcatgttctttgtttccagtaaaatgggaataaaggtttcagtactcaaatactgcttattttttattggaaaaaaggaagcgtgggaggcttttaagagagtatcattatgagggtttcatagaaatactcagtctgtctcatttcagcatccattcctatatgaggtgacatggtaccagacttagttctgtatgttattcaacaaagtattttccactgtctggtaacatggcagcttctctcttcctcaccacccccccggattaccttggaagtgggaaggaaaatatttactttccagcagttttcattttgtgaaagatcacaaatgactgaaaatgctcacctatttggcagaacaaatttgatatttgtgagactaatcagttgagagtcataaataggtgcaaatgtttatgagttcccctcaaatttcaacatatttgtgaagatgcaaaataagcatgttagtaagttcaaacctaagacatacaagtgaaaaaaagggaacaacatactcaaaagcaggctcatcgtgttcccttaaaaccaacatatctgtaatgtggccacgcaagcttcatttgaagcctctccagtccctcatcccctggtttactcagcacacccaataccagcacagctgcaagactgcttagcatggggcaagctgttggggaaaatcttttaaatcatccttaggcaccgtaactccaaaagccggtgtgtggttggctccttccatactaataatcttgggttactgatgttcgtatctacccaaacctctttctcttccttaaagagctgtccttgaggccgggcatggtggctcacgcctgtaatcccagcactttgggaggcttaggcgggcggataacgaggtcaggagttcgagatcagcccgcccaacatggtgaaaccgggtctctactaaaaaaaaatacaaaaagccgggtgtggtagcgcatgcctgtaatcccagctactcag

SEQ ID NO: 203 - DNA, 1532 bp, Homo Sapiens
tttatagattcaatgccatccccatcaagctaccaatgactttcttcacagaattggaaaaaactactttaaagttcatatggaacaaaaaagagcccgcatcgccaagtcaatcctaagccaaaagaacaaagccagaggcatcatgctacctgacttcaaactatactacaaggctacaataaccaaaacagcatggtactggtaccaaaacagagatatagatcaatggaacagaacagagtcctcagaaataacaccacatatctacaaccatctgatctttgacaaacctgacaaaaacaagcagtggggaaaggattccctatttaataaatggtgctgggaaaactggctagtcatatgtagaaagctgaaactggatcccttccttacgccttatacaaaaattaattcaagatggattaaagacttacatgttagaactaaaaccataaaaaccctagaagaaaacctaggcaataccattcaggacataggcatgggcaaggacttcatgtctaaaacaccaaaagcaatggcaacaaaagccaaaattgacaaacgggatctaattaaactaaagagcttctgcacagcaaaagaaactaccatcagactgaacaggcaacctacaaaatgggagaaaattttcgcaacctactcacctgacacaggacaaatatccagaatctacaatgaactcaaataaatttacaagaaaaaaacaaacaaccccatcaaaaagtgggcggaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttgttgggactctaaactagttcaaccattgtggatgtcagtgtggcgattcctcagggatctagaactagaaataccatttgacccagccatcccattactgggtatatacccaaaggactataaatcatgctgctataaagacacatgcacacgtatgtttattgcggcaccattcacaatagcaaagacttgggaccaacccaaatgcccaacaacgatagactggattaagaaaatgtggcacttatacaccatggaatactatgcagccataaaacatgatgaaactggaaactatcattctcagcaaactatcacaaggacaaaaaaccaaacaccgcatgttctcactcataggtgggaattgaacaatgagaacacatggacactggaaggggaacatcacaccccggggactgttgtggggtggggggaggggggagggatagcatttggagatatacccaatgctaagtgacgagttaatgggtgcagcacaccaacatggcacatgtatacatatgtaacaaacctgcacattgtacacatgtaccctaaaacttaaa

SEQ ID NO: 204 - DNA, 1905 bp, Homo Sapiens
tttaactctccaggtgaccctaacgtgcagccactgctgcaatccacccccaatcaagccagtccccagtgaactgtgggcattcactcataactggcacagccatcccctgaaatctgttgcgaggaacaatactcaaaggctaactacgctgagaatgatggtttccagcttcatccatgtccctgcaaaggacatgaactcttccttttatggctgcatagtattccatggtgtatatgtgacacattttcattatccagtctatcattgatgggcatttgggttggttccaagtctttgcgactgtaaatagtgctgtaataaacatacatgtgcatgtgtctttatagtagaatgatttatattcctttgggtgtatacccagtaatgagattgctgggtcaaattgtatttctggttctagactgggactatgggcatgctaccatgcctggctaatttttaaatttattttgtagtagagacagtgtctcactatgttgcccaggctggccttgaactcctgccctcaagggatcccaaataaatatatttatttctaaattcattctaaatgtttgcaatgttaagtatgtgtggcaaaagaacagatacctttcattttttcaatcacctttcaaatattgttacaaaagcacatattactgtgaaatagtcgtaatttcagaaagaaattattcttcattcaacttctcttaagatttttaattaaactttttattttgaaaacattcagaacctacagtgcaattatcaaatttagaaaacttaacattgacacaatgctattatctaatatgtggtgaatattcaaattttgttgatggttacaaaattgccttaaaagcaactttttcccctcaacacaaaatccaatctagggtgatgcgtcgcatttaggtgtcatgtccccttagacttccttaatcaggagcagtccttagcctttctttgttccatgaggctgaaagttcgtttctgaagtgctcagggtctttttgttttgctgacgtctcagtttgggtatcacttggttaaggtggtgtcatccagagttatcttctggaaaggcaccttctatcttggataggaaggaatttaagagcaggcactaggcaactgtaaatatcaccccacaattccactgaatgatattaatattcagcgacgatctttgcccgggccaacaattattatggtggtttcaaagcacctgctcacaatgggggactagggagtgtctcaaagttatagtttcattttcaagaatgttctgatacctctgttactgtacctagatttgttttgagcctacgtttctttgaggtaattgaggggtgtcgactgagggcttcatgccccgctgctgtgagtgctgccagcaccatcccctgcctgccctctctctagacattgccctctgctgaagggacccaccctgaccatggtccctggagcagcctcagttgagtgatgtacttgtgataagagggccctgcccctctcaccccgattccgcacaaccttaaagggctgctcccactccagagatcttcctgtggggtggctgaggcttttcttttgaccacgtggaagcccagcctgtccctctgcccatctgccgctttccctccccacaggtgttggtcctgagagcattcccaaataaatttcctgaaccatcatcaccatagcaaagcagcttcctgggcaacctcacctacaacagccatttaagaataggaatttgaaagacattgagtgaaaacaatttataattcagaaaggaaagcttgccttataaataaaactattcattattacttagctaaaatagtcgtagttactttacaaatgtttacggctcccctggcttggaga

SEQ ID NO: 205 - DNA, 13030 bp, Homo Sapiens
agtcgtcgtaggtgaggcagtcggcgctggcaaagagctgctgcgcggggagccagttatcgggcacatagtcggtgccgcccctgatcagccatgtgaagaccatgattgctttcccttcagccttccacctttgtaagtttcctgaggcctccccagaagcagaatcctgcatagtctgcagaactgaaactctgccaatgtgtcagtggtggacctgacctgccgtctggaaaaacctgccaattatgatgacgtcaagaaggtggtgaaccaggcatcggagggccccctcaaggacattctgggctacactgagcaccaggttgtctcctccgacttcaacagtgacacccactcttccaccttcagtgagggggctggcattgctctcaacgaccactttgtcaagctcatttccttgtatgacaatgaatttggctacaccaacagggtggtggatcatggtccacatggcctccagaaagtaagacccctgcaccaccagccccagcaagagcacgagaggaagagagaggacctcattgctggggagtccctgccacactcagtcccccaccacactaagaatctcccctcttcacagtttccatgcagaccccctgaagacggaggggcctagggagcctgacctcgtcatgtaccatcaacaaagtcccttgtgctcagccaataataataatacaggtataaagtattattgaaaaatgctaagagagtggatgttgtttgtagcacaaaatgcaactctactaggtaacgcatatattaattggatagacttagtcatttcacaatctatagataaatcaaaaccttatgttgtacatgataaatgtgtataattttatctgtcaattaaaaataaacaaatttactaatggtaatctaataaagtaatgtttaagcaggacattcagcacttataatttctgtgtgtaaatatctaaaatttttcatcttgaatgatacagagttaccacgtcatactgaatgacatagaatatcttctgtactcctaatttccctgttatcctagtaatagatccaaatagatacaagagtggccctgtttcttacacctaaataaaacttattaaacacagataatattacatacatgaaaaaggagaaaaaataaaaatattgggaaatgtaaagaagagctagaaataagacattaaaaggccttgtattttattaaaaactcttgtgaatgcgggatggtctaaaattttgagtctgatccttctagtagatcaagttaccaagtgtatggtctgtggtatgaaattaatcaatttctaggaagaaatgctattatactctgaactaaatgcaaacagaaaatgtaggattctctcaaagagaacattctgtaattcaatgtatatgtttctcacgtgaattacaataataaaaaatgtggcaagttgcaaagggctgtttcttatgttcatcaataaagacctataatcaggcataaaaaagtattctatagcaattaaatataatgtggtccttcaatctgttgatttgacttcacctaggaatagactttgaattatctgaaaaaataaatgcactaaatatcctttgagtaaccctgactatatattctttctcttgaaagggatttttagtaaatatatatttgataaatacaattcttgacgaataatgagggtgaagctctcttactggaataagattgaaagctttttgtgtctgaaaataaaggccatttactttctatactcaagtgaattttaaaatgtattcccaagacaacgtttttcaaaactaatatatagatgaaaaaactaattgatgtttcaaagatatactcagagtagcatagttaacaactacaactatgacaaaaaaacaaaaaacaagcaaacaaacaaaaaacaaacccataaacacaccaaaggaaagaaaagaaatactaaaagcatcaatggaacccagaaaagctacttttggaatagcttccagaataaacatcttgtgacatttatgctggtgaggtttattattgtatagacttcaattgatttcaatccaaatcaaatatagatttaaaatatttgatgaaatatatgcctgtgttacagataatatatgcttatttattttccaatttaagcataactcttaataatttttaaaacaattttaacatgcctttgacctgtaatgaacaactacagaacctgaaagttgattaaagattcagtagtaacataagtaatatttgtggtaaaatattgatttaaaaataatgtaaactacattattaaagctatttaaataggccatgggagtcagggaagacaaaaggtctaaatacttttctcttcaatattttgttttatggaaatatttttatattgaaataattgtatttaaatttagattttgtgataaaagttaatttaaaggtatgaactataaaaccaccacaggaaagaggataatgtttcaacagttacttgttaatgtaacagtttatacaataaaaagtaacccacagtataggatttttcacatttacaaagtgtcaagtgtttacttcttcatcaatatcgcctacattttcattatttaacatctttgcccaattcccactgtaaccaagtgtatttccatgcagtcaagttactacccagcttagtttgaggttaaatgtaaaaagctttgacgttttctgttctcagagtcctcctgcagaagcctttgttctgacctttcacccacacccccaggacttctattcactaaaaatgtggaattatccatgctaatcctggaattctggtcattaaaagaaaaaaaattgtgtatatcattctctgcatcaatttcaaaagttattcttcacacctatatttagagatgcagctgaagcttaaaaatattcaattgggcatataattttataaaaatagagcgttctaaaaagaattgagaatcatgtaaaatttaacctgtttttactggatctataagtcaatataaaatatttatttttctgtgtacattcccatatctacttaatgacactgtatcatgttgattttgtcttttttctttcattagcctatatattcttcatgagagtaaataaaactaatcgtgtcttaaatatcgacttctattgttattttgaatcttcctaagggtataggtcaaggtttattcattcttaccttaccttctgttttagcatttaagacagctcatagtagacattggaagattggttaaattgctatttaaatgacctagaatacaattgtttaagtaatttaccaacctttgcaaagctgaattatatttgtgtattctgtcaatattacataatattaaggttctgagatgtgttctttatctttattcagcttttcctatattctagaaaatttcaccttcttcataataatttcttagaaacttgtgtttttttttctttttttcttttttttttttttttagatggagtcttgctctgtcaccaggctggggtgcagtggcgtgatctcggctcactgcaacctccgcctcccaggttcgagctatttcccctgcctcagcctcccaagtaggtgggattacaggcacgcaccaccacgtctggctaattttttttttttttttttttttttggtattttagtagagacgggtttcaccatgttggccaggatggtctcaatctcctgacctcatgatccacccgcctcggacttccaaagtgctgggattacaggcatgagccaccaggccctgctgatactatggactaaattgtgtctgcccccaaattatatatttaagttctaaccctcaatctggttatatttgggcatgacacctttaaaaagtgattacggttaatgaagtaataaatgcgtatccctaatctaatatgactgatgtcttcccaagaagaggaagagatgtcagggatatgcaaacacccctgtgaggatgcaataagaaggtgaccctctgcaaacagagaagagaggcctgaggagaatccacacctgccaacaccttgatcttggacttccagtttccagaactgttacaaaataaatttcagttgtctaaccttctagtctatggctttcattatggcagcccttgcaaattaatacagttagcttgggccagctcacagaacttaacaccaaagtgaaagctggcaaaaatttcgaaaattttataagtggaattttttaaattatctaattttaaacacttccttattattgagtaggccatttcatttttttcaaagataaaaacaaagaaatatattttaatttgcagaagagcaacttatgttaactgaagaaaatgcttactgaatatgaagttaaagtaaaatgtgttaaaagagcctcccttaaattattttagctagaagcataaatctgtctctaaacattctgtgatagcaaaatgaatataaatagcatattatgccattataaatagcagttttaagtgatatgattaataactgttagttctggagtcatatgctaatctttgtggaagcagaagctggctcatatactgacaacctctgtttgccctactaataattcaacccctagttgctattgtcacattgaactacaaattcctaacagaaattactccaaaacctaggaaatgaaacagatgctaacatttcaagaaagccttcaggacaagaacattaaaaaatcattttcatgtagtgcttgaagtaaatcaaatctgctggtatttcatgtgcttaagcgatcacagctttcccagccagtgagtatctttaaaagagaggtttctgtctttcatatcaagtattattttgattaaaataatcatttaatgaactagatctggaagaagtcaaaggtcttttataagattatgacataataatatcttagaaaaatctcttatttactgaaccactatttattttcaaagaataggaaaaacattatgataaagctcatcgaaggtataacttatataggctaatagttatacttagatttcttcttctttgatttttttttcaaaagaaaaaaattttttttaagttttttaaaagaatgcattaaaaccagttataaattcttgtccactactgccaggaaaaacaataaatcagtagggcctcatgcaacttatttggaagtccaaaattgatggtaaatattataatatgaatttacatttcagaaaaatatatgttcaagtgcattgtgagtgaaaaaataataattttgaaatatgcatgtaagagatgtactcttctgagagtagaggtgtagggaacactaggttcagaacagaggaagaaagagtaaatttttaatatctagtcttggtttattgatacacaaatacagtaataatccatatctagagttttactttcaaatagatttaacatatctgaatattggatactttgcatgagttttgtgaaaagattgagttaaaggtttcaaagccatttgagaatttcctttgaacacactaaagggtatctgtgaatactggcttattatatcatggctgatttacaataatttacgtgttgcctttcttagctggaactgtatgtgccaggaatagattaatccttatggttacatagatcagcagcaagacctcccacgtggaagtacctatattcatctttgtcatctgaaaataactttattagaaaatatcacatatcttcttattgccagccaggtgactcataggaaagtacaagataactgaaatcagctacataatcctatagttcatgcactattttcaaacactttgaaacttactgttggtaagtaaatgtttatcttaattatatctaaataatctcttccataattactcttgtgattgaaaccttgttaggcctcagaagcctctcgatatcaaaataactcataaattcctacttttatttgcacctcagaacatgagacttccagcatcctggaaagttcaaggtgtttcttaaactctctaaagggatggtttgcaagccagtctctttcataggaccaccataggccattctttctctaacagtccgatttaatttgtccatgacttctgcctttatagtcaactggaatgcctttactcttgctactatgtactattttatgctgacactatctcctgatgctctcaaagtcatcaactcttgggctgccagagtcctgctacattctgtgcacaactggtgaaaaatggccttcaattttaccctctgctgtgttgccatctgggccctacggcagcacaattcctgtcaagtgttttattaattccctcataaaaacaccattttcatcttcagctgtctagaagctccaaaccagttcagtgtccagtaagcatagacaccatgccaccctttgagcctttacattctcatcgtcgcaagttggatctcccaaacaaaagaaaaccatccaactttcttttccctcttcaacaaaattcaaagcttcttggcacattatttcaagcatacagatgctggtgggagtgtaataggaagtggacaaaaggaaagatatttggaccaagtattttatcctggctccaccttatgaataaaaggaaagtagacattgtcaggaattcactgatgtagcattaaaaaatctattaccaagagatcaaaggtagctagcaggaaataagataaaggactgacacccaattgtatccacagggcaagtgtttttattactaaaattccaataaaaaattagtgtttctagaaaatagatatttatatctgtgttcaggcagattaaaaaatcaatgagttttaaaaattacatttaatgaacagagtgatttatggtttgtttttgctttactaatgtgccagctcgatgtctctaataacaagtctggcttgatagccctgctaacaaatccagcttcatctagtacaatagaatatattttttctgaattcatttccatttactatctgctcagtttcttaaattagaaaataacttgactaattcaatggacaatggattggatatgaatctaaaatgaggcagtttcctgaagcccagacttaactgtatgtggcaatttgctttggggcattgtgcaagagaaggtttctcaaatttgtctaataatagtgaggctcttatagtaaatatcacagaatgctttgttaaatttgaagttcaacacataagaaaatgtccagaagaacacattaatgtccagaagacattacctaatcttgtcttttagaaattatcagcaacattgtgttgctgataacttctaagagacaagattaggttgtttgtggacatttatggaatagtcagtacaaatgtattgaagagaaatggtataattctgattgtgacactagattactattctgtttcttttaactttcttgcttctcaatttttagtgtaaaatatgaggggggtatattaaaaagataaaaggatctttgtaatcctaaggagctaggaagatagtctactagaagatataaatatagggattttgaaagctctgtgttcagaaatggcatcaaagtaataaagttccaatagagaaaaggaattacaattcacattacagtatttagataggactgtaagagaaataaatagctcttccttatttctcgtttaaaatttcagacaaatttgaccttcaaagatatgtctgaacaataacaatagaacataatagaaaaattgttctgactgcaaagaaatagacctttcccaacagtcacttcaaaatgcaaaccagaatgtatggtctatattgtttttaatttaatatatctatgtgaacaagcatacttcttcctcattttcattgcataaatttttacttggaatgcctttgaagttaaaccaatgtgcttcaaagttacatgtatgtatggtttttttttttttaccaactgtacatatgtctacaatttcccaccaaatatggtatcaaatatgtagaatctgagatgttataaaagcattcaaaatcatattttcctcataaaggaaacacaaaattgaccttaataggatattattgaggaatattttaattatctggttataaattctaaggtttcccaagatttagaaaacttactcttggatggcaaaatttactctaaagtattttgcaattgtgtgtgtgatagtgtttgaagtgacagggaaacctatgtatcctggaaacctatgtgtcaaggcattgttttctggatcatttattggcatatccaaaggcttgggaaaaaacttaggataaatagagaataatgaactttttcagaaataaataactaagattactccatgcaatagaatcccaaatgatttgaagttagactttattattagttatacagtaaatgtgataaacaagtttaccctgtgtgatacaaaaaataaaaaactgcagcatgaccataattttttctttatagataaggggctctcatgcttaaagtctgattaacatagccacatctgatttcaaaatatagatatgcccaatgaggtagttcttcacaatgggaatcgctggttaggtgttggttacccaatttcttttatttaaagtttaatggatatttgatgccatatagacaaaacatttggaaggagtttcaaattcccatctggagataggtgtcatataaaacagcctaaaaaaaataagaatggtttaaaaggcttgcttgagttaactaatggttggcaggtccatttgccaggcttattgaatcaagctttaccctcctttaaatgaggggtctgtttttccttggcaggaatgttttagattcagcatattaaaagctgcaaatatttgtgttgggttttcctttgtgagctatctacagcaatgtgagagagcgagtacatttagccacagcaggaacttcccataaaatcacagtaaatgactgtgcttttcttataagccacacccttcctaggcatttctcaaatactttacatagaaatgtgttcactttaacaaaaatcaataaatgcaaatattatttcatttgttttcattaactagtagaaatagcagtaatatattgttaattatattagcaggaccctatagcttaatgcaacaagtcaaaaggcatctggccattcctaagtattgtgactgatggagtaatatagacaaaaaaattggataaccttggaaaagtatgaagatgtgcagtttacaaagagctggctgaaaattaaggagaaatggcagatttgaaaccgtgataggtataaatgaattgtggtatggcctgattaaaaattttacttcatcatattcatactggagtctacataatttgggaagaagaaatattttgtcaaaactgatatatcccataaaatataactaacatactttgcagggaagcttaaggaaggcctgggagacaaaatggacaacaaatgtaacaataataatatttaagtgcaataaggttttttataatgtcattttttaaaaaataaagttttttataatgtctacataagggaaatcaacactgcattgactattagaattagtttgggggtctaatggactattcctgaaatttggactgaggggtcagattattaatggtagacctgaatttgtctcaaagaacaatgttttggaatctaataaaatctcttcagatactctctatttaactgattgcttgtttcaaaggtcaattcattttggaaaaagattatagatttttctcacattttatgacaacataaatgttgacaacttatgtttttgttaatgtatagtgttattcattatcaaaaacaaaaacaaaagcaagctatttgctaatagtcatgtcacaaatataattattatacatagaattatacagacccagttgcaatggacctttcttaacttccttataatttattatccttttaaaacacaagagaaacccatttggtatcttccacccatagcttgaaagtcttatatttatttgcttattagtagtacatttccatctgatacatgtaatattaggttgcattattctagatccaatttttccttctgtaagtgaagtttatgaaataaggttagttgttctagtcacaaatgcattgtacaatgaaaagcatggcattataactcactatattttcatgataagaaaaaagtatgcatatttattgataaacgtattttaagtgtattccttatagtgcgggaagtgcaaagatgaatgaaacactctagtaaagagcagtgtgcttcaagtttttctgttgacaccttgtgtaaaataattttgaaagaacttcagccatttcaactgacagatcagttgtaaagcatgtaacttttggcacattttaaatgttgacattctaaactataactgttatatcatttttaaaaattcacaatgaaacataaatataaaagcaattcaatatctaccacattcatttaaaataaatgagttcttcacagcggttggaaatggtacttcatttctttctctccttgaaatcatatcccagtccactacccacccttcctgttatagaattttattctattaaaatttatttttatactttaaattatttttagtgataccctgaaagagagccaggaaaactcattatatagaaaaaaaaaggaataaaggtagcacggagcaagaaagaagataaagtgacagggaaatagatcattagatgagcacgtaacactttaaaatctgtgaagttatggtgtctgtcatttattattttttttttttgcagacgtgtgcattgctgtgatgtaaatctcttctaatcttttctcgtgaaaatctttaccctgctctaaaatgttttgcaacaaaatttgtacacagattaacattttattttgaaagaatcctgtccaaatggcggcaaatgaatgtttttaaaaagttcttccagattgcattatcactacaacttttataaaaaataatggcaataattatcatgttgataataatagtggctaacacgtctggaaggcttactaagcttcaagcacgaatctatacattacctatttatacctctacttgtagctatctatttatatagagtgtccaccaggtctggaaacacaaacgatatataataaatgattcactgatatatattagattgtaatactttcaaaaagtaatatttgattttctagagttatgatcaccttacaacaatcatgtaaggtaggtactatgcttaacccagcttacctatgagggacctgaagctcagtcagtttattaactttaacatgtgattaaaaattgattaattcaagagttgaatcaggcaggctggttttaaagtttacactcaagatcaaaatgcattattatagactttgatatatattttgattcataattcatcttaaacaaaagtaaaattttatttaccctatattatttaatgagatgaagaaaggggaagctcacatgtccttttgaaaggaggcttggcaaacatcaatgtatccaccatccctgtccccttgtttgtggcctaagagattgttacaccttccaaaaatgctctctagtaagattcagaatgggtgatacaacacttgtgttttttgtgtggggagggagacgtaggtaaaagaggaaaaggaagattgtgaaaagagaagtggaaaaggataactagctggaagcttgtagcttcgaagttttctctggcagatcagttttaggaaggagatcaaatcgagtttgagaatcaggaaattgatttctgtaaaagaagctgtttctgcctatgtggtaagggtatggataactcacttcataggtccttggtctagggaaaagtgtaacacaaagtaaatgatgaaactcagttctatcaaaaatgaaaatgttgttgcatttgagaaccattatggtgggcaatgtagtaaaaaggataagacattcatcctactttaatgtaaaacaaatttgaaaagaaaaaatgataagtaaagaatttcatgaaggtattatcgtcactgcatataatatgctttctactaaatttcaatggcagtttatgtttacctaccatattaaataattgctattacattggtatcataattcctcttatgagaggaactgttctttctgataaaagaaattaaaaatccacttagagtagagcagactcttggtcataaatgttatcaggtgctcaaatatcaggggaagaattctcctctccatgaatcaaattagaaaatgcattacttttactcatgcaacagaagctggaaaatgagtgacaaaaagaaagaatggggtaaagacacaatgaagtcaaaaagagagaggccaaaatagattattgggagaaataagtgacatctaaaaatggtcatttctactatttgatttgaagttgtttgcattggtagtatgtgaacctctcccatatctgctatcatgtaaatctttaatgaagtctactgtctgtgtgagtgaaattttttacagagatcaacaccagggctgtttcagggatcaatgcaaagcagaacaactatatacactaaagaagagtctgattaagggcaaattaacaaggacattgcagggaagcatattcatgagggattccaccattttacagaaataataataatatgaaaatcttttagtgatgaagaagtactggtagactttcatggcacttaagatgagaccctcaaggcacatgatcaaggatgattaccagtacttacttatttaagccagtgtcatatttaagtcccagctttattttgctgtggaacatgtaagttaacataaatgacaagtcacactgacctcatttggttgaattttaattactttaattggagacactgctcattat

SEQ ID NO: 206 - DNA, 1365 bp, Homo Sapiens
tgcagtgagccgagatcatgccactgcactctggcctgggtgtcagagcaagactccgtctcaaaaaaaaaaaaaaaagattaaatgaatcataagaatggggccttaatctgatagaattgtggccttttaagaagaggaagaaagagaaaaagagaaacatctgtctctttctctctcttaaccgtgtgaggacgcagggagaacgtggccatctgcaaatcaaggagagagtcctcatcagacattgaccctgctgtcaccttgatcttggacttccagtgcccagaactgtgagaaaagaagtgtctgttgtttcagccactcagttgatggtgttttattatggcagcataaacagactactgtaggagcttagactctgggtcctgatacatatcggatcctgatgcttatcaaatccaggctccttccttgaatgtgtgacctttggccaggttctcgacttctctatgcctcagtttactcctcagtaaaatggagataataatattacttatcacctcagtaaaatggagacaataatattacttaccatctaggtttattttgagacttaaataacttaatgtatgtaaagtatttatattgtgagtgcaaaataaattaactattataatagtccctaatgtacttaatatctaactgcaaacattgccaagttttcttcttgtccaaagtcacaacagttttctttaggaaattttccatacaaagtggggcacattttcactgggttctttaagatgagataataaaaaatgatacgttagaaaattttccttatggcatcagtcttctctgacagattgcagcttcataaaggcaaaaactcttgattttctttttaacccacataagcccttaataaaatacccattacatgtagttgaagtaagaaaagctggaagtgaggaatggaggaaagaagaaaagaggggcacaaaatatttcattaaatgttttaaaaatccccagaaattcagaatacatgaatataggctgacattaaagcagatgtacgtctcgtgcagaacacacagtgaggaaacaaaatggcaagagcaaagctaaagaaaactaccaaatttgcattttcattaattcagccttaaatgtaactttgtgtcactgaataagtgacttacttcctaaacatgacggtcagacaggaaatcacttttcttgtgattagcataatgcttatattgtttttttagctacagtctaatcattacaaagaactactcgttgtgtccatattaaaattaaaagtaccttgccataacaaaagcacattctaagcctttcgaaatgtcaacatattaaaatatattaaagcaa

SEQ ID NO: 207 - DNA, 1266 bp, Homo Sapiens
tgacacgccgcgcggccccccagtctcccgcggccgctcccccaggcatggcacagggcctcgcctcactatggcagcagcacggcacagcacgctcgacttcatgctcagtgccaaagctgatggtgagaccattctaaaaggcctccagtccattttccaggagcaggggatggcggagtcggtgcacacctggcaggaccatggctatttagcaacctacacaaacaagaatggcagctttgccaatatgagaatttacccacatggattggtgttgctggaccttcagagttatgatggtgatgcgcaaggcaaagaagagatcgacagtattttgaacaaagtagaagaaagaatgaaagaattgagtcaggacagtactgggcgggtgaaacgattaccacccatagtgcgaggagagccatcgacagatattggcccaccgccgatgggcgcctggttgaatatgacatagatgaagtggtatatgatgaagattcaccttatcaaaatataaaaattctacactcgaagcagtttggaaatattctcattcttagtggggatgttaatttggcagagagtgatttggcatatacccgggccatcatgggcagtggcaaagaagattacactggcaaagatgtactcattctgggaggtggagacagaggcatattgtgtgaaatagtcaaactaaaaccaaagatggtcactatggtagagactgaccaaatgatgattgatgggtgtaagaaatacatgcgaaaaacgtgtggcgatgtcttagacaatcttaaaggagactgctatcaggttctaatagaagactgtatcccggtactgaagagatacaccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgaaagaagcactgtcgctctatgaagaacagctggggcgcctgtattgtcctgtggaattttcaaaggagatcatctgtgtcccttcatacctggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaa

SEQ ID NO: 208 - DNA, 3297 bp, Homo Sapiens
catcactcacgctcgggagtgagggagccatcgccaaacagcaaatcatcgtcaagtcaattggcctcgacgtgcctccaaaagggagagggatgctcccttggcttccatggaaaatattctccaagcaagctcccttgccccaggctccatcttcttcatctcctttttttttttttttctggttttagcgggaacgccgcgaacacacgtattctccagggtcctcacttggtgctggatttcaccaacagcagcaccacaggggaggtcagaggaccgtcagtcaacaggtgagccagtggaagtataaacattgccacatcctctcttcctcctgccctggagcccagagaggttttatgtccatgtcatttaaggaaaggagcccacgagcagaagagaccgtgtggtttctattcatgacgttctcatcattgtgaaatctctgcaagaacgacatggaatggaaacaggtattggagacgaaggcaacacgttgtcgtctgttctacttctgcgaaatgggcacattcatgtcttaaaatgatgcagactaaaacaaccgagcatcttccaaggaaatctaatcacctgctgttcacctgattgccacttcctagtgcttctgtgacacatcaccaccagccaggtgaccttcacctagtgtctgaatcagcaccacgctctcctgttgctattcagggagggccttggcacacgggagctttacagtaagtgttactttccatctttattttaacttcatattttctactttgaaaattactaacagccagcatgcatcatggacatcgtgttgcttctatgccctgatttgaattccttatgcattatggacatcgtgttgcttctatgccctgatttgaattcctagtgaatgaacgtgcggtcagctgtgcagaacaaggtggagtaggaaccaggagagggtgtggagctgggaggaaatcgcagggaccatgctgcccagggcctcctgaccccctcacaggatgctgtttctcccgcagggatatgaggcgctatttttattcctctcagcactattcatttacaaatattgtattgggttctgtgccaagtttaaacaattgatgaaatgtggggtctcaggggacccccgagacagaagccttcctaaggaaagacggcgtgaagctgagcggggcggcggctgtttctgggtgggggcttctccctcgtcggggtgaatgagccccgagaccctggggtgctccctgcattctgcttttccctccacgcctgtgttcatccaaaacgcggcagcagccttgacagatgggaagccacctgcgggccccgtgcagcgccgctgcctcccctttcccgaacctcctgcctcctgacccccaggggaacttttctgtgtcagcgtcagcacctcgcagggcgggaacgtttgcttgagtctatgtggctcctgagaggcgacctctgtgttgggcaggatggaggtgaagcacggaggtcttctctggcgaatctcatcactgccaggaaggcacagaggtcaggtcatgagcagggccccaggcagggctccctgtgctgtggagccacagagaaatgccacctcgctttaaaatgaggccaacctgtgttgcctcaagaaaagacctcattggttctcatgaccaaatccgtttgtaaatatttatggcatagtgtgggctgtatgaacacaaacctaattttagaagatattggaagcagggctgatcagtatttttgtcaccgcgcgggacttttttgaattcctaaagctatactttcgggtcagaagaacattgcaatgacacaggacaaaagcagtattttggcaaagattgatgaatgcgcacaactgaatttctacgaaaagaataaattgtgtaatgaaaacactgctaaaaattaaagggacgtggggaacttttccattttttaaaagtggtcatattttaagaaatattttatgaagtaaaatcacattttaagtccaaaggaatgtgtccttttaagtttaaaatcacattaaaaatgttaaatgaaaatgttgacagccacgtttacaccaagcacagggaaaaggccagcacctccccaccagctgtgcagacacttctttgtcaaaaatgtgccagagtcagaaaataatttgataattatttaggaatctgtttttcattttccttccatgtcaaaagtgtattttataataattatgccattttgactttaaaagtacattgtactttttgctgaaatgccagttcagggagcttagtcccattatgtatggtaactggtggctacaagtttatattcactttggaaaaaagttataattgtcttctagtatttggatttcagtttgtcagagataactgattgtgaacaaagtatacgctttgtcctctttatcaaactgccagcattctgcagagctgaacgcattttgcttggttgtgtgtttattgtcaaatgatggaagtggtttttctccccctagaatcaagcagatcctctcttgggctacccaagccccagtggtgaatgggcttcctttggcaggggtgtcgccaggagaagtggttcctctcagttcccggtcaggtaaacagtggctgccagggtgagcccaattattaatttaaaacacccaaaataacagcaatatgaaagatcagtaactgtcttaaagtggccaagtgtaggagtctgtgtgtaacatggtgaccacagggtgcttcgggacattctgtaggtactcatttgtcccacgacatttgtttagagctatcacggttattttttcaagtacattctctttccagttcaaacatatcatcactaattagtgtgtcttggatttgatttttaaaaggaatcttaacatctgaatatagacgtagaagccatacttcaaatacaaaaaaatcttgcattgtcaataagaccactggagtcaaggtccagagagaagccaacagaatcagagaccataatagacttcatgctgtgttctgtctcagtattaataatgctccttcagaaaccacacttccatagaatttgtctacaaatagcacatgctaaataattgtccatttgtattaaaaagagcatataaatatgtagtgtaatattatataagtgcatgtgtatgttgtgtgtgtctgtatacatatatatatttacatacatttccatcttctgatcaacttaaaataacgtgctatagaactgagctgataaaaatctgacaaaaac

SEQ ID NO: 209 - DNA, 3079 bp, Homo Sapiens
ttgttcattttagagtcttacgtttgaagctcaagccacttttctagccacggctataactaataagcacctgctgttcagctccactgctctgtacttccttatcggaaactgtctcatttcccaaacaggaggatgtaaattggcaccatggcttccaagacattttcaagaataagttgggctttgcacataaaaaaaaaaaaagctccctttataaattttattttgcatttctccacctagaggaagtactctgtttcttctttggaaggtgggtttttagctgaaaaagatctgacctccacaaattgcccatagcatccttcagccaccatcccaaggccggggaaccactgatctgctttctgcctatctctataaattagtttattttctttagaatttataaaaatggaataatgtgctatgtgctctttttttttcttgcttcattcactcagcataattattttgagatctatcaaagttgttgcctgtatcaactgttccttccttttaatgtctgagtagtgttccacaatatgtttacacccagcttgtttatccatttacctattgacagacatttgggatatttccactttttggctatcacaaattaagtactcatgaacttttgtttacaaggatttgtattgcatctatactttcatttatcttgagtaaatgtctagaagcagaataactagatcatatggtaggtataggtttaactttttttttttttttttttttttttgaggcagtgtctcactctgtcatccaggctggagtgcagtggagtgatctcggctcactgcaagctcggcctcctgggttcacgccattctcctgcctcagcctctcaagtagctgggaccacaggcgcccaccaccatgcctggctaattttttgtatttttagtagagatagggttttaccgtggtctcgatctcctggcctcgtgatccacctgcctcggcctcccaaagtgctgggattacaggtgtgaggtttaactttttaaaaaagagaaaaattatcttccaaaatggtcacacaattttatattccaatcagctgtgccacacatccatatcttactactcattttaatgggaaagcatttcatctttcaccataactgtgatattacttgttgcatgttttttttcacaaatacatattaccagggtgaggaggaagccttctactcctagcttgctgaaagcttttatgagaaaatggatgctgggttttgtgaagggctttttctacttttactcagatgttcatgggacttttcacttttagtttgtcacatttattttggattgttaaactcaccttgtattcctggggtaaatctcacttgctcacttgttcatgatgtatttttaaatgttgaatttaactggtaagatttagcttaggatttttgttcttccatgctcccgaagtctgtagttttctcttcttataatgtcattaatttttttttttttttaagtcagggtaatgtcagttcactgaatgagaaacctcttcagttttctacttgagtttctatgtaaatagtatactctcttttattactgttagtagaatttactagtgaagctatctgtctctaatataatcattgaagggaggtgatcagctacaaattcactggccacatcctcactcctgtgacaacaaaacagaagattccacttcagcccctgattgactgggggccaagtcttcacttcaccctctgatgggtcatgggccaatccttcctagggtgtaaccaactggacgcctctaaagggcacttagggatgttaccaaattcttttatcttaataaaaccctaaagaacattgtaattcggggggttcttcaggcacttgcttgagcctgttcccactctgtgaaatgcacttttgcttcaataaatctgtgcttttgttactctgttcttttgttgctttgtttatctttcattgtttcattcttttgttgctttgtttatctcttggttatcagttttctatgacaatatatatgtttctgatctcatccaattctgtgtagacagcaagaccacattgttctcagcatgcatctgaaaccctgagcttggcttttctgagacatggtgtacacgtgcagttactcctcttgcccacctttggtttcttatcaaaagtgtgacatggcattggtcttgttcttgaagctcatctttgcacacaaccaatgtggatgctctctgctttaagtgtctctgaatccaaagagaacatttaaggagactacagactgattccctgtgtccttcaagttaccttcattctgttgtaaaacctatggcctctttatccactgacagaaaccctaaggacaacccaggtatttctagaaagtctgtggttcctaagtgaggatgaaaggaagaggttgtgaaaggtgagggccagcctgcggctgttgttcagagaccctactcaaggccaccacgttctggagcgccctccccattcaaaaacagcccatgcacacgactatgcactagcttgtctcagtgcctggaattttccccatgctttgcaattgcaaatgctttcctgagggagtggcagccaggcagagggggaacggcagcctttgtgtctgaaaagcaaagttttaactggaacttcacttccaattacctgatgatgaaaaataaacacaatgaaatacttaagtataaatcaaaccaaacatgaaggggatgtgagtgctaagaacatctcagagtcactaattctggcatctccttcaagttctttcctcccatgtttccagtctaacacagggtctccttgctcaacaagtcagatgctgagagactgccagcacagcctccaacatatcttgtgattcacaagaccttctgaggacatggagaagaagtaaatgcagctcccagttgtggctgtcagaaccatgggatctcaaggcactgagtatgctttccttcagaagccgaggaactactcagtgtgtctcaggactctttgatatgacaattaactcacatag

SEQ ID NO: 210 - DNA, 774 bp, Homo Sapiens
ggcgcgggtgttcgcctacgtcactggggcgctacggtgcctggagctgggcggtcttctcgtcagagtggggactggtgagagcgacctccccgccaggtcctgtgtgttgccggctgaagaagggtagctgaaaaattcagacccagcacagtgtttatgttggtcaaaaatagaaaactatggcgcggccgaggcgggaggacccttcaggccaagagcagcctagcaacatggcgcaaccccatctctgtagtcctacctcagccccccagctacttgaacccaaagattcaaggctccagtgagctatgatcccaccacagcattccagcctgcgagattgagatgatgattattccccaccttctaagagacaaagaccaacgagccaccacagccaccagtcccagaacccgccaatgctggggaacggaaaatgagggagttcaactctggtaagttctcagcgaaatccatgaccttttcctttatcttctggactctcaatgtgactgatgaaagttaccacatgctctgcagggggaaatggtttagcatgtgttactacatcttaatcacatctttgtaaagccaggagcattttacaagtcatgttacagacattgtttaaacatagtctgtatttaccaaagtataggacgttgtatcatctcatattaattagttagttggctcaaaatgagtgctaatgacttagtaattcagtgatttctgttagctttaaaacctttatttcagaactatttcacc

SEQ ID NO: 211 - DNA, 1860 bp, Homo Sapiens
ggttttgtatcctacaactttactgaatttgtttatcagttctaataggttttttgtggagtctttaggtttttccaaatacaagatcatatcatctgcaaacaaggataatttgactacttccattccaaattgcatgccctttatttctcctgtctgatttctctagctagaactttcagtactatgttgaataacagtggtgaaagtgggcctccttgccattagcattttttctgattttattttcatttgtaataaagtgttattattagtagtagtagtagacttaaaataggcatggttaggattggttgactttcactttcagtttccagcctctgttatggtctcatttagtagtatgtcagatgcatttgcagtaaatagacttctcactttaacttgtagttaagtctggaagataaccggcaatcaccctctctctccttgtgttctactaacacaaggaatgaattcttgtgttcattcttattaaaaaaaataatgagacagtttaagcaaggggccaagtgatatagatttatttttgaaattctataattgctctttgaagggcaaactacaggatgggagaaaattttttgcaagctattcatctgacgaaggtataatatccagcctctaaagggaacttaaacaaatttataagaaaaaaaatcccattaaaaaatgggcaaaggacatgaactgacattttttaaaagaagacatacatgtagctaacaagcatgtgaaaaaaagctcaacatcactagtcattagagaaatgcaaatcaaaaccacaatgagataccatctcacaccagtccaaatagcaaatagctattattaaaaggtcagaaaataataggtactggcaaggttgcagagaaaaaggaatgcttataacactgttggtgggaatgtaaatttattcaaccattgtggaaaacagtgtggcaattcctcaaagagctaaaaatagagctaccattttacccaggaatcccattactgggtatatacccaaaggaatataaatcattctgtcataaagacgcatgcacacatatgttcattgcagcactattcacaacagcaaagacatgtaatcaacctaaatacccatcaatggtagactggaaaaagaaaatgtggtatatatgcaccatagaatacaatgcaaccataaaaaagaacaagatcatgttctttgcagggatatgtatggaactggagaacattatccttagcaaactaacacaggaacagaaaaccaaatactgcatgttctcacttacaagtgggagctaaattatgagaacacatggacacatagaggggaacagcagatactgggacctatcagagggtggagggtaggatgaaggagagaattaggaaaaataactaatagatactaggtttaatccctgggtgatgaaatctgtacaacaaacccttatgacacaagtttacctatattacaaacctgcacatgtacctctgaacttaaaataaacttaaaaaaaaaaagaattactaagcatgctttcctgggtcaggttttctagagacataccctgaaacaaggatttacatgcaagtaatttattaaagaaatacttctaggatgaactagtaaaggagtggaaaaataggatatggaagaggaaaaaaattaagtgtagtagatgctgttagtggctgtatcactcagggttcttcaacaggaacagaaccaacagggtgtggtgtgtgtgtgtgtgtatatgtgtgtgtgtgtgtgtgtgtgtgtgtgtgtgtgtgtgtgtgtgtgtatacacaaagagtgagagagggattagttttaaggaa

SEQ ID NO: 212 - DNA, 2135 bp, Homo Sapiens
tcttaaatgatttgtgcaattgcaaggcacggcagtgtattttcagtgtctaaaatgtgcttgtaaagtttagcacacgttaggtctccttggcccgaccttactggccaaagacattacagacaaaatctctgtgtcaaattaaagactacaaatgtaagaatgctttgtcagatgcccacatgttagtaaatgcttgctcagtctctgcttactctgtttgactacatttcgtttttgtacagacaccatcaatcacggaccctgtttatttaaccagggtgagatagcttcttagcctcagttactaagtctcagcagctgggccttggagacccaggtgaaatctcttctgttggttaaaacaaggagacaattaagacacttgcttctcttctaaattagataataaatttccatcaggttagtgtttcagggtttcactcaagttttttagactctaagcatcttcagtttttcagcggatggacagacaggaccagaacctggaggagaccactggggtgggttaggtggtgactgaggacccagagaggaggagctgaggggtggtccaccatcccgcggctcctgctgtgtgtgtgggcgtgtaggtacaagtagatgccaaccagctacacagtcttggaaatgaaaagagccacttctgacacacacaggaagtgacttgggagcttggaaatgtccttaatgaaaaccccaagaagcttgttgggggtgcaggcatacgcttgggtaccactgggcaacacaaacacagagcaaggaggtgggagtcaccccacagggcgtcaggcaaggcgaccattggaccccgtgacctcaccctgtactcacagactccaacactcaacaccaaaagcagctttaaatagtatagattttatggaagtcttcacgaggacgggagtacagagcttgaagcatgagatggattaactcaagtatgaaggacaaagaagaaagagtgactgatagaaatacagaagagacaccatttttttgagccttttacatgagaaaaaaatattctgggaagattccatttccccttccagaattttgttttcagaacagaaatccagaagttatcttttactcatcctacttcctcactcacaattctgtttcatttctgtcccgcaggcttctttcacgaggctgtaattactggcagggacaccttacctacctcctcctctctctccaaatactgtccttcgaggcctaattgaaggcctctctcctccaggaagtcttttctgaatgttggaggctctgataaccttccgggtttttccctccctaactctgcacctacagcagttcggcattacacaccatcctgcgttcttcatttgtttattcaaccacgttttagggattttgaaggtgaattactgttgctgtttccatcagcaataaacagacatatagacacatagttggacacatttggacacgtcaaataagtcttaaaggccgtggaatgagtctagttatatatgtttttccattctagatggcatgaaatttaatgtctattcaaaagtcgaaactataaaactccactaagtataagctttccagataactagtttattttctccctggaacttaaaataggaggaggaaagggaagtctaattctgagaaagtaggatctctttcggatgttttgtccattaaatagtgaatattttattacactaaaaaattctatgcatgtagacttacagtaagtactccatatacattttaggctgataaattggaataactggtattctaaggggcataatttcctaacataaggacacagttacctgtgctacaatgaagagattaaaaattggttattgaatgctttatcttaaaggagtgctgtgtagtaaagaagattcatatttgctaagctctttaaaaactgtaatgcatggtgcaaatgttacatatatagacgtacattctctttgcaaagagctttcacaaaggacaatgtactatgaagatggccacttggaagtaaataggactttgaggcgtttctgatgccactgtagagaatgtcaacaatggcagtattaaatttgctgttttttattatttatttc

SEQ ID NO: 213 - DNA, 3879 bp, Homo Sapiens
gtaaaagcctcagccttttcccactcattttagaagggaaagggaagctggagtgtgcagaaatcacacagtgaaatagaaagcaggaatgagaaatgggaggtgccaggctctttttaacaaccagttctcatggaactaataaagtgagaatgcactcccctggaaagtaatcaaaaatgccccagtgaagaaaagttctgaaccagatagttttactggtgatttctaccaaacatttaaagacaatcaacagttgacttaataagcccatttcattaacagatgcacattgcatctattaatgaatcacttcacccatggaatggcaggctccagaggggctatgaaatggtggtgcctcaggcaatcacctgccgtcatgtcacccttgaaaggttgaatgttttgtccatctggtggaggtgagaattgaacttaaagcctagtgaagctatgtatttaccttgcccctctttgcagggacagagtcaatctctggttccccctatatttctcaggatgggaggaaatggggatccttcttcctatatcatggaagggagaatgaggacctcacaaaggaaagaaactcactacatctgtcagaagtaaggcctgcctgaaatcagtgaggctcatcgcagcccaaaattcaggcagtgagaaattcaccaaagtggcctttctgaggagaattagagaaatgtttgaggctcatagataggcacctagaaacgccatgaagaaagtcacaaataatgcctcaaatgatgtgctcaaatcacgctagagtgaaaaaattggaaacaccacctttaccatgaatttctctttttttttttttttcgagacggagtcttgctctgtcacccaggctggagtgcagcagcacaatcatggctcacagcaagctccacctcccgggttcatgccattctcctgcatcagcctcccgagcagctgggactacaggtgaccaccaccacgcctggttaatttttttgtattttcagtagagacggggtttcaccatgttagccaggatggtcttgatctcctgacctcgtgatctgcctgccttggcctcccaaagtgctgggattataggcgtgagccaccacggccagcctttaccacgaatttctaatagctccctaggccaaggtgttttttctctcctctgtctcctctctcgtagcaaattcctaccgcacacaaacagggaagaagagcccttgtcacttgtccagaacagtgtgggagctgttgggtgctggctgtgggaaggtacacaccttgacaggtttctggcctggagaacgaggggagaaagttccctccagggtgcccctcagtttgggcccttaaggtaatcagagccagcggatgttgagagtttgagaggttcagtaaggttcctagagccacaggacaggagggagctgttggtggttggggagacagttggagaaagttccaggggagttccagggaggagccgatatgtagggcaggagagaataggaaaaaaaagaatgggtgggtttgccagcattcctccttccaaggattctaaggaaaagagtggaaactgcggagacaattctcttaccgtttctcctttcaagatgcacagagagtcaggcagaagggacactagagtgcaggaaaagaaggccgcagagacaggtgcagaaggttggagggaggaaccactgagaccagcgtccgtggaaagatgtccaacgtttgaccacggagagcaacaggccctcagccacagacaggagagatcgggattgacaactatcttcagagctcccagtctgcgggcattgattgactgattaaggcggagtttcactcctgttgtccaggctggagtgcaatggctcgatctgggctcactgcaagctgtgcctcccgggttcaagcgattctcatgcctcagcctcctgagaagctggtattacaggcacccaccaccatgcccagctaattttttttgtagttttagtagaggcggggtttcaccacattggccagtctggtctcaaacccctgacctcaggtgatccactggccctggcctcccaaagtgctgtgattataggtgtgagccacccaccgcacctggccatcacggggatttagaatcatccccttccccaacaagtgtggcctggagcctgcagaataatggagaccaccaccacctggctcagacccaggtcttccaggctggctcacacttgggtaaggttctgccaatcaggtaactaagcccagggcaagtacgtggttttcaggtcctgggtttcctgctgtgttttaaatgaccacacctggaaccatctccttactttctttctagagaattcctcccaggaaaatcaacaaatcaatgagaagtcaaacacttacccagtagttttgcacagtagagcacctgaggaattcgtgaaaaacaccaatgcctggccccaccccaggtgaattagaccagaatttcggagggtgaagcctagacatggagggtttcaaatgcttcccaggtgactcgcatatgcagccaggctggggagtccttgtattcaatctagataaatagcaggcatgcggcaggtgctgaaggtgcaaagatgaacaaggtgaggatcccgctcttgataaactcacagcttagaagggagatgagcatccaaacaaacaaacagccaggtgtggtggctcaaacctgtaatcccaacataatgggaggctgaggcaggaggattgcttgaatcaaggagttcaagaccagcctgggcaacatagtgagaacccccaccaccccaccccccaccacccccaccatctctacaaaaagaaagaaagaaagaaagaaaaaaattagccatgtgtggtagtgcacaccttgaggctgaggagggaggaatgcttgagcctgggaggtagaggctacagtgagccatgtttgtgccactgcacttcagcctagagtgagactctgtctaaagaaaacaaaacaaaacaaaaaaacacagaaaacaaaatcaccaactgtgggccgggtgtagtggctcatgcctgtaatcctaacactttgggagtccatggtgggcggatcacttgaggtcaggagtttgaaaccagcctggccaacatggtgaaaccccgtctctgctaaaacttcaaaaaaagtagccaggtgtggtggcacacacctataatcccagctacttgggaggctgaggcaggggaattgcttgaacctgggaggtggaggttgcagtgagccaagatcacaccactgcactccagcctaggcaacagagtgagactccatctcaaaaaaaaaacaaaatcaccaactgtgtgctgagttcagtcatagaagcactcccagattaaagaggagggtgcgttaatcatgttttttaaaaaaatttttttagaggatagggtcttactctgttgcccaggctggagtgcagtggtgcaatcatagctcacttcagccttgacctcttgaactcccgacctcaggtgatcccccccgcctcggcctccctaagtgctgggattacaggcatgagccactgtgcctgcctatgtttttaattttctgtattttatgatggtttgacatcttgagggccctgctggcctggaagagactgtccctcccagggctagctaattcctaagatagtaaataacttgcctgtgaacttgcctttcatgtgcacatcagccaattcattccccaacccccaaccacctcctttatctactgtcacaccgagccagtattacccctgccctaaatcaccccagaccaacatcatacaaaccagccaatcctcaaccagc

SEQ ID NO: 214 - DNA, 2336 bp, Homo Sapiens
aaaaattagctgggcgtggtggcgggtgcctgtagtcccagctattcaggagtctgaggcaggagaatggcgtgaacccaggaggcagagcttgcagtgagctgagattgtgccactgcactccagcttgggcgacagagctagactccgtctcagaaaaaaaaaaaaaaaaaaaaaaaaaagacaatctagtctgggctcagtctaggagagcgaatcacttgtcaggagttcaagaccagccaggccaacatggtgaaaccctgtctctactaaaaatacaaaaatcagtcgggtgtggtagcatgtgcctgtaatatcccagctactccggaggctgagggaggagaacatcgtgaacctgggaggcagaggttgcagtgagccgagatggcccactgcactccaacctgggtgtcagagcaaggttccatctcaaaaaaaaaaaaaaaaaatgaaagaaggaaaaggcaaggccaggtgcgatggctcacacctgtaatcccagcactttgggaggccgaggcaggtgaatcacgaggtcaggagctcaagactagctgtccaacatggtgaaactccatctctactaaaaatacaaaaaattagctgggcataatggcaggcgcctgtaatcccagctgctctggaggctgaggcaggagaatcgcttaaacctgggaggcggaggttgcaattagtcccagaggttgcagtgagccgagatcatgccactgcactccagcctgggcgatggagcgagactctgtctcaaaaaaaaaaaaaagaaagaaaagaaaagacagtctacagtctagtttatggaataacagaaatctttagggccttgcaaggtttttggtgaataaagtttttttaaacatgaaaaaaataaagaaatctttatggccctgtcaacctcaattataagcagagaggctctctaacggaaaatgttaatctgggaatacagtgtgcaatgggaataggcatgcttggtaaactatgtatttggggaggaaaaggaagacaaaggtttttaaaggaaagaatgaggaggattatgtaattgttttgagataattacctttgactacaaagatcaataacaagggtgacatcagtccaagctcagatagacagttgctgggcaaatgtccttgtagtagtatctttttgtataaggtttgagatggtctttgtgcaaggttgtgttttttgtagtcttttttgttattaggcataatacatgagacttctctctctctccttctctctctctctttttgtagacacagggttttgccatgttggccaggctgcgtttgaactcctggcctcaagtgatccacctgccttggcctcccaaagtgctgagattacggcctgagccaccgtgcccgcctgagaactctctctctctctctttttttttttttttttttgagacagagtctcactctgtctcccaggctggagtgcagtggcacgatctcagcctcactgcaacttccgcctcccaggttcaagggattctcctgcctcagcctcctgagtagctgggattacaggcacgtgtcaccacgtccagctattttttgcattttcagtagagacggggttttaccatgttggcctggctggtctcgaactcctgacctcaggtgatccacccacctcggcctcccaaagtcctgagaatacgggcatgagccaccgcgccccgccaagaattctctctttatagctttccctcactccctttatcagtgttttcttaatgttaatgactccattttgattctgataactttcacagccttcatgtgtgctttagggtaagaagcagccatacccagatcacaatagcaatgttcctttatcaaatgagtgtataagctaaaagcttttcatcattgcaacatcattcaaaattcgctcttcaatttaggcaattgctaccactccccatcagtaaaataatgtatagtctataataagtagtaaattgtgatcaatgtttgttttgagatactatctgttgactttacctgggcctctttcttttcttttctttttttgagacaagatctcactctgttacccagactagagtgcagtggcacaatctgggatccctgcattttcaacctccctggctcaagggatcctcctacctcagcctctcaagcagctaggaccacaggcacgtgccaccatgcccagctaatcttctttactttttgtagagatggggcctcactgtgttgtccaggctagtctcaaattcctgggctcaagtgatcctcccaccttggcctcccaaaatgctggga

SEQ ID NO: 215 - DNA, 1495 bp, Homo Sapiens
cttgagtcatcagtaccttcagatggagattttgctagatttcagtgagaatttatttaccatgctaactccaggcagagtaaattagaaaaagaatccattatcaaatgtaatatttagacataattggcaccttacaaattgtattatctggtttcttgatgccttgtgcattggagatgagaatatatagtatcttctaaaatgtttacattttaaagcctactttttcctattatctttgcaacttggaggctaacatatgagtgaaaataattctcaggttgagttcttagttagttgttgctgctgttgttgttttgagatggagtctcaccctgtcgccaggctggagtgcagtggcacattcttggctcactgcaacctccgcctcccgggtagctgggattacaggcatgcatcaccatatctggctaatttttgtggttttagtagagacagggtttcaccttgttggccaggctggtctcgaactcctaacctcgtgatttgcccgcctgggcctcccaaagtgctgggattacaggcttgagccaccacacccagcccttacttactcagttttgtctgtagagttgtcccaaaaattatggagatgagccaggcatggtggctaacacctagcactttcgaagtttgaggtggaccgattgcttgagcccaggagttggagaccacactgggcaacatagggagaccctgtctctgtgaaaaataaaattagccacttgtggtgatacgtgcctgtggtcgtagctatttgggaggttgaggcaggaggattgcttgagcccaggaagtcaaggttgctatgatttatgagctctgatcacaccactgcactccaggctgggcaacagaacgagacctttactaaaaaaaaaaaaaaaaaagctatggaagtgtaaggcagcttggtggttgcaaggggctgaaggagggaaagtaaggagtgactgcttaacgggtgtaggatttcctttttgggacaatgaagttttagaattagatagtggtattgattgtacaacatggtgaatacactagatggcactgaattgcaaactaaaatggtttaaaagttgaatgttattacttatattttaccagaatagaaaaaagtatgattctctaaacataagtgaagttagtgcccagacatatttgcaagtgaggggccttagtaactagtatagagaaagtagctgttctctgtggaagctatcacttgatactaatcactaggcaggtatagaatgtcctagagttgagcaagcctcaaaaactcacttcagtttagtcctcctgaatctcagtggaacagagctagaatagtttaaaagacatagaggcagctggtgggtgggccatgcctgtaatcccagcactttgggaggccaaggtgggtggatcacgaggtcaggagttcgagaccagcttggccaacatagtgaaaccccgtctctactaaaaa

SEQ ID NO: 216 - DNA, 1535 bp, Homo Sapiens
aaaaaaaaaaaaaactactacaaaagactgtaaaaacacaaccttgcacaaaggccactgcaaccttatatacatacaaaaatatttctgcaaggacttctgcttgttcaacctcagactggtgccaccaggacttgttattaatccctggagttagggatagttatcccaagacaattacataatccttgtttttccttttaatctgtcttcctttacctccctgaatacgcatagtatggcacatggactcccactgcaatgccccattcatgaataggtatcattttcttttacggcctccgtttatttaggttgacagtatataccacaatttgtttatccattatatgttgaatattttgggttgtttccacctttgggctgttatgaataattctgctaaaaccagttgtatacaagtttctgtgtatcaaactacctttgcaaaagtgacagtaagagaaatctgacatggctgactccatcttgcttctgaactcaacaggcctacgtcttggtagaattcaggcccctctcatcctcttcacttgagggtctttcactagttttataagggcagtttagcttttgggaagagctcatcaaatcttattgttgacgagtttttatagagctttatctccagccacctctgctccaggaggctggtgggtgggagtgaaagttccaaccctctcatcacttggtctttctggtggctggccccatcctgaggctagctaggggtcccactctaagtcatgaactcacgtattatcccattacacaggaaattccaagtgtttttcagttgctgtgataagaaccaggaaaaaaggctaaatatatttcatattaccacagatacatatatctaggagtggaattgccatatagtaattctgttcagctttcaggaactgccactgttttccataggggctacaccattttacgttctcaccagcaatgcatgagggttcctgtttctccacaccctcaccaagagttatttttttcataaataagccatcctcgtgggtatgaaccggcatctcattgtagttttgatttgcatttctttaataaccaatgatgttgaaccagttttcatgtgctttttggccatttgtgtatcttctttggagaaatatctgttcaattcctctcatttttgaaaaaggttatcttttttattaagaattttttatagttcaaatagcaaactacagatatcagactatcatatcgtttgcaaaaatattctccccttccataagtttttttttcattcttcaccattcttggatgtacaagtttttaattttgatgaagtcccatttacatattttttcttctgttgcttgttttcaatgtccaatgcaataatccattgccaaatccaaggtgatgaggacttactcattttcttctagatctagctcttacagattgtttaccaattttgagttaatgagtgataaatgaaggcatatgaggtagagttccaacttcattcttttacatgtggt

SEQ ID NO: 217 - DNA, 1417 bp, Homo Sapiens
agcagctgcaggctctgcggggctagcggcggcgagctgggcccctgggcgagggccattcccggggggcttgggcacgcgggcgagcgactgcgcaaggagcgcgcccggtccgcagtctcctcgtccccggcgcgactccccgccccctcgtctgccaagggtgggcctggggcagccccttccacacctgcaactcggcaacttccttccccgcccgactgaccgtctgctctttctggtccgcaccctgtgctctgattccccgctcgtacctttcccaggctctccggctgcccctctgtgctgtgcaggggacgcgcgaccatcccgcgtctgctccggccgccgctgtgcaacgcacggtttagcggatcttgcacctttctagacgggggagggggcggggaggaggttgcttcaccgtctcgcccagcaaacaccagggatccgtgatcacctgctcgccaagacccgcggcgtggccagacctcctcttctaccgaaaatattagtcacatgaaaaagaatccttggagccaaaaatgagaaccattgaaaacaatgccctgaatcctagatttatgaggcaagagtgccagaaaacagaaattacgtcttaattcgtcctggttttgatgtggattacttttgtctagataacttcaacccagttaagctcaatgaaactgaacacttcgtttagtaaccggcaccaaaaataatctgacaaagaaatttcgaaatagaactattagtgtgttttcacaaacttactcgtttgcaacgttatttctagggtttcttcccagtgtcacttctctgactgagaaatgtctcccaggccggtgatttcagtcatcatctaaaaccaatctcatgtctgcacctgggaaggtagtgtgtgtcctggttaaccgcaagggcgccagagtcagataaccaaggctggatatccgcttgctaactggtgaggagaccacgggcatgttacttatcctgtgcatcaagaggagactacatgtgatagatagttcgtatttaaatgtgacaatacatatgaagccctttaaataggaccgggtatgtagtacctctcctggtacaatgttagctacagctatatttttcctcccagaactctttcctatgctcctttccccccttttcacctctgccagttccctcggatttaacatgttgcatcctccctaaatttgctgtgctccttctagcggcttacgcacccagtcagcattctaatacagtcatgccttacctagccacaaggatatgttctgaggaacgtgtcattaagcgatttttgttgttttgcgcacatcatagcgtgttcttacgcaaacctaggtagtctagccaactacttgctttggctatatggtatatagctattgcg

SEQ ID NO: 218 - DNA, 1269 bp, Homo Sapiens
cagaggatttgattattgagttatctttctattctgctgctgtcagtagatttgccataaatgtttcctgagagtctctctcttgaagagattcaggccccagttaagttcatcccaattaaaaatagaaccctgagatgcagcagctgtagcacctcttaaacctcttcaaataacattgtttaggctgccaaatctcttttataaacatttcgttagctaggtaggatttttatatactttcccaaagggccaagttgacagacatgggctttcactttatttccatagagatctggatccaaatccctgggtccaaatatatgccattcacttcccatatttagtcctgttatctctctgaagactggcccaagagaggcctttctgatgagacatttagcacagcgattaatcactagataaacatgtgaatgggtccatttgcaaagtgaaagctccctaaacagaggcttgtcctttacaaaaagagcaggtccaattttccttaaaagttcatggttgcctatgtggtgtgatttgagaaatcctgaaccttctgttcccattactttccctgttgagctctacatttcatagtgtatcactcctgtggatgaaacctggcctctccagggcagtttctctaataaatggccatagtcctgggaaaggtcctgatgccttagtgtgcagtgtgcttgacaccataagatcctttcttctttgataaaaaaaaaaaaaaaaaagactaagacaagaaaactggtggctgttggggaaaggtgtggaaagaatgaaagaagaaaaccgatgcatggaaagatggtaaagtaccaatggaccggtgtgagtcaggttctgaatttaggagtgaggactcaaatatgcctgtttactgggttagcttttggaacgatcctatggaacatatatcctatgaacattatagaagtcactaaagctgactgcaaattgagtgtaagttgagagtatctttctggaaaaacaaattggaaatatttatcaaagggataaagaacttacatatatttagaaccaaaaatttcaattgcaggactctatcctaagaaaaacaattagcaatgaacacgtttcaacccaaagatgttcactgggacattatttaaaatagcaaaaatattagaacaagttacatgtttattaatagagaaatgaatactatggaaataaatttatgctgtaaaagtgaccaaataaagcttggctcaggggctcatgcctgta

SEQ ID NO: 219 - DNA, 2470 bp, Homo Sapiens
atgggggttcaccgggttagtccggatggtcccaagctcctgacctcgtgatacagctgcctcagcctcccaaagtgctgggattacaggcgtgagcccccgcgcctggtcccgagaacatctttatactgtttggataaccctcctaccagcatcttccagtggttaatgataaggatcaagaagggcctcctaagctagtagctattaataattgtaaacatgtattatatacttaatgctcacactgtgttgagtactttacatgattatctcatttagtcctcacaacaaatctttgaggtaagtattactattaattgcatttggcagaaaagcaaactgaagtttagtgaaggcaaataacttgctcaagatgacactgctggtaagtagcagagctagaaggaacctggaaacctgacttcccagctcaagtgctaatgatggcattactttgagtattgttactgggacatcctcctgatctactctaaaaatctagatcaccaacatatatattcctggatgcagtattgctaagaactggttttaacctctagatctgtgtttgaggactcacagattcattactggtccacatataccagcagggcttctgcatgatacccagtaggactttcttaaaattgtggaaagcattcagtgtatcttgagatgtactagtcttatggataattcatctcttcagttctatccagaccacctcataaaggagaatatattaagcattgccaggctgcatcatcaagctatgaaaaatagcttgcctctcaagccttccctacttccccatatcattggaagctttacttctatccctgtggtatcagggaatatcttactcctagaggagccagacaacagtgacttccacaatagcctcatgtgggagtgagagttaataacttgaaagatggccgggtacggtggctcacacctgtaatcccagcactttgggaggctgaggcgggcagatcacgaggtcaagaccatcctggcccacatggtgaaaccctgtctctactaaaaatacaaaaattagctgggcatggtggcgcgcatctgtagtcccagctactcgggaggctgaggcaaggacaattgcttgaatccggaaggcagaggttgcagttagctgagatcacaccactgcactccagcctggcgacagagcaagattccatctcaacaaaacaaaacaaaacaaaacaaaacaaaacaaaaacttgaaagactgcccaagaaaggtgaaggttagatctcaggggatgatcttgaagcaactgagacagacctagaaacttgcctcatatgatacaagaagacccagcttctttgtctctaccctgtaggcactgggtagacaggtaggtgatattttacttcacaaacaagggaactaaaagtatgaacatttctctgttcctcattatctctgccctaaaatattttggctatctagccccagttagagcggactggcactgtctggtacaggaggtatgcagcagatgttctgcatctgagctccattatgactgtcccccaacaaatcatcccccagccagcccaagggaacgtggaattcagaggggaactgttctaaccaggagcagccaattagatccaggccagagaaacccatatccaggcactttatctttgtcctaaaatgaacctagctaacctcttcaggctatccaaaaccctgaccactccacatagagagacatttgctagccttacatgtcactttccactgtacacataccaatgacacctgaaccagatataaagacagacccacaaaggttctgctgagcctaaggatctgctcacctatttctgatcccgaatgcccctgggacatcttccagaatgtgtgcctccaaataaagtctagaaaattggaggaaaatttaaatgcagatgaatcgagaaggaataaaagccattagaaattctgggaaaacaagaaatatagaagaaagtcacggggctgggtgtggtagctcacgcctgtaatcccagcactttaggaggccaagtcgggcggatcacctgaggtcaggagttcgaggccagcctggccaacatggagaaaccctgcctctactaaaaatacaaagattagccaggcgtggtggcacatgcctgtaatcccagctactcaggaggctgagcaggagaatcgcttgaactggagaggtggaggttgcggtaagctgagatcgcaccactgcactccagcatgggtaacaagagcaaaactccatctcaaaaaaaaacaaacaaaaaaaaacaaaagtcacaacccaaatatgaagcaaacaaactttcagatgatgatggtacagtgtgtttataacactaacaactcacttttctccccacacatagcaatcgtaaaaataaaaacagccaggcacagtggctcatgcctata

SEQ ID NO: 220 - DNA, 3396 bp, Homo Sapiens
gcttggcgggccccgcacgcgaagcagccggccggccctgccggccccgggcaatgaggggcttagcacccgggccagcggctgcggagggtgtactgggtcccccagcagtgccggcccaccggcgctgcgctctatttctcgccgggccttagctgccttcccgcggggcagggctcgggacctgcagaccgccatgcctgagcctcccaccccctccgtgggctcctgtgcggcccgagcctccccgatgagcgccgccccctgctccacggagcccagtcccatcgaccacccaagggctgcggagtgcgggcgcacggcgcgggactggcaggcagctccacctgcagccccggtgaggtatctactgggtgaagccagctgggctcctgaatttgatggggacatggagaagcttggtgtctaactcaggcattgtaaatgcaccaatcagcgccctgtcaaaacagaccactcggctctaccaatcagcaggatgtggtggggccagataagagaataacagcaggctgcccgagcagcagtgacaacccgctccggtccccttccgcagtgtggaagctttgttcttttgctctttgcagtaaatcttgccactgctcactctttgggtccacactgcctttatgagctgtaacaccgcgaaggtctgcagcttcactcctgaagccagcgagaccacgagcccaccgggaggaaggaacaactccagacgcgccaccttaagagctataacactcaccgcgaaggtctgcagcttcactcctgagccagcgagaccacgaacccaccagaaggaagaaactccgaacacatctgaacatcagaaggaacaaactccggacacgccgcctttaagaactgtaacactcaccgcgagggtcagcggcttctattctttaagtcagtaagaccaagaacccaccaagtccggacacaatattttctattatctatgtttgattcttgtcataaacatctgaactgttaaggtaattcactaatggatcacaatctgcacttcgaaaattactggacacttcttattcacacgtaatacattctgccttaacacagtgcactctaagagaattaatgaaatgcagaaaagactataggtttgtaaaattcactcagcaaagtcattcattgtgttgcttaggtacataatatttcaaaaactaagcttcactgagcatctgtattgaccactttgaagtgatagttttatagctggatcttcctacatcatgtactatctgaacacatcacactagttttgatcgtttggtctcattaactccaattatccaaattggtatgtagggaaatatacaatacggtgttgacagttcataagtatttgactattaatgtgttgtctataaaatactcaacctactcaggaaacacaattcttcaaagaaataataaaagaatgatccagcatgatctagattgtgttacattcaaataaagaaaaataatgcaaaacaatgcaacctaacctaccattaaatttctaagtaatgaccaaaatccttagctttatacatgcattatttaaaattatgaaacccaggagacttatttacaattcatccttaaatagtggaataaaaatcaatataactgttttgtcaatgcatttgacttcctgagcatattttccaacagaagcatgcttatgcaaatccagaaatgaaatgttaaaaattcagaaatcaaaatatttctttaaataaacttgttgagaaattttttactcagtaaacatttttaacatccactgagttttcttaattccactatttttctgaattgtcatttcttcatataaaaatatttgaataagtaaaactttatgttaggagtatatgtaagtatgtgtggctaccatttcaactaaaacttagggtgggaacctatctgaggatcttttttaaagctggataccttatagaacttgtaaaataaaaatctttttttcttttacaatcttttacaatttttcttttacaatcttttaaaaagggatctatatcacttaaatcctcaaaaaaaggttatatcatgagggaatagaagaaatactttctgttgacataaacagtaattgataaggttttcttgaatacttttatagaaatgctgatgtattacacttaagattactagttagctctcatttcctttcaacttttgcctctggataagctcaactattcccaggaagaaacagtgatcaagtacatttgtcatgcgagcagctataataaggtaattcatcataatctgtcagagttttattctagaaagactgctacattttttttcttacttaaaaatctgctgtcactcctgttgaaaatttggtagacattttggacatgtttaaaagcccttccaaactgatagttgcagataattaagttattggctatcaaagattctttttctctttttctttttctttttttttaacaatatatatgacactatgaacccttctagctagtttaatctgacctgttcacagagcatgatccctcattccctttcctttttcctccttaagagtagccaacgaccaaagtaattcacaatgacaaatgaagcctttctcaagagtctaattgagcaattttgttttcctttgcaagacctgaaatctacagcattctgaactccattcactgaagtggcaagagatagtggtcagaaggaaactaggtggattaaggggtttctagaaaacaagtaaataaactctacctaggtgtgacatcttacatctcagtaatatttcaattcatctactcaattacttactccgtgtatcctttactttaagccatttttaataaagtttcattgtgatgtgtactttattgaatcctaaagtctcagtcactactctctcattcttttgtaatacttcctgcattttttcagcgtttaaattcatgctttcttagaagaagaattatattagtcttttctctagccaattgtgtgatatccttttgtactaccttagagatagactgtgtttggcttaaggacaagaaaggagatataataaatgttttaattggcttttcaaaaaatttacattattctcatacaatgtacattttatacattaactgattatcaaacccaagagcatgttctcattggtagcaaccactggcaaagtattaaacgaagatatacatatatgtgcatattcaaatatatatgtgcgtatatatacatgtatgtaatgttttaatgactgctaaatacaaaagaatatgtaaatacatattgaagtataaattatgatataaatatattgttattctcttctagtaatttgaatttaag

SEQ ID NO: 221 - DNA, 1549 bp, Homo Sapiens
ccccagttcccaccaccactcccagcctctggtaaccatccttctactctccagctccctgagtccagttgttttattttttagatcccacaaataagtgagaacatgaatgtttgtcattctgttcctggccggcaaattcttgatatctaatagcaaagcttcctaccttccctccttcaattttgtatgaatcaaaattaatatctttattatatcttcaaatctgtgtgcttggtatattctccatttaagttttctttaatggctttcataaagttttatgatttttcttgtacatcttttgttagatttattcctagacacttgtattctaaatgttatctttaaatttatttattttaccactgttatcagtgtatttaaggagattctaacactatgtctttcatccaacatatttcattgctaaagttatgaaatctgtcacattttaagtactacaaaatattagctgatattaatagtaattaaattgaagacaatttatctcaagaagtatagttgaaaattagagaaacacttgtaatgccctgcactttcaaagaagtcttttaagttgaccaaggttttgaaaaactgcagatgttacaaatgaaacctttagaatgttaacaaagtcaattatatttatatttactgcttccttaattctctctgtataattaaataaattgtagcgtcaaataaattttaaatgagggcattaaagtttccctgatttttttttcccccaaagaaaaagtaggaagcaatgtagcaatttgtttacagattctccttcatttgattattttggattatcaggtcttttcgtggttaaagtttcaaaggtgtcaggagaggttatttttttttctcttttgaaattctgaatttagtctgtttcctgttcctgacttagtacacttttaaatttggagggcccttagatggttgtccctctgccttccctctggtgcaaggccccagcatctcagtagatactgccaaaatgtttcccaagacaggacgtttactgctccttaatagggtagaattctaattttaattattggtccaggaggaattttaaaagttatgggactggctttagagttttaaatttgctgaaaacagcagtcttagagttgtgttcaaaatgctttgaagtttgttaggcaatattttaaatattgaatttctgatttccaaacttcatgaatgtgtggaagaaaattggaagtttaaattgcattcaggtgaagatttagataattagaacgctagaagaagactatgagtgatttcatagtactcataaaaaagtgagttcaacttgcccacttcaaactgtagactaagatctgtttcctttgaaaactaaattttattttaggaaaaaatgccatagacagtgtcagattgaaggactaccacccctgggctcagtggctcacacctgtaattcctgcactttgggaggctgaggcaggtgaatcacttgaagtcaggagtttgagaccagcctggctaacatggtgaaatc

SEQ ID NO: 222 - DNA, 837 bp, Homo Sapiens
aaaaattgtgcgagaaggcaaaggaaattttaacaaaaggatcagatgtgcaagaggttcgttgccctgatactgtctgtggagatgtgcatggtcaattacatgatcttatggaactctttagaattggtggaaaatcaccagatacaaactacttattaatgggtgactatgtagacagaggatattattcagtggagactgtgactcttcttgtagcattcattatccagaatgcattacaatattgagaggaaatcacaaaagccaacaaattacccaagtatatggcttttatgatgaatgtccgcgaaagtatgggaatgccaatgtttgaaaatactttacagatctctttgattatcttccacttataactttagtagatggacagatattctgcctccatggtggcctgtctccatccacatacacactggatcatataagagccctgggtcatttacaagaagttccacatgagggcccaatgtatgatctattacggtcagatccagatgatcgtggtggatggggtatttcaccctgtgtgctggctacacatttggacaagacatttctgaaacctttaaccatgccaatggtctcacactggtttctcgtgcccaccagcttgtaatggagggataccattggtgtcatgatcagaatgtggttactattttcagtgcacccaattactgttattgttgtggtaaccaggctgcgatcatggaactagatgacgctttaagatattccttccttcagtttgacccagcactttgttgtggcgagcctcatgttacacagcacaccccagactacttcctataa

SEQ ID NO: 223 - DNA, 13939 bp, Homo Sapiens
gccttcagactcaaactaaacgtcagcttttcccggctctcaagcctgctggtccctgaactaaaactcacattatcaactctactggttcttaggcctttggagtcagactggaactacagcattgactcttccggaactccagcttactgactacagatcttggaacttttcagcttccacaaccataatgaaagccaagcatattccatcatttcctaaaaccaagatagagcacatatgggaacttgtgaaataaggatgccctgcggttgttttcaggactgaagacaacagctccacgatgtatctttgcataagaatacacttgtataataagtttttttttttagagaaattgcatgtatctgccttataaactttttcattcattcattttctttcttcctaatctgttccataaagcaaatttctaacttattgttaatcaaaataattattgaaataattagtactttcatatgataaagattattttaatctgcagctacaaaatatgtaactcattaatatttaaacaatcacaattttctattaacattatagcattttatctactactagatcaggaattagctattttttgtaaaatttctttgtaaggcaaagcaatagtattgtatatactttcctaaagattgtcaagttcagttttgcttaaatttaacagtacatgtgacactttctgtttgaagaataagttggttttaagtttataccaaacaaaagcatctcttttgttttgcaaaatctgaaactttgatctttctagttgtgacttcttgtaaatatgttttatataaatattctatgaattggttattaacaaggtaaagaaagattgatatgtaagctgattcttaaacattaattttctggagataaacttttttaaaattatgctttaaaaatattttaacacatgttatcaaaaaggaactgaaatatcttaggcataaaagacatctctagaggtcattattcagtttccagaaagtactgaaactatctctgacagattgatacgttttctgcatttatagctctctggagagaggttctgtatatttaacaattctcactgtgagggatattttaagtatttcaaatttaaagtgctcatgtttcagattcagattattattatcatcatcattattttggttctggcttcagtaaaaatgtgaaaaacacttttccatcttctgataatatttcatatttataaaattattattaagttataactcagctttttcatttatgctttaaatccttttattatctcatcacaaccatctttgactgtttatcagaaatggttctcttttgtacattgaccattattttatagatcacatttaagttaatataaatcatgcctataaatttcagcctgcttattttttataatctagtcagatatcagctagacatattgttaccaagtttggagagccttgggataagctagtttcaaaactggctgttagcatccctcagttgtgttttgggagcaaaggacacccttaaaaaagggaggcagttatattttgtgagcattataaaataaacttaaattctcataaaattagtgaatatgtttggaacagtgtgaattacgtgtgtgctacatgaagtatatagaattcatttgaagtaggaagtctggccttacctcaaaagacagtcattcaattaagcagttaaacataagccaccataagaagtttttttgatacttagagagagaaaggcaacgtgtattaaaattccgggaccattatctcaggagtgctgtgttattattgactgggggcctgctgggaagctagaaatatatctaaaatgtggcaggtggttaattagagcatatgaataaatatatataaatttgttaaagcgttcacttatggtaaactatacctcaattaaaaagaaaaaatatgcacaaagaaaataaataatgaatggaaatatgagcctctaaaatcaaagttagaaaagcagatattcaaatttgcagagctgattgtcaactggaatgattgtgatagaatcaagtctcactagctcattggaaataggatttgttaaggtaatgatggttaatgatttttcagcataataacagccaagttaatgtatgggtgcgtgtgtgtatccataggtgtatgtttttacatgcgtatttttattgtaaaattaacatgtttattgaaaacaagaaagcacagaaaatatcaacttaagtaaagatcaacataatttagttcaaaattatattcaacagtgcattatttcaatgttttttatcttaatccatttgcttgaaagcattgatatatgctccaaatttcctcccagattccacttggggaaatatttagtatattggattatgaaatgatttatctttacctatattattagtaaagttcttaaaatttttagcctgttactgtctatgtgattagtgatattgttcacatgactaaaattcaaagataaaatatgattatattttatgggtgaaagttaggaagcaaaatagcatattaatacatttaactaaagtagtattcatttggataatcaaggtcaaacacttcaaaaataataattttaaagttaatgctttcaaaaaataaattagcaaaaattatttactttgtttcttaaaaagaagaattattgaaaaaaattctaccatcaaaaaatagttgttctatgcctagtttattttagtcactgaataagactgagcccttgacctcatattttttcctgcctcaccattagcagttaggtttagctatgcaaacctttatttattcaacatatataaaatacttagtatgcagtagatgttattctaagtgcttggtagatatcaacacatttaataatcaaaacaactctaagaggtaattagtactattatctccattttattactgaggaaaccaaagcacaaagagagaaagaaaagaaagagaaaaaaggaagaaagaaaagaaagatgaaagaaagaaagagaaagaagagagagggagagagagaaagaaagagaaggaaagaaagaaggaagaagaaagaaagaaagaaagaaagaaagaaagaaagaaagaaagaaagaaagaaagaaagaaagaaagaaagaaaaaaggaaggaaggaaaagaaacacatggaaagtgcttctttggaccttttaagttgcattatcccataaaatgtggtggattcaatgttgtatggcctgtaaaactaagtaatgaaggctgatatgtacccacctggctctgtcttgggatcacacaacttgggagccaaaacagtgagacttataagaatctcaaggatggtgtcccaaggcaaactcatggcaagatcaagaaagagaatggcctgtcttgacaagatttgtggttttggctttcgtctgatggaatgaattgtacacaaatacacagaaatcccacaaatattaaaataattgtatcaacttgtaagaaaaagggaaagaaatagcttaaaatggaatattgctaagccctcaaacctttacaagcaggaaataggtgtaaacaggcttaggaaaatggaaggtggactcagggcagattgaggagatcttggagtgcagcaaagagccatagagagcaatttccagggagtaggactgaactctaaccaaataattggcagcatgtgcctggcatttcaggattgacatggaccggtgactactgtgttccttcccattccccacccttttgtgtaggattgtctgtagcagtttcccaatgcctgttcctccacttgacgttgggtatttggagaacaagaaaaattctctttttaggtcagatgtgtgacatgtatcacattgtaaaaaagagtgctcaatgagctgtatttcaggaattgcacttaaggggaattatttttacctatattggattaatatgataagattttgaactttgagcttatgtaattatgaagtgagacctttagtcttggggaatgactgtattttatatgcgagaggtatataaatcactgtggcctgaagatagactgtggcagattgtatttttcaaagatttcctgtcacactttttttttattctttatttttctctttctttctctttcctctttctctttcccttcctcccttccttccttctttccttccttccttccttccttccttccttccttccttccttccttccttcttttctttctttctttctgagagggtctcactctgtttcctggctagagtggtgtcacattcatagctcactgtagctcaaactcctgagtgcaaacaatcctcctacatcagcctcccaagtagcttggaccacaggtgtgcatccactcctggctaattttttaattttaatttttgtagagacggggtctcactttgttgctcagactgatcttgaattcctggcttcaagagatcctgctgcctcaacctctaaacttgctgggattgcaggtgtgaaccaccatgcccagctactttctttttcttacaatatgcctttgatgctcttcccatcaagaggtattcctttcccttgaatatgggcaaggctgtgattattaatgctatatgacttttgagagtaggtcatgaagcatgatacattttcctagttcatttaggatgcttgctcttaatacctagcccctatgcttgtataagtccaagagacctgttgtggggaggctcacatgaagaagaacgcaggcacctagcctacagtctgattgagctctcatctgataacccataagaacttgagagccttgtgagtaaaccatcttgaatctttcaggacccagttgaaacacttcagctgatgctgcatggatcattgcggatttgtgagcaaaataaattaatatagctttttgttttaattaaacaatattttttgagacaagatctcattttgtcacccaggtgggagtacagtggcacattcacagatcactgtagcctcaaattcctaagcacaggaggtcctcccacctcagcctccccagtagctgagaccacagcatgtgccactgtgtctggctaattttttatttttttgtagaaacggagtcttgctatgttgcccaggctggcctcatgtgatccacttgcctcagtcttccaaattgttgggattacaagtgtgaggcactgcactgagcccaatattcctttttaagctactaagttttggactgatttgcttcccagcagtatacgattgataaaacacagaatatagaataaaattaatctcttatgttgtcctatgaggctttgtgagatttagtttctaccaacaccccaaagtcatgtcataccatttttcactgtgcttactttgcttcactgacttttctcctgttttctaaaactagctagttcttatcttcaggctttgtcattgtcattccctgctgagaatattgtctgtccaaatcttgtaattcagactcaaaaatagtctgtggccactcaatctaaagtaacccaccacaaactctagcccatctccctatttattttcatcatgatatttatatctatctcatctaaattttatctatttgtcatctatctaattgaaatttcatgtttctttactactaatacgcaagctctgttaagacagaagtatttagtttaattagatcccatttgtcaattttggtttttgttgccattgctcttggtgttttagacatgaagtctttgcccatgcctatgttctgaatggtattgcctaggtttttgtctaggatttttatggttttaggtctaacatttaagtctttaatccatcttgaattaatttttgtataaggcgtaaggaagggatccagtttcagctttctacatatggctagtcagttttcccagcactatttcttaaacagggaatcctttccccgtttcttgtttttgtcaggtttgtcaaagatcagatagttgtagatatgtggcattatttctgagggctctgttctattccattggcctatatctctgttatagggacacttttacactgttggtgggactgtaaactagttcaaccactgtagaagtcagtgtggcgattcctcagggatctagaactagaaataccatttgacccagccatctcattactgggtacatacccaaaggattataaaccatgttgctataaagacacatgcacacgtatgtttattgtggcactattcataatagcaaagacttggaaccaacccaaatgtccaacaatgatagactggattaagaaaatgtggcacatatacaccatggaatactatgcagccataaaaaatgatgagttcatgtcctttgtagagacatggatgaagctggaaaccatcattctcagcaaactattgcaaggacaaaaaactgaacaccacatgttctcacttgtaggtaggaattgaacaatgagaacacatggacacaggaaggagaacatcacacaccggggcctgttgtgaggtggggggagcggggagggatagcatttggagatatacctaatgtaaatgacgagttaatgggtgcagcaccccaacatggcacatgtatacatatgtaacaaacctgcacgttgtgcacatgtaccctagaacttaaagtataataaaaaaaaaagaaaaaaaagaaagacagaagtattgttcatcttgttttcttccctaatcacgttacctagaacagtgcctatcagatagtaggcactccacaaatatttgttgacttaatgaaccagtggaaataaatattaattcagttttacattacacagcaaaatagaaatccaatatttaatccagttcatattacaaaataataccttctttttaaaaattaaatccattaaattgacatagaaaaatcttcaccatctcatgactttataaaaacaaaattggtttctataccacttggattatttctacaaattctatttatatggtttgtgtcaataaaccatagaaaataaaattttcaaataaaacttatatatttgttatttgatcttgttctacttatatgaatcttttatttcatgcaaataaaacccaaaatatgattcagcaactttcagtctgtttttagaggcagagtcttgatatttcacccaggctggagtgcagtgtcacaatcatggctcacttcaggctcaacctcctaggcccaaaagatttattcacctcaacctcctgagtagctgggattacaggtgtgcaccaccatgcctggataagttttatagtttttgtagacacaaggtctcgctatactgcccaggctggtctggaactcctggactcaactaatccttccacctcagcctcccaaagtattggaattacaggtgtaatccaccatgcttggccaattttcattctttaatgttaggctttgagtttagtatcaaactttaaaacaaaagcaacaacaacaaaaaacaaaaaacatttccaaaaaagaaaaaaagtactggtagcagtcaataaaagaaaagactccaatttccaggaatttggaatgtggaatcctggcattatagagatacagctttttcatctaattaatgtataaaatagtcaatactttcattttattttcttggagtttactccttttcaccctgaagcctgggtaacaaagcaagtgcacaaaaatcgttagaataacacttttcaacaagaagcagtcccaaagtaagtgaaaggaatttctttagtgattttctccctgagggggagcagtagtctgaaatctcactggtatctattctgaaagaatcaggggatttatttatgtcataatctagtatttgcagcctgctttgattttcctcgggatttccttggatatattttactgagagaagtgtgaaaagtacttctgatttgagaagcatgaaaagaaagcctcaggccaggagaccatcttctactctgagtcatccatttgcctgttctgaacaacctctactattggctcttgcacaaagatctcctgagagtagttgttggtagactctaattgcctactatttttaactcattcccttactcctttgataagagttgagagcccaagactttaatggattttgcacgtatgtcttattctatttacctaatcataatgcaatttcacttcagcacaaacacagccatagcaatcatgacttaattttaattcctaactcactgtaagtaagccagcttatgcttttactaaccaatttccaatgcatataaataataacacatatttggcatatcacagtgcttagctctttctgatgagcaaaagattatatatttattggtgcttatcttgatgtttcacaagatttttcatttatttctatactgttcccttaggttactaggtgcagtcactttccctaccacctgctttccactatctgctccttatctttttctttagaaccttgcttcaccttcttcctctatttgtgaccgctctgcaggtgatcaggcttcctccactttccttaccttctgattgtctcataccatcttccatcattttccacacatattacttgctttataccatactgtatttgtaaaacacataaaagattgctagtatttttattttatagatgatgaaactgaagtatgaaagataaatgactcaccagaggctatgatttgtgggccttttagtgggtttaataggaggaaagcaaaggtgaaatgccagaatagcgaaggtggagaaatttgagatgagtgatagagacctaagaaagtggcagttaaaatggtccagggcataaaatgatgtgaggaatagtagaaagaaaaggagaaaaataccttaaaattgatgactcttctgtcctaataacttcaaagtgcatttcaatttgaaacctttatcacctcattgcgtggaggagacaaaggaaagaaaacatacagagcatttgtctcttcctgaagtttcctcaattcataaaatccctaagacactaagagaagaaaatactgtgaacatgtttagtttgatattggttattgtcatttcttttcattccttcaaatacattttataaattcaatttcacatattatttaacctcatctacctgacatgatattgttctcctgacacatcctgtttattaaatattaatcacatattttactggttccaaattatgcttttattatacttgcttatttgcaggcgggggctggggaaagggggagtgactttcaatagaatcgggatctctagtatgatcacccgcatgatgacatcatcaacagtagacttaagaatcctgttggctccacttgctctaaatttatcagtttcctctggttctctctatcagccttaaggttgggttcctgttcaatactttctttcttttttttttttttcttacttgtagggccaatgtgtagagctgccgactttcttaataatgcaaatccaaggggtgcccctagcattctgaaatacgcaaacttcaaaaacatatctaataaccctgcatcagctccatataacagttttaattagggcccttagcagggcatacactaattactgcaaagagcaaacaaaactaaaatgagtaataaacagaaaatttatttgatgagtatctacaatggggcaggttcaaggtgtgttataaatgttgtgaactcaaaagtggatagtaaagagccagccccactctcatggagcttacattttagtatgggtaggggccaataataatcaaatcaaaccaaatcaaacaagatgttgaaaagtaataaatgctatgaagaaaaataaaatagtataatatcatagaatagagagacatggacgctgttttagggaaaaaatgttacgggtatataagcagaaaagcagatactctgataagaggatatatgaactgaaatctgaatgaagcgaattaagtgagcctgccatgtaagaagtaggattttgggacaggggaatagcaagtgcaaatatcctgagacaacagtgtgctgagagtgcttaagaaatagcaagggggctctgtggcaggggtgaagtgggcaacaagtagaatgataagaaatgatgacacagaggaagccagagataagaccgagttctgacattcttataagccataataagaattttattcaatgtatgataggaaatcattgaaagattttaagcaagagtaacactatctgatttgccatttagaagtcattaagaggtcaagaaattctataattgctggtatgttcagaatagactgagtgatacaatagaggaagcaatgaggcaagttaggaggctacagaagttgtccaggttagaaatgatggtgtgacttcaatggtagtggaggtagggagaagggtgcaataagaacatatgcttaaggtagctcttgttacctttactctgactgctattcactgagggattagttatgaggtaggagagaaagagggatgaaatgtgattgtaaggttctaaccctgagcaactagatgaatggtgataccattttctatgatgggtaacattgaaagacgaaagtttgaaagcagatgataataggaatcaatatattatgcctggagatgttgagttgagtttgaggtgcttacaagacaatttaattagagataattgtggtttgtaacagggaaagaggtacttttgcaatgtgcatgtggtcacttatctgctgactcaacttgctggtgtgaggaagcagctaactctcagaaatttaggtagtgtgaaagagaaggcaagtatctagtagtagagactattttcactgtttgaattattatggatagactgacagtgggaatattattaaaatatgtgacaaggaattccagtcataattaaagtaaatattttgccagaaatgataacaaatacctttgcacagagttcccattggtcccgaaacctgaaggtgctggcagtgcctttaagaggctatagaatatgatctgctgtagttttgctgagcttgttaaaaataacccttggccagacacatgccatccttcagaattaagtagatccctcagcacctgcttcctgtaccctgtcttctgttaccatgtgctttctcagatactaatgggttcttggcttttgcttctaggtataattgtgatctcttcccaggaaaaaggtaatgatcctggaacaagatatatatgcctggtatatatttattatcttacaattgagctttcattaccaataagagttctcttaccttgagtcctcaccctgtgctaagctcttgcaaaacacatcccagattttatctcatttaatcctggcaacagtggtacaaggcaaaacctggtattattctcattttttatttagagaaatataattgtaaagaaattaagtaaattgtgcaaggcctcacagtaagttgtaggacaataaagacgcaacaggtgccatctacctctaatggctgaccacttactatattaaattgttcttgtgagcatgggagaatcttggggaaactattatacagactgctggaggtatgtgactggttactttgaaattgaactctaatgtggtcccaagaatttttgaaatcttgaaagagagtagaacttccagtaacccttcagatgtttcagagaaaatatcaggtttctgttttaaaatagaggtaataaacacatttttaagacaggctcttttattctagaaaaatctcttgagatatataactaaacaaataaaagacagactccgatatcagaaaagcaattacagacccttcattataagaagtaaaaattgctctatacaatagtagaaaatatggtcactgtggtacatctctgcagcctgacatctgatttttgttgctgttaatagaatgagacttggctgttctaaaaaactacagcttgtcctgtggagaactgtgattacttctgatggaaaatgacaggctgaatgccagaaggcaaagcaactgttttcctaagagtcttaagaccctgaaggacttgtgcctcctttggtgatctaggggataaagaagtggaatggaaatggagaggaatagctggaacaaaaaggcaaagaggtataatctatcataaatatgccgcctttataagcatgtgtgtaccaaaaaaaagccacaaaccatataaagtgagcctatattagaaatagaagtattttatgaaataatatatttaaaatttccagtaaacagaatataaatttttcccaaatacccataatatatttacaatattagaaaaaaatgcaagcagaatttatgtaaattatattaatggaattaacggaataaaattagaagttaaaattaaaaatagccaaaattaatatttgaaaataaaaatattttgttatttgtgttaaaggggaaatcaaaactaaaattagatattatttaaaaatgaatcttactatatatcaaatcacataatatcaaaatcatactctaaagaaattttgtagccacagatgtatatttttagtctgataaatgaaatctgcattcacctcaagaagctagcgaaacaacaaaacattaagaactaaaatcaacataatttctggtcactttgttaaataaaattgaaaccagaatatttccttgtacctctattaagttaataccaagaacaagcaaaaataaagcaattacttgttctagaaaatattttctctttggaaataagacgaataaccagctaaaataggtttttaatcaaaactaacaaaagtgttgatcaatactcatttcaagatcctggcttcatggtgcccatcaatccaaaactacttcctagaccctgttgaatctcaaccaacttcccccctgtcaagactagctttaaaatcactcatgaaggtatgagattctaataaacatctccctttccctctgacttctccttcttgagacactacacttgtactctattaaggtgatagtttttcttcctgcaataggtcacataaacttagctgtcttcatcaatatttctgaaggtattttgtgaagttaacagcaatggaagagaaataaatcataaatatttgaaaaccagttattttaataaaaaaagaagtgtctttttttttaacagaattgcaaataacatatggagatactgtgctcccaggaggtggagatgaattattatcctttcttcacaccttcccattgagattgggctagatttgctgatatttttcaaaaaaatagtgcagtgaaaaaaaaaaaggtgcattgttttagtacaagaaacttggcacattctacctcaaccaaatgatgaaagttaacatcacagattccatgtggacattactacctccctggtatgatgtgatgagaaaggcatttccctctgtggtattatttcaaatgactgataattctggtctaatcaggagaaaaacaacacagatccattggagactttcaacaggacacctgcccagtatgcctcaagactttcaaggtcatgaaaaccagaaaggagagataaacaatcacagattaagacattgtggaaattgaacaatcagaagcaatgatgtagcctagattaaatcctaaatctgtaagaggacattgatggaaaaactggtgacatccaaagaagtcttgaatttagttacagtaatatcctaaaagaaaaaaaattgaaattgaaagcaaaataaagtacttcacaaataaatgagaaatacatcagataattcagattataaacaaagagaaaaaatcaattag

SEQ ID NO: 224 - DNA, 1490 bp, Homo Sapiens
gtaaaaggcagggaactaggatgacctacagtggaatcagtgactccagccaggtgaatcagtctagctaataacagctcatgttcgttaaacaagtcctatgtgccaagcattttgccattacttaggtacaatattacatttattcctcaaaataaacccttagagttaggcaatgttataattattttactgttgaagtcttctgaggtttaagaaagttaaagtcctttggacgtgattaccaggtaagaagtagaatttgggtttaagaagtctgattccagatcctaagctctggccccacaccagggactagaaggaaaaagatgagacatcagtctggagccaggcatctaaagatctcatatacccatctaaagggcattgattctttttatttttagttgatatgcaataattgtacatatttatgggacacagagtgatattttgatacatgtgtacaatgtataatgatccaatcagggtaattagcatatccatcacctcaaacatttatcatttttttgtgttgcagacaatcaaaatcctctcttttaggctgagcacagtggctcatgcctataatcccagcactttgggaggccgaggtgggagatcacgaggtcaggagctcacaaggtcaggagatcaagaccatcctggccaacatggtgaaacctgtctctattgaaatacaaaaaattagccaggcatggtggtgcaagcctgcagtctcagctactcaggaggctgagacacgggaatctcttgaacccaggaggtggagattgcagtgagccaagatcatgccactgcactccagcctgggcaacagagcaagactctgtctcaaaaaataaaaaaaaaaagaatcgctacagagctgcagaggcacaagaggctgaggcacaagaattgcttaaactcaggaggcagaggttgcagtaagctgagatcactccacttcactccagcctgggtgacagggtaagactctatctcaaaaaaaaaaaaacctctcttccagctttttgaacatgtacatttaattattgttaaccatattcaccctaaaatgccgtagaacactagaacttatccctcccatcttactgtaacttgtatctattaaccaatctttcctttttcctccctagaggactagaatatttatgtaaaaaatcatccaatcaccttttattattattataaatatttcaaacatatagaatataatagcaagtaacagaattaactcacaggtatctaccacttggttctatcatttcatcatatttgctttatattgtttccttttttaacctatgtcatatttaaattagctttttgtagacagcttatatttgagtcttcttttttatccaatctgacaatctctgtttttttagtggtatgtttagctcatttacatttaatgtaattattggtatggttgaatttatgtctattattgtattatgtgg

SEQ ID NO: 225 - DNA, 8078 bp, Homo Sapiens
ctctctctctgtacatgaagggatcatgagagctcacagcaagatggcggctgcctacaagccaggaaaagaggccttggggtgaaacttaccttgcagtaccttgatcttgaacttcttaccctccaaaactggcttttggagtcccctactcatacaccttctcatacatgagactacactgcttgaaaaccacaatgggctccataaacacttttgcaatagtgaagaagaagaaaaaataatgccacacatgaatgctcctgagatgcctctgcctattctggtgtgattgaattctgtccccagcaaagggaggaatggggtgaatgttgctatgtttctctttgcctccatggaaagaagtatttggagtaaccagcatcatggagacaacagccttactccccaagaaaccagagttgggggagaagagggatctgccttctctgtgaaaggcccggaggcactgaaaaggagcagtttcggaagaatgctggccttggaattatctacccacctatctatccatctgatcatccatccatccatccatccttttatccaatctcctatctgtccatctgtccagctagccaaccctcattcaccaaatatttattgagcatttgctatgcacactcactagggataaagtggtaaacaaaatggacatcagatcaattcaggctggtgtcctagctcagccatttaactgtcaccttgggaaacttgcttgctgtctttgagctgctttctttatctgcacattagggattctaatctctacagtgaaaaaggttacaataaatattgtccatatatggacataacttagcacagtagcaagaccacagtaggtgcaccacaaacagtagttttggcagttctctatctcccccaaagacccctgcctaccacccttctgctgcataggacagcatttctgcatgatcttcatacaaggcagcaacaaggacctgtgggacgacgtttgtctgggagtggagatgaggcccaatgagagtcggtggcgtgtctgaggcttaccggtccttgaagagcaggagctccttccccagcattgtcacagcgtcaaaggatgagctggagtcacagaggcatccaggaaaaactgagcgagttcttgtgaaactgaagtacactgaaggtgtttgctatttaaaggtatcttctggtggatcgtcttggaaaacatggacccaaatcttgcgagagctatcagtgagtctcctctcctgctctgcatctctcaggactgtgtcccagctccagaagaatgagcctgcacagcttggactgtcacctctggcaggttcctgctctttgatgaagcctcgtcataattacaggtgtttgaaagttcctccattgatcttctctctcctgctgccttgtcaagaaggtgcctgcttcccctttgccttgcaccatgattctaagtttcctgaggcctccccagccatgtaaaactagccttatcttcaacagctgctaaaattgaagaacaaaaagaatctttgaaacttcccttcaactggtcatcctcttccctttttctctcctttaaacactgttccaattcattatgatggccccaaagcaaagacagacatggaagtgaacattggagtggaaggaatgacgagcccaaggatgaaaacagagaagtaattaatggcagctttcctgggccagaagaataaataaggaattatcttacaaacaggtgcttcccattcccctgaccagctacatagtcatgtcaggcatcatgattcgagaccagcctgacctacatggtgaaaccctgtctctactaaaaatacaaaagttagcagggcatggtggcaacgtgcctgtaatcccagctactcaggaggttgaggcaggagaattgcttgaacccgggaggtggaggttgcagtgagctgagatcgtgccactggactccagcctgggtgacagagtaagactcggtctcaaaaaaaaaaaaagaaaagaaaaatgttttttctgtccttagatgattcttgtaagcaaattctctttccaagtagtttgccaaattgatttaatgaaagtccatatgcttcaaacagattcctaaagcctcagatgccaggtgggtgttggccttttctgggaaagatgtttcacaactggctataacctctcattccagtgtcccaaacccttggcccagccaagggaggtgactgttttctttaggaactgagtgactgcttctgaggaagcttgagtaaatgtgaggttggcttctgtttgataaacacgtggcactcaatggggacttttggacagaggagactgcatgggtgacagctggtggccttcaccaaatcctgaagttaaatttagggaatcagacccaagaacactaaaaggattaggggctctccacctgtcttccttggtcttgctctctatgctctcaggtcttcactgttgtagccacagtggtgttagaaggacgaaaatgctagggtagggatggggcaggggtagtgtgaactatagtggttttcaaaatgggcaacatcaatataacctgggagcttgttagaaatgcacattctcaggtctgctgaagaccgactgaatcaggaaatctaggggtggggcccaagacctccaggtaattttgatgcatgctaacatatgtgaaccagcattttagaaagtttatgctacttaaagaaagtctgtgaagcaacaccccctgggaacttgttagaaatgcagaatctcaggccccacccttctgagattcaggtttcattggtctagggtggaggagcccagttattggtcatttaaaaaacctcccgtgtgattctaactttgcatccagaatagagaattactgctctaaggaagaaattgttaaatgcattttatgttttccaggagaaaagatggtcccttccacagagacagtaaaagatatgaatgatttttctttgtagattcactggagttccactagaatagtgcagttatcacatcttcctccaaagaggggtaggtttcagagtttcagcagtagaagaaatctgggaggaatcaagccagtgtgcaacatcaacatcagttatattaggctgttcttgcattgctataaagatatatgagacagggtactttttataaagaaaagaggtttaattggctcacggttctgcaggctttacaagaagcatagtgctggcatctgctcagtttccacggaggcctcaggaagcttacaagcatggcagaaggcaaagggggagcagggacgtcacatggccagagaaggagcaagagagagagtaggaggagggtggcggggtgaggtgccacacacttttaaacaaccagatcttgcactaactcagtatcacgaagacagcaccaaagtataaggatccgcccccatgatccaaacacctcccaccaggccccacctcaagcaccgtggattacaattcaacatgagatttggacgtggctttattgagcaaataaaccacagcaaccatgaaattagaagtttggtaaaacatgttgcagaagaaccaggaaacacattgcaattgagcctgctgggtgctgctgcaagtttgggggtgaacaggagaatcaggttcttataggggtgaagtctgcaaagtaggatgttttcctaatttgaatgcaatgactgaagtggaaaatggtcaaaactgggcagagtggctcacacctacaatcccctaggagggaaggacaaaggcatccatatcacctcgccacagtggttgtggtggaagctgtagcactgaagagatgcagccccatggaagatgctgccaagagagggagacagagctacgtctggtgtctcccttcctccttacctggtgcctccctcctcctgtcctcctgtctcccttcagatgaaggaactgatgctgagacttgcactctaccataggcggaagcacccaccaccctgttcccagccctggaagggcaaggaatgaatctgaggcaaatagggccagcactggcagtctgctcgattttccctcagagcatttatcttccttgacatatttacaattttttgtctatttttggtttctctaacttgactagaatgtaagatccacaaggcttgggctttgctcttttgttcactatgtccatagctcctgtaacagtgcctaaaacatagtaggcaatcaatagatattctttggataaacaaatatgcctcaacattgagtctaacttacagcagacattgaataaatatctattgaatgaatgagactaacaatttactacaaaagcagttcttatgtgaaatatgacagggttgacatcttaactgaaatccatcttgagagattttttttaacccaccgagatttctgagaacacatttatttgaagaaccttatattttatgatgcatttttatatgtgaattttttgaaaccctactatcttatttcctgaggggttttagactcagctattcttcatttcatttttatacatttgtgcagctgaacacttcctactttattctttttgtttctaagttcctaaaaatagttcagaaaatccaaaattatgaactcgattcatccaaaaaaatgaacaaatcaaataactttgaaaataaatgctttcactatttattactaacaaaattgaacagtataatccagaaaaattgagcaaaaataatttataaatctcaagattaaaaccaaatatggctttatgattgtattagtccattttcacactgctataaagatactacccaagactgggtaatttacaaacaaagaaggtttaattgactcacaattctgcagggctggggaggcctcaggaaacttacaatcatggtggaatggaaagcaggcaccgtctttacaaggtgtcaggagagagggagagcaggggaaaccaccacttataaaaccataagatctcgtgggaacacactcactctcatgagaatagcatggagaaagccgcccccatgatccaatcacctcccatcaggtccctccgttgacatgtgggcattatgattctgattacaattggagatgagatttgggtggggacacagccaaaccatattggtcaattaagcgataaatactataaaaattataaatagtggtcaaactgaaacatttctctgtttcagaaacttttcactttaagaaagtcttaaattcattgttgattaccttgttcacattttctcgatctctcctagagatcaaattaggactgatttgtatcaataaatctggattttgatttcctttatgactttggatagatttctggatggtgagtgaatacagacttaaactttaagaaagtgcctgcttccagcttctggctggaggctacacttcccagcctgtcagaacagccaccctgaaaactgcaatccattatgagaaataaagctctcttttttaaattaaaaagaaaaaggaattaaaatgtaggatttggtgaccaatttaagtatgttaaagatatgttttggctactgagcttcctctgagattctttatactcaaacacaaacaaagcactgaatttcaacctgaaaatatgtcatgtgtttcaaataacttgaagaacaaaaacaacaacaaaaatcctgttattttctgggaaaaatgattcatttcaggtaaaacccatgacatatttttaggtcaccaaatcccacgttttaattcctttttcattaggagagtccacccatgataaacaataggaaggttgtaatgagtttctgtctttgtcctcaggcaagaagaaattcaaatacattctttctgtgtgaattcatttcttttccacctcagctgttcaaatctccaaaatgaataactattgccagcactgtcttgttcatgcttgtttttaaagctgtttctttcttttgagacgtaatcgcaggcccttaagaaaaccagaagggacaagccaagtgtcaattatgtttgttgttccagctagtctgtttctgtaagtgtatgatataggacagaaagaattggcccatatttttttccaattttgagaaactctgagcttaatttttagttttcccaattgtttttactttagaataaattgcttagtatatctaattataataatgatggctcacatttactgcgcattaactacatcaagtacttattgtaagtgacgcatgtgaccagttgccaattgttcaggctacagcttggatctgttagcatcctcatttaacaaatggagaaattgtagcacagagaaggaactttccccaggttccatggtgaataaatagaggaagtgctcaatgagcctaactaatctgggttgaaagctcatactcttacccagcctccaagctagcagatggaaatcaaaatatcttattttaaagctcttttctaggagaaaagataccttgataagctgtttttccaaggaatgggaggccataatgacatgtttaaatgagacaataaacaggtttacataactagtttacatttaaaaagaaagataaagaaacaggaacttgggttcctcccagaggtcaaagaagggaggggtcagacagaagagcagaaggttggcatctgtggggaggtcactgtggggagacgattttggaggtgggtttgccaaaggatattaataagatttttccctctaattgtttgatggggagcattagaaactccataagattttggattttggaaatcaagtttatttaaatcttaaaggatgagtgatatcacctactttttgagttataaatctttaatataattctaatattcaacatatatgctttgaaaactgtgtttttagattttccactgaatttgaaataggattatttttatagttgaatcttgtcctctcctacaggtcaatttttaagaatatatatccaggaaaaagtaactgcccataagcaaaaatgagtgcaatttctggtgctctcctaactgtaatatcacacgtatttgtgctacagaacaagaatagggacaaggaaagaaaacaaacttgaccaacatttgagaatctactacatgttaagtagtaagtcatactactttttaaaatccactttatcgaagtagagtaaacatatacaattcactaattttatttgcacagcctatatatatatacactagtgtcaccactgcaacaatcatgatatagaacatttctatcaccccagaaagtttactcatgatcctttgtagtcaatccctcctcccacttcccacctttggcaatcagtgacctgctttctgttactatagttttgtctcctctaatttttcatataaatggaatcatatatcatgaagtcttttgtatctggtttcattcactttccatattgcttttgggattcatccatattgtttcatgtgtcagtcatttcttcctttttgttgttgagtatggacattccagtttgtctattcatcaactgatagatatttgggttgtttctagattttagctatcataaataaaactttcatgaacatttatgtgcaaatacttatttgggcaggttttcattcttcttgggtaaacatttagagtaggatcattgggtcacaggagaagtgtgggtttaattttataataaattgccaaactgagtgaggaaggaagaaaccagtcaggcaggcagttagggtggatgctccattgatttctttcaaacaaaagaacggcatgcaagcactgataagggaactttcacaggggggcttgcctaagatatgcccacagctgcatacataagaaagtctacacaggagacttacccagacttatctgcaatggaaaatgctatcccctgacacatgcacggtaagggaaacaaagacaatatggagtaactcaagctaagggcctgcatgcacactaggaggactgggtggagcgaccagaaatttgctccttatgcaaatgagacacccaac

SEQ ID NO: 226 - DNA, 1212 bp, Homo Sapiens
ttaatgaatccatcatggtccggagaatgaacctcatccttttggggtcagagattatctcatcattgactccgagttgattggatggatgcagacagtatacagaagagcctttagagcttcatacaattgtcctgggatacatgtacagaacgcaggattgttacataaggaaacgtatgccgtggtggtttgctgcacctatcaacccatcgccaaggacatctaataactgctctgattggatttaaacatttgcagtggggtacttctggctttgtgtatgtagaagtggtgtctaaaagagtcaactgcttcaccacaggacttttatacttctcatgaaatacagtccttcaaaaggcaaattctctatttcccccactttgattatctgcttatgctcctaaaataatgtaaatatggtcattaatcatctacaacattgtcaattaggagagtaaagccagtaatgaactctacatccctgacctcatatggtatgttgcattttaagggagctgtttttatcaatgacaatcgtattatttgtgctcataacctgggctctacatccagtgaaaggattttgatacagaatctttatttgaagagaactacacaaaaacaccatcaccatcatacctgatgtctgctattgttgaaataggcttcagcactgtagctggtggaaaccaggtcaccaaagacactgcccttgtacctggaaggcccgtccctgcccccattcacacagtgaattcatttagaagagaggaatgctgtagacagagtcattagaaaacccttcatgactgtggcgtggaaaagggctggcaaggatcacaaacagctttcctgggtttggtcttacagcatggacttcttcaccctcatctacacgtaaaatttattaacttcaaggagaggagatcagggttgcctctaccttgcattcctatgtagccatgaattaattcccaaatgccagtgtgagcctgttttccttttcatacatcgtatttgaggaaacagctggaaatattactctgtgtgccacacatcccgattcagcacagtctcttgttcccagagtggagtaaatgagtaaagaaattattcatccgccttttacctaacttggtgtgtgaccaataaattctctcaagattgattcaggttcctatattcatggaaacaaaaaaagaaaat

SEQ ID NO: 227 - DNA, 1079 bp, Homo Sapiens
acatgcatggcaagtgtcacacaaaaataaactcagaaaattttcattctccagtgatgtggcttgacacaaaggtgcattcagagctaagaaatgaaaatagtggtaaaagtcaattatgagaaagcaaagtgggttagtagaatgcagggcgtgtacgccaagtgcctaatcccagcttgcctgcttagtagccatggaacctatttagatatttttaggtccacctgcttcgtgtatcaaatgtggggatatacaagatcaaggatgtcaaataggttttcaatgcaagtgtcaactcgagaggtttattggaaaagataatgaggccttatgtcggccatgagaaatagtgatgtgattctttactgatattctccatcagtacaggatcagggaggagcccagctctgggacatgttggccattcgtgggctaggagattatctgtgttcctctcaattttattttcctatgattgattatcatcttgaaatgagtccaatctgagacttggacacttagggcattaggaatcagcagagaagtgttctttgctgtttagctgtaggacaggcaggatagtggttaaaacaatggactctgtagccagattgccaggatttggatgcttagatgttttgaaagcttatttcaggtctctgtgccactgttttcctatcagcaaaataggtgtgaattaaactagttgacacaggaaaagggcattgaaaagtgaggtgttagcatatggtaagtatttaataaactcattgttatagatattgatagtgagaatatagtgatcagaggatgctaaacagagacccaggatgtggactattgaagaaggactcccttaattgtcttcatgcattcagatgaagacatgtgatagagatggaccttcaggaatgcctgtgctgtaaataaggaaataaaaagagtctcccggaaacagggaagcaagagaccccaggatcttcacatcagccagaggtgcaggatgctctggaccccagaaagaataggagaaagatcccaggtatgacacatacccagagacaccatgctcatgt

SEQ ID NO: 228 - DNA, 3121 bp, Homo Sapiens
ataatgcaagcccttgcatggcaatccaaatttattgaactactgatgctaagttatacaaaattgcaccactttaattaaggcttttagtttacatttggccacctcaaagtagttgtaacattaggttggtcaatttaaatactgtggctccctgttggatagacacacaatctttacatccaaacattaatgcatacaaagcaacaaggcattgttaaataaaacagcaatagttactgcaaattaggccttgtgaccaattacatatgattaaaattacttcccacattcacatccacagtactcgtccaccatttaacatctcaaccaaaacgttacacatgtgaaacaatcactaacaggcaaaaatactaaacctgtatatttggtattgcaaatacacttatgcatgagcaagcaagggattcacagtgagaatctacagctgcagaagcctgaaaatgatttacaaaaattgttaaatcattaaaaaattgtttgaaaatatacacttcttgttgtagacccccactgtacacacgactataaacattgttccctatgtaaacaaaaaaaggaaacatataataagagatttgaaaagtctggacatttccttcccaacagatattaaaggcaacgtctttaatctaagacattatactgaaaggactatcatgttttaaagacaagatcaccgtctccacaggttttttaaaaattaaaaaaactatatagctgtgttaatcaaagcgcttattttgtacaataataatgaccttgaatttcttaaaaaaaattacaataagctacaagtatcaaagaagcgaagttatctggagtagtctatataggagctctttggactttcttttattatgctaaaatagtggtgcttttaggatttacattattgtactctccaatacaaagtatggggcatgttaaagtatacagtacaccattttcatacatgtacaacattggtggatgaagaatgtctcttagcagtaatactggatgtagcctctggttttaccagctgcaaactctaggactattatataagtaaaaatctctcttgtgatactggaaagtgattagaatgtgcaaactgatatagtagctttcatccgcctcttaaagggtaccaccacaggaaagtccatttaagatgttggtaggtttaacaaagttggaatgctggcactgttgaattgggcaacagttcttcagacctgtcaaaaggaaaaaaattaattaaaaacatgggctagaaaaagtaaagacccaaaagcaaacagttaagaaaacagtcttaaaagtgttagaaatgaatataatctaggctcttgttctaggcattacattagtggcaacataccacaattcacggcagaccttttcattccaaaaagatgaagtctattctgctgccctcttgaaagtcagttaaatgaaaatcttaggaacagaaagggaaagtacctttgtgcaaatttttgtgcattaccttccaaggattaaaaaggaaaaaaatcacattaaaattgttagtcaagtcaaccttattagaattaggattgaaaagtcagatagcaatattaacaaactgggtgatcctgtgtttacacaatcgtaatgtactcctagaattagatcataagtatagaatgcacatctaaccaaggtttctagtatcagataatcaagttcttcctcactctttcaatgaaagtggctaaaaagctcgttcagagcagacaaatagaatttatttcatgatggtgttttacagatttacaatcacgttatataatttctaattccatatttaaacattctattaagactgatgtcagaaaaaggtggtattacactaaaatcacatgtaattaaagattttaaaaagtaaacttagaattgttaaatatgtactttgaatagttttctgcatacatgcctcggctaaaaaaatgttccctattatatttttctggtgatcagacttgttacaagctccagaagagttgttaatacatatgtggctgttgaaataattttcacaaatgcctagaactttaggtcctcattctgagtctgaatgaggtttgcaatcaagttttctaaatcctggcagactgttgcaaattaaaaaggacagatggaagtgtgtgagctcaagcacatgtgtgctgctaagaatgggcatgtggtcaggaattataggatattagaatgagaggatataccactaaacagaaagccctagatggaaggcaggaataaaaactctgaaaagatgcagaatcaaagtgctatggcagcactgagtcaattaacataggaagaaataagagtcaggaatgtcaaaggttcttaagaataaattaacagtttaacaataaacagtttaatgacagctgaagaggaaaccattatcattggcaaacagcagcagctaatagttgagtgttaactatgtgccaggtaccgatgcaagatctgtgcagcaaaccccatggtacacctttacctatgtaacaaacctgcacatcctgcacatgtatcctggaacttaaaagttgaaggaaaaaaaaaaaagtggcacatgatgaacatgtcaggggtgtgtgtgtgtgtgtgactggcacatgatgaacatgtcaggggtgtgtgtgtgtgtgtgtgttttaaattagggacggttggctgggagcggtggctcacgcgcacgcgcgcacgtgtgtgtgtgtgtgtgtgtgtgtgtgtgtgtgtgtgtgtgtgtgtgttttaaattagggacggggttggctgggagtggtggctcacgcctgtaatctcagcactttgtttcagtcttaagagcttaaatttgatttttaaattagaaattgactaattgttatgtatacacacatacatgcaggatcaactgacctccccatcactttggatacaaatgaaaaagcagttcatttcacattgtatgtacttctcagtttgttccaagcatgacacttctcagctaggtggcctttctaagtggccaagatggtttatcttatgagtgagacagaaggtcaatctatttgcttgtgaggctttgctaagctct

SEQ ID NO: 229 - DNA, 1433 bp, Homo Sapiens
gcttagcaactgtttaatcaggggggagatgcaaggtactagttcatttattaacgggaaaataatcgcgggtcctaatgagtcactcagcatcaaaatgcatcaaattcatcatctgtttcagtctttgaaaatgattaaacatcactttctttccctttatagcaagatccaagtgataaccaataaatcaggaacacagtcctattcacaattgccacaaaaagaatgaaatacctaagaatacagctaactatggaggtgaaagaggtctacaatgagaattacaaaacactgctcaaagaaatcagagctgacacaaacaaagggaaaaacattccacactcatggataggaataattacccatgtctgtgtccaaatttctcccttttttaagacaccagtcatcttggattaggtcccacccaactccagtgtaacctcttcttaaataattacaactcccatgagcctgtttccaaataagcctgtgtgtgtggtacaggggaagaggtacgattccataacaggaagagagcatggcaaacagtgaggctgagatggactgagcacctggtgtgctgggcttgtagcttccacactcactcccttggccatcccaagacacctgtggtgcagccattaggatcctaattttaacaatgagcttcatacaatgtgctcatgctcacacagttagctgagaatgcagttcagacagttggactccggagcccaaaccctttctactttccactggaacatgaccacgcacagggaccagatggaaagaggcaaagaccgcaacgcccaccagatgctttgcctcggaacagaagggaggaaaggatgtcttcaaagctcataggagactgttgttagggaagcagaggacctccctgtggggcaccgaggggcaggatggagaggcagacatcagcaccgagaccctctgacactacctctgctccatctgctctagctccacaggcctccctgctgccctggttaggagaggtcccctccatttagctcctcctgccccggggagtccacttgtcccttccctcccatctctcaggcctccagtccagcacctcttcacagtgagctcatccctgacttcctgcccccaaatcagggatttccctacaccggcattctccattcttatctcctgctttatttttctccctgacactttcttccatctgttagtaaatctttatcattgtctgtttcctcccactagaatataaacttcatggaggacattgaccattttgttcagtgcggtaaattcagcacctatactagtgcctggctcttgggagggctctgtaatacgcgctgaaggaataaatgtttccaagcagtcctggatgctggggctggtatgtccttgcttggcgaccagggaggatgtgtcta

SEQ ID NO: 230 - DNA, 5163 bp, Homo Sapiens
agatagagtcttacagtgttggctagcaggctggtcttgagctcctgtgttcaagcaatcctacgtcagcctcccaaatagctgggcctacaggcatgtgccactacaccctatgctgctgctttttaatggaatgtttaatgcataagttttaggctccaatacaatattagtaagacttattaacttagcagatcaatgtggcaatattatttatcccaggaatgttcaggtgttcgtgtgtggtgtgtctatatgattggaaacccatcaactggctgtgaaagcagcagtttaggattgcccaaaagacaaagatttggaaaagctttaaaaagttttgaccacaaaggtcataaattttagtctagtgatgcagatttactggatcctgatgagcaacaggagtgaaaagcattttctagaagaaaaacctgtggtgatttctaggtaaaggacttcagatgagatcctgaagtaataacatattggcagctttagtagactcacaaacatgaggttaggcagcgatctaaggtgatagacagatgacatcagaaacaaaataagtactaggcaaggccatagccttgaatttttattagagttaggaattgaggatattctgaaccccgaggatttcaaccaagagaaagagtagcaaggcaatttagtttaaaaaataattctgatgtatattgggaaggattttattcaacttaaaatcagaaaaacaaccactaatagtttatgtgatgcttcttctaattcttacctggtattttagttctaggttcctattaaggttcaataaaccgcgacaattgaccaagggctgggctgtgataaagtcttccattttaaacaaatacaaataacattgaaccagaaagagacatcaagtccatttaaggcattggtgtgtttgtacaagacctgggttatgtaggaatagcagtaaagaacaaagcctcagacatctgatagacattgcttttacttcctttttatgtgactttaagtgggcctatgacttaatctatttgacctttactaggcctatagttatctttagtacatattgccagttttctaagtggttttaccattttacattcccaccagcaattttttagagttttagtgtctccacatcctcaccaacattcagatgaggggatggtggtttctcattgtgattttagtttgtatttctgtgatgacaaacggtatatatcaccttttcatatgtttattggattcttagatatcatatattgtaaggtgccttttccgatttcttgcctattttttaaaatgaggttaggtttttgagggttggttggttgtttttttgttttttgtttttttttgtctcttttattgattagtagtttaaaagaaagtatattctagaatatgagttctttactggatatgcatcatgcaaatatcttcttccagtctgtggcttgctgttttactctcttaatggtgtcttttgatgaacataagtttctaattttaatatagtcacatttatcagtttttccctttatgtttagcacttgtatgtctttagcacttgtattttaaaaacttttgtctaccctaaggtattttataatatttcagcagctttatttcaaagtttaaatctttaatccattgagaatttgttttagtaagagatatgaggtagggacccaattttatttttttccaaatgcttttaaacttctctgaaaacattcctcaattaatattttaaactccacctttagggtgttttcaatcacaataatcataagtttatgatataaaacactccaatacttagcaatgttcaatgaaatattaaaacaccaaaagacacaatctcagaaacagataaatctctcagtgaaccaaatatagaacagaaaagcaaaacaatgagtggagctgaagtcaaagggcttctgtgttgtgggtttcttgtttttttaaggggcagtatttgctgggagtttagctgctatgagataaggagtacttaaagtatatgaacaaggggcatgaatcctgatttccatatgaaaccaggggccggggaaaaggatcttcttctcatgaaaaaaggcaaaaaggctaggggaaaacaaagtttctggtcactacactgggctgtgactttagaaaacttcagggtacatttgaaggaaggtacatcctcgtaatcagaacagaagtggttgtctgtgagctttgtgacagcatcaggtttatctccattgtcaccctgggacaagaatcttaatatacctttatcagacctcatctggattggagtgatcatgacttgcgtagatataaacacaagactacctggccaaggtctgggttgaataccgaggaagagagaggaggaaaaacaatacacaacaggccaaaattccatgcctgtcgatcaggtattccttaaatccctggttagtggtgctggctgaggccctgaggaaaggaaaggcaaacctacatctggaatggataccaattgctgtgaggaaaaaaaccaaaacaaaacaaaacaccgtggacccttcgaggataaaaggagcccaacataatcaactttccatctaatggctggttgtcacattggaggctcagcactgatatgtgttgctggcaagtgggacactcagagacaaccgtagctatatcaaccttggtgagtgaaagcccatgccactgagtccatgtatagcctccatttctgcctctctggtcacttcattcatgggccattgtgctggggtggccagtgacaaaaactggctaatattaactcaccaagtcattttgtttacttgattgtttaatgctccttccatgataataatttcattttaatgacgttttcaggggccaggtgttgtggctcaggcctgtaatgtcagtgctttgagaggccaaggtaagagaattgcttcaggccaggagtttaagaccagcctgggcaacatgccaagacccttgtacctttgtaatgagcattagtgtgtgatacaacaatctttgtacttcattcatgtcaattctcataggcctatctacatgctggtaccccagaagtccttgtctctgtatctttcagtcctccgtgtttctgactagtaggccaagccatttgtcactgcccatgaatccatacatactctcgtcacaagcccactccttccacacaaggtggatgaccattgcctgaactgggaccatcagaaagattttccctctccactgtctttcaaggccacccgtcaatgaagttgtaatgcagctgccattcatttttggcttgagtaacctattcattacctcaaaacccaggctttgtctacctccttcacatggttgtacatatgtgtgtatatataaatgtgtgtacataggttatggtatgtaggccataggtgtgacttagggaagaattctgggtgaactgtggtggatgatgggggggtccgctcatgcagcttacatgtgccccgtggtcctgctcgtgattatcctgtatgtagtatttctattttataatagattattggcaagccatcttaactttatgacttactgagttcagcagttctggacatacggtcactaagtgtcacatggtcaaatttccatctctgtcaggtcccagtatcatatcagaagctgtttttgttttgttttgtttttgagatgaagttttgctcttgttgtccaggctggagtacagtggcacaatcttggctcactgcaacctctgcctctggggttcaagcgattctcctgcctcagcctgcccagtagcttggattacaggcatacaccaccatgcccagctaattttgtatttttagtagagacagggtttcaccatgttgaccaagctgctcttgaactcctgacctcaggtgatccacccacatagtcctcccaaagtgctcggattacaggcgtgagccaccacctggcccagaagctgttttttaaaagtcatataattttatgctatagatgtcacagaccccaggttctgcactgtgattcttcctctagagtttactataaacacactgccctttttatcaaaactgatacatataataccatagggtctgctggattgtatgactcaagtggctgggcgacttgcatcacagcctgtaccttctaaagagctcttgttcccagccccactcaaagctggcagcctcttatattgcctgatacgtacgtaggtgagctcagtatacctagttgtggaatgtgtggcctccagaacataaggaggcttaataggcatgtgtctcctacaaataatgaaagtattgcctcttcctttccaatttaagaccccatttttctttctcttccctaatcgcatttgctattccttccatgacagtgctaagtaatagtagtgaaagtgaactactaaaaatttattggcctggtgcattttgaggtgtagctttctgacgatcaaaattttttttgtatcataatttgtccatttagatttgctgtcttctctggagctagatttttattatttatattttcctaaaaatacatccattttaataatggtttcaggggccaggagctatggcttatgcctgaaatctcagtgctctgaaaggccaagataggataatctccagaggccaggagctgaagacgagtttgggcaacatagcaagactctgtctctacaaaacaatttaaaaattagctgggcgtgatggtacacatgtgtagtttcagctacttgggaggctgaggcaagaggatcacttgagcccaggagttcaaggctgcagtgagctatgatcatgctgttgcaccccagtctacgtgacagagactctgtcttaaaataaataaatatgtagagttgagaaaagcaatcagttataatttgttttatattttatctgaatctgttctctccacattctaatttttttttgtttatttatgtttcttttttcttgtttaaactacttattagctaaatggtttgttggtgccctccaatttcttgaattggaaacttaaacttttattcctatgtgaataacataaatgaacataaatatttaactaatgttacatattatcctctgg

SEQ ID NO: 231 - DNA, 6399 bp, Homo Sapiens
attgaggcgtgtcttccctggttctgcgtccgtgaagcctagagattcccgagcctgggtcacccgggcggtgtcgcatgtcgtctgcggggaggttggggctgctcgcgcgaggcgctctgggtctcatttccgaggccgaaaatgctggctccaaagtggtgccctgggagatgagggcgactcgcagattccaccctattctctgaatgggcttcgagtctccatggttggatgtattggatgttacgaccactaaactttcttctgagcacacacgagcagtggtgttgttctctctgagaaatactacaggctttggtgttaagacactggaattccggaaacctgtccctgtcataccagttgctgtgtgacctccgtcaatcatggttctttactgagccctgagactccgcacgtgaaaatggatggggatgaacttccagtccaggcagtgccactgactttgcttggggacctggggcaagctctgtggcccagcattgcaccatctgtaacaacataaccaaggggtgcgcaattgagctttgaggttaatttcggtgctaaaatcccggtcagtagttccgtcatcttcacagacctcaccctacccaatgcccttattgtgctccacatcccaatcaacacttactgattccagatttgtaatttttgccattgtagtgagaagtaattaactattttatggttttttaaatttgaatttttgactatcaggattagcatattttttttttcttcgttaaagactagtcaagtgcattagtgaggaggggggaaagagtagaccaaggaatttggtctgtaactgactgtggacaatacattggtagaactcactacctttgagccagccagaatctttttattattcactggatattcaggttttgcctctgtaaattttctttcattgccatttttttcaaatagttcattcaatctttgttttcagatgtgctttccacaatcaggttacaaattctctgccactaatgatcattacaattcctcttctcagcctgtttattgtttggtctgtttatggtttctcaggcttcttatttatttatttagacagagtcatgctctgttttccaggctagagtgcagtggtgtgatcttggctcactgtagccttgacctcctgggcttaagcaatcctcccacctccgccacctgagtagctgggactacaggcgcatgccaccacctgcagctaatttctgtatattttgtagagatggggttttgccacattgcccaggctggtctcgaactcctgggctcaagcgatccagccgccttggcctccagagtgctgggattacaggtgtgagccaccatgcctggactaggcttctttaaacattgaatagtgttcctttctagatgaaggaggatcacatagcacttgggagcaaagatgcagccaagtaacccagtgctggagcccacgatggagaagatctcacggccactctggccttgccctgggtgctttagtaactcgggaggaaggccacccagacactgcaggacaccagcatgctgaaggtcaggaacttggcttcgttgaaagcatcaggcaggttccttgccagaaaggctacagcaagggaccctaaaaccaagaagcccaagtagcccaagacagagtagaaggcagtgacggagccctcattacactggataatgatgtagccaggcatgaactgagggtccttgtttacgaagggaggctctgtccccagccagattccacagagggtcacttgggtaaaggagcaaaggaagacaacagaatttgttttttggggacccatccactttcggatcctgctttctggccttatagcctggaaggccctgcagaaaacacagccactgtgaacacagctgcaaaggtggtctgtgagaggaggcaggtggcagggctggggcggccgatgaagagcgaggaagagagaaagcagagtgtgagggagacaaggagggtgtagctcagagtctggttgctggccttgactatgggagtgttttggtgccacacaaactccacaaggatcagaacagagaggacagagtagaacaaggctgtgcatgccagagtcaggcccaaagtttcatcataggccaggaaggtctcctatttgagaaggtatgttcccttttcttgtttggataatgatattcaggacaaagcctgcattgttttatatctgaaataaacaaaaagggtgtcactgtctccaaaacagagcactgcacgtttggtaagattccattgcccagagctctcaccaccacagcgccatttaggtggactgtttggctggtgtgtgtgtgtgtgtgagagttgtgtgtgtgagttgtgtgtgtgcgtgcacgcaagcatgcgtatatgtgttctgcatgtgttttaaaggaaaacataaatacttcaccagcttttttttttgaccattttaatcagttttattgattcatgcttccggttcttattcagttcaaaacaaggcacattaaatacatcctcttattgctttataaatgcacgtagctcattctctatatcaaaagtaataaataatggccataaaacaccaagacctttataaaaatgacaacccagccttgaacatagtatttaacagtccaatctagaacaataacccaacacggtacatcaaagtgccacatatgaaaacatgcagtgtgtgtagtcactctagtactgagcttgcactggctattctttaaaaacatactagggctttttcactccttaaaaaaggtggacatgatgcaaacattgcaagttatagcatcactgactttaatattacatttatgtgccaaaaatctttacagatacataagagaaaataaaatcaatgataacaccgtatatttaataaaagtgaaaatgagttttttgttgtgccaaagaggaagctacatattttgaaacagacaaagccaagccagaaactgaagcagaagagggatcacgcatttaatagcagaaatcctaatacactcagtataaattgattgaaagcaggaatattgcaaacagcatgatggatatgaggcagaccaccgtggctaaacaaataatccagcattatcattattgttatgactgtggtggggctatttaaaggagtatccaactctctagcacagatgggggttccttcacctgactccccttaaaggctcttgaaataaatcacttgataataaaaggcaatccctgcatacccaccccaaccccaacagaatcaactaatgtcaagtttatatgcaaatggaaaattttttcttttgttcttggaacgaatttcaaagaagctcattcccccctatttcttgtctccctttcttaaatcaggtaaggaagctgtacaggcttaattcagaacttatggctgggtgcagtggctcacgactgtaatcccagcactttgggaggctgaggtgggtggatcacgaggtcaggagtttgagaccagcctgaccaacatggtgaaaccccatctctactaaaaatacaaaaattagccagatgtggtggcgggtgcctgtaatcctcactacccggggggctgaagcaaaagaattgcttgaacctgggaggcagaggttgcagtgagccgagattgcaccaccgcactccagcctgggcgacagaccaaggctccatctcgggaaaaaaaaaaaaaaaaaaaaagaatttacacaaaatgctggggtgctttattcacagtaatggcttgaaatcagttcatttccaaacgagtctctgggattggtgaaggaccgtgtgttttagcatttagcagattttaagtaaaagcagatatgctcaaaagaagaaaagtgtgcttttctttgtccttaaaggaacttcattcatagcaaaatatgcacaaacaagacctgtttaacaaacacagatctgctcgggccagtcgcatcctaagcccggtccctcctgtaactatggtccactggaattgggactcttctgtcgaggttctcttctgcagttttcattagtataaagagccggcttccagacacccttcctttttgaatagcactcatcagctgcaaaaattcattgagttcaacctgtccatttttattcaaatcgacttcatttagaatttcatggagtgtattttcatccatttggacattgatactctctaatacacatggaacatcaacaatggtaataaagcctttctggtctgcatcagacttacaaaatctcttcttatacctgtcactgtctgaaggcagtaggctaatttcagagccatctgttaactgttctgatcaaagtttagtctgtttcataatatagaaacttcctggttgtttcaagttgttcctgtttcttataatcatctcaattctgttctctgcccattagttcaacaatcctgagtagggcttgctctgctgcccggacatttagaaaggccaggcgaggctgaggcaggcagatcacctgaggtcaggagtttgagaccagcctgaccaacatggagaaacccaatctctactaaaaatacaaaattagccaggcgtggtgatgtcctgaccaacatggagaaacctaatctctactaaaaatacaaaattagccagggtggagacccaatctctactaaaaatacaaaattagcctgtaactccaggtactcgggaggatgaggcaggagaatcgcttgaacccaggaggcggtgattgcagtgagccgagatcataccattgcactccagcctgggtgacaagagcgaaattctgtctcaaaaataataataataataataataagccaggcgagtacaacgtgaaatcatatccacggtggtgcaggaatactccttaatcccatagttcacctctgcttcaatatatggaaattctgacacaagacgtactccaacaataggccaccttttgctagtcacacttgccattgtggccacctcaaaagccttatcaccataggtggcagcaagatgctgtgccccctcgctttcaagtccataatcctggacaagcttcatgtagagtgtggggttccaatctttacccccttgaaggaaaagcccagctgttctacttggtcctgctttcaaattgtgggttttgatagcagcatttagggtatcttcgccacagaccggtaagttgtccactttccacctgctgtagtaataagacttctctcactgacatggacaacatgatttcaggagatagactgagtatctgcagatttgggatctgtaacaaggggacggatactgctccacgctgctaggatgtcgcccctcttctcacctcaacatcacagctcaggtaattacgtgcttcattcaaaatgaagttaatatcttcttctgaaggacttggatggtgtgtaatatcagttggggtatcagtagtgccagcaatcatcatcttttgccagggtaagaagaaaataactcgcccatcactggtcaagaagtcccatgccctctgggctgtaataaccaggcatcacaatgtggacaccagcagttggctggcagatagctgcagcatccttatcatctattttgcacacagagtctgtgaaatgtccaacggcattgataacacacttggctttcatgtcaaattcctgccctgtgaggacatccttgcaccatgcaccactcacacgcactttcgctgtctgtctgggtgtctgtcttcttaagcaagctcactacctccctgtcattgactgtggcatccccatatctggcagcagtcagcacaatggcaaggttcatccatgcatcgttatgtcgtccatcatagtagacaattcctcctaccagtttgtccttctggagcattgggaaatgttcaagggctcttgatttgctgaggacataactgcttttcaggcaattacttcctgcaaccaaatcatacagcttgattcctacccagtagtaaggtaactgccaccacttgtaaactggaagcatgataggcaatggagctgataaatggggagaaatttctggcaggttggcacgctcatcaagggcttctgttaccatccggtactgctcaatatccaacttcatcatggccttctgaagatatctcacaccaccatggatcaaattagtgcttctgctgctggtccctggcattgaagactgttcctttctgggtgaaggagaatcacgtagcaattgggagcaagatgcatccatgtaacccagtactggaggtcaagatggagacaatctccacagccaccatggcctttccctgagtgctactataactcaggaggaaag

SEQ ID NO: 232 - DNA, 961 bp, Homo Sapiens
catgactgtaaaagctggattaaatgggcttgtctatattgggtgcctagttaccaggctgcttccaaagtggatactgtggccatcagtgactccttccttgacctcagcaatagggactacgtgtccagaaatgattctacccatggcaagttcaacggcatcatcaaggctgagaacagtaagtgcagtcaattgaaatcctaccttcattttccaagttcaagatccccccaacatcaaatggggtaacatgatgttgaatacatcatagagcccaccgcactctttaccgtcttagacaaggctagcaatcacttgaaaggtggaagcaaagggttattattcctatcacctgcgccaatgctgctgtgctcagaatgggagagaactgtgaagatgacaactccttcgaaattgtcagcaatgtcacctgcataccaagtgcttgactctcctggcagaagtcatcgatgatgactgtgctaacgtggaggaatctcagaccacagtccacgccatcactgctccccacagatcatgattactcctccagcaagctgtagtgtcatgtcagtggtcattatctctcaatccctggccctgccaaaactgtgtgcaagacaacccctgagttgaacggagagttcactgatttggctttccaagtccccaccgctggtgtggaaagtgtgttgagaatgagatttgccatctggagaaaggtgccaaatataatgacatcaaggaggcaatgaagcaagcatcaagggcccctggaagagcatcccgggctacattcaggaccagttggttgcctttgtgacaaccactatcccatttttgatctggggagggtattgctctcaatgatcacttaatcaagctgtttttttggtatgaccataaatctggccataggaattgactggggggatctatcttatggtctgtgtgacct

SEQ ID NO: 233 - DNA, 1796 bp, Homo Sapiens
ggtgacacgcacctgtaatcccaggtactcgggaggctgaggcaggagaatcacttgaatctaggaagcggaggctgcagtgagatgagattgcgccactgcactctggcctggcgacagagtaagatgccgtctcaaaaaaaaaaaaaaattggtgttttcttggtttgttttgtgttttagtttaaggagacacatttcctcatcttaaggacttttttgctgctctgatgctggtcatctagtccattcttttgctctaaactgagccttgcctcccagttcttcattgcacttcagattgtgtcttactacaaagagaaaattagtctgtgatcagtttggatcagaagaactgaaaatgtacatttagaatagaagccagggatgtgatgcacacccgtgatcccagctactcaggaggctgagatgggaggatcacttgagcctgggagttagaggctgcagtgagccgagatcgtgccactgcattccggcctgggtgacagaacaagaccctgtctctaaaaaataaaaagaagaaaagaaagaaatttaaagtaggaagggctaccgtttgcttctggccaagcttcacctctaaccataggatcttttaaaagactagttctgaggtcctttactctgagtaggtatttatggaataagccattatgtattgacattagaatcagttaaacataaatttttttctctttttatgcactacttgacatcaaaagcaaaaagaggtaagttggctataaacctgtaggtgaacctaatttttcttagtagatttgttcctgagtagctttgcttcaattaaatttctgtgaatcaaatacttttacattaggaagattgtcattggaaattcttattcttttctttgaaaatgaataagcatcttctgtaaacttagattttcaagatatctagtatttaaacattttgcttttcctttaatcaagttatacttacggtttaatttgcttgtgaagacaaggcattttcaaacacttggtttagttttgagataactgaattgtttctcccaccagaaatgtggattacatgttataagtctttcctattttcttaaaaatgaaaaaaaaagccaagaaacaactgacattggtgaaagtctgtaattttcagatccattgatttacagaagaagatgccctgaacctctcagaatattttctagtgtgattttttttaatgattaaaaaaaatgaagaaaatattaaacaagaagatcaaacacatttcattgagtggtgtctcatatgtttttcttgtttgggatctatttttataattgatctttttagtggattcttgattgtagtttaacttatttctcttttgtttctttttgatgatgcatcaattctgacatttcaaaggtacagctggtcttcattagatatgtgctgttattgactttgcttaacaagaacagaccatcatcgtaccaccttgagttaactctgtgccagctggccttgctcttgagaaggtcatttctaaacagaaggttattttttgaaagatttttaactggtgtaagaatctggcagcagaatgtacttttacctcttggtgccactgtatttaattaccctctccccatttatcctccatgtctttcctaccataagctattgataacacacatgctcatggtttaattgtaagttgttcagaaatagaaagctgactgtactgcagggcgtttttatatttctcttttgcaagatttgaaataaaaatagatttttgcatga

SEQ ID NO: 234 - DNA, 3666 bp, Homo Sapiens
cttttggatctctactcccatctccccctgagttcagacttgcaccacctactggctcttcactgaccggctaactgatgctcaaattcgacgtatcgaaagcagaactcacagtgtgcccttacagacaaagtatgggcactatttcatcagcgggaagaaagagaagtatggtgccctaatataaatccatcagtgtgcccttccaggattcctcaaggaatgaacattttccagaagcaaaacatcgcatctttccattttataggacaatgccaactcctgaagatcttgctctaagtggtcaaagggtgagcatactgcaggcaacaaaagatcgagcatactacaggcaaccaagggtcaagacaaatttacaggatccctccctaccgtggccactacccagcttcccagtagtgccttcctaatttgctgcccatggtaatggagacaaatacctgcagaagaacataatcaaaactcaaaggaaagttgagcaagcactggaacattcacaaaggcagacagcagacgtgctcatcaaaagcatttttgctgcatattgggttatcaggatggacatgcatggactaatcaatgtgcttcaatgagagctgtagaaaaatggaatgagcaacaaatggagtcatcatacagccagcatcatatagaagaatgacaaagagagaaaaaataaaactttctgggaaagaaggaataagaagctggattggcagaaagatcaatgtggttttccctagagcttcctgggcagagcacagaaaaggctggttgcctatggagaactacaaattgaagagtttcttaatcagtccactgttcacttgattcccagacacagacaacatgagtttaattatccggagacatttcaaaggatgttgatgtttcatgatgggaaaacggctacttctacaaagaattgatctttctgaatagaaagaaggtcattcctgtgagcactgtatattttgccaacagaattagactggtcagttaagaagtatgccttaattattaagagcataggatcaggcagtctgagctctgagttcaaaatcctaaccttacccttaccaaccaagtgcctattgggtacagaatcataacacttcggtaaaatgattcccgtgaacacaaaatatacggtactctcatgagcaccatatatttttccaacagaattagactggtcagttaggaattagactgttttaattgttaagagtacaggatcaggaagtctgagttctgagttcaaaatcctaaccttgcttttaccaaccaagtgcccattgagtacagaatcataacaattggatgaaatgattagcatgacagtgcctagatgatatggtgttgtatatattcaatatgatgtaattttccaatatccattgaatgtgtaccatgtggatacaaggagaacaagaagatgaagtctttctcattgggaagctcacatcttagtgaccctccagaattaatatatctaaagactaaggacagtaccaaacacaaagtaattgctatctatgctgttattcatgcaaatgattaaatcagtgcaccccctcccaatcatggattgctctaatattacatatcactcttatattataccttcctccagacagtaaatggaaatctgcactcctagagttttgtgttgttattcttaatgatgatatggcaagagactgcaaacatcctgatttgcaaggctagggagcttggaaatgccaggaaatatgggaaaaatcaaaccccattctttcaactcactggcgattttttcctggctacactgtcttcatttaatctacatttccctaccagcaggtgctcaccaactaccattggtgaaggcaccagtgagtttctggtaaggatctgagttgttcctgaccacagattggaggaaccatgtgggaaaaggtgtagcattgcattctcttggaacacagactttcgtcatttggcaaagagattcatcttgcattttttagtatgatggcaagcaatacatgatggcaagcaatacttaacttcataaccttgattcatatccttccccctaatgctcctaacaggacaactgaaatttatattgcctgattgaaaagaggctttatttgacccagacacaaagttagctttccaatacttccctagcttccaagccataaaaaattaaatgcctggaatgtgtaccttacaagataaaataaatgagataactttttactggtaaacaatcaatagcctattaaaataaaactagcatacaattctctgatttttgtagagggacattttattttggtcctgtaagtttccctagtagagctggaataattgtagaatagattttggaagtagtatgttcaggcataaaataatgcaatatgcaataactcaagttgataaacaggttaattgcaatgatgcttggcacgtagatctttttctgctaagactttgaaagttagaaaaactcataatatttatgtttgtcatttgaagaatttaaggggttattaatattcagaaacatgtactaatttcctttgaagggagataacttactggctgtaaaataaatattggccttggaactggacaaactgagcttaaatcctggctccttcacttatttgctatgtgactttagataaatgatttaatcttgattttttaaatctgaaaaatagggttaatgatacctgatgctttagtagtacaatgaggtattccacaaagatagtggaaaacagggaaattaggttgcatgtaactactatcttaggagctttaacaaaataataaaatacctgggttctcaaccccagaattctgatataattagacttgaatgaggttgaggcacagtatttttgtcaaaatccagacagacatggtccctatctctcatgaattgcacaatacagtagaagttactgacgttataggtgaagaactaaattgaatatgagttttagagccaggaagatctgtgatattttgctagctgtgtggccttgggcaataacttaattttcctgagtctcagtttccccatgtataaacactaacgttaatgcatttgtatctcttagtatagtgatttaggactgccacatagtaggtgcgtcctaaatatcattattcattataatttcacaagtattattggtaatattttacctcaaaaagatactatgactgatcgtttaggtctacaagtatctaattgctcagttgtaatatttcactttaaagtgaataaggtctccaaaaggttaaaaaaaaaatcacagttctatcttattagtgttgaaatgggggcagttacagcctcttttccatgccacttcactagtactagtactgtcaatacatttcttcataaaatatatccatcagacatggaatattaggtattcagagttgatctgtactttcatatacatattgatttaaacaacataattttgtgattttgttttcaatttccatcttgcatgttttagaatttcatcttctatcttggtatatggaacaatgtgtcaataaacatcagtgagcataaaggaaggatgactcaacaaattcttgcatccagttcaatttcaattcagg

SEQ ID NO: 235 - DNA, 971 bp, Homo Sapiens
taagtctaattttactagatagagtaatggaaaatgaaaatctaaccctttattccgataatctcatgaagcaaacctaactatttaacatcagctggaaagaagggaacatttatattgcccgtctcctgtgtcttcaaaggtgtgagagttgaggaatatgtgttcctacgggaactatgtttgaatatgtgcagttttcaacattttggcaaatgaaagcctgacaagtttttaaaagggcagaagctttattttttgaacagaaaaatctattttttaaattcacatgtttgtatgagtacttctgggaagcaagggatgaactgctaggtattattaagaatgaatgatttttgcatttaagttgtttgaaggcatgtattttgaaaaatatctgttacaaatttataatttcaagacatactaaatcttataatacttttggaatttcattaataaggctaaaatctgaggaatgtaactaattttcagccttaagacacttaagtttggaagtccttgctattcaacagaataacaagaaaccttcagaatgtatcactctcccaaaaagaagatattaataagcccttttcttttattcatggttatagtttttttatagtctcaaaattcctaaagcaatgctgacagccattgaatttgccatattttgtattcagtgctgttaatgtgctgttgcctcaagaaaaagtgctttttctccattgatgaggctagaccctaagaggtaattaagtcaatgtaaatcaaatggaagtttttcacttttttgatcttggaaattataggtatacatttccctcttactactgctttttgctgtatcccataggttttggtatgttgtgttgccgtttttatctgcttcaataaatttttcaatttcttctgaatttctttgttgaaattgtaaggatcattagaggctactatgagcaaccata

SEQ ID NO: 236 - DNA, 1096 bp, Homo Sapiens
ttgtaaggtgacaatactttgagcaatgttatccaggctttccataaaatccttggacaagcgttggtaataggatagggaagttgcaatcccgctaactcccattcctacccctgctgttattcctagccgttgtgtctggtggttgcagttaaaggtataatgagggattggttgttgggagctatattaatttagggacatacaatatttctgtctccagtctaccacttccaccaaagacaaatcacagcagaaccgacctaacttcaaaataaacttcagtcccgtatactgggcctgattacccacacaaagtgcaacaagaatcattgtccatatagactctcctagattggctttgctagaacatttcacaaggccatttcagtcaaagtcctgagaaagtaaccggtttcaattgtgccctattacaaaagaaaacgtggttattaactttatacagacaaatgccatgaattaagaatattcataaatagtttacaaattctggagaaattagaatactcaatacacttaaagtgtatttcaaggctataaatagctcaaaataaaaagattattcagactctgaaaaaacaaaaagaagtagcaatatttcaaacaacaaaagccatacaaattatttcagtcttccattagttcatttcagtccatgtaatcaactcctgctctacttcatattcatctttatgaacacatcagcctttcaattagtgccttggaagttttctgtctaatccaatggcacactctccaaagttaccagaaacctgcattcaagagttcttttcatgaactccaaagaagtaagccttggactgtagctgattataagtcactttttttttttgagaaggatcacagcaaaacatcaattatggatgacaaaagtcttaagacagccataaagacacagttgacaaatgtggctatttctgtggcttacaacaatttaacataatcattacaacatatattaagacatatcagaattttagaactctcatacaatcctggaacacatattaacaacaaatctctatcagtataacccaaaggaagctaaacacca

SEQ ID NO: 237 - DNA, 1489 bp, Homo Sapiens
ctctgtaaacttcagcattgatgatgaacattatttcaaggaaatatcccactactttatctctgtaaagacatccatagagaatgtaagttataatttccttattcatttttctggttagagaaggcatttctattttaatggtcaattattatattctgaatttgccacaagtctccttttcatatttaaacactagggtttttttttgtttgttttttaaattcttaagataaatagaaaagttaaggttagaaaatgttcaaaacaattgctcaccttataaaatcttgttagggaagtaattttgctcatttcatactgttgacatttctgaatttcagtaatcattaatttttttaaagctgccagcagatatgtacaatactccttttagatattattcccatcaaagacagatttcacctctttcactctttgtgtcatttctctattattttgaaaatattactaatgccttcaagttcatttgtattctgtaagattctccttgtatccaagcaactccatctgaaaaaataatttgttttttttaatgagagatatattcaaaacaaaaccctgcatatatttatgattttttggtaataattttcatgatactaatttcctggaaagggatttgcacttcacgaacaaacagtgatttcctttgaaaccttctctggtctatgtcaccacagttatctaaacaatttagatgtccctttcttgactaaacttttaaaaaatgttgattctgttctgtttttagaaatgatacacatcatcagataatttgtaaaacagaaaatatattaaaaaataaaaacttccttaaataaccatgggataatcaaggttgtagtagactgccaagtgagttataaaaactccagaattatgtcagaattagacagataaccaaagaatctgtggggcactttgatgaactcaagtgaatccttatattcatctttactgagaaaactgttgggaatgatttcacttccatttttttaaaaatataaagcatatccttcagagtggcacatgcagaaatattttttatgcgtgtatatttactgttaagtacacaatacgcctatgagaacaaccatagctaatagctttaagaactgtgcttggggcgaagggaaggaatgtgtggctggagacttagtttggcatgactgagaagcacccaagcggagtaaggacgggtgtgtcggctgcagccaggcggcagttctggtacttctcagtcatgacatttggggtcaggtaactgaatcctcatcagcaaaaaggggataatagtagtaatatagctctcataatattgttacaagaattgcatatacttatattcacaaaataagtaaaatgttttgaacagtgtcgtgaagttatgtcctatgcaggtattttactgtaattgactttatttttgttttagagcagttttgggtccacaggaaagttgagt

SEQ ID NO: 238 - DNA, 5651 bp, Homo Sapiens
ttagtagagacggggtttcactatgttggccaggatggtctcgatctcttgaccttgtgatccgctgtctcttcttgccacgcagttctgcaacccgtcctacacagagtgacagcagcaaaactgtggtggtggtggtgattgttttcctttttcttgctaagttttatgactgaaacccattaacattgatctcaaccatttgagttgtttgggggtacactaggggttccagaaaatgagttaccatcagatttcatctatttctggttgatctataagtgttggactttcatagacctccatccaactgactgaaaattttcaaacaggcagcaaagatagaagcatagtacaatgaacacctgtagactgtctccctggctctaaccattgtttatattttgtcatatacagttttctctctctctctctgtacacacacacacacacacacacacacattttgttttgattttttcttaaccatttgaaagtaaattgtaggctgagtgtggtggctcatgccagtaatcccagcaccttgggaggctgaagcaggcagatcactaggtcaggagttcgagaccagcttgaccaacatggtgaaaccccgtctttactaaaaatacaaaaattagtcaggcgtggaggcacgcacctgtaacgccagctacttgggaggctgaggcaggggaattgcttgaacccaggaagtggaggtggcagtgagccaagatcacaccattgcactccagcctgggtgacagagcgagactccgtctcaaaaaaaaaaagaaaagaaaagaaaaacaaagaaaaaagaaggtaaattgtaaattgtaaatgatcatgatacttgactataaatatttcattagatgtctaccaaggacattctcctatgtatctgcgacaccattatcatacctcataacattaatttttaaaaaaattaactctagcgtcatctactatccagttcatattcacgttttcccaattgcatccaaaacatcttttatagcttttttaaaaaaataaaaaataaagcaggatctaatcaaagatcagtatgttcattgttacgtctttttatcaacttcaatctagaacagtctcccagactttttgttatgactgactttctgaagggcctagctgagttgtcttatagacaaccccacagcctggatttttttttctctctctctctctgcagatttgtttttgtgtgttttttgttttttgtttgtttgctgcaacctccacctcccgggttcaagcgatcctcctgccttagcctcacgagtagctgaaattacaggcatgcgccaccacacccagctaattttgtatttttagtagagacgaggtctctccatgttggtcagggtggtcttgaactcccagcctcaggtgatccacctgcctcggcctcccaaagtgctgggattacaggtgtgagccaccaagcctggcccaggtttttttagttgagcaatgttactaccttgttgaaggtaagaaagtgtgtctctgccaataggcaatttcctcaagatatgttgccatgcaggtttattgacatcttatctactcctaaaaagaatttgaggcagtttataataaaagagaaagtctgttgaaaaaaagagaaaatattttcttaacatgtagaaggatggtgggtgggaggaaggaggggaatagaggtgctataaacacattagtgtcgttcgtataactaaacgcaaaatttcactttaaaatgagttcagtcgaggtaacttgatttctgcatctaacacgagggagaactgaggatgggtgggctgcctggctcccactcttgtcctcagtcccctactgtctccctcggccttccctgggcaggtcctcaggtacaggcagatgtcagctggaccccagatgaggaaacagagcaggtgcaaggctggacctcaaggatgaagctaagcctgagtcaggggctgtcccagacagacagctcctcatccaacaacctccccacagagctgggctgcagctgaacttgcattttatgataattgctttttcagtctgcttaagtgctgaacagcacagcagggctgcgttctcctcccctggagaacgtttacagatggtgttgcagtgaggatggattcctgtactttccgagggtgggggagcaccgtgttgtcctttcatgccactttgcctcctgtcagtcccatggggtgggtttgctctaaggtgtacctgtggctaacccgaagggtttcatatggccatttgaactgcagaaagtgctgccaaaacatacaaaattcatgtgctttgagataataatttttcagttgcttatacatgacgttacagaaattgttggccacagagaaaaaattccccatgatctcaccactcctgaaaccaactaagtcacctgctcagagccactctctgtggactcccttctgcattaaaggaaatgcacctgttcatctcctttctagaataaaacatgactatacatgtcatttagatgtgtatgtgtatgcatacctatatatttgtattcttttgtggtctttaaatgtatttttatagttataattcacataccattttgtacagtactttttctcacttaattttatagctcatgcttttttccattaccatgtggtctttataaatcatttttatttgtattttattttttacttttatttatttatgtatttatttttgagagagtctcactctgtcacctaggctggagtgcagtggtgcaatttcagcccaccacaacctccacctcccaggttcaagtgattctcgtgcctcagcctcccaagtagatgggactataggcacctgccaccacccccagctaatttttgtatttttagtagagacagcgtttcgccatgttgtccagactggtctcaaactcctgacctcaggtgatccgccccctcagcctcccaaagggctgggattacaggcatgagccaccacacccagcccacaaagcatttttaaaaatggataaatgattttctattgaatcaatgcactgtaatttaactcatcccattttcaggcaaagtctgttgtttccacctctccttttcatccattatcattcacacttccctagccataattacacaataagatcaatggcttgccacaacccttcctggcttgtgatggttagattacgctggcctcagggagggagatggttgcatttcctcttggtatggctgggaaagatgcaacccactcaatatttaaatataaggggcggggacacagcctctttacacagcctgagactgacaccttgcccaggggaatgagcaagagcaggattgaacccagagctgggtggcatcgtgaaaatgggacactcagggtatcagtgacaaataatttagaggctgcttgcccctggagtagaatgtctggcacataaggccaggtgtgcgcctcgctgaggagtctgtgcgtcatcttgatgggatggtgccatggtgattgtcagccagcctctccttattgcccgctcaccccacacacaaggcatgttgatatggaagagagacttgaaggattgccaggcatcggccacacagaagatgtgacggggagttgtcctaaacccatatgtttttatcatcctgtacttgtcaaagagctttgaagttcacgaccttgctctggttcccacggggggatcgtcctgggcttccatcatccctttttcctgtcaaccgtgtgttgcatgcagatgccacccccatgccttgccggagactcccctaaaaagctgggattatgtctttgaaattattaattttcatgaatagcatgaaaaaatttttttgtaatcccagctactcgggaggctgaggcaggagaatcgcttgaacccgggaggcggagtttgcagtgagctgagatcgcgccattgccctccagcctgggcaacaagagtgaaactctgtctcaaaaagaaaaaaaaaaatttaaagccacttcactccagtgaactaagctattgcaatttttctgtgttcagttctagtcctcagctgcacaggcacgtcagatcttaccaatttatttaagttttattttaagttcaggggtacatgtgcaggtcggttatataggtaaacttgtgccgtggaggtttattgtatagattatttcatcacccaggtattaagcctagtacacattagttatttttcctgatcctctccctcctcccacccttcacccccaggtaggccccagtgtgtgtggttcccctctatgtgtccatgtgttctcatcatttagctcccacttataagtgagaacatgcagtttctggttttctgttcctgcattagtttgctaaagataatggcctccagctccacccacgttcctacaaaggacatgatctggctcttttttatggctgcatagtgttccaggaggtcttaccaatttattaccatggtgacgttgccaccctgcattctgtttgctcattttctctaatgtggtctcatcatcaatattttcccacgtggtacaatgtctacgtaatcaccattttaacagctctgtgcccatccagagaatgggcgcgccccactttaaactctcgatgctggacacagaaactgagttcacaattgtaagccggaagcatcttcaggcacatggagtatttggcctacagaggacattaacagatggagtttagtggttaacagttggtcacacccaatgtcaccaacctggcacctaagggtgcactgtggggagcaccctcctggccatgtgtccagagcatcccctgcccgtgcagaccatccagccactctctgcctggctggaccctggcattcccaggtcctcttcccacacttgcggagggaaggcacagccagatgtgcagccccacccgagctaagccctgctccattaccgaccggccccaccgaatgtgttttctgtgtagttcgtggctacgctctggaatttcagaccacgctgaatttacttgttttatggctaggaatttcaggaggagcaccacagatgttaaacgcaggagtctcttggtgctagtaaaataaaccttactcaaacaggggtgtcgtgactcaaagggttagatagcccatgatacaggatgtcggtcaccaatgcagatgttgtaagttgagtcatttgacagcatggtaactttatatggccagagagccagctgtgactatttaaagggatggggggtcagggggaatgcatttttatttctagacaaatatatttctgatcgtaacttaaatactttcttttagtcaaaatactgatttttctttctccccgcattctcgaaagagaagcccttcctatccttttggcgttcaaccccaccaaactggcttcacattagagaccctgcaaggcttaaattagaacctcacttttgaaacctgttggaaggactttttttttaattttattattattatactttaagttttagggtacatgtgcacaacatgcaggtttgttacgtatctatacatgtgccatgttggtgtgctgcacccgttaactcgtcatttagc

SEQ ID NO: 239 - DNA, 1126 bp, Homo Sapiens
gttggtcaggctggtctcgaaatccagacctcaggtgatctgcccgcctcagccccacaaagtgctgggattagaggcgtgagccactgcaccctgcctcatctcattcttatctcttgtttcagtgagccaatatgttattttattttattgagagccaagcgaatgtactctaaaatataccagagaaatataccataaaatgtcatttggaaaattttatttttctctgtttatagtgtccttaaacatatatttccttttactcatgcatgcatgatgagacttctatctaggaattatatttgatttctagtggattgagtaagttcttcttgaattcctttgaactttacctatatgcgtgattgcagtctctgacacatcatcctcataatcaataaatatggagactataaaaagattctctaacataaagagaaacaaggcaaacaaaacaaatttaaacttagctttcttatctacttaaaggagataataacacttaggtcacaggaaatattgcaagattaaatgcctaagatgtttgacatactccctgagaaatacttaacagatatagctcttattattacatcagtggagaatctagttattatccagaatattaaattggcatggaaaaagcatctggttattgaaactttggatatgtaaaaatagcattcatggatagtactcatttcttaccacatcattgcaaaattacaaacagcctgggagtccttcatttttattcttcaccttgagaagcgtgtggacaatctaactaccaatatcatcctttacgtaactccttaactccctttaaacattatacttcgggctgggcgcgggggctcatgcctgtaatcccaggactttggaaggctgaggcgggcagatcacgaggccaggagattgagaccgtcctggctaacacggtgaagccccgtctctactaaaaatgcaaaaaattagctgggcgtggtggcaggtgcctgtagtcccagctactcgggaggctgaggcaggaggatggcatgagcccgggaggcggaggttgcagtgagccgagattgcgccactgcactccagcctgggtgacagagcaagactctgtctc

SEQ ID NO: 240 - DNA, 3265 bp, Homo Sapiens
gtgtttcagcaccgactatgtggtcaccgggtatcatgcctgagagctagttccggggtccagaagtcagaatcaagacatcagtaggaccttgttcctcctgaagactctaggagaatctccttccttgcttctttcagcttctagtgaccccaggtatcctttggcttttgactacgtaactccaatctctgcctccatcttcacatggccttctctgtgtctctcttctcctccactgcctcttttttaaaaaattaatcataataattgtacacatttggacgtacatgtgatattttgatacatgcatatactatgtagcaatcaaatcagggcaattggggtatccatcacctaaaacatttatcatttcttcatattgagcacatcccaaatcttctcttctagatatttttaactatacaataaattattgctaaccatagtcacctgactgtgctaacactagagcctatttcttctctataaccataattttgtacccattaaccaacctctcttcatccctccttccccctacactttccagcctgtggtagccatcattctactctctacctccatgagatcaacttttaaagctcccacgtatgagtgagaacatgcaatatttgtctttctgtacctagctttttgcacttcacataatgagctccaggctcatccatgttgccatgaacgacagggttttcttttttgtggctgaataatattccatcctgtatatataccactattcatcagttgatggacacttagtttgcttccacatcttggctattgttctgtctcttataaggatacattttgatggatttagaagctactcaggaaatccaggtgatcttgtctcaaattccttaactttattagacctgtaaagactctttctcaaataaggtcatattcacagattctggggattaggatgtgggcatatcttttggggaccatcattcaatccaacacagtagttttcactatcaccattgctacataattcatgagatcattatgcaagtatgaggagaatgggcggggaggctgactgacatctagagagtgagttatcatctatcctgaaccttaagagactcttgataagcattcaaatggtacactaatatttttccactctgagagcattcagatggaaaaagatatccactaccctctaccaaaatattcttgttacttctaagcttctgactacctgctcaaattattaatcattacccactggtccactggtttttgttattacttaactcaatctatgacttcttccaggcaaattagacaacaggattacttctctttaggaccagcattgaattaagaagtacaatcatttaccataagtccaccagtgctggccccaggaaatcaggaagaagcatctgtaaaccaagagctatctatctatctacgtatctatccatttattgatttatttggcatctcaggctactaattagtcacaggaatccttccatgaggccactggggttgagagagaacagcagcgtagcaggatgataccaggaagatgagaatcctccttgtgcaatttaacatgtgcatttaagattggcttggaaccattcctgtgcatatgtgtgtgtgtatatgtgcacgtggatgcatgggtatgtgtgcatttcacttgagggagtactgctgtggattcctcactttattttttggtgaatgagcttgtgactcattcataatgggaaattcagatcataatgccaggtatttagtcctaccaaggtccagtagcatttcaagagttgtttctcaaaataggactagttacttactggagaggtcataactttgattttttaaatgatattagaggtcttgactgagaatttactactggagctccataaagcatcccaatctgctacaaactcttcaagcttcattggatccgctggatcaaatgggctgccaggtagagttgattgcactgcagcctggactgattgccaggagctctgttgatatgagttagtgaggagacaacatctggaacagcagctgcacttggaggcaccgcctaattaagcttacgataatccacactcattctccaagacccatctgtcttccccatcaaactaattggagagttgaatggagctgcgatagaaatgaccacaacctaccatttcagtcattgatggtagcactaatctctcagattctatgggaatatcctactgctcttggtttttcttttagtaaggaaggtgagatccaggacttccatccttgttctttcctttcataataactcttattcctgagttaagaagtaaatgtgagtatttagccagttgtctagagtatcttttccaagaacacacaggaaatgaagggaaaaagaagaggatgtgtctgtaggtcccactatgcctacagtgagatgggcttgggtcaagactctatcacctgaacatcatacatttctactctgaccattgaaccacagtgccattcttctataacagacatgtgtaatttgggagccattatcttaaaacaactgaaaggtctacttatattcttttcttcagaatatatttacaccagaaaacgaccacaggtctagaaatagagtaatgactctgtttttcctttggtgagcttcatcctgagacatggggattttatgcaaatttattaggaactttgtgattgcccatatatctcagatctatagactcaatgatcaataaatcagtgttaaatatctatgtgtctctattagggaaagcacgaataaatggcctctggaggttaagtgcctgacttctgcacctgcccttctcaatcataggatctttccaatctccactgtaatcaggcagactatttcaatattagtccctcccatcaatatccccaactgacaagagaagccacaatcacatttttgtagatactagtagttccctcataagtatttctcaaggccttagtaaaaatggtcatctatgtctacttaggcaacatagttaggaagtagatgagattcatgttataaattcggtcattttatttctttctaggtactattgtaaataatttatggcatcttaattttctttagcatgatcaataatctatacagcttcctgtattaaaagtagcttgccctctctatgaattcagataattgcactatatgaaaaaaaaatagactaacctaagactacatttattc

SEQ ID NO: 241 - DNA, 2222 bp, Homo Sapiens
agtttcttgaaacagctccatattctttcttctggcctcccacatattccttgggctagaaatctctttcttgattttaatcttggcagccaccctccatgacagccttaggtctgcacattcatcgagagagccttgcttccttcccagcaccctgcacacgggtgtacatgggtacacatacatgcacacacacatgcacacacatatgcacacacatgtacacacatgcacgcgcacacacacacacacatatacacacacgcatcctttgttaggagtgagtttactactacattctggcctgtctcccacgttcgagtcaggcgaaggggaacagcagctttgaagatgaatttaaccagttcttcctgagggcggattgcggtctccttatctgacccttgctgagagagaaggagcagcgtggaggaggcggcagtcagggaagccttgtctcagtccaagagcaaagtgactaccgtgtgctgagcactggagcttggtgacccaaagatgaataagactcgactcttatccttaaggagcctgcagtctgatcaagtcattactgagaagagaggaaggaaaagatacccttggcctttccaacttgtcaagggtcaactgaattcctgagccggtccccctgagagggcagtgggcgagattccagcaggtaatggatgagcacagctatgccctgacagggacattgcctgcaattggttccagtcatatatggagccaaactgctttgaaaattgggggggatggtgacagaagagagcaggcccacccctcccccatcccctaggagcctagggccctgtcttgatcccccttctgggagatgaaacgtgtggtttcccaaagctaggagcagagcaaatatcttctgcctcggaggggttggtctctgcacaggctgggaacccccagggaagcagcactgagggccctaggagagagggcagaggccagaggcagggtactgcctgctcagaaggtcagattccagagcaaacagcaagctgtctgccttttcagactctgaaaggatgggggtaggggcaggaagggagggtgaaagtttagagcccctgtgggtagggaaggggcctctagggtctgacaggcacccccaggacactgtgtctgcccaagtgtttgctgagaaagtggaggccagtgcagccaccggttgagtgcagccactgggtcagcgcagcggccgggtgagtgcagccctcggattttgccccaataaccagagtcccattagcacagtctgagcagggggcctggcagagcacttcgccctcctctgtcatttagcggggaaacagttcacacagggacaactaccatcttgagtctcttctgtcaactgccctgtggtctctctggccacactgggacagagcatcactccagtaaaccctctgagctcatttccctagctgagcaggttcccgcctctgttcctagagcaccagcatgagtgagcctcaggaaccaccccagattttaggagttaggagtgggtctagctgtgctgatggccacctggggctctggtgaactctagcctcctcccatccgcccatcgagggcatcgtcaggcctctgtgctgagccatttgcctcctgctctgccccaaacctgttcagcccccaacattctcactttcctgtccccttcatgcttcttaggtcatttctctctgcttctgcaaacctccctgccaaatgttcccccaccccaaaccgacccttttcatctctatgtccccccgtgtacacctctctcaaaatgcagggccacggggccctccttcttagggactaggccatgcctaggggtagggctgctgtggcattagtgacaaaaactgctatgtctacccacgtaaatcacataaatatacaagcaggggccaggcgtggtggctcatgcctataatcccaacactttgggaggctgaggcgggtggataacttgaggccaggagttcaagaccagcctggccaacatagtgaaaccccgtctctactaaaaatacaaaaattagctgggggggtggtggtgcacgcctgtaatcccagctactcaggaggctgaggcaggagaatcgcttgaacccaggaggtagaggttacagtgagccgagatcttgccattgcactccagcctgggcaacagagtgagactctgtctc

SEQ ID NO: 242 - DNA, 13810 bp, Homo Sapiens
aaacagccagcggcgaaacagccaagcaaggcctaacagggccccacgaggacgcaccaggaagtaatgaagtcacccgtgcctgtcaagaggcacggcgctaacagaaggctcccaggagcttaaccggatgctcatctggcaacaacggcaagaatcaggcccggcgttccctgcgcagcccggtcggagcccagacaaccggcccgcgggccaagctccggccttcggtgcacgcggcaaagcgcggaaaataaggcggctcggtgccgcctggggactggccgcccacgcccccggactcaccccggaggtccagctcccggtcgcgcaccgcgttggtgtactgcgccgcctgctcgatcagctccgccgtcagcttgaccatcctgcagcctcccgttcccccgcgctgtggaaagcccgtggcctcccgccagcgagacgtcccagcgtgccccgcgccccgccgccaggcagcaccaatcgcagccgccgagtgcgcgcgcagctcgaccgccaggccgaagcaatcgaagagccacgcctccgggggcgttcttgccggaagtcgtggcgcgcgcacaggggatgtgtctcgttctgggttgtttcctagggtgtgtttcggagtctggaggacccctgattccagacgttggtgtttaaaagttaaggcgaatgtggaaacacccgaggggaactttctcatgcattagcgcacctcgaggtgggaggggaagcggtgactgtcctccctccaccagccgtcgcgggaacccgtggggttcagtgaagggtccagcagttcaggtgcccgccccgggcctgggccttggctccgggctacagtgtgagatcccgggctaggtggcccgcctggggcaggtcgccgggacaaccccaccgccccgcaagtccagcccggcctcgggcacggtagggtttgcggttaagcttgtgacctttagacttctgaatattcatatgtatgaaatgtgatatacataaaagtgtgcatatcaggaatttacagtgattaatgaccagagtgaacacagctgcgtagccgacaccgggatccaaaacaccgctattctgaaagcctccctctttcccaaaaggcaaccgcgaactcaacactacaaattcggtttgcttgcttttgctataaatagaatcatgcagtatgcttttttttttggcctagtttcatggagtctatattatgtctggagtccatccaggttgcatacagagatggtttgtttgcttttgctgctgaagagaattccattgtatatattataccataaattacttattctgctgttgatagacatcaaagttgttttcagttagggctattctgagtaatgctactatgaattttctggtacgtggttctgatgcacgtttgcatgagtttgtcctggagtgggactgctgggacatagggtatatctatcatcaataagtaatgcccaacagttatgctaagaggctgaaataatatacacactccagcggtgtgtaagggttttcatggcttccagcttcagccttcttggcattttaactctataacttcagctattctgatgggtgtgtggtggtattgcactactgctttgctttgcttttctctaataactaatgaagctgagaaccttctcatgtgtatggtgcccattctgatagcttccttggttaagtgttctttcgagtccctggctcattttttttttttccttatggagttgtctgccttttttcttattgatttgtggaatttctttatatattagggatatgaacacactctgtggcttgccttttcactcttaatggtgttgatgattagattttttttttttttttttttttttttttttagacagggtctcactctgtcacctaggccggagtgcagtggtgccatcaggactcactgcagccttgacctctcaggctcaagagatcctcccacctcagcctcccaaatagccgggactataggcacaggtcaacaggcctggctaacttttgtattttttgtagagacaaggttttgatatgtggcccaggctggtctccaactcctgagctcaagtgatccacctgcctcagactcccacagtgctgggattacaggcgtgagccgcctcgcctggctgagaagtttccaagttttatgtagttcaattattttctttaggttagtggattgggtgtgtgtgcatgtgcatgtgccttaggaaatcttcccttacccccatcatattttcctatgtggtctactagacgattgttttgcttttcacatttagttctgcaatccacccggagatgattctccttgaacttttattgaagtatgatatacatatagaagaatgcaaactgaacacacccaaccaactagcatcctcgtaagaacaggacattgccacattccagaagccctcctcctgtcttcatctagtcaccacccttgccccaagggtaaccattatcctgccatcttgtatagatttgctttatctagttttgtatttatgcaaatgaagtaccttgcatattttttgctaaacattatgtttgtgtgtagatgtagttaatctattctcactgtaatatggtatttcattgtggatgttttacaatttacttatccattctgctgttgatgaacatttgggtaattttcactcttttatattataaatagtgtacctacaaactcaataatatatatctttatgtgaacacatatactgatatactcccagggatggaattactgggtcatagggcttacttatgttcagcttaagtaggacatagttttccaaagtggttgccaacttaaactccttgctaacgtttagtattgtctttttaatcttagccattctggtagataggtaatggtatgaaattgtggttttaactgtatttccctaattactaacacaattgagaactttaaaaaatatatttatgtttgtttggataacctctttaatgaagtgtctgcttaggtgttttgcccatttttctattgggctttatttttaaactgatttgtaggagctctttatattttttcaataggaaccttgtgagctatgtctgtagtgagtatcttccccctgtggcttgggttttcactctcttaatggtatcttttgatgaatagaggttcttcattttaatacagtctgatttatgaaccgttccctatacagctaatagttttcgagtacgctgtgagaaacttttgcctactccaaaattatattttcttctaaaagctttcttcttccaccttgtccatttagatctgcagtctctctggcctagatttttgtgcatagtctaaggtagggaagaagatatatttttccccatatggatatttggtggacccagcaccatttattgaaaagaccatcttctcccccactgctctgcagagcagctcttttcaaaaatcaagtgtccaaatatgtgagggcctctgcttctgaactagctgttcttttccatgggtttagtcagctatccttgcagaatacaagctttagaaaaagacttggtatttgtccctcaaaaaaagctcccatttttttctcagattatctagtagttatctgattattctaatcctttgcatgtgaacataaattatagatatatgtgaaaaagcacccatgatttgatttgtagtgtgttggatctgtagaagaatttggagagaattaatatctttacaatatgaagtattccaatcaatgggcatattatagccctacatttattgaggcactctttaatttcagcagcatcctgcagattttgtgtcaaggccttgtatatcctttactagattgtctagatatttgatagattttgatgctactgtaaatagtaccttttgtttaaaaactccattttctaatcattagtttgatatatttaaatacagcagatttttgtatattggcgttacatccagcgatcttgtgaaatttacttaagtttatctgtaaccattcttgtggattttctacatacataaccatgctatttgagaataatgatagttggctgggcgtggtggctcacgcctgtaatcccagcactatgggaggctgaggtgggtgggtcacctgaggtcaggagtttgagaccagcctggccaacatggtgaaaccccgcctctactaaaaatacaaaaattagccgggtgtggtggcacgtacctgtaatcccagctacttgggaggctgaggcacgagaatcacttgaatcagggaggcggaggttgcagtgagtgaagatcatgccattgcactccagcctgggcaacagagtgagactcggtctcaaaaaaaaaaaaaaaaaaaaaaaaaaaagatagttttatttcctcctttccaattattatactggttctgtattttttgccctgttacactggctgggatctttagcacaatgttgaacagcggtggtagtggatatgctttggcaggcatcacttcatagcccggaagaaaactctaaccaatgatcgttaacatcaccaataatggaacagatcgtgtactccctgctagaatgcagacagaacacagaatcagcctgtgagattcgtgtcaaagatgcatgacttgactcaaaacgtgaggaaccctcagacaagtgcacagcgaagggcagcctacaaataactggcctatagtctttaaaagcttccacatcatgaggcaaggagactgaggaactgttccagatggaagaacattaaagagacatgatgactaagtgaaaagtgtgtttctaaaccagaccattttgctaagaactttattgggacaactggcagaactagaattcagtcagagggttgatggtaataacataccgatgttaatttcctgagtctgatggctgtgccggagaatgtcgttgttcataggaaatacccactgaagtattggcggggggggggcggtcatagggtatatcggcaacttactctcaaattgggagggaatttctttgtattgtacttggaacttctttgttttctgagatggagtctcgctctgttgcccaggctggagtacagtggcggaatctcggctcactgcaacctccgcctcatgaggaataacatgaggttcaagtgattctcgtgcctcagcctctcaagtagctgggattacaggcgctcgccaccatgcctggctgatttttatatttttagtagagacggggttttgtcatgtttgccaggctggtcttgagctcctgacctaagaagtgatttcccctgccccctgtccctgcctcggcctcccaaagtgctgggattacaggcctgagccatcacacctgccccggtcactgcaacttttgtttaactaaaaaaactaaaaaagttaaacaaaataactaaagaattaaaataactttaaaaagttaaaataactaaaaaaattaaaataacaagttaaaataactaagaaataaaataacttaaaagttaaaataactaaaaatttaaacaaaataactaaaaatgttaaacaaaataactgaataatgaaaaaattaaacaaaataaaacctcaacttcatttaattccagagaggaccaccaggtggagtccttaggctggagagctggttttaacttggggcccttctgttgctgtgtttaaaaaaaaaaaagagtggggtggtatctctttactttaaaaagggaaagttgtacaagtttcccttcagcataggaacagggacagaagtcaaaccatatgtggttttattcattgagggtatctctatgaagttgcaaacaattttcttttttgattccatttcttttggccggaatttctcaacctcggcactattgacattttggtctggacagttctttgtcatgggggctgctgtgcattgcagggtgcttagcagcattcctggcctccacccactggatgtgagtacatccttccagttgtgacaacccaaaatgtctccagacgttgccaaatgtcccctggaagacaaaagtcatccctggttgagaaccactattttggcaacaggatgttctctgccctgggcactttggttcctgttgtttcaaaagggagtctaagatatctggtcacccttagtgtggctggtctgtagtggtgaggggctttggatggtgggactgaatcctaggatctaaggtgggtgctcagtgctgtaccatctaaggatgctgttctgtgctcagataagccacaaagcctggggtgtcaggaaaggacttaaacagccaaccaggaaggatagagtctggggttcgtgcgaggaaagcaacagtgaaggctggggtaggggagcagattcttcctttccccccagcagccagtgcccagtggcctcccagctggctgggcagaaccttaagatgctagagaatggccttggtgtatactttccatcacccctgcttgttcttattaaaatgtttttctttcctgttctccacctcctttttccatcctctgatctgaacctctggccctcacctgctctcgggggccccaacatactccaagcttttaggcaaaaggccctctccagccatagtatcaataatgcaaatgcagtggagggtggtctccccaagttcaaggacactccactcctagactcatttagaccatgttgctatctatctatctatctatctatctatctatctatctatcatctatcaatctatcatctatctatctatctctgtcgtttttgattgattgattgagacagggtctcgctctatttctcaggctggctgcaaatgcctgggctcaagccatcctcttgcttctaacctctcagaatgttaggattacaggtgtgagccactgtggctggcccttttatttttttaagttctgtccaccccccctcccatttcaggtgtgtcttctgtacaaagtgccattctcaccagtcctttgaagagtcgcaagatacaaagtcagtagtggcctgggagggatggggatgtacacatggggtccactgtgaggtgccaaagaatttggggataaggtcaggtaaacatcaccccctgaaaataaagctagtttaaaacaaatgcatcatggctgcatttgggcagctgcagaacgacgcccctcctgcagccagccagcttccttccctgggcccggtggggagcaactttgccaatgtgcagccccaggcaaggcattcacttctgtgggtctcagtgtccttgtctgggaaatgacaggtttagaggaggtgatccatgatcctgtcacttaaaatccatacacatatcctgccagagtccagacaattttaacctcaaggtcggaccacttgtgagcagacattatatgtagttggtctctttcaacaaggtggagtttagtcattaggactttgtgaacaacttctcaactccccacccgacttgtcagccccaagctgggcttgcctggcttagccactcgacgaggctgcctggttggctttcctgtagttgtatctccctttgggagataaagggagtttcttcccttttttttttttttttttttttgagacgcagcttcgttcttgttgcccaggctggagtacagtggtgcaatcttggctcactgcagcttcacctcctgggttcaagcgattctcctgcctcagcctcccgagtagctgggattacaggtgtcaccaccacgcatggctaatttttgtatttttagtagagatggggtttcactgtgttggccaggctggtctcgaactcctgacctcaggtgatccgcctgcctcggcctcccaaaatgctgggattacaggtgtgagccaccatgcccggccaggagtttatttctgattcagctgcaaacatggtagactgtaagctctcagtgggcagctcggatttgctggtatctgggctctagggtctaaaaggctgcctggcaccagcagcacttaacaagttacttttaattcaaggtcggtctcatgggcggggcaaggggttgaatgttcatcccaaacacacttattccttcactgcctcacacgcacaactctggtcaattggtgcttgtggtggccagctgttgggttgtgtgacttgccctgccttctgagagctgcacactgctcccctcctctgctgcagagctccctgcagccatattctgctgcacaagcctgtccttgtagccacagctgatgacacagggagagtacccatgtaaggcaggctgaccaagtcctgtccctgggaaaagaagagccaagaaacagacccagaaagttggcctgaggggttggatttgtaccagttttacctggaagatgctggaggtcttgtcatttgtcccatcaactggagaaggcggccatggagagaagggcagtgctgccgtacagagagggtccaggtgacatttaatgccggctccagctttcccaaggctctgctgcacccctccctgaaattctgaatccactctggattctcaaaacaacgcccctcacccactcttgttttcacctaagtcatttctagttggtgcgtttcctttacttgcagccaaaggattcctagcaagtacaagcttctgacttcacagagaggccatggtaaacatcccaaggagtgcatcagccatgggttcagggatttcagccactgcatagaagacaagctgtaacctaattcaatcacacttggcagcaaccggtgaagaggcagtctgggctctggggagctcccccgtgacagatggaaggggcccctacatctggagaggctctagaacctcctcccagtgaggctaacgtggtctgaaggggtctctttgcccagtgacattctggggttgggatctgggatttcctccattgcttccttacatcaacatttgctaaagctcaaaagaagaccttccacgtaatgacatcaaacagatctgaaaccacagttaaagtaacgtccacttaacacttggtcagcactcatgtttcattttgtgtgccgtggaaagaaatacaggctcctgtgccatgggatgttaactcttttattaatttagggttaacattgtacttgcttcattgatttctctttcagagttgtagattcaataaacaacatctgggttctctccagctcacaggtgacaaggcaaatgcactgtcgtcaaacaggggagcaggacaatatggagaaagacgaggtcgaaaaaatttaaggcaaatgttacttccctattcaagggaattgatcaagcagatctgtgcatttcaatgaaaatatatgaaatatttgtcaaaataattaacatcggtaaaaattagaacatgtagcttataaaatgcctacacaggtttggcagaataaatccaactgtgtcatgtaggcttgtaatatacacagacacaggagtttccaccttaaaaacgagtcttctgaagggcagaggccaaatgtattttaaaagcaattccataaaatgggaagtgatggatgattaacaatgcatggctggctttacattttgttcagaggaattgcttggccatcggggtaccttttggctggccacagaatgcctcctgttgcctctcctcagaaggctctgcatcaggtcgaggtggtcgttcaggccatgagactcctgaagacacagacagaacacggtaacaaggagagctcggcttgctcaaaggagagcgctgcgggggatagaatcttctggtctggctttggaattggactttctaagccactgctgcagtttcagaagtagctgactatgtagaaatagatactccggccccagtggtcatacattttatgccctcaaacctatcttatttatagtctgaccaaaccgtccccagactgctcagtggcaggcaacgagcaggtagactgctggccctttgtcacatgtgaggatggcccagggttcgccagctgggccggggagatttactacacagccgcagaaaagcacggggagaagagtgatgtgtgatgccaagcgcctttcttttctgctttggtcttgaagattcagtaaacttatggtcccagaagctgctccaaagccagagctgtggattcccagaattcattttgttcctgttagtttgtcggaagactggagccaacaagcagcatttgagaggatatcaccattttaggaacacctccttaagagccaccacccacctggcttgggtgctcagagatgctgctcctggggagataaagctgtcaggtgcagggcgccgctcctgaaacagactctggccgacagtctggaggaaggtggacggatggatggatgggagtgcctgccctctgtgggcagctaggcacccttacccggccaggaggcacgtgcggcagcagaactgaatgaagagcttccgttcgcacagccggttggacttcaccatctcgcagaatgtctcgtcagctggggccccgcatcaggaaaggcaaaagagggaaaggtcagtcttcggtgcctgtgaagattgtttcaaggccgggcgcggtgcctcatgcctgtaatcccagcactttgggaggccgaggtgggtggatcacctgaggtcaggagcttgagaccagtctaaccaacatggtgaaaccccgtctctactaataatataaaaattagctgggcatggtggtgggcacctgtaatccaagctactcgggaggctaaagcaggagaaccacctgaacccaggaggcagaggttgcagtgagctgagatcatgccactgcactccagcctgggcaagaagaacaaaactccgtctcaaaaataaataaataaatacataaataaatattgtttcaatcattccacatatgctgggcatcagtggtgccctgggcaagagggacacagacagaggtgggcagcaggatggcagcccttgaagcccctctcctgcaatgcacttgactctgggagccctgtgtggcgggagggcactggtatatggggctcttgctgagtctcagtgacaaggggattcatgagcaggatgtgggggtggtgtgggagggatctcaggagaacacccagcctgggcctgtggggcacatgtgcacctgtctttctggacaactgctggcagtggagcttaggaggaagactgtaggggaggccggaggacgggcctggaggcaggagggaatggaagctgcttccagggtggagggggcggacagggaggagtggggatggggggaagggagccgccgtggacaggacttgctgaggacaccgctgcagcaaggggaagaggcctttgaggatgcatcatccgtggacctgggaggccctccagtggcaaccacacttttttgggctagatacataacctgggcaggtgacttcccaaagaagtagtttctgggcctttgaagggacataattagacaaccctcccgccaccccccaaaaataataaccagtaacaaggcaaggaggcatcccagggccctccacaagctccatgctctgcctggacagggccagtgccagcttcatacccaaggaccacctgccctgaccctggacactggagcagagagccttcctctcctggctgtcagaatgtggctccaccctgctgcttgctgggccagagcccccttccctgcccgtgtgtctacaatgactcctgcactgcacctccaggcccgagtcctgccaaccctccttggtgcctggaattcccaaactgggcacttagctttggtgcccttttaagtttctgtttttacaacttgtccttgtcccccatcctatggcagagccagggctctcctgcagcacagatgcaggtccatgctggatccctgcagagctgggattgctgctgctgagcgtgtgctctactctgggctctgtccccctcgtcctgagcagagaccctccaggcttcctggctttgaccccccaggtcaggcttcttttatggtatgtcgtcacatccgggccaccggcggcctatggcatggcagtgggaccagtacaaggacaaaatcatttttaggagtcactcaataaacagatcagcagtggctgggatgcctctctgatcgatgtgagaggcctagagggaagctgggagacagggcagctgtcttccatatcagctagaggaatcccagacagtcaatcggatcaggggcacgaacgcctgtctgtggagccgccatgcctatgtggctttgcttttctctttggagcacgagctggccagctgagctcctccacaggcagccccagggtaacccagctgctgctcaccgttgctgcacgtgtggttggtgatgcaggaggtccccagctgtgtgaagcccgtcttacacctgctacagttcctgctggagcctgcacagctcaagcagttctcgtcacacctgtgggaagataccgttcctgctgaagtctggggaagaggctccaccactccgggctcccttcccagaaccctcacctccctgcacctccttcccaccccctcagcctcggtcctctgtggagaggctgtgtcgcccaccattccctgacacaggggctgagtgtctgcatgtcttttctcctgtctgacctcactattgccctgggagggcagagacagccatggccagttggcaggagcaagcccaggatcaggggccaggcctccgaggcttcccgcagctcacctggacaccctcctgggccctggcacccagcccccaccccaccacacggctcccagagctgtgtcagtcttctctctccagcggctgccgggctgcgatggctgtaggcttggggtccaggccagactccacccagggatgtgacacacctgactcgagctgaccagaaggctgctgtcacctatatgtggccatgcctgcttaccctcggggagtgggagagatgccccacaattcctgcccctctcggacggtcctggcccagcctgcgcagagatggacaccagccagggctatttctaatgcagggtaaacgtgacctcaggggacggttggtgcactacagcccaagggccacatccagcatttatcctggaccacagtcacactcattcattgacaatcttttgtgtagcagtggctgagctgagtagctgtgacagaggcagtgtggccccaaaagcctgaacgactgaccattgtgccctctacagaaagcacttgccgatgcgggccgagtgcttgaaggagcacgtttcccatcctggggccgtgagtgcaccccggctatgctgctgcctgtcctgagtccagagcccggtgactcggtctccacagtgcttgcatcagctgcccacctccccattgttgccagttaagggtggaacaggccccataggcagggcttggagctttgttgtgctcatgcctgggcctccctggggggcagttctttgctttatacagatgtcccctccctgctgtgtgaagccttcccacgctcagacaccaggcctcctcgtggggctctttgcagagcagccctctgatggggtctggtctcaccacggactccgctgctctggagccccaggtgcagcatcgcttcagcctgggtgggaggtgggttttattcctagtgtgtctgaggatgctgagcctagagctcaagcccttggtctgtaattgtaaatgtgtaaaccccac

SEQ ID NO: 243 - DNA, 2415 bp, Homo Sapiens
aaataattggtgatccacaaaaagaaaataaagtgagagacaaattcctgactcttttaatgtcatactggttaaatattcggggggaaaatttttattaaaaatatgtgtacaaaatactttctaaaacaggcataattcatcacaattaattacagagggttgttcaaacaaatggatctacttctatagatatacatgcatatacagacatagatatagataaatatcaactttccttttagcatgaaaagacaagaaatttaaacaatagtgaactaataaaaatatacctccgttaaactgctcagactcaagaaaattagggtgaataatcatacatcacagatgatgaaagaagtactgtgttctcataccttgcatattacgattataaagtgttccacatttaggggttggcaaccaaacaatatctattaacaactaaaatatagaaaagcaaaatgcagcaatgctggtcctgagaatctccccagagtaataaacgcaggtataattacaagagcaaaatgcaggacaccaatacttctatgatatgacctgtatttggtgttgggctttacaggagctctttctcagacacatatgcattatctgtatcttttctgagattctactaactttatggtgaaatcaacaataaaaggttttcattttgataaattggttttcaaaagagaaagatgttacaagaccctttcaacttgtcttgcaagtgaaggctatatctgaggctgccaagaaaagttattgacaaaggcatggcaaaatgttaatgtggttttgttgaccactgtgtttgcagcacagtggagaaacagcgtggttttctgtccttgctgagttttatgcattttaaggaatcatatttgttcattccacattgcagaatgtttcttgcattttcatttcctaatgcagactaaatatcttatgtggtttgcaataattctctccttttaaaggtatttctggagtaactgcctggtctgtaacatgtttgatggatacctaacccttaaatattacaaaattttatgcacaatcactacttgattttgatggacataaaaacacgtttttaagttacagtagcaagatattatcgttgcctgtgttaactcattactgatactcggtttataatcatagccaccctttgtgaaaaggttagcttgttacattatggttatgctgagggaagaacaggctatcctggatgcttgagggcctctcgtggtgactgagtgttggcactagtgtcagttcatatctaaatattcctacatatgtaatgtactttcatattttttttgacaacacttgtctagggaatatttcaactctactctgtgcttttgggattcaatgggaatcccctttcagatggtcaacagtgtgagccttattgattgacctttttgccctcttccctgaaatatattctctaggtttaatctgtggaattagattttaagtcacattttcttgcgtaaatgtatgaaagcaggaaaaccggctgttgctcatattaacagcatttttttcacatagtgtaagaaaaacagtggtcttattcaccagaccaatcttgtattcccgctggtctcacagttcaagactcccttccccaggctttttgttctgaggtctggccatacaagcatcctagctgagtgggtggaaacgacatttacctggtacaggcctgacctgtgaaaacaccctctgtgaagccccaaatattttttgccatacaactgcatgaaattttcccaagcaccatagccagatttgaagacacaggttagcaatgagaaatacaccaatagaaggtatgggggtccctaaatccatatttggaggaaaatccacaagcagagtcacatgacatttgaaagcctgtgttgaggtggtatatgccagcaatgataaatattacatgatgatcaaactgctgataaattcaggtttgtctattacaacagctaattttacgttaactgtaacaaaaatatattgaagaaaagtttgcatggaaatttttatttttatatttatttatttgataaatatcaactttccttttagcatgaaaagacaagaaatttaaacaatagtgaactaataaaaatatacctccgttaaactgctcagactcaagaaaattagggtgaataatcatacatcacagatgatgaaagaagtactgtgttctcataccttgcatattacgattataaagtgttccacatttaggggttggcaaccaaacaatatctattaacaactaaaatatagaaaagcaaaatgcagcaatgctggtcctgagaatctccccagagtaataaacgcaggtataattacaagagcaaaatgcaggacaccaatact

SEQ ID NO: 244 - DNA, 4042 bp, Homo Sapiens
actggacatcaccaccctgtccagacacccagagcagagtgggggatggggaaggtggcaggtgggggacaaatgggttgatatttatagcagacaaattaataaagctacagataatgcatttagacaacaataaaaacacttgatatcaaaacctaggaaacatctaaagaaatacttagtggtccatttatagccctaaatacctgttaccaaaaggagaaggtttaaaaattaattacctaagcattcaacaaaggaagctgaaaaagaatcacagggtaaatccaaagaaaatggaaaaaaaataaaagcataaattaaggaaacatgaagcaaagaaacagtagagatgcttttatttttaaatagttctcaaaaaacaaccctctggcaaactgatcaagaaaaaacaggagtgaagtcacaaataaagactggcagatagcagtgaagttgtaaaaattctaaatgaatgtaagaaactactgtgagtattgtactgataaatgtgaaaccaaaaagcaagaacaattttctagaaaaataatattgcctactgtaactcagtaagaaattaaatgcctgagtagacttaaaacattaaataaattggatttgtagttctttttaaagccatgcacagccactcacacttacataaaaattaccagaacagatggttttaccttctgccaaaccttcaaagaaagatactccttacatgacacaaattgttctagaagacagaggaaaagggtaatctctccaactcattttataaagccagtatcaccttttagctttgaaataaaaaacaggcaaggatagtaccagaaaggaaaattatgggccaatttcagttataaacatggatgaaaatgttctaaataaaatcagagcaaaaacccctcagaactaactaaatggtttatcttagaaatagaaggttgaataaatgccagaaaatctatcaatgtatattcaccacataagtagacagagggagaaaaaaagaaaattattatcttggtagatgcagaaaaaaagtttatgacaaatttcaccatgcatttatgataaaaactctcagaagactaggaaggaaatcttcttactttgataaaagataatatcaaaaactgagagtaaacatcatatctaatggagaaactttagacacgtgctctttaaaattaggcagaagatggccgggcacagtggctcacgcctggaatcccagcactttgggaggctgaggtgggcggatcacaaggtcaggagttcgagaccagcctggccaatatggtgaaaccccatctctactaaaaatacaaaaattagccgggcatggtggtgcatgcctgtagtcccagctagttgagaggctgaggcatgagaattgcttaaacctaggaggcagaggttgcagtgacccgagatcacgccagtgcactccagcctgggtgacagagcgagactctgtctcaaaaaaacatataaataaataaaataaaaaataaaaaaattaggcagaagataagcatacctgattccaggcattgttcagtatagtactagatgatctggaccatgctctaagacatgaaaaaaagtaaaggtataaggatagttgcatagaaaataaaaatattcaacagataaactgatagacatggtaaaataaatcataacattcacctgattggtaaaaactacagaaatcaacagtgctcctatacatcagcaaaaatcaacaggaaatataacagagacacttttgtctctggccatgatggactaactggtattggaccagccctaccactgtaaacaactagaaaactggagaaaacatatgaaacaactgttggcatatattggacaagaggcagcccaggactaagatcttgagagaagagaaatgtaagaggcaagtcctatgattaccctggctttctgcctacagatactttctggacagtggcacagaagtgggggaaaccaagcagaccatggtgctctctctgagtcagagctcaggagaattaagtggttggaatttgtgaaatggagcaccagagagaaagaagggaactcctcaaggaaacaactccaaaatcctgcatagaccctttgagtctttggctgaaaactaagctgtgcacaagatgaaactaactctttgaaactgggcaaagaacaactactgattatctgtctgctgaacaagtctcagagttcacacagggctagaggggttcaagttctgataagctaaagtagaatgacttcgttggaaacttgggacgttcagtagaaagcccaaaaaggtctctcctatagctactctagacctgctctaacaaagttcaaaacaagtcttgaaaggatcaaatttatctgtaaattaaatgtccaccagaagaaggcctaccactgtttaacaaaaaattaaaaattcagacattcaacaatgtaaaactcacaatgtccatcatctaaggaagtattactagacatgtgacaaagcagaaaaatgggacccctaaccaggagtaaaattagtaaattgaaagagaccaagaaatgacagagataaaattagcaggcaagaaattttaaatgcctgtcagaaatgctcaaagatttcaaggaaaacatgaacacaatgaaaagaaaaacatgaggtatagataagaaccaaatgcaacttctagagctgaaaatatagtgtgtggaacaaaaaaaaatttactgaatgggattaagaacaagattacacactgcagaagaaaagatcagacaacttgaaagcaaggcaatagaaactatttaaaatgaagcacagagaaaaaaaaactcagagctttagtaatctgtgagacaatatcaagcaatataacatgtgtctaattcaaattccaagaaagggggcagaaaatatttaaataaaatggccaaaagtttccagactcataataaaattataaaataaaaattacaggccaggcgcagtggctcatttctgtaatcccagcactttgggaggctgaagcgggcggatcacgaggtcaggagattgagaccatcctggctaacacagtgaaatcccaggttactaaaaatatgaaaaattagctgggcgtggtggtgcgcacttatagtcccagctactcgggaggctgaggcaggagaattgcttgaacctgggagtcagaggttgcagtgagctgagatggtgccactgcactccagcctgggcggcagagcaagactctgtctcattaaataaataaataaataaataaataaataaataaaaattataaacccttagatccaagaacctcaatgaatataatgaacaccaaaataaactataccaaagaatatcatatctacacttttgaaaaccaatgataaagagaagaccttaaaaacagccagagatggccaggtgcagtggctcatgcctgtaatcccagcactttgggaggctgtggtaggtggattgcttgagctcacgagtttgagaccagcctgggcaacatggtgaattcccatctctacaaaaaatacaaaaattagccgggcatggtggcatgcacctgtagtcccagctacatgggaggctgaggtgggaggatggcttgagcccaggagatgaagattgcagtgagtcgaaatcatgccactgcattccagcctgggtgacagagccagaccctgtatcaaaaaaaaaaaaaaaagacagagagaaaaggatgagaattattacagacctcttttcagaagttaagcaagacaaaagaccacagaatgacatctttaaaattttaaaagataaattttaaaactgtcaacctagaattcttcatccagagaaaatatccttcaaaaaatgaaggtgacacattacccacaaaaattaacttaaaatgaatcaatgacttaaatataagagctaaagcctcaaaatccttagaaaagaacacagaggtaaatcgccaatctccatgaacttggatttggcagtgga

SEQ ID NO: 245 - DNA, 8030 bp, Homo Sapiens
agtccttggccgtctcgcggccgctgacgaactggaactcgttgggcgtgagccactcgccgcggtggcggatggacgggcccttgctgccctggcagagtttgcgcacgtagagcagcgcgcggttggcgccgcactccacctcgatgcacggctcgccgttgtccagcagcggctggaaatccggggccgcggccgcggtggccgagaagcgctcgagggccagcgggtccctgggcaggtggaggtgcggggcggcctcgtgcaggctgaggagtgagttcgcccgagccacggagttcctgttcagtcttttgcagaagacgctgagacagaaaggtcaagtaactctcctgaagtcacacagctgtttcaaatgcaggatgtctcacaccaggaccgcgccaggaccatggtgtggggcaagagcttcctgtcaccccacacctcccagcaggaaggtggtgtggatccgaggcagggtgagggtgggggatagcgggttggcagagtgcacggcctcccactaggaggagcaaggctagtgaagcaggaccggccacaccacgtccaccttggtgccttctgacaggtcagtctgggccccagtccctggttcctggtgagcttcccatcaccccccacctccctgcgtgcccagatcggcattgcatctggagcgttccgaagagaaacacaacctgggggcgttggtaacagcagccaacccgcggagtgaggtctgggccaggagtgctctgctcaggcaaggaacatgcccagaagcctcccccgctatcctggccctgttctgtgggggctcgttggacaccagcacatccctgaccccagctgtggctgccagtgagttcctgtgccttcctctcctgaagtctgtgtcttctcccaggtctgataccatgtggaaagtctgctcctggggccagctggaggccatgtggactggccctgagtgcccactgtctggatgcagccctgaccctactgcccgtgtgtgggctactaggttcacctgcacctgaccctccttctaggttcgcctgcacctgactccctgatgttcacacagtgatttggagagggaggctggggaggcgcaggtctgcatggcagtgcctctcagggtctgaggcccttgggccaggcctctcctctgacctgggccagcagaggggcctcctttcccttccaagagccctcccctgttcaccagcatctcatcatgctcaggcccacagtgtggttaaggaggggcatggggctggccctgggtttctggctgggtgtgggggcctacccggggcccatggtgtcttccagaaaagaccctgactgggtccaaagctggaggcacccctctatcctcactgtccactccctgatgttctggaggtccctccaggggctgggtgaggaggccttccccaccacctccttgtcttcctgggaagcaggcacccgttcagaggccacgttcccacaggaccaggctcctcacccccagcatcacccttttccacggggttgtgccccttccttggtcctgtccactcacacacacccgtgtccgtgtccatgttcacacctgttctgtgtccactcccacacacctgtgtccactcccacacctgtgtctcgtgtccactcgctcacacctgtactgtccgtgcccactcacacgtgtcccgtgtccactcgctcacacccgtgtctcatgcccgctggcttacaccagtcccgtgttcactggcgcacctgtgtcccatgtcttgtgtctgctcgcacatctgtgtgatgtgttcacttgctcacacgtgtcctccactaccacacctgtgtcccatgtccactcacacacctgtcttggtctgggacacctgggccccactctcccctgcactcctcaggctggcggcagaggccagaggaacggagttctggcgctggaatcatcctgagcgaggcagggacctggcggtgtggactccaccgcccctcctccggcccaccgagccccgcctgcctgggccttggtgcctctgtcgctgctccgggtccccctgctggggcccctccgccgctgggctgaggctggagcctgcctcccgccgccagagggaggaggtcataaataaccctggggctgccatggagcagacggtgaccccagacgtcctgggggagtgtgggggcgccaggggccgctgccccagcccgcatgccgcctccgccatccgggagtgcctgcccaggctccccagcatttctcttagagcccttctcatccatcccctcatcaatcaatcaaccatttattgagcccagatgtggtacagccccagccggagatgacccagaggtggggtggggaggagagagatggggaagctgagtccggggccacaggtgcagccaggaggtgcaggtgagcagcgctcagaccagcctgtcagcctcagtcctgagcttacttctggtgatggagggagatatacagaaaagatcctgcagcctgcaggtgtggcacagctgatcttgggccaaggatgcacagctgtgtgtgtgcctggccaccggcaagggcacgtgggctcagaagcacaggtgtgcccacaccctgcgtgcctgtgtgtggcgcagcagctcccgacgcgcgcaggacacacacacagcacagacagaccctcccatggccacacggacaaagatggcttcactatagacaccggtgcagacaggatgtgcactgctttccaaggcctgtgcgcaacacagactcagggcctgtgggcatcagcaccgcccagacccaggcacacgtgatcctcagccaaggtggcctgtccagtcctggtgctgttggatggaaaggctaacctgggaggtcaggggctgtggtatatcagctgggctccctcggacgctcctgcagaagtggccaggacctcaggaacgcacctgctcctggtcagacaggaggggctgccgtgatgcaacttgcccgtgcctttgggtgctgtgagctggctgcgtgccacgtcgtttcgaggacgcaagaaggtgtttccaagtccagtctgtccaccgacctgaacctttaccattgaaagaacaaaggggtggggcccgagggacccttccctgccgtcccgtggtgtgtagtcagggatgctcctgcagacacacaggtgggctctgactgccagatcgcaggggcggtgccgtggtcctcacctgccatgtcactagcgtgctgacgcagacaccggcgagagctacagtgctcggcccggcacatcccagacaattcctctgtaaatgctgcagcagccagaggccccagcaccttgaggttaagcaaagagaaggaatagagttctccagagccccaaggagcgggagggtctgtcccaatggatgggctcagccaatttcaccctctcctccccctgccaacactgcggcctgcagcctggacctggcccgggttgtggaggggaccggggatgcagctgccacctgctgggcggacgtgggcctaggtggtcctcagccctcatgacaggagcccccgaagcactgttgcggcaccctctctgacattgggtgggagactctgggagccgagtgcagagccagggcccagcacgaaggccttgggctccagtccgtgtgccccacatccctacatgagtgagggtggagggatggtgcctctgccacggccacggtgccgccgtccacgtcagctcactctcagcacaggtgctgtgtgacggcctcgggccacaccgcttgttctgaggcccctagcaggtcgggcttgtgctggctgcacattggctggtgagcttggcgggtctgtgggcacggagagaccagaacgtgcgtaacaggcccgatgagggtgccaggctgtggcgacccccgagcttcagaggagaggggcaccagccgggggccctgcacaggcagcctcagagagaggaaagctcacgatctgggagaactccaggcctggcccagtgaagacgtccttatcttcagcagacattgcccagtgcaaggggaggtcagtctcaggagacagtctcctggacagtggcgtggcatctgtcctaaggccttgcctgcagcacagggtgccacagaggtcccctgtgacagagcctcatggctggggcaggcgggggtcgcacctgctcctgcatgaagaggcagataaagacccacagcatggtctctggggtcccacatcccaggtagagaatgacccaggtcgctggcgtctgtgccatctctgctccactgaccactcatgggggtcctggagatcctgacaccggtggccggggagcagcagcccaggcacaggccccagtgcacatgcagatcccaccgtgtctgcacaaggccttgccccaacgaggcctgggtgccgtgtgagggccgggacgctaacacagcggagggtacccacgcgtgagctgctctggggtccctccccgtgtttcttcctgtaatgaaacttgtacccaaatgggatatgcagggttgcactgtgcagtcgctgtgtgttttagggtctcatacccgtgtgcgccagcaggaccacagctgtgaccggctgctccagaagaagtgggtgggttgagaccccaccggcagggtcactgggggtagcaggccctctgtcagcactgacttctgtatcatgtcagggatttttagggcggcaagctcaggtggacaggcagttttattctgtttcccatgtcaagtccagccccagactgactttctgaggtcacagacggagcctcaccccatccaaggcggtgtcctggactcccactgtgctccccagagggcagggtgagtgcgtggcatccttttggcgggcgtgggtgcctctgtggacctggcgtgaggcttctctgtttctgagtctcctatggaccatctgtcttctgtgtggctgctgaggaatcacactggggtggccgtgccggtggctgaatgagaacaggacccccatgctgcacagccctgcttaacgcgggggtggccccagaagcgggtgggcgaggctgggcagcagggattggctgaaatcatatgcagagcccaagaggcaggggaaaggcggcaatttcagggtccctttgttcgccaggtacctggggcccagcccgggcggcaggagggactcagcccctcgcccaggcaggaagggtcccaagcagaggcccctccctcaggcactccccagcccacacctgcagcactgggaccaagactaataaaacaccagcctcacggaagacagctttatcttgttgatcggaagtctgccagcccaatttatgatggaacataagatctctaaatctgaatttacgctctgtagcgtaacgagaggtcaataagattaaacgggggctcaggagaggaccagcgtcaggctcactgcgaggtgctgcacagaaaacccacagccagagcccctgggcccagcccaggcaagaccagaaaaggagggggcaggtgggagaccagcctggggctcccgggaagcccacgggatggaggcgggagagccaggaggcctggggcaaccctgggacggttcctggatcgaggagagcaggggggtgatgagggttccctcagggctggggagccttctcctggtctcagacccaccccccttcagctcccaagccctgggtgcccctggctctgaggacagttgggaatcttccctgaggcaggttcaaggacagagctctgaccctggcccagggctgctttgggtgcctatgaactcggcttctggctcagagcagttccctgcaccccttcctgagccctctgtcctctggaacccgtgggcagggtgagggacgggtgttccttctgggtgggggcctgggcgcccagccagcacgacgctggcttgctgagcttagggcagaccccgacttcagaatttatacaaataaatgcaatgaaaagtgctggcaacctgatctgattacagagtcattcattctctggtcgttaataatttgtgcaataaaggactgcagccgctcagtgcgggggaggctgtggcccaaccttccctcggcgccggccccgggagctggaagcataaattattagtttcttatcgctgggcctgccatcgctcatgctgccagggcctggcgggagctggtggctgttctgctgcccgccctggccggctcagggccggctctcagccgtcgcctggggccctttgtcacccccaccctggccccccaggtgtgggagccccagagcctgctcaggcctggaggctgctgctggagccggcaactctggaagccagaaaggtggggctttagtgcctgtcctcagaccctcaggtaaccaaagccaaattactccctgttggaaacacaacctcacataccgggccacagcacggacacccacgacagcaggccacagcacggacacccacggcagtggcccacagcacggacactcacagcatggacagcagcccagagggacccttgcccagaccctgaccagggggaagagacagttgtgtctgggtttgtcagtcctctggttgtggcagggcccctctgggtgggactcggcacctgtacctgggagcacctgctcagatgagggagtgggagcaggaacagcgctcatgctctctccctgtgtccagggctggggccctggtctggcgggtaggcatagggcacctcctgccctctcatgccctcatacacctgctgctggggttccctgtcccaccccaaaagggagaagccaaggctgaggcaaggttggaaaatcagggtggggactctggaatccagacatcccgacagaggatgcaggaggaatcggcgtgagcgcagggtaaactcacggacccgaactctcagatgtgcttcctgggctcagcttcccctttctggagggctgggggttccagaaccttgccttgaatttgtgaggatggtgggacctggagggcaggtggcgcagatggtgtgagccctcaccccaggacgctgtgcccacttctggctgtgcagccttgggaaggcttctgacttctctgaacctcaatctgtaaaatgggaatgagaatgaaacaagatgaaattaacatgcattgagcgtgtggggtggggcagagacagccaccttgcagctggtgaggcccttacagcatctggtcctgccacctcgcagctggtgaggccctcacagcatctggtcccggagcccacacagccctttgcagagactgccctacccacgtgcaagcgtttcgccctcttcccacgggcgaccccagcttggccgcatgcgtttttgctcagaacgtccccacctatgtcccacctgccctctggcttcgggagtgctgggcgcagtggtggcaggtgcctcggtgcccttggacttgcccggtcgtctgttgcttctgaggcggccccgttgatgggtgctccttctcttctgggtgcattttccttttcctgcttcctcgcatgcctggtgatttttgaatgggtgacagggattgtgaattttgctgggtgctgactatttttgtagcaaagctgagaaaagcttactttgctcaggactccaggaagttacttggaagctgtttggtcctttggggtcttgcttttaagccctgctgggaggaccaaggcagcttgtagtctggggctgactgtgccctcctttaccagggcacggccctgcttggtgctctgcccaggggctgaggtgccccagcctggctggtggaccacggaccttccacggttccctctggtgatctcgggtggttctcctcaccttctgtagttgcctttctttttttctttttctttcttcttttttttttttttttgagacggagttttactcttgttgcccaggctggggtgcagtggtgcgatcttggctctcca

SEQ ID NO: 246 - DNA, 1723 bp, Homo Sapiens
cttcccaagtgagaagcagcagggtggtgcaagatttcatcatgcttctcagaatgacatgcaatttaagtcatataaattgtttatttctggaattttttatttaatatttttgtacagcagttgactgaggttgaaggaaaattaccctggatggaagatcagaggtatagaaagaaatggagagcaaagaaagagtttgatgattccctccttggagatcttcacctgcagttcctggaatgagtgatgctgcttccacatggtcaatttcaccccttcatatctcttctgcatctatgacacacctttatcttcttgttgctgaggctgcctcacccttagcagaagcttttggtggcacttatggccagctaatcaacttgactatcaggcagcaccattccgcagagttgtatgtgatctatggaaaatcgacccctctgccctgctttcaatgaacttgtaacttactactgacaagaggcttcttattcttctataggcagctctaggtacacttacctttgcttttttgttcagccatgggtcaagtaacttgctctcatgtctctgaaattccagagaatgcatattagcctcccaaatggttcttttgaggcccccttcaattgatttgagatgaaaggggagtttcctttccctcccatgtaagagagagataatttataatgctctgacaatagtctccaaaaaaaaatcctcattagcagcctcttcaccctttcagtggatatttagctatctcttagtctggaggcgaatgatagtcttcaaatatccactggaatgtaagcagcaataaagcagacattttttatgtgttttgattatttctgtgtcatttggttttagagaaaagcctgacacatagtaggctgtcaatagatatatgttcaacatatgaatgaatgaatgaaaaagcaatcaggcactttgatttagaatgtgtgtatacacacacacacatcatatatatatttatatataaaacaacagatgtcatacatatacatatatacacacatcatatatatatttatatataaaacaacagatgtcatacatatacatatatacacgcatgtatgtatatatgtatgcgtaatgatatacatgcatgtatatacatatatacatacatatatgtgtacatgcacacatatatgtgtatatatatatatggcacttctattgttttcagattttgggatgtctgctgaaacaaaaaaatagaaaccccaaaacaaaaaatccaagaaatatcaaatttaatattctatcatacttatttaattttaaaattatctttacaaagataacaaaatccaaagtttgtgaataatctttcaatggtgatatccaaaaatacatgtgtttttcagggaccaaaggctataaatccaaagccagaaatttagctaatcttaggcagtccagaataaataagaaatttagtttattttagtaatttgaatcatccattttaagattataaatcctagttaaaagcttgagaatctatgaagaatgtgcaaaagtagaatttactagactctggctcacagaataaggtacattttagggtcagcatctggaaatacccctttctcatatttctctgttacgtgtctatgcctttaaaacagaagttttaaaacttgttgtatggatcatgttggaaataaagactatgaatcaa

SEQ ID NO: 247 - DNA, 1332 bp, Homo Sapiens
gagaaataataaagaccagagtagaaataaatgaaattgaaattaaaaaatacaaaggattcatgaaacaaaaagttggtttttttgaaaagttaaacaaaattgacaagcctttagtcagactaagaaaaaagagagaagattcaaataaataaaattggaaatgaaaaagaagacattagaactgacactgcagagaatgaaaggatcatcagtggctaataggaggaactatataccaataaattggaaactctagaagaaatggacaaattcctagatacatacaaccaaccaaattgaatcagaagaaatccaaaacctgaacagaccaataagtaatgaaatcaacatttttactactgaattctaccaaacatttaaagaactaataccaatcctactcaaactattccaaaaaatagtggaggagggaatacatccaaactcattctatgaggccagtattatcctgataccaaaccagagaaagacatatcagaaaaacaaaactactggctcacatatctgatgaatatttataaaaaaaaacttcaagaaaatgctagcaaactgaattcaacaacacattaaaatatcattgatcatgactgatatggtttggctgtgtctccaccgaaatcttatcttgaattgtagttcccataatcaccacgtgttgtgggaggtacccagtgggaggtaactgaatcatgggggcagttacctccatgctgttctcatgatagtgagttatcctgaggtctgatggttttataaggggctttttccccgcttcagtctgcacttttccttgttgccatcacacaaagaaggagaagaagaacctgtttgcttccccttctgccatgattgtaagtttcctgaggctgatcagccctgcagaactgtgagtcaattaaatctctttcctttgtaaattacccagtctcaggtatgtctttattagcagcatgagaacagactaacatagtaaattggtgccaggtagtgaggcattgctgtaaagatacccaaaaatgtggaagcgactttggaattgggtaacaggcagagtttagaacagtttggagggctcagaagaaggcaggaaaatgtggtaaagtttggaacttcctagagacttggagggctcagaaggcaggaagatgtgggaaagtttggaacttcctagagacttgttaaatggctttgatcaaaatgctgatagggatatggacaataaagtccaggctgaagtagtctcagatggagatgagaaacttgtgggaactggagtaaaagtcactcttgctatacaaagagactggc

SEQ ID NO: 248 - DNA, 1458 bp, Homo Sapiens
ccctgttaactgggcatggaaggaaggccaagtctgccattaagtctctttttgagcctgtatatatttgcataaggtccattaactatattaagtggtcatagataaaccagatacttataggcaactctaataaactacatgcagctttgtagattatttgcaataaaattttaattttaacaatcctttaattgttaaattaaagcctgcctaagctctcttgtagtattttgcatatgtctggggtggatctctttattggcttttggcatatgcgtttggtttaaagcagtccaagcaaaacataagtagaaaggtaggcttactgattatatatggtatatatatttacacacacacacacacagagtaaacagccataagaactatgtccagctctttctaatatagctaagtaactgtaacagtcagttagtccacctgaggaccccagctttattttttaagtaaaaataaaaatcttacttgttatcaaaacaatatgttccttatagtaaaacagaagcaaaatttttaaataggaaatttggaacacaataatcataactccaccatccagggataaccactgttaatatctaaggttgtattcttccagatcattgtatatatactgtagagtttggagtcatactattcattttaatttaaaataaacttaaaaaaaacttagcaatgtattgtgactatctttctttctttcttttctttttctttttttcttttttttttttttggagacaggatcttattctgtcacccaggctggagtgtagtggcacaatcatagctcactgcagcctcaacctcctgggctcaggtgttcctcccacctcagcgtgtcaggcagctgggattacaggtgtgcgccaccatacccagctaagttttgtttttgtttttgtttttttgttttttgttttttttgagagatggcatttcaccatgttgccaaggggggtctcacactcctgggctcaagtaatctgcctgtctcagcctcccaaagtgctgggattacatgagtgagccactgcacccagtccctatctttccttccttcctccctccctctctccctccctctctctctctctctttctttctttcgacagagtctcactctgtcacttaggctggagtgcagtggcccgatttctgctcactggaacctccacctcccgggttcaagtgattctcctgcctcagccccctgagtagctgagatcacaggcatacaccaccatgcccagctaatttttgtatttttagtggagatggggtttcaccatgttggccaggctggtctcaaactcctggcctcaagtgatccacctgccttggcatcccaaagtgctgggattataggcgtgagccaacgtgcccagctgggcccctatcttttaataataataaatattcttcaagactttc

SEQ ID NO: 249 - DNA, 1941 bp, Homo Sapiens
tcttacctacggatgacactcctgtgcaagaagatggagaggcagaatttcaaatggtggcagtgaaacctaaagccaccgggggctttggatgtgagcctatcagaggctcaaaatggaaatgtgtcagaagaaacagtggggcatggaaaagttaaaaaaatccctaaaacatgttatgattgtgggcttgtcagaagccccaaatggagacatgtctaaagaaatagtagaaaatgtaaaagttaaagaaaactagaaatctatcatactaaccagtgcagaagcagcaattcagtctctagattcgaaatcaaaaaagaaaagaagaacaagagaaaaatagtgactaatgctgggcgtgatacaaaaaaagcaaaaactgaaaacaaaggggaatccgaagaagatggtatcgaggctcctgaagaaacagaaaactggggggaagccagacaatgagagagatgagaatacttcatttcttctctaattttgtcagtgaaaacactttgaaggcaataaaagaaatgggctttaccaacatgactgaaatttagcataaaaatgatgggccacttatggaaggcaggatcttccagcagctacacaaaccagcagtggcaaaaaccctggcatttctcatccctgcatttgaactaattgttaagttaaaattcatgtccagaaatggaacaggagtctttattctctcactaattaaacagcttgtcctgagactcttggtgttcttaaggagctaatgactcaccatatgcacatgcatgggttgataatgggtggcagtaacagatctgctgaagtacagaagcttgcaaatgggatcagcactggtggtcacaccaggccatctcctgggctgtatgcagaattctgcaggatttaagtataaaaacctatggcgtctggttatggatgaggctaatgatatcttggatgctgggtttgaagagaaattaaagcaaattattaaacttctttgaacatggagactatgcccttttccgccacacaaactcaaaaacttgaagacctggcaaggatttctccaaaaaaaaaaaaaaaggaacaaatgtatgctggtgttgataatgataaagctactgcaacagtggatagtctcaagcggggatatgttgttcgtccctctgaaaaaggattccttttgctctttatattccttaagaactgaaagaagaaactgatggtcttcttttcatcctgtaggtccataaaataccactatgagttgcggaactacattgacttgcctacctcagccattcatttccagaagcaaaattacgtgtagaattacattttttccagttctgtaatgcagattcagggatattgtgtacagatgaggcagggagagagctagatattcctggctggattgttcagtattatcctccagatgaccctaaggaatatgttcatcgtcgggggacaatagccagggacctaaacgaaagagggcatgccttgctcagtttttgcccagaagaattgggttttgtttgttacctgaagcaacccaaggttccattaagtgaatttgacttttcctggcctaaaatttctgacattcagtcttggtttgtaaaattaatgaaaaagaactactttcttcataagtcagcccaggaagcatataagtcatacatacgagtaaatgattctcattctctgagacagatttttaatgttaataacttaaatttgcctcaagttgctctgtcattcggtttcaaggtgcctccttctgttgatgtgaatgtgaacagcaatgaaggcaagcataaaaagagaggaggcgagagtagattcagctaccagaaaaccaagaaagttaagtccataatctttaaaaacattagcacgaaatcatctgatagcaggcagttctgtcactga

SEQ ID NO: 250 - DNA, 2811 bp, Homo Sapiens
ccgatgccacaccaaatggctagagggtgtgtttgggatgacctgagtctggtaggcaacttccagtggaccccacggtgcgaccacctccctttgagtgtgggggagatgtagcgactggcttctagcagtaggatagggcagaagtgacagtaggttagtcttgtggttaggttacaaaactgacctctgtgatggtagcgtccctcgtcagccctcttgtcttgccctctcgctggctggtggtgatggagccggctgccatggtgagcggccctgtggagaagccagggaggaatggagacaatctggagaaacagaatcacaccaacaaccacgtgcgtgagcttgctgtgtgctcttgcttgggagcaagttacaggttcagcccaagaggagcggaccactccagggtgtaaataccaggagggggaattggaagactaccctaagcatgccgaccggagactgtgtgtgtgtagtaggtatttcttactgggagatcacggaaaagcaagtttgagaaacactcccatcagatgggtgggccgaggataacctcaaagcctttggttctccgaataggtgcgtaggactcacccaggcactctttccttttttaaattgtggtaaaaactacataacagtggccaggcgtgatggtgcacgcctgtaatcccagctattagggaggctgaggcagaagaactgcttgaaccaagggggcaccgctcctggctgtaacatgttttcaatatcccccctcttcggtggcacaggggctggccccatatacatgtgcgatggcaactgacagggtccctgataaaccggagtgctccagaaacaccccattgcgtgggacggaggatgttaggtggccctcctagcgtttgagtttgataaatgagcaaaggaagtggtttttactagaaagccagctttccttttttttttttttttttttccagccagcaaaccccaaacaggaacctatggttggtgatggatgtgcgttcagaaagcagggagggagggggagtcagaggtgagggggtcatcagccatagctgtccgctgcatcaccccctcgctatctccaggaagcgttctgggcttttcctgttgtgcagtgtggaagtgctctatcttcattcatatcaaggaaagtcaaaggacaaactaaagccggcagcgtctttctggcttcctagtcaggctgttcggtagcggagtgtcaccctgatttccagccccgcagcacacacagtgagagcctgcctggcgtgattcagaggcaacgtatttcccaaggtggctgtgaaggaaccagggggataaacacagcccgtgaaccgcacgccagaggacaggtccggctgcctgccgcggagtcgtcacggcgtgtcgcgtctgagcgcttctccaaagcacccaagtggcacccggggtgacagttacatcatcttgagtacagttctctcaaggaaaaagcaagcccagcatcttctgccatggcaaccctggcttggagcctccataagagagaaggccctaagaataataccattttcttgctctaagttgctcttacgggaaagaagtgataatattcttcctaaacgccatcattcgtgcatccttcccacctatatgtgtcaccggatcattctccgcctgggcggggccgtcctgtgcactgcagaatgctgagcagtgtccttggcttcgaccgaccacatgccaggagcaccccaatttctgccatcgggtgattgacttcactgttgcatttgattttttatgtatcttttaaaaggacccaatagggccaggcacagtggctcacacttgtaatcccagcactttgggaggctgaggtcggtggattgcttgagcccaggaggagttcaagaccagcctgggcaacatagtgaaaccccaactctacaaaaaacaaatgttttatttttatttattttagatggagtttcactcttgttgcccaggctggagtgcagtggcgcaatctcggctcactgcaacttctgcctcccgggttcaagcgattctcctgcctcagcctcctgagtatctgggattacaggcatgcgccaccacacccagctaattttgtatttttagtagagatggcgtttctccatgttggtcaggctggtctcaaactcccgacctcaggtgatctgcctgcctcggcctcccagagtgttgggattacaggcgtgagccaccacgcccagccgggtttatagttttataacccttatgacaaatctcatagtattctgcagggataagcatgaaaccactcgttcaataagtgcaaacaaaaacgccaacaattcttaagacatttctaatcttattttaccaataattttaaagccagcttatgtattaaagatttataactacttttattaacacgtttaaaattctatgcagcttaaagcatttataatggataaaactgccaatactgagtgcctgacataatatttgaaaggtggcaggcattcaaccatggtcactgaatgagagatgtagggaagatgatggcagggaggtttttagatatcaacaccctgatagttctcattttaaccacctgtaagtgcacatacaagtcaacgccactgtgcctggctgatttttattcttttagttaaggctggttgatattaccttgtgtgtatataccacatgttgtttatccattgttgttgatggacatgtgggtggtttcaccttttggctattgtgaataaagctgctatgaacactgtgtac

SEQ ID NO: 251 - DNA, 3875 bp, Homo Sapiens
caagacctaagtcctaaacacaaggagatctgatgctataaattttcatccaagctcaggagaagacctgtgtctcagctcaaccagtgcttttacagctagggattaagtaacctacttcactttaaacccgaattcagtaagtggggaacccattatttgtacctaagtggtttaatttcagagcactcgtagaaattatactctataatttcttcttatttgcctagtgatccacccaaattctacagaaaactgagtcccccttgatatctccttctcccttgctttttcctcccacctgttaaaacatcctcttgagtctaatccaaaatatattttgagtcatctccttctccctgcaactctagcaattatctctttagcctcttatctatttttcttgattccactgttacttttctctaatccgttccttatacagaaagcattctcttgtttaaattgtttgatagttccacattgtcattggtgtaagattttttttttcttaatttctactaggcttaaaagtcatatatctggcccctgcctacctctagatttatctagttccattcatctcttcactcagtacactccaagtatactagctttattgcaattctgcacatattccattacacctgaagccataactatattttcattcctcctgaagctataactatactttctggtttatctgagtaactagccttgtatataaggccttagtcctcaggacttttctttgggagaatagctggccctgaattatgattattataaatgcacagacaatttcatggaagcagaaaagaataagcctcagaagcttcctttgtcaagaaatgaaagtacttgcaattagcattcaaatagatgataaatgtagagtatctgtagggtatacaatgattctaaatttaattgacaattagctgtgattgtgtgaccctataaataaaattgtaataaattgtattgcataaattaaatttattaaacactatttttgctgtatcctaatatttattagtctatttaatcactctctgaaattagaaaaaaaagacagtctccatataacttctcaatttgataaatgctcacttaaaaataggtacatgagggaaacagagattggatgtattataattcaataggcctatactttttaaacgtaattacttatattggtaatatgtggaatatgtgcaaagtttaaatggttattaagattttaatattaagggagaagagtaggagatgttattagaatacataacacattagatattagaatacataacacattaagaatactagtcatatccttaatagatggaatatatctgtcagacatagaagagaatcaccagcactgtaaacaataataagctaatttcaaaataacaagaattaatttgtcagtttttcagaagtggtcaacagatttctctcatagaaattcgtctgttacaatatgttagaaactgtgaagaatagaagctgtgaagaatagaagcacctgaaaagctgtgttattcacatttgctgttgtagcctcaatgtttgtgtccccccaaattcatagattgacacctaatggccaatgtgatgattcggaggtgggccattgggaagtgattaggtcataggtggggcccacatgaatgagattagtacctttatgaaagaggccccagagggctgctttgcccttttccactatatataggcatagcaagaaggcactacttatgaaccggaaaatagacatcaccagagaccaaatctgctggtccttgatcttgaccttctcagtctgtaaaaccatgagaaataaatttttgttgttgataagccacccggtctaaggtatttattgtgttacagcagccttagcagaataagacaatatcttatgacaatatagtacaaggattaatgattatgctttaaaaagtagttttaggccgggtgcagtggctcacgcctgtaataccagcactttgggaggcggagacgagtggatcatgaggtcaggagatccagaccatcctggctaacacaatgaaaccccatctctactaaaaatacaaaaaattagccgggcgtggtgacgggcttctgtagtcccggctactccggaggctgaggcaggagaatggcatgaatccgggaggtggagcttgcagtgagccgagatcacgccactgcactccagcctgggcaacagagggagactccatctcaaaaaaaaaaaaacatgtagttttaaagatattttaataaaaataaacacgatttcctgagaaaaaggttaaaatgcgaagtttttatttctaaaaaaatactctgaataataaatcatagaagaaatgttacatagaacaggcttaaagttcagaatggaaactagtgggtacatgaaagatagtaaataagagagccaataaagtagtaattctccatcaccccacttggtacccaggatatataactgaaggacagaaaaaatataattttaaaatgacaggtttatcagacattcatgtgggattactgaatttaaaatgtgtaggcaaatcaaaactttaaaataggctaataaataattcaataagccaaaatgatttctaacaatgaattaaagttggaattggatatcatctataaaataataataaagacaatctttcttaaaagtatgttttaaaaataaaagtgcaaagaggtaaaattctttggtattttctattagaagtataggaaagacatagcaaagaaacaaaataaaagcagaatccctattattaccaaaaaatgcaacccttgtgaaaatgaaatgaacacactaataataaaagatataaaaatgtttatgatttagaagaaaaaggtgaagggagtttcattaagatcaagaaatgttgggtgttattttgtatttgtttctaataacagggcatatatttacctgttctctcactaatttatttaatatatatttattgagcactatccattgtcaatattgcttgatgataaggtcacagagatggaacacaaaatttgcacggtcaaggactcatagcccagtaagtaatagtgaaaggtgaagccgactgggcatctgggtcagctggggacttggagaacttttctgtctagctaaaggattgtaaacacaccaatcagcactctgtaaaaacgcaccaatcagcactctgtgtgtagctaaaggtttgcaaatgtaccaatcagcactctgtaaaaatgaaccaatcagcactctgtaaaatggaccaatcagcgctctgtaaaatggaccaatcagcaggatgtgggcggggccaaataagggaataaaagctggtcacctgagccagcagcagcaaccttctcagatccttttctacactgtggaagctttgttcttttgctcttcacaataaatcatgctgccgctcactctttgggtccacactaccttaatgagttgtaacacacactgcaaagatctgcggcttcacttctgaagtcagtgagaacaggaacccaccgggaggaacaaacaactccagacatgcgaactttaagagctgtaacactcactgcaaaggtctgcagcttcactcctgaagtcaagcaagaccagaaacccaccagaaggaagaaactagagacacatctgaaggaacaaactccagacacaccatctttaagaactgtaacactcaccgtgaaggtccgcggcttcattattgaagtcagccagaccaagaacccacaggaaggaatcaattccggacacaatagagttcaggatggagaaaaatacacaatttaaaaaatattatgagagg

SEQ ID NO: 252 - DNA, 20130 bp, Homo Sapiens
agtgctgtcgggaaggccactggagtcatacgcaagtaggtctgatgctgattctcctgcccccctcacagggcagtgatgtggaaccaagtgagacagtgcacagaaaagcattttattggctgaacagccctgtgataactacgagagggtcctccaggcctgggcctccagccacctcctgtcagagctaatcaagccagcaccaactcagcaactccctggacagaccctccaggagcaactgaaagcctctcagtagagaactgcccttgctaccctcagactaataaaggaggaaagaccctaagtgccttatccacacctccaacaagctgcagttaatccaaggagaggccagtctgtctcccacgggtcccacaccatcctccctccatggctagtcaccagacagggaatctctggcttgggctcacagcacagaccctccatcttgggctgactgtactgagtgattgctaacctgcatcttcctggggtggagcccccaggagtcaataaaatgacccttggccacaccaccactaagatctcttcctctatggcctctaagctgaggaaggaatataaacactgagattgccccagagctgcagtgagcagcccagaagtgccaagtcacgaactacagccagaactaaagggtggagaggtatccacactttcagagcactaagaggtaaaacagctccaactgtgaggaaacatagggaaaccacccaaccaagcaagagtctaccaactgaccaataggcctaagtgtcaccttctggatcacactccaaagcttcaacaccaaaaatatctcactaacataaccccttctgaaaccagagacaagaagtcagcttcaaataaagaccctcacaaagccttggcctagtgaaaacatccagaaaagaagtctatttgactgtattcatctacactacagttaaaggaacacccacatgcagagatgagaaagaatcaatgcaagaactctagtaactcaaatggccagagcgtcctacatcctccaaataacagcaccagttctccaacaagagctcttaaccaagcaagctcgaacttgctggaatgacagaaatagaattcagaatatggataggaatgaagatcatcaagattcaggaggatggcaaaacccaatccaaggaaaataagaatcacattaaagtgatacagaagttgaaggataaaacagccagtataagaaaagaacctaatgagtctgaaagagctaaataacacaatacaagacattcacaattcaatcacaagtattaacagcagaataaaccaagctaagggaagaatctcagaacttgaagactggctttctgaaacaagacagtcaaaaataaggaaaaaaaaaaaactaaaaaggaatgaacaaaacctccaaaaaagtatgagattatataaagaggcaaaatccacaaatcaatggcatccctgaaagggaggaggagaaagcaaacaacttggaaaacatatttcaggatatcatccatgaaaatttccccaaccttgctaaagaggccaacagtcaaattcaggaaatacagagaactcctgcaagattctacacaagaagatcattcccaagacacataattgttagattttcaaaggtcaaaatgaaagactgttaaaggcagctagagagaaagggcaggttacctacaaagggatccccatcaggctaacagtggacctctcagctgaaaccctacaagccagagagattgagggcctatatttaacattcttaaagaaaaaaatcttcaaccaagaacttcatatgcagccaaactaaactccctaagtgatggagaaataagatccttttcagataagaaaatgttgaaggacttcattaccaccagatctgtcttacaagagatcttgagagaagcactaaatataaaaaggaaagatcactaccagctaatccaaaaatacatgtaaacacacagaccagtgtcactgtaaagcagccacacagtaagccaacataataaccagctaacagcacaatgacaggatcaaatccacacatattaatatgaacctggaaagtaaacaagctaaatgccccacttaacaggcatagagtgagaaactggataaaaaagaaacatctatggtatgtatgctgtcttcaagagacccatctcacatgtaatgacaaaataaagggatggagaaaaatctaccgagcaaatgaaaaacagaaaaaagcaggggttgcaatcttactttcagacaaaactcatttcagatcacaaagatcaaaaaagacaaggaagggcattacataatgataaaggtttcaattcgacaagaaggcctaactatcctaaatatatatgcacccaacacaggagcacccagttttataaagcaagctcttagagacctacaaagagacataggctcccacacagtaatagtgggagacttcagcagtccactgacagcattagatggaacatccaggcagaaaattaacaaagacattcaggatggtaactcagcattggaccaaacggatccaatagacctttacagaaggttctacccaaaacaacagaatatacatttatctcatcaccacatgacacatactttaaagtcaaccacataattggacataaaacaatcctcaacaaatagaaccaaaatcataccaaacacattctcagaccacagtgcaataaaaatacaagtcaacacactgaaaattgctcaaaatcatacaattacatggaaattaaacaacgtgctactgaatgacttctgggtaaataatgaagttaaggcagaaatcaataagctcttttaaaataatgagaacaaagatacaacatatcagaatctctgggacacagctaaggcagggttaagagagaaatttatagcactaaatgcccacatcaaaaagctaaaaaaaaaatctcaaattaacaacttaacaactgaaagaatcaaagaagcgagaacaaattaaccccaaagctagcagaagatgagaaataacaaaaatcagagttgaactggaggaaatcaagacagaaaaatattcaaaagatcaacaaatccaggagttgtttttttgaaaaaaaatcaataaaataggccactacctagcctacttaagaagaaaagagagaagattcaaataaacacaattagaagtaatgaagcaaatgttacaactgaccccacagaaatgcaaacaatcatcagaaactactatgaacatttctaaacacacaaactagaaaacctagaagagatggataaattcctgaacacatacaccctcccaagactgagccaggaagaaattgattccctgaacagaccaataatgagctctgaaattgaatcagtaatagcctaccaacaaaaaaaaaagcccaggacctgatagattcacagccgatttctataaggtgtacaaggaagagctggtactattcctacagaaaccattccaaaaaattgaggagaaggaacttctctgcaactatttctatgaggccagcatcatttgataccaaaacccagcagaacacaacaaataaagaaaacttcaggtcagtacccttgatgaacatcagtgcaaaaattctcaataaaacacttgcaaaccaaatccagcagcacatcaaaaagctaattcaccacaatcaagtaggcttaatccccaggatggaaggtgggtttgacacacaaatcaataaatgtgatccatcacataaacagaactaaagacaaaaaccacatgattatctcaatatatgcagaaaaggcttttgataaaatctaacatcccttcatgttaaaaaaactctcaacaaactaggtattgaaggaccaaacctcaaaataataagagccatctatgacaaacccacaaccaacattatacaaaataaacataaggtggaagggttcaccttgaaaactggcgcaagacaaggatgccttctctcaccacttctattcaacgtagtattgggagtcctagtcagagtaatcaggccagagaaagaaataaaggacatccaaataggaagagagaaagtcaaactatctctgtttgcagatgacattattctatatctaaaaagccccatagtctcagcccaaaaagctctttcaactgataaacaacttcagcaaagttgcaggataaaaaaatcaatgtacaaaaattactattattcctatacaactacaacaaccaaacagaaccaaatcagaatggcaatcccattcacaattgccatacacacacacaaaataaaatacctaggaatacacctaaccaggaaaatgaaagatctctacaatgaaacttacaaaacactgttcaaataaatcagagaagacacaagcaaatgtaaaagcatccccttctcatggatagaaagaatcaatagtattaaaatgtctacagtgcccaaagcaatttacagattcaatgctattcctataaaaataccaatgacattcttcatagaactagtaaaaatattttaaaatttatatggaaccaaaaaagagcctgaatagccaaggcaagcctaagcagaggaggaatcacattacctgacttcaaactataccacaaagctacaatgaccaaaacagcacgttactggtacaaaaacagacacacagaccaatggaacagaatagagagcccagaaataaggctgaacatctacaaccatttgatctttaacaaagctgacaaaaacaagcaatggaggaaagaccttattcaataaatggtgctgggataaccagctagccatatgcagaagattgaagatggacgcattccttatgccatatacaaaaatcatctcaagatggattaaagacttaaatgtgaaacccaaaactataaaaaccctgaaagacaacctaggcaatggcatactggactcaggaataggcaaagatttcacgacaaagacaccaaaagaaatcacaacaaaagcaaaaattgacaaatgggatctaattaaatttaagagcttctgcattgcaaaagaaactatcagcagagtaaacagacaacctacagaatgggagaaaaatatttgcaaactatgcatctgacaaaggtctaatatccagcatctttaaaaaacttaatgatatttacaagagaaaaacaaacaaccccattaaaaagtgagcaaaggacatgaacagacacttctcaaaagaagacatacatgcaaacaacaaacatatgaaaaaaagctcaatatcactcatcattagagaaatgcacataaaaaccacaatgaactaccatctcacaccagtcagaacggctattgttaaaaagtcaaaacataacagatgctggtgaggttgtggagaaaagggaacctttacacactgttgatgggagtgtaaattagttcaaccattgtggaaagcagtatggtgattcctcaaagagctaaaagcagaactaccatttaacccagcagtcccattacagggtatataccctgaggaatataaagcattccaccataaagacacatgcatgcaaatgttcattgctgcactgttcacaagagcaaagacatggaatcaacctaaatgctcatcaatgacaaattggataaagaaaatgtggtagatatacaccatggaatattatgcagccataaaaaagaatgagattatgtcctttgagggaacatggatggagctggaagctatcatccttagcaaactaatgcagcaagagaaaaccaaatactgcatgttctcacttataagtaggagctaaatgataagaacttgtgaacacaaagaaggaaacaacaaatactggggtctacttgaggagggagaagagcagaaaagagaactattaggtgctaagcataatataatacctgagtgacataacaacaacaaacaaacccctgtgacatgtgtttatctatgtaactgtgaaccccaaaaacctgagacaggtctcatttaattttaaaaagtttattttgccaaggttgaggccacacacctgtgacacagcctcaggaggtcctgacaccatacgcccaagatggtcagagcacagtttggttttacacattctagggagacatgagacaacaatcaacatattcaagatggacattgattcgatctggaaagatgggacaactcaaaggcaggaaaactcaaatcagggaggaggctaggtcataggtagctaagagacaaatggttgcattcttttgagtttctgattagcctgtccaaaggaggcaataagatatgcatttatctcagtgagcagaggggtgactttgaatagaatggggggcaggttggccctaagcagttcccagcttgacttttccctttagcttagtgatgtgggggcccaaagatctattttcctttcacatagcaaaccttcatatgtacctccaaaccttaaatattttgaaaaaaaatttagaggtctcttccgcaattctgggaccacaaatgccagaaaacttccaaatacttcaccctcacaaaagtatgagctttaagatctggactttgccctactggatatctccattccattctaagaaataggaaggaattgctaaaatatgaggggtttctgacaataaacctcaatataatcagtgaatacttcctgagcacctgccttttgtcatgctctggtcaaggaactgagtgtagagatgaatataaaatgtaatctctgacatcagtgatttcattaggtagcacaggacactaagccagtatctgccactttatcagccttccagctatgtctgctctagcctttaaatcagagtgtgtccagataataaatcaaatgtttacacgtgtggaaggaaagagtaccagtagggattttttttactcttaatcactcatttgagcacacatagtacctggaaagaaaaaagaaatctcttttctgtctttgcatcaccagaaatttgccttgcaggatctggtatagtctagctggccaggggataatggtggtttgggttggaagaggaggaagggtttcctccgtagtttaggtttgcttcagtttcaccagtgattgttctcaaaggtcccgataacagaacctctcaacatctttcccctaaagaaactatgataaccttgtatctttatgacatgaccacttacgcatcccaataaaactgagagaaataatagctttctttaacgcttctctaagagaactcttgtctactctcattgactcccagatatacatctctatcccagatccttctcctgatcaccagacctataatgactggtggacacctctatgtgactgtcatgtggctgcttaaagttcaccatgccatagactgaactcactgtttctaccccaccttgatctttctattctcggtgactagccgcattgttcactggttccatcctcttcctcattctttattcagtactcttcatttcctatgaaataaccccataatgccctactgacttcttgtattcatccacttctttcaatcaccactagcactactttggttcagtccactgctctcttttggattgttgctattctcccaattagtgtctccacttctagtcttacctgctctagtccagtctccaaagtcatttttataatttaaaaatctgagtatgtatcctccatttgaagcactttaataggaccccctttatcttcaaataaagtccttcacataaatcaccacgctttcattatatgacctgttcatctctccagcttcacatagtgacactccccaccttattgtccataatccatactattccaattgtagttctcccagtggaaaaaaaaaattctattgcctctggaatttttcacatgctggccaaaatatttattctttgtcttttttatctgtgctctctcccagttccactttccttttttcctgcttactcttgcaaaaaaaatcctccctgatacctagaggactacatctgtgttggtgtctctgaaatttactcccatagggtgcttgacttacccaatattgtagcccaaacccactgaactgactgtaaatgctttggaaggtgaaccatgacatgtttgttgttaatttcctgatgactaacatacaggatggcacagaatcagacatcaagaaagatgaatcaaaagagaatgacatcagtaagatggcagagtaggaagccctggaccctccttctacctacaaacacaaattcagcaacaatttatggacaaattccctttgtgagaaatcaaaaactaattaaaaagctcctgcactctggaacagcataaaaacagacatagcaaagcctgtggacagattcaggatactgtcttgtcagagacccttgcccccagtgcagggccatacattcaggaagaaaccctgtagcttccagcttcatgcagtcgaggtaaggagctggttgcacattcagcaccccaacatttccaagggagtccccagaggtttgccttctttcttgctagacctggtgctctaatgggtctggtatagtctagctggccaggggataatggaggtggtggcttgggttggtagacaacattgatttccttctcccccaactccagttggcacagagtgagcagatgaaaactttcagccctcagcttcccccagggaggaaaagagctgatctgtgcaaccagagctccaacttctccagggctgctcaaactattggcatctgtttcaccagtcttgaagctctgatgtgtgcagtacagtctaactacccaggagagaacaaatatgccaatttgggttggtagatgctatagtttgaccaccccactccactctccagctcagcacagaaagagtgaacaaagccatagctcctgcttctccctggggaagtaaagaggtagtagatgtccataagaatcactggctgggctgatggggggttgggggtgtattttcctgtatgaagccagttcatgaagactgtgatagctgcctgttttgtctaataaccctcggatatcaacacagggagtcaaggaaattaaataattgggcaaagatatttttaaaaagggaattaagatacatttccaaagactaaccctaatgaactggagttacaacttcatgaagatgtggactgagtcagtaaaacatgcatttaaaaagtgaggatttcaacagagagataaaacatattttaaagtgccaaatagaaatagaaatgcataatagatgagccaaatattcactggaggggttcaacagcagactagatcatgcagcagaaaggatcagtgaacccaagcacaggtcactagaaataattcagtcaaagaaacaataagaattaaaagaaaaaatggagaaacttaagggacttatggatcaccatcaagtgggccaacatacatattagggatattttagaaggaggagagagaaaggaccagaaagattgttcaaagaaataatggctgaaaacttaccaaatcttgggaagaaaatggacattcagatctaagaaattcaaaagacaccaaataagataaacccaaagaaatacatacaaatttgtaatcaagttgttaaaagtcaaagacaaagagaactttaaaaacagcaagagaaaagtgacttgtcacgtacaagagaactctataagactaccggtgggtttttaagcagaaagttttcaggtcagaagggagtgggatcatatattcaatatgctgaaaaaaaactgtcagtgaagaatactatactcaaaaaatttttctataaaagtgacacagagtaggaggattctggaaaggtggtagagtaggaagcactaggaatagtaatctgtttccccatctacacaaaaattaccctggactaatctgtctaatgtaattattttggaactccaaagttcattgaaggcttgcaacttccagcagaaggtttggatgataaatatggttaatgtcagtcaatttcagctcttaacacagtaacagctacccatctccacccatactctctccccgtgggaggtagccagcacatgatcctggagtaactttcacaaagcttttgggagtcatggtaccaaatatctggtatctgtgctgtgatttctgattgctgcttctgatcacaacagcgtagacaaggaggtagtggctattgttggacttccctccattgttgcaagccccatcctttctggataaagtgacttccagggcatgtcactaatcatctgggaagtgcatactaaaccacattaaaatgtcacctcacacctgctagaatgactattatccaaaaaaaaaaaaaatatatatatatatatatatgtatatacacacatatatataaaacaagtgttggtgaggatgtggaaaaattggaaccattttacatggttggtggaaacaaattaatacaggcattatgaaaacaatatggagacctaaaaaaattaaaaacagagcgatcacatgtttcagcaatcccactactgagtacatgtccaaaggaaagaaaatcagtatgtcaaaggagtatctgcattcccatgttcattgccgcactattcacaatagccaaggtataaaatttacctaagtgttcatcagtagataaatggataatgaaaatatggtgtatatacacaatggaatattattcagccttaaaaagaagaaaattacatcatttgtaataaaatggaggaagctggaagacattacattaagtgaaataagccagtcacagaaagacaaacactgcatgatattacttatatgtagagtgtaagaaagtcaaactcatagaaacggagagtaaaatggtggtttccagaggctgaggggtggagaaaattaggaagatgttagtcaaaacacacaaaatttcagtgagacagcaggaataagttcaagagatttatcatacatcacagagactacagttaataacaatatattgtatacttgaaaattgctaagagattaaagtgttctcatcacaaaaaaaattataagtatgtgaggtaatgcatatgttcaatagcttgatttagccattccctaatgaatacatatatcaaaacatagtgttgtacaccataaatatttataatttttacttgttaattaaaatattttttaaaagaaaagacattctgacatatgctacaaaataaatcaacctgaaaacgttatgctaagtgaaataaaccagtcacaaagacaactattgtaggtttcaatttatatggagtatttaaagtagtcaaaatcatagagacataaagtagaatggtggttgccaggggctagggagtgaagggaatggggagttattgtttaatgggtatagagtttcagttttgcaagattaaaagtgttctggaaatgaatagatgatgatagatgtacaacaatatgagtgtacttaataccactgaatgtacactaaaaatggttaagaaggtaaattttatgttacatggattttaacacaataaaaaattgaaaaaaataaaagtaggtataaagactttcccagacaaacaaaagttcagagagttcatcttcagtagacctgccttacaagaaatggtagagttcttagagttgaaacaaaaggacactaaccagtaacatgatagcataagaaaaagtagaaaactcattggtaaaggtaaatatgtagacaaatacagaatactgcattactgtaatggggtggaaaatcaccccattaattctagcataaaagctaaaagacaaagtatgaaaaataaatataactaaaaccatgataaaagatatacaatatgaatacacataaattgtgacaagaataatatatgaggggttaaagtgtagagtatgtgattgaacttaagttgttatcagcttaaaatagactgctataaccatattttatgtaagccccaaagtatgtatgtaaccacaaagaagattttttatgtaaccacaataaagtccctatagaaattacacaaagaaaataaagaataaaatcaagcatattatcttagtttatttgggctgctataacaaaataccttagacttggcaatttacaaataacagaaatttattgctcacagttctgcggactagaaagtctgagatcaaggcatcagcagattcagtgtctggtgatgtgtcagtctctgcttcaaagatgatgcttgctcactgcaccctcacatagtagaaggggtgaataagctcccttaggcctcttttacaaaggcactaatccattcattagggtggagccctcattatccaatcatctcccaaaggctccacactttaatattattgaattgggtattaggattcaacatataaattttggagggaaacaaacattcagatcatagcacatattaatgcaaaaactttacaaaacataaagaaagacagcaagagagaaaaagaaaagggaactacaagactgagagaaaacaactagtaaatgcctatagtaaatcctttcctatcaatattactttaaatgtaaattgattaaattcccccaatcaaaagacaaacagtgagtaatggactttttttaaagacccaactatgtgctgcctacaagaaactcactttagatataaaaacacacataagttgaaactgaagccaagaaaaaagtattccatgcatatggtaatcaaaagagagtaggagtggctgtacttatatcagaaaaatagacttgaagtcaaaaattgtcaaaagagacaaagaaggacattatatgatgaaaagggtcagtccataggctgtaataccaatataagagcacttaaatatataaaatattgacaaaactgaagggaaaaacagacagcaatacaataatagtagaattcagtaccctactttcaataatgaacagaatatccacacagaagatcaataaacagaggacctcaatcgcattataaaacaaatggacctaacagacatgtacagaacattccatccaacagcagcataatacacattattttcaagtacacatgattctttctgcagagcaggtcacatgttaggtcacaaaataagtcaacaaatttaaaaagattgaaatcttaccaaagattgaccattatggtcaaccttttctgaccacgatggaatgaaacgagaaatcagtagcagaaggaaaactgaaaaattcacagatatatggaaactaaacaacatacttataaacaacaattgagttacgaggaaatcaaaaggaaattagaaaatatctcaatacaaataaaaatgaaaacacaacataccactgcctatagggtatagcaaaagcagtagtaagagagaagtttatggtgatgaacatctacattacaaaagacaaaatgtctcaaataaacaacctaactttatacctcaaggaactaggaaaaaacaataaattagttccaaagttagcagaaggtaggaaataacagattattacccagaaataaatgagagagaaaatataaaaacaatagaaaaaaatcaatgaaactgagagttggttttttaaaagataaataaaagtgacaaacttgtagctagactaagaaaaaacactcaaataaataaaatcagaactggaaagaggaaacattacaactcttgccacagaaataaaaaggatcctaacagactgctatgaacaatatccaacaaactggataacctagaagaaatgataaattcctagaaacatataacctaccaatactaaaccataaggaaatataaagtcaaaaccgacacataactagtatggagattgaatcagtaatcaaaaacctccccaaaaatcaagctcaatacctgtagagtcactggtaaactctatcaaacatttaaagaagaattaatgccactccttctcaaactcttccaaaaaattaaagaggagagaacacttccaaacttattttatgaggctagcattaccttgattccaaagccagacaaagacaacacaagaaagaaaacctacaggccaatattctcaatgaatatagatgcaaaaaagcctcaacaaaatactagcaaactgaattcaatggcacattaaagggattatacaccatgaccatatgagacttatcccagagatgtaaggatggcttaatgtcgaaaaagcaagtaatttaatatactacattgacataataaaaaataaaatcacatcatcattttaatagatgcaggaaaggcatgtgacaaaatttgacattgtttcatgaaaaaaactgtcaacatactaggtataggaggaatctacttcaacattataaaggtcatatataaaaagtccatagctcacattatactcaatggtgaaaaactgaaagcttttcctctaagatgagaaacatggcaaggatgcccactcttgccagttctattcaacatagcactagaagtcctagccagagaaattagacaagaaaaaataaacataaagattcaaactggaaaggaagaagtaaaattattcctatttgcagatgacattatgttatatagagaaaactttaaagactcaattttaaaaaaaaaactgttagaataagcagttaataataataaataaattcagtaaagttgcagttaacatacaaaacttagtagtattcctatataccaacaacaaaataaattgttagaataaacagttaacagtaataaattcagtaaagttgtagtcaacatacaaaacttaatagcattctgatacactaacaacaaatatctgaaaagaaatttaagaaaacaatttcactcataatagtgtcaaaaagaataaaatacataaagataaacttaactacaaggtggaaaacttatactgaaaactacaaaatattgatgaaagaaaactaaacaagacacaaacaactggaaagcactccatgtttatggattagaagagttaatattgttaaaatattcatactacccaaggcaaactacacattcaatgcactccctatcaaaatcccaatggcatttttacagcaatagaaaattttttttattcatgtggaactacaaaagaccataaacagctaaatcattcttgagaaagaaaaacaaagctggaggcatcatagtttttgacttcaaaatatgttacaatgctacagtaatcaaaacagtatggtactggaataaaaaaagacatataaaccaatggaacacaatagggaatccagaaataaatatatgcatatacagtgaaatgatcttcaacaagagtgccaagatacacaatagggaaaagacagtctcttcaatggtgtgggaaaactggatatccacaatcgaaagaagaaaatgagactcctattatatgccatacacaaaaatcaacccaaaatacattaaaggtaaaaccccaaactgtaaaactctcagaagaaaacataggaggaaaagtctctagacattagtcttggcaataatttcatggatataacaccaaaactacaggcaacaaaaacaaaaataaacagcacaccaaactaaaaagcttctgcatatctgaggaaacaatcaacagaggaaaaaaggcaacctacagaacaaccaacctacagagtgctatttgcaaaccatatatctgataagtagttaatatccaaaatacataaggaattcctacaactcaaaattcaagagtaaaacaaaaacaaacaaacaaaaaccccaactaataacccaattttttaaatgggctgaggacttgaatagacattgctccacagaagacttaaaaatggccattaggtataaaaaaagttttcaatgtcactaaacatcagggaaatgcaaatcaaaagaacaatgactatcacctcacacctgttagagtggttattatgaaaaaacaagactacaaataatggtgaggtcgtggagaaactgaaactcttgcacaccactggtggaacgcaaggtggtacagctgctgtagaaaaccatatggaagttgctcaaaaaaataaaaatagagctaccacatgatccagaaatcccacttctgggtattttacctttgagaaatttaggagtgctaatatattgtttgtttgtttttgagacagagtttcgctcttgttgcccaggctggagtgcaatggtgcaatcttggctcaccacaacctccgcctcccgggttcaagcagttctcatgcctcggcctcccaagtagctgggattacaggaatgagccaccatgcccagctaattttgtatttttaatagagacggagtttctccatgttggtcaggctggtctcgaactcccgagctcagggggtctgaccacctcagcctcccaaagtgctgggattacaggtgtgagcaaccatgcctggccaatatatccttgagatcctaatttcacttcttttggctgggtatttttgccaaaagaattgaaattaggatttcaaagatatattagcacgcctatgttcactgcagcactattcacaatacccatgatgtggaaacagcctaaatgtttattgacagatgaatggataaagaaaatgtggtatatatacacaatggaaaactattcaatctataaataaaggaaattcaacaatgtgaaacaacatgggtaagccttaaagatattatgctcagtgaaataagccagccacagaaaaacaaacactgcatgattccatttatatgaggtatctaaaaatagtcaaattcatagaatcagagagcagaattgtggtgccaaggactgggggttgtgggaaatagggagttactaatcaatgggcatgaagtgtcagtcaagcatgatgaataagctctagaaatctgctgtacaatattttacttatcgtcaacagtaatgtattgcacacacttaaaaatgttttaagagggtagttctcatattaagtgttcttaccatgataaaataaaatgaaaatgaaagaaagataaatcaattcagtgaataaattaacaagtactcttgagtccccatgggtgaagccaaggacacatatagattggggttttgttgtcacggggcattttgacttgtatatgtgtttacctactcaatatgtgttacagtatatgctatttctcatttcctacatttctattccaatgacttcatggtaagcttctgacgaaatggcgtggctatgctagtgaagataatattccttgaaactacttacttgatattgcaataatttctccctacaaacatgctaactatagctcctgaatgtataagaaaccatgaggtttttttattatgtatgtgtgcatgtgtataaacatttcatgtagaacttggaagctataatttctaaattcattaacatggtggctgcccagctatagtaaattatatgccttcttcctcttcgggccaagcccacaatggtatgtgctacatgatcgttagtgcccctctcaccatagctctttgatccaaagtgacccacattggctcaatcagactttctcctagaagaattgggaatctgctgctaaaagacccagcacccctagagctgagtcatttgacatggtctgtacatttccatggcatctcacgttcccaagacctacctattcaactctttcttagatcctatgagagtcttccagatcattttaataaattccctatttttaaggtcactttctgtgacttctcaccaaaagaaactctttaactaacgtagcagcagtgttatagaaaactatcagtattatactttccttattggttcaaatttctcaaaggtaaaggaagacaatacaccttgaagtcccactttaatgattttcttaggtaccatgctgttggatctaacaaaactgtagaagaagaaagtagactgaaggaactacaggatctttcatgccaatagagcaattctatatatatatatccgtaacatacaacctagtcctaagtgaaaagcctatgatgcagttcatcaggttcttccagcagtggccagccatgctttgaataccaaccattttctcagaatcctttctagattgagaaacaatatatactgtcatgtgtcccttaatgacagggatatatggtaataagtgctttgttaggcaatcttgtcattgtaagaacatcatagagcatatttacacaaatatagatggtatggcctactatacacctatgctacatggtatggcctattgcttctaggttttaaatctgtacagcatgttactgtattgaatactgtaggcaattgtaacacaatgctaatgatttgtgtatctaaacagatataaacatagaaaaagtatagtaaaagaaatctaaaagattaaaaatggaagccgggggcagtagctcacacctgtaatcccagcattttgggaggccaaggcgggtggatcacaaggtcaggagatcgagactatcctggctaacacagtgaaaccccatctctactaaaaatacaaaaaaaattagccgggcatggtggcgcatgcctgtagtcccagctacttgggaggctgaggcaggagaatggtatgtacccgggaggctgagcttgcagtgagctgagatggcgccactgcactccagcttgggagacacagccagactccgtctcagaaataaataaataaataaataaaataagtaaaataaagattaaaaatggtacacctgtatagggcatttaccatgaatggcgcttgcaggactagaagttactctgggtaagtcagtgagtgaacatgaaggcctaggacattactgcacaccactgtagacttcataaacactgtacacctaggctacactaaatttattaaacaacagttttcctttttcaataataagttaactttagctaactgtaacatttttactttttaattgttttaactttttgacttgtaataacacttagcttaaaacacaaacatattacatacctatacaaaaatattttttatttacattctcattctataagcttttttctattttaaattttttaacttattaaacttttttgttaaaaactaagcacaaacacacacattagcccatgcctacacagggacaggatcatcaatatccctgtcttccagctccacaccttatcccctggagagtcttcaggggaataacacgcatggagttgtcaccttctatgttaacaatgccttcttctggaatacctcctgaggacctgcctgagactgttttacagctaactttttttaaataagcaggagtacatcctaaaataacaataaaaagtatagtttactaaatatataatccagtaacatagttgcttattatcattataaagtattatgcactatatgtaatcgcattgctatacttttatacaactgtagcacagtaggtttgtttataccagcatcaccacaaacacatgagtaatgcattacattatgatgttaccaccactaggccacaggaattttttagctccattataatctaaaagaccaccatcatataatatgcagactgactttaactgaaacattattatgtagcacgactctctctctctctctctctctctctctatatatatatatatatatgtatattttgttttgttttgtttttgtatttgtttttgttttttttgagacagtctcgctctgttgcccaggctggagtgcaatggtgcaatcttggctcactgcaacctccgcctcctagttcaagcaattctcatgcctcagcctcccaagtagctgagattacaggcacccacaagcacacctggctaattttttgtagagatggggtttcactatgttggccaggctagtcctgaactcctgaactcaggtatttcacctgccttggcctcccaaagtgctgggattacaggcatgagccactgcacccagcagcacatgac

SEQ ID NO: 253 - DNA, 5037 bp, Homo Sapiens
tggttattcttcttgttctttttctaacttcttgagttcatattaagttagttagcttttagtccttctaagtcaattactgaatgttttgaagttttcactttgtgttactttatattttttaggctacttattaaactaaaccacgttctgaactgttactgctactggaaaccagtcccgatccagaccccaaaagaggattcttggatcttgcacaagaaagaaaggagagggacctgtagtcattaccttcaaggaacctaaatcctggtgtctttatggttatgggtggcatataatatacagacacagtgaaggagtgagatgtgaaggtgctctgtcattgcctcagtcaagactttcatggtacattggaagaaagagaagcgtgaacaaattgcatgatacttgaggtcatgctgtgtacctgtattgaacaagaataagggaagaaagctgggaacctggatctcccatatattggaagttttgtaaaaaccttgagggtcccttccactacatatggggattatgggaactgcaattcaagatgagatttgagtgaggacacagccaaaccacatggttttagaacattgacgaagagagaagacaacccactttgccatatatgcccatggtcttaccaaggctagagtacagtggcacagtcatagctcactgcagccttaaactcccagactcaggcaatggatccgatcctcccacctcagccagcctcccaagtagctgagactacaggaagatctggcaagagttagcatgcaggtctacattgtgacaatccatgagagctaaggactggctgtctcttgggacaaataggctttcttgagtctggatgtccgctctgcttgtcttaccgcatgagagagtgcagatgttcctgaaagcatctttgcgtggatttgcttgaagcgagatgtgagagaaggggcaaagctcgaagggagctgctagagagagaggaaagcagctggacagggctttcctgatgactgaaatcttattgtggataatggagatcaggtcctgtggtggtggatctaatggaaggatcctaggtctctgaatcacaacgtggaagaaaatcagtcaccacccctagctggaacaccaacatttcaaataagtgaaaaataaactcttattatgtcaagccactgcaattttggggtttgtcttagtgttagtgtcacctacatttatgcaatagctgagtaacattttagaagaagaggatgtttgtagccattttggactacaagaaatgtcaaagatactttttattttcctaatttttaatttctaggtttattcttaaaagagtaagatctttttttgaaaaatcagtactattattttgacttttggatatacaaacaggtctctccttaaccactcaaaagagccaagtgagaggaatttgtggataaagacatttaaaggtagtatgaaatctttaatcacgccaaatcaacactcatcaccacgacattctgtcagtgcctccagggattaaggacatatgaatgtctttccctgaaatgtgattgtgacattggacttagctatttgggttttcatgaaacccattgtcaggttaaataatgatagagtagtagatgttctgcacaattgcttttgttataaaacttgaaaaaaagtatattaattttttatgccttgcctttcagtgcattattacttatctttgtgcagagtagattaagtaggtccattgaataagaaagcattaatttggtagattctctgtgttaagatgctcagtattttttatggaataaaggtgtggaaggtttctactcctggtcaaggagtagaaacaggtagaaaatatttatatttcagccctgcttctcctttgtcatatccttcaccacaaggatctactttcacttctgccttggttttaaacagcagccagtatatgaaggtctagctaactacactatctccctaggagagttggtacaatgttgtttccaaaaattagacaaagcatgtttaatggctccctttcactaagtaaataaataaaagcaagaaagggaggaagcaagctggctaaagaagaaatgaactagacatctgtatgtttcattttgttagtgatcaagctcgtctttcatgattattactttgatacatacaagatatatcacaactattttcctaagcaatatgaagatacaaagttattataaaaactaatggatctaaaaatacatattgaaaggtatatttatcttttgcacacctcgatgaatttttcacaaactgaacagatctctgaaactgacaaccatataaaacaaacagacaaaacaaacaagcaaacaaacataaccaacaccctagaaaccctcctaggctcctttctagtcaaaggattagtcattattttgatttctaacagtatagctcaattttataaattaattaagcaaattactctttgtgtaatttacatgaatacattaggtattcttttgtgcctgacattttttgttgaatattttgtttgcaagatttatcctattgttgcatatgcttgtagactgttcattctcacagatgtattataaaatctattgagcaaatatggcacagtttatttatacactctactgttggtagacatcttgatagtttccagttttgtttggagctattacaaaagtgctgctataaacattccagttaagtcttttggtaaactcaaatatgtatttttgttgaatatatatgtatatatacctaaagaaagattcgttgatactgccagttttccaacatggttgtatcaatccacatcactaccagttgtgcataaagatttgagttgccttgtatctttgccaacacttgaaattttttgtctttattgttttagccagactagaggttgtttagtggtatttcactgtggtttaatttgcatttccttgatggctaatgaacttgagaatatggaaatatgtttattggccatttgaatgtctttctttatgaagtacctgttcaagtattttacctattcctctattgagttgcctgcatttttcctattgatttgcaggagttctttatatgtgctagataagagtgtttttggtactctacatgtaacattatatgtatgtgtatatatatatatatatatatatatatatatatataaaatttcccactttgtagtttgccctttcattcttttaatgtcttttgatgaacggatgtttttagtttatttaggcaaagctataaggtaagaacaatgttagattaagctttaaaaggtgattcagttccatgaacagaaagattgggattcccagcactattgagctgtttgaatcaaactcctagaagccttaatatattttttcaactttccctttgtaattgtagtgttggaaaaacaatagttaccctcagagtgttgtagaaattaccatctgttgattgaaacaatgagaaaatattaccaaaatggttagaacaataagagtactatataatatccatgaaaaattgacactagccacaggttccttcaggaaaccatcagtgttctgaaaataataaatcagaaaatcaatgttcagttttcaacagcacggtgaggatggcagtgaaaggtattattttaagaattttctcaggccctgagttgtaagagtctgtaatcagtgatatttttatttaaagaaaatcagagcatgaaagagcattattttaatatctaatatttaatgctagaattaaaaatctagtgtaagatttatgttggaaaaagcaaacaagcaaacaaagtaaattacagctctctgtgtaataacgtgaatgaatggagattcctcggcaaattgaatttactatgtgaaatcttgtaaatgaggcatattttaaaaaatcttggctctaaagtgatttggtgaaatgattattttcctcattaagacaaaataaatttctgtcatattattaaacatttcacaacctcaaagtgctgttttatggtagaccagctagaagtaaagattaaagtggactgtatttgtggtctggtcagagtttaagcagaggacacagtttctggaagcttttccttcagcctggatgtcaagggtccttttgctgcttagcacctccagcagcctccacccaggttcatcatctagctgtgttgtctccactgtttcctggagaaaggtccaattacccaaaatacagttgtgccctttttatgttttcatcatagttaattatagaaaaacttggttatatgcgaagtcctactaaaacaaaagtatcataggaaatatttctaagaatcatgcaaaatcatgattttgtattaagaaattctaaattaagaaccatgtaaaaatgagagtttgaaatgttactctgtcagacactgaagaatttaagaaccgttaattgtttgtatactagctcctcgaaggtaggtctgtttttattcatctttacggccttcgttgtccctgacatattgctgcacgtagagtatatgcacagtgtatacttgtggactaagtgaatgccaactttagcttttgaaaatgtaatatatgagtttaacagatgttgtctcttcactttctaagtacttggaactttgaaaatggctctttcaatagtaaagtttttttctctagatatgttcttaaataaaaagtgatgtaaagaaaggaaaacaaacttaaaccattaaaatgttttaaattactaaatctgcctccaggaatgtgtaaagagataatgactacctaacataattttttatgggttaaattttctctaaatgtgatctattctattttgaactacaaatattttaaaagtataaattgtaagcaactggaaaattggttttaggcacgtgatatgcaatttcacaaatgttcaggatcctggtgttatttctatgactatgagatttcataaacaaattatatagcc

SEQ ID NO: 254 - DNA, 3140 bp, Homo Sapiens
agcctccgggatctgcaagtctggaaaggccacgttgtggaccttggcgcagaggttatgggggcgacccggagcggatggtttcaggaaaactagaacccaccctcatggcctgaacaactggagagaagaggatcgcagcaatttaaagccagcggcaaggatcacagtcctggggtcaggtgaccaaagccagtttttcagcccttaacaagaacctggcttcacccagccaaacatgagttaacgtatccattttacacacgaacaaactgaggcgcagagatgatcacagcttgttggtggcaaactccgctagggccttctctgctaccctaaggaggtccgaccgtatgttttggaccccttaactcgggataccgataaacgaaaattaatagggtgttggatgttttaaatgtgtgcgggaatgtcattatattggctagaatcaaaccttatttagacttgttttgcacttttgtacactttagtaatttttagttttaatcataagggagttaaaggcgaacacaactggtatttttttttttttttttttttttttgagacagggtctcgctcggtcacccaggctggagtgtaatgctgcgatctcggctcactgcaacgtccgcctcccgggttcaagagattctcctgcctcagcctcccgaatagctgggcgtgccaccacgcccggctgatttttgtatttttagtagagacggggtttcaccatgttggccaggttggtctcgaactcctgacctcaaatgatccgcccgccttggcctcccagaatgctgggattacaggcgtgagccaccgcgccaggccgacaactggtatcttaaggcttagggcctctggtagaagtgagctccacctcccttcctgtgtagaaggtaaatgcattcattcattcagtgaatcgagcatgcatgaaatcgtttgcgcacacccagaagcccacctgcgagccacaggagcagccattccaggaagccaagctataatgggagacgcaaggaatggaggcggaactcctgtttttaagtcctagctccaacactagccttgtcagcctgtaattctgaattactgggcgcctctgaggcttcttgtctcatctgcaaatcaggaacaacggcatagagtggtgaatgcatcaagtgggatgatgtctgcaagtacgcaacccgcttacacaaagaattatctttccataaccttccctggacccctagggccagcagggaatcatagcctccctttgtttctagagcccggaaatcactgggttttccctctgtctggagcagagctgggtgcgaatttgaccaacgggtggcaggaacagccggagcaggatattaaggagcgggcgagcttgccaagcatgcgcagtagcggcgggttggtttgagaagccgccagggagccagcgcggcgacctagctggctggggcaggggaggggcccgccttatatgggagctgcgtggggacaaactgttcgggcccaacgcgcgggtctgagagacagccacgcctgctccgggtcactccggccacctggggggcgtcggcgcgcagactctggccagttcagtattcaaactcttcaggagtgctaacttactcatgacagcgattttctgtatcggggtttcattggtcggtggtttagaaggttttgctcattcattcgttaatgtaattccaacaacctacacgtgtttataagccccctttccatccacgactttgctgtctgacacaaaacggaccatcgcagcccggcagacgctttagacaacaaacagcatgcctggagcttttcaataggaagcagtaaggcttgatcatcacagacgatacggaacgggcactttcttagcagaaaatatttctattggggcgtgaaggaagtttctgaaagggaagattattataagataaggggtttgctcatctcagactttagtgtgcctgctttaaagtgttttgcaaacttgaatgtttaaaggaatcacctggcggtcttgtgaaactgcagcttctaatgggcaagtcagaggggaagcctgagacatggcatttccagcacgttcggggagtgaagatgctgtcggctgccaccctccctgcaaggagccaggggatagatgacctctacgcaaactgtgagagcttaaaataactgatagtgaaaaacagttacagaagctctaggccgggcacggtggctaatgcctgtaatcccagcactttgggaggccgaggaggatggattgccagaactcaggagtttgagaccagcctgggcaacacggtaaaaccctgtctctacgacaaaataaaacaaacaaaaataaaagccacgcatggtggcgtgtgcttgtagtcccagctactcaggaggctcaggtgggacaatcgcttgagcatggaaggaggaggttgcagtgagccaagatcgcaccactgtactccaacctgagtgacagagtgagacccaatctcaaaaaaaaaaaaaagcagtaaatccagggcccaaaaggtcagtaagaattcagggatccaaatcagttatgtactgatgcataaaaataatggccaaaaatgtggaggcttaaaacaaaaaccggttattatttctctcaattctttgggttgctggtgtcacccgggctttgtggctgggctctaggctcacctggggtgaggaaaagttggtgcattttgctttttcatcctcaaaaagtttagaccaggttccagatttcttgcggcggcgagacacctcgccaggagagcaccgcactatgcacaagcctttgctggacttccattgaccaaaggcagtcacatggtcacgcccaggcaatgtgggagggccccgcaaaggaggggtgggtactcaagagagccactaaataacaaacctaccttaagatcacatttatttctaacattttaatagttatagttcagtataattgattttcctggtaatcccatttattttattttatgcattttaaaatgttattctgaaaatgttactctcaccaaacaaccaaaagggtccacggcataaaaaaggtttaagaatctatgattttaaaattcaat

SEQ ID NO: 255 - DNA, 2077 bp, Homo Sapiens
ttacaaatattgattgatgttctcatgactccctaaaatgtataaaaccaagctgtgcctcgaccaccttgtgcacatgtcatcaggatctcctgaggctgtgtcacaggcgcatcctcaactttggcaaaataaactttctaaattaactgacatctgtctcagattttctgggtccacacactggacaaaacagaagtgaacaaaatagccgaagttcccaattgtgttcctatggtgggagtagggcagcaatggagacggaaagcaaacaagtaaatgaagaaagaaaatatcactgagatgtgctaaggggagaattgaaagagggtgatgaggttgagtataaggagctacttcagataggtggtgtagcaaccctggttccaggaagaaaaacagaggcaagtcaagtattccaggaatattgggtggtgtgaatgtgggaggagttggagagtgaaggcctgaaaagcttcagctctagaatcagagaaactctctgcactttcacctggaaaagctggaactcaaagcgaagttcaagaagtagcacaatactagctctttgagttggattgtgaagtgtgtccgtgagagtggccttgtcttacactcacgacctcccaataatagtgacttctgccttccatatcttgcttgaactcctgtccttggcaaaccctaatctagaagcatacagaaaaggggactctgggaaacatagttctcatcctcagatgggccttgtggcttggtgctgagctgatagctgacaatttaacactgatgatcagaatgacatttaagctgaggtctaaataacaagaaggggtcagctttccaaagatcacagggaggaacattccagacagagagagtaaccagcacaaagtccctgaagctagaaagagcatcttgagttctccagaaacatcaagaaggccagtatgcgtggagctgagtgcatgagaggaagactgatgggagatgctgttggagaggtaagcagaggctgagtcatacggggtcctataagatctagtaggtccattagggatttatgtgcctgactggcttgtgtctgtgtctgagccccgtggataaggtgtttgtggacagaaagctcactgagctgtttagaaagaggggcttggtgagatttagggacccagacttttctgcctcaggcagtagacagtgctatgaagcagagaggggcactcaccttatactccccagaacacaacagagttttgcagcatggagaggttaggggacacagtgctgccctggagcctggaggaaaggacatttgggagcatccagagacatttaccctgggaaggatgtccactcttgtccagtggtgaagagccacagtgtaagaatagaggtgctctagtaggtttgagttgtcaactgacagatgaattcaggaacagatgtgagaccctcatcctgcagccagaaataacaggatgaacaatagaacagacttggagaggggacatgaaggtgaaatatgagtcagtaaatgttaaggtgatcctatttcccttgaagcctgggtgaaaaccatgtggaacctcagattgcattggctaggcccttgcttgaatgcattcagaaagttaagggatattcattttctttggggaatccatacagttagtgatttcattcccaatgtacatacatgctttactgaaatgactaggttgcttggaattttttatcaggcatactttcaaacccaaaagctataattttaggcatttcaggtctcccaacaaaagtactggccaaggttgatcaaatacaggttggtctatgccctgtggtgacatttgtgggataacaagatgattctaatgtcccttgaacatgtctccttcgcattgtctgaatgccatgatggagagttggttggcctgttagtgtgactgaaccaagtgcccgcagtgatagctgctctggatgctccctaagttaatttctttacattttgatctcacttccacagttccctgcaggtgcttcttgagatcacctcccaaataaattacttgcacag

SEQ ID NO: 256 - DNA, 1075 bp, Homo Sapiens
agaagacctgaaaggagagtcaccaaaagaagaaaaacaatgtccccaagagtccacctccaagagaacaagcaacttcctagcagatgctgaggcttgcaagactaatctgggcttggaagtgttaaaagaaaagattttaatttaaaaagcaaagaaagggccgggctcagtggctcatgcctgtaatcccaccacattggaagccaaggcaggcagactgcttaaagccaggagtttgagaccagcttgaccaacatggcgaaaccccgtctctactaaaaattggctgggcatggtggcctgtccatgtggtcccagctacttgggaggctgagatgggagaatcacttgaactggggacccagaggttgcagtgacttgagatcgcaccactgcacttcagcctaggcaacagagcaagactgtctcaaaataaaataaaataaaaagcaaagaaagtccttgaacccattggaaacatctttcaaggagcatgaaaccaacccttttatcacgtaacaagtattaatggaaagacatgagacgttgcaaagtattactagatgctggagtctagagattatctatttgacatttaggcagagagcaaggaaaaaacacaaagtactaaggaagcagggagcctctctaaatgctgataagacgatgaactgcgttagtcggggaacactttgggagactgaggtgggtggatcatttgaggccaggagttcaagaccagcctggttaacatggggaaacccatctctactaaaaatatctctcaaggcagcctcttggtgagcgaaagttctgaggcaacccggtggagggttagagttccccgatgggcaggctttggtttgcaaatcaactggtaaccctcaagaagagatccgtctaggagaacatataattagatgaacttgccttgtaggcatctgctgaactgcgaggtaaaaggttatatttgcatgtctaaaggaatgagtaggaagtgggaaactggggaaccggggagtgagaaaagaagagagaaaaaaataattaaaccatctcttagaaaaacggg

SEQ ID NO: 257 - DNA, 1913 bp, Homo Sapiens
catgtctcctgacacccagttgcctctaccactcagatgatgtcaggcccagtccctcagtgccctgcgcaaggaacaggactcatcttctgagaaggatggacgcagccccaacaaatgggacaaggaccacatccagtggcccatgagtggcggtcatgatcttcagcaagcggcaccaggccctggcagggcacaccagggtcaccccaaccaggataaccggactgtcagccagatgctgaacgagtggtggtacaccctggggcccaatgagacacagaaataccacgacctggccttccaggtgaaggtggcccacttgcaacaaggaccgaaagaagtccagctcagaggccaagctcacaagccaggggctagcaggagtgtaacaagggctcgtgggagtggagcatatcagagacgggcactgccactgcccctggggtgtcctctgaattcctgtcagttgcagcccaaacactccagagctcggataccaaggagcagcttctgtggggcagaacggctgcacacagtcagggaacctagctcagcctggcccaagccttctcccacaggggggtacacagcctggatggcagggaaatagatcatcaggcactacaggaactgacacaggtggtgtctggcaatgcatcatactctggcccaaagccttctactcagtatggagctccaggccactttgcagcccctggtgagggaggtgaccagtgggcagccctgctgctgcccacctgagctgctcattcccagcacatggccagtgaggacatagcgagtgatgaggcgcacacgatcatccatgaggaggagggggtgatgatgtcattgctgatgatggctttagcaccactgacaccgatctcaagttcaaggagtgagtgaccgacagagtggggacaactctggggaggagccacagggcaacaagggctttggtgggaaggtatttgcacctgtcattccttcctcctttactcctgctgccccttgctggatcctgagcccccagggtcccccgatccacctgcagcttttggcaaagtctatggtcccaccctgtcctcctcctacacatactcggatgcttcctcctcaaccttggcacccacctccttcttactgggcccgggagccttcgaagcccaggagtctggtcaaggcagcagagtgggccccctacggcccctacccctggggatgggggcccagggatgccttccaaggcgacctgtttcctcccaatggatcccgccaccttctggtgcaagagacctgaaagtgtgggcgacctggagctaccaggctcctcagtcatcagggtccctccgcagatcctgaagagaaactgactggtctttcggggtcggggcagagggaaccccacggacatggatcccacactggaagaccccaccacgcccaaacgcaagatgagaagatgctccagctgcagcccaaagcccaacacccccaagtgtgccatgtgtgatggggacagcttcccctttgcctgtacaggtggagaagccgaggacaggctcagggaaccggagaccgagaaggcactgtcctcttcactgcacgcgccctggaccagtgccggccctgatcatgcagctcttccaggcccactgcttcttcctgtccactaggccacagccaccctccaggcccactatgcacacatcttccactccaaggtttgttctgcccctgccctgactcccagccctgtgggggtcctgaccggacctcacctggctcaggcaaccctggctgccctgccactgcctctgccccagagttggggccttgacagcctggttggaaggggacaccccagccctgcctcaacacctgggggtctccataactaccacagg

SEQ ID NO: 258 - DNA, 3556 bp, Homo Sapiens
gtctttcgctccaggtagagcttggggttagtacatcactggcctgcgtgctccgctccaggaggtctcggtgattctgccacagcctcatcctccgtcgccctgtgacctactggtattggaacattcatagctaagactccaggacacccacaaagccgagaaatgctgagtttgcgggtcagggcgtccggagactggggaggcctcatcggagtcggccggaaatggcggtggcgggaccgagtctgtgagcctgagcccccctcagctcagccctcagtctcctctggtgcagggtacccaggcgtcctgtaccgtttcagcacagcggctttggccccagcctgtagccctctttgcgcagctctgcgcccgcatcttccccagcttgtgaggtgatgaggagaggttcaccagggaaagacgccgacttggtgtgcagggcttctgcgtggaaggagctctggtctgtggggtcaccagtccctactttaacctattcagacataaacggaggcaccattaaaacattaaagaatttatatgagcaaacagtgatgaaccagtgggacagccccagacatggtttgtcgtttgggggctaccagcgggtcttgaagaaaaggctttaagtctgcacatgtctccaaggagtctgaggacaagtgcaaagtcaacaacaagcaatgatggtggtggtgatcctagtcaataaaaagggggaagatgtgggtggcaagccacccaggtgccaaagcaagagactgagggcacaagctattccagtataataaagaaaatatatagtataagaatagttctactagaaatagattatggatatgattatatatgaatgtcattaatcattagtttgtagcattattctttattctaatattataataatctttgttctacaattataacctaggaaaaaccaggccctacagagataggaggtgaagggacatggtgagaagtgaccagaagtcaagaatgttagccctctgttacgcccagacagggccactagtgggctccctggtctagcagtaatgccagcacccattacctagcagaccttggtctagcagtagcatcagtgcctagggaaggcacccattacttagcagaccaggaaagggagtctccctttccccgggggagttagagaagactctgctccaccacctcttgtggaaggcctgacatcagtcaggcccgcctgcagccatctggaggcctaaccgtctccctgtgatgctgtgcttcaatagtcacgctcctggtccactttcatgttccactctgtatacctggctctgccttctagatagcagtagcagaattagtgaaagtactaaaagtctttgaaatgcataaaagaaatagtggtgtaatctgtcctctctctctctccacctcggctgccaaacagggaagggccccctgtccagtggacacgtgactcgtgtgaccttacctatcattggagatggctcacactccttaccctgcccccttgtcttgtatccaacaaataacagcatggccaggcattcagggccactaccagtctccacaccttggtggtagtggtcctccgggcccagctgtcttttcttctatctctgtcttgtgtctttatttctatgatctctcatctccgcacatgaggagaaaaaacccacagaccctgtagggctgggccctacataactgtgtagaggtattagactcagtttattctagtgggcccaacctccgagaccatcttgagtatcaggagactgtgagctatacttggatgggagcagctttgccaacctctgcaaagtgactctgaaaaagatggcaagccctgctccagtcacacctggaagctgactggttcccgcatcaccaaagcatgaggaaattaatcacaggactcatttccctgaaaatttggacttgtacagtaaggacttcaactgaccttcctcagactgaggactgttcccaatatatacatcaagtcactgaggtaggacaaaagtttgctacagtcctattattttatggttattttaagtgtaccaggactctaaaaggaacttgtttgtataatgctattctatacaaggtatgtagcccacgaaatgaccagcctgatgtgtgctataacccatcttttttcctactgcccataaaaacaggcgaacttctaggtttcctggtctatgcttcccgagaaaagagaagcatagctataggcgactgaaaagatgacaagtggccccctgaaagaatcatacagtactatgggcctgccacttaggcacaagacagctcatggggataccgaatccccatttatatgctcaactgaatcatacgattacaagctgtcttagaaataatcactaataaaactggcagagcttcaactgttttagcccagcaagaaacccagatgagaaatgctatctataaatatagactagccctagactacttgctaacagctaaaggaggggtctgtgggaaatttaaccttactaattgctgtctacacatagatgaccaagggcaagtagttgaagacatagttagagacatgacaaaactggcacatgtgcctgcgcaagtgtggcatggatttaatcctggggccatgtttgaaaaatggttcccagcactaggaggatttaaaactcttatagtaggagttataatagtaataaaaacatgcttactgctcccttgtttgctatgtacttcttcaaatgataaaaagcttcatcgctaccttagttcaccaaaatgcttcagcacaagtgtactatatgaatcactatcgatctgtcttacaggaagacatgagtagtgaggataaaggtgagaacttccactaatgagagaggttctcaaacggggggaaaaagggaggagaccacccctcatattgtcttatgcctagtttctgcctccaaagaaagaagaagtgaaaactgaaaggcagaaatggaatccacaggcagatagcccagcatcatgccctgggcctgctagttaaaaatccacccctgacctaactgcttgtgttatctatagatttcagacattgtatggaaaagcatcatgaaaatccctatcctgttctgttctgttctgactagtggtacatgcagcccccagtcacataccctctgcttgctcaatcaatcatgaccttttcaggcggaccccgttatagttgtaagcccttgaaagggacaggaattgctcactcagggagctcagtttttggagatgtgagtcttccaatgctgccagctgaataaagccctttccttctgcaactcggtgtctgaggggttcttgtctgtgtctcatcctgctacaacagaggtgggcagatcacgaggtcaggagttccagaccagcctgaccaacatggtgaaaccccgtctctagtaaaaatacaaaaattagccaggcgtggtggtgcaagcctttaatcccagctactcagggggctgaggcaggagaatcacttgaacccggg

SEQ ID NO: 259 - DNA, 1864 bp, Homo Sapiens
atttggctgggcctttgtctctcgctcccaccagagcttggaatccgtctctgctcttctgcattctccacctcgggagcccctggggactctgtgacggcctctgttgccctgtgatctgcaggtccggagagacgcacagctaagatgtcaggacatcctggaagctgggaaagggtcttgccatctctaagctggacctggtgacctttttggagggaaagaaagagccctggactgtgaagagtgaggagaccatagctgcacagccagtccagatgtataatctcatccctgaacatttctgatggtgtgattatgacatgtgactttatctggcaacagagtgagttgttgctcccgcctgagcccagcccccagaaaggattgtgacatatcgttggacccagaattgaggtggaattgtgacatataacttggccaagcacacagatgtaatggtgtggtgactctcatacctagaactgggacctgtgcaggattgttaattcattactggacattcctgtgggtgtgattgttacatatgcctatgttcagcacccgagtgatttgattttgctgcctggtctcagtccaaatgtaagattgtgatttatcgctgaatccagcacctcggtgatttgactctccctttttttgtgggagggatcctgcaaattttgggtattgtcaattattgctgaatcctgtacccatgttatgactctcccaaatgtgccttacctgttgtggcacaatatatcacattagacattgttaaatattgttgggttcaacacctgggtgatggatgtaactttttttctgggcctgcctacaggggaccttgtgacataactcaatgcccatcatcatggtaatgttactctcttctcctgcctgatctctgctcacagagaaattgtgacacatcactggcctagcatctaggtgatgtgactctcctctttttttcaggctctgcatatttgggtattgtgacatattgctgaactcaacacctaagggatgggagtctcctacctaggcccttcctacaggggacattgtgacatgtctctgcattcctcatccaggagatgtgactctccttttctgcctacaccctgcctacacagaaagttgtggcatattgctgtggtcagcaaccagatgatatatttctcctgcctgggtctttattacaggaaagatgattgacatattactgggcccagcatccagatgatgtgactctcttcttctgttggtccttgcttacagggaaactgtagcatattgctacacccaacacctagcttatgtgattcttcttttaggtttgccttcagggaacattgtgacatattgctgggccctgcactgataatttgtgactcttctgcctgtgatttgcccacttggggcattgtgacatattgctgggtttaacactcaggtgatgtaacttttatgcctaggccttgcttacaggaggcattttgaaatgtctttgtggctgggcatggtggctcatgtctgtaatcccagcgcttggggaggccaaggtgggcagatcacaaagtcaggagttcgagaccagcctggtcaacatggtgaaaacctgtctctactaaaacaaaacaaaacaaaacaaaacaaaacaaaacaaaacaaaacaaaacaaataaaaccacaaaaatcagccaggtgtggtgattggtgcctgtagttgcagctactcaggaggctgaggcaggataatcgcttaagtccaggaggtggaggttgcagtgagctgagattgcaccactgcactccatcctgggcaacagagtgagactccatctccaaaaaaaat

SEQ ID NO: 260 - DNA, 10240 bp, Homo Sapiens
gcacggcacccacctcggggcagcggcttcacctccccgttctcctcccgggaggccccgccggcctctcgggccccaccgagaccgtgcctcctcctctccttctcccgcttctccttaggtctgcgcgacttggcgttagccgaggcagcggcggcggcggcgggcaggaggagatggtgaggctgagcgtgcagcagcgtaggagggaccagcagtttgcgcggcaccggctgagacaaggaagcggaggctgaggagggaacggccgtgccagcggagaaagagaaactgctccgagaagaggacggggagggagcagcagacagaggggcaaagctccaagacgcggggctgccatagctctgaggcgaaggtgctgccggcggctgcagctgcctgctgttcccgccgctgcccccttctccgttcactctccgcgacggtggcggtgggggccgcggcagcgacacagtgcacggggctcggcggttccgccattttgcgctcctgttgtatttactctcctccgctagccggcgcggggcagggggcgggccctccgcgaggggtagggaaggggcggagcggccaggccaccagccggcattgctccattgggcaagccacgctgagggatccacctaagagccaatcaaaggcacaaacatcagacgaaggggcgggatcgccacagggaccctcttcggaggtcagagctcggcggggtgcggctagtggcggagcgcgctgcgaggggagggctttccactgtcgctggcgtgaactcgcgtgcccggcttcaccaggtactgccttctaacgagctggccatttccacatgtcagataggaccaacttgccttttaactacccgtgtgatacttaaacactgttgccggtatcacagcttttcttcaaaacaggatcttgctctgtcacccaggctggagtacagtagcaccatcactgctcactgtagcctcgacctgctgggctcaagtgatcctcccatctcagcctcctgagtaggggactacacacaggcaccaccatgatccggtatcaccagtctgtgggtacaaaaggagagtaacatgaacgattcaaattccactggctcttgttcccatggattcacagaagttcagccccatttcaaaacttcacatttgcttctgggaagcccattctggaaagtttctctgtggccctctccagaaggcagcgcgacttccacccagcaacacaagtctctgcagcacctgccccagcagcgccagctgagccccggaagctgggaaggcttaagctgactcttctgctgcacatagcaaaaaatggtcatttctgtagttgcagctccagatctacaataatcaatctatatccatattttatggggtttttttgagacaaagtcttgctctgttactcaggctggagtgcagtggcattatcatcattcacttgtagccttgacctccctggctcaggtgatcctgtcacctcagccttccaagtagctgagaccacaggcatgcaccactaagcctggctaatttttcaatttttatttttcgtagagacagggtctccctgggttgcccaaactggtcttgaattcctgggctcaagcaatcctcctgtcccggcaccccgaagtgttgggactacaggcatgagccactgtgcacagccctttttgtttttgtttttgtttttttttaaaggtaatttcccagtggaatcctcgagatttcttcacgtttttggaaaaatgagttacattttagattgttttcctttttggaatttaatggtatacattatattacatagctatgttgagctctatttctattacactaaaaagtaggctaattgtcttaactttcatcagtaatgacattaaatgtgtgaagattatacttggaataaagcacttggattcattcatttcttcagtaaatatttattgagcactagtatgttccaacgagtgtctgtctacattctggggacaagtgataactaaatccctgtcctcgtggagagttaacaatcaacaaactaacaaacatttaatttatgtcatcaactcatttccacaaatataacaacatcttgacttcaagtttcctgagtttctggtctaaagaattgctaccttcaagagctcaaatcatttgttggggagagaggcctgtgatatattttctcctttacaatgaaagtagctgtaaaaagaggaagagaaattctgagggtaaagataaaaaatgttgaaatcttctttctggatttcagattgagtctcttgccctaattgatgcaatttacactccatgcatctccttccctggaccttctccagttcttggggactacagatgaacttacttttaatgcattttatggcatttggaggccctccagtggacaaatactatacctgaaaaaaatccttttgctgtgctaaagtgttcaggtgtgaagtgtactcatgtttgcaaatcactttgaaatatataaacaaaaatgaattaatggatgaatagagtgatgcatagatcattagacatgtgataaaaataactgttaattgtagaatctagatgatgagtatattatatgatatggcccactgtataattctttcaacttttctgtttgaatgtttgataataaaatattgaataaaaatctttttgctaaagatttatgccttgtagttcacattattgaaaattttgctgagataacgtaaattacctttcaaaaatcatcttaaaaattgtcttaataaacatggattaatttttatttttatttttgagacaaggtcttactctgtcacccaggctggaatgcagtggcatgatcatggctcactgcagccttgagcttccaagctcaagagatcctcccatctcagccttctgagtagctgggactagagactaattaaaaaattaacccagctaattaaaaaacattttttttttttgagatggagtctcgttctgttgcccaggctggagtggagtgcagtggtgtgatcttggctcactgcaacctctacctcctgcctcagcctcctagtagctgggattacagatgtgcgccaccacgcctggctaacttttttattttctgtaaagatggggttttgccatgttggccaggctgcccttgaactcctgacctcaagtgattcacctgcatcagcctcccagagtgttgggaatccaggcataagccactgcaccaagccttaaaaatgttttcgtagagacagggtctcactatcttgccaatgctggtcttgaactcctgggctcaagcaatcctcttgccccagactcccaaagtgctgggattacaggcacaagcccctacaccctgcctggattaatttttaaatgtctgaaaaacacttatttttagaaagtttagacaatgtaaatgtgaaatagctctatgaattctttgtttgaaaaaaggcttatcttcctggaatatgtgttttatgaactcaggaaattgttaacaagttaactgaatttactttgctttttaaattagagaggcgattgtttgagaattattgacaataatttttcttagaggagatgcattggtctgggttcaacgcagaggtaaaatctacccttagctggtttaagccaaaagggacttattacatggtatatcataaaatttgtcagattaaagaaacagcgtataagcactttgggaggccgaggtgggcagatcacaaggtcaggagtttgagaccagcctggccaatatggtgaaaccctgtctctactaaaaatacaaaaattagctgggtgtggtggccctcgcctgtagtcccagctacccaggaggctgaggcaggagaattgcttgaacccgggaggcggaggttgcagtgagccaagatcgtgccactatactcctgcctgggcggcagagagagactccatctcaaaaaaaaaaaaaaagaaaaaagaaacagtgtacaggctgagcttcaggagtgactcacaaatccactttatagacctgggctatcaaaacatgctgttgatgccaggatccggaagccagcccctacagccgctagttccagagccacattacctttcctataaaacactccatcaggaaggatgcctcataatctgtctctctgccactcaattatgaattcttcactatatgcaagtgcttctagaagtggttggttggtttgttttcagacagggtctcattctgttgctcaggctggactgcattgcacaatcatgacgccctgcggtcttgacctcctgggctcaagtgattattttgcctcagcctcctgactagctgggactacaggtgcacgccaccatgtcccactaatttttttttctttttcagagatggagtctcgctatgttgcccaggctggtcttgaacttctgggttcaagtgatcctcccacctcagctgcccaaagtgttggaatttaaaattcatgtaacagtctgaaaagggtaccttcttcactctgactgacggccacctcctttcagacaatttctttgcaagttatgtgcatctgggtccacctgtaagcagaaaatcaggttaggccctcaaggagcttgcaagcaaatgtggaagacatattttataaacagctaattttaaatgatgtggaaaaactgcacagaatacaagagctaaggaagcctgatggagaaagcagctgattctgccagaggtcaagggagtggtacatggagaagtaggaaggctttataaacaaagtaaacttggtggactttgaaaggtatgtcactctacttttgcttttggagaaagtggtcagggtggggccaaaggagcaaagcacagagttggaaaattccaaggtatatttgggggctaaatttctggttgaaggttagggtggaggagcggtgggagtgacagataaggtagaaagcttggagctacataatagatgtcaaatgctaaggcctttatgctctcatggttaatttcctgggaagaattacttaaacagagctgttacttcaatatataatatcacctaactccagtcccgcctcctctcccacatccttcatctagtatagagggaacaaatcttccctgcattgtaacctaggacaagttacttaacttctctctttaacttgatgtccaaatctataaatggagattgaagatagtgcctatatggttagttaaatgatttacttaaaacagtatgtggacacagtgagcaccatatggacgcttgctacataagtaagttgtaggcagtggatacagcattgcctattagaaattctcaaataattgttttgagacatttaaataaaaaggaggctgggcacggtggctcacacctctaatcccagcactttgggataccgaggtgggtggattatttgaggtcaggagtttgagaccagcctggccaagatggtgaaatcctgtctctacaaaaaaaaaaaacaaaaaaatgagccaggcatggtggcacgtgcctgtaatcccagctactcgggaggctgaggcaggagaatcacttgaacccaggaagtggaagttgcagtgagccgagactgggccactgcatgccagcctgggtgacagagtgagaccctgtctcaaaaaaaaaaaaaaaagaaggatttttagacttgtgctaactcccaatcatgggcttaagactttcacaataaaaatcattatgtgtatatatcattctagccttaaaaaacataattgctaaaaggactattagaatgcctttctattttacagtctgggtaaatgctttcccagacttaagagcttcttagagagttttatcaaacatgcaggcacatttctgattatttaaggcttaagactttggaaattctttggcatttagctacagccttttgacatttttgctgttcattaccagtaccgtgctgtggaaaggaaaagagaagggacacacaaggtgattttatacacctacaaacagtggaaaagtgatagtggataggaaaaaagtagaatctacatgaaatatttgtagatttaacttatgttctgttctccattattgtaattgtttgtgtcatacattgctgcataataaactaccgtaggccaggtgcagtggctcgtgcctgtaatcctagcacgatgagggggtgaaatgggaacattgcttgaggccaggagttcaagaccgacctgggcaacatagcaaggccccatctctacatctgaaaaaataataaattagaaacctactataaaacataactttaaaagaacacttaatgatttctcaccattctgcatgagggcgctgctgtatgactttcttccatgtgatgtgggttgggacttgttgggaatctccccacgtggtctctcatccgtccatggcttagcctgagcttctttacatgccagcaggaccccaagagactgaagcagaaggtctcttaaggtctcagaaccagcccagaaacacatctgctcattttattggttaaagcaaggcacaaggccagctcaaatactagggctgggaaaacaaacactaccttgatgggaggagctgcaaaatattgtggctatgacttccaacacacctcagtagctgatcaagttgactgtaaaattaaattggacaaaattggtaaaaattccagattctgacttctgccagacatttattccattttgcatttatcccatttgcatttattccatttgcagatctgcagattaggaagtagacagaaacagtaagaaaaaacacgtggatagtcttaatcacttttcaagttttttttttttggagatacaggttcttgctaggatgcccagtttgtagtgcagtggctattgacagatgatataccacactgtggcctcaaatttctgggcgcaaataatcctcccacttcagcctcctgagtagctgggacgataggcacatgccactgcgcccagcttcaagaagtttgttttttttttttttttgagacatagtcttgctctcttgcccaggctgaagtgcaatgccgcgatctcgtctcactgcaacctccgcatcccgggttcaagcgattcttttgcctcagcctcccaagtagctgggattacaggggactgccaccacacccagctaatatttgtatttttagtagagatggaatttcaccatgttagccaggctggtctttaactcctgacttcaggtgatccacccgcctcggcctgccaaaatgctgggattacaggtgtgagccaccatgcctggcgaactcataggctttaaaacatatgtcttggggactgggcgtgatgttgtttttaaccactctgcttatgaactgactccaggagcagggataagagtgtaaacaacctacattaagctttactccatgggtatctttatgtaagtgttttaaatagatcaagaggtattaagtttgaaaataaagatttattaataggagtctattaatagacttctactgggaatataaatcaaaaccaggtacggactagctaccttaacatgtactatggtcttggatttaagtcatctattcagtagacatttatttatttatttgtttgtttgtttgccaggctggagtgcagtggtgcaatctcggctcactgcaacctccaactcctgggttcaagtgattcttgtgcctcagcctcccaagtagctgggattacagccacgtgccatcacacccagctaatttttggattgttagtagacgcagggtttcaccatgttggccaggatgatcttgatctcctgacctcgtgatccgcccgcctcggcctcccaaagtgttgggattacaggcgtgagccaccacgagtggccaatactttttcttttacggatggagtctcactttgggaagtcggggcaggaggatcacctgcatccaagaaaccagcctgggtgatatggcaagaccccatctctataaaaaaatcaaaaattagtcatgcatggtggcatgcacctgtagtcccagctactcggagtctgaggtaggaggatcgcttgagcctgggaggtcaagggggcagtgagctgtgattgcaccactgtactctagcctgggtgaaagagaaagactgtgtctcacaaaaaaaaaaaaaaaaaaaaaaaaaaagaggcagggcgcagtggctcacgcctgtaatcctagcactttgggaggttgaagcggatggttcacgaggtcaggagttcaagaccagcctggccaagacggtgaaaccccatctctactaaaaatacaaaaaaaattagccaggcatgatggcagacacctgtaatcccagcgactcaggaggctgaggcagggaattgcttgaatgcgggaggtggaggttgcagtgagctgagatggcgccactgcactccagcctgggtgacggagcgagactccatcttaaaaaaaaaaaaagggatggagtttcattttgcccaggctggagtgctggggtgtgatcatagctcactgcaacctttaactcctgtcctcaagtgatcctcccgaagtgttggggttacaggtatgagccaccacacctggactcaggaccatatttaagaaaatacttacattcaggctacacctgtaatcccagcactttgggaagccgaggtgggcagatcgcttgaggccaggagttcaagacaagcttggccaacatggcaaaaccctgtctctactaaaaaattacaaaaagtagccgggtgtggtgtgcatacctgtaatcccagctactcgggaggctgaggcacaagaatcgcttcaacctgggagccaaaggttgcagtgagccaagattgcgccacggcgctctagcctgggcgacagtgaaactctgcctcaaaaaacaaaaacaaaaacaaaaacgctgggcgcagtggctgatgcctgtaatcccaacactttgggagaccaaggcgggtggatcacctgagatcggagttcgagaccagcctggccaacatagcaaaacctcgtctctactgaaaaaaaaaaaaaaaaaaaaaaaaattagccaggcatggtggcgtgtgcctgtagtcccagctactcaggaggctgaggcaggagaatcgcttgaacccgggaggcagaggctgcagtgagctgagatcgcaccactgtactccagcctgggtgacagagtgagactccgtctcaaaaaaataataataaaaaaaaggccgggcacagtgactcatgcctgtaatcccagcagtttgggaggcctaagcaggagaatcacaaggccaggagatggagaccatcctggccaacatggtgaaaccccatctctactaaaagaaaagaaaaaaaattagccaggtgtggtgacgcgtacctgtagtcccagctactcaggaggctgaggcaggagaatcgcttgaacccaggaggcggaagttgcagtgagccaagatcgcgccactgcactccagcctggcgacagagcaagactccatctcaaaaaacaaacaaacaaacaaaaaagaaaatacttatattcaaaattagtcctacttttcacacttagctacctgagtctatatatgccaatatttccactaaatttcacggtcatttctctcaaagaggctagtttagtagagcagaaagtttaagtaaatgtacttaaacagtataggaacaaagaggaaatggttgatttgacttgttgggagacaggacaagttaagtttaatacaggaaatgacacttgaactaatcttgttagatgagtagggctcaacagaacaggacaaagaacgatgttcaagaggaaaggtataggatgactaagggcgttggggggctctggaaactataagtagctcatggttggagcacagatgtgaccagagtaaaggccagagagaatagcaacaggaagatcttgaacaggtcttgcatgatctgctcaggagtctggacttgatcctgtaggtcttgttctccaattttattacgcaacagaatcacctgtactgcttgtctaaaatacgcattctttggctccactctaattcaggtccagagtaggatcttggaacctgaattttaagaacactgcctcaattctagtgcaggagaatctgggccag

SEQ ID NO: 261 - DNA, 3910 bp, Homo Sapiens
actgtgatcaccgtccatggccgcctgcggatacccacgccgtgctcagaagagggctctgaggccacgcccgcctgtggggtcggtggccgggcttccgggaccccagagggagtcgtcgcgcgctaggtggaggggacccctctggaatccggcgatccccgggcgcagatgcaggagcgggtggggagagccgcgttcctggcatgtttgcctcgagttagtcacgaaggaatcgaagagagccttagtcttcgaggcttttcccttcctgtgagcccctttgaggccagcacattgatttttttttctttcgcagaacaatttcggacctcctggggtctatgctaggtatgaggtgtatctttgccctccatcaagtagcaaagatggacatgtaaacaaatttcgacactgtgatgactgccacaaaaagcagcattatgaggttgaatgtaaaaggataaccttagcggcggcgggggccggaggatgaaggaaggcttcctgaggtaggcgctggttgaaactgaagttggagagagcaagtggcatttgctgaagtgcatttccggtagaaaactccagtggtccctcacctgactgagtggcgcagtcagagataaatggaacaggtacactgaccagaaagggcaagatgggctaaacttcgccgttgggccactgggctcccccgcaggattttaaagagctagccagtagatggattttgtttttgttattttcgcaatttattttcaaatatgtaatacgcgaacttggtacaacattcatgtgataaaaaggtagatacgtgggcaggacgcggtggctcacgcctgtaatcccagcattttgggaggccgagatgggcggatcatttgctgtcaggagttcgagaccagcctggccaacatgagtctacaaataaacattttataaagatgatccttcaatacatattctacagcccagttaaaatgtgagaggccatgatctacagacagccatttataaaggtggatcagggccggacacggtggctcaacgtctgtaatcccggcactgtgggaggccaaagcgggaggatcgcttgagcccaggagttcgagaccaacctggccaacatgctttatgtgattgacacagacatggaagagatctggtccttatgaagaattctgtgctcgcaggaaagatctgtaggaataatgaaatgctttcttcattgatgagatgaagtctctgtttttcagataaagaaaagagaggataatgggaagacaaaacattgtattaaggtagaaggaagctggataaattgtctctgtaaattatcttaaattttgtattaacaaatttaaaatgactcaaataaaataacaaagaaaaatatattaatttggcctcaaggaattttctcaagccataaaaaattttcttagtttatttctttacggaagtatcttatgcttgatcagctgacttaaaggaactctcctagtgtgggactgaaaacaactttatcattgataaaagatgattagtttaaaaagttggtttttattattgaagtgcccacaggcacaagagtataggtgcttacatttccctttagattatgggaaagcccttttgagaatgcactaaatcaggaaatctttcagcaatcagaatgcatgctgaaagttcagatcttttaagttttgggtttcgctgtttgagcataaaaaggaagggagcagggagaaatgtaactaggttcacaattttgagcaagagcatatgtaaaggtaacgtatgtacattttatttcaagaaagacagaagacaaacagcataaagatgcccagatgccctaaagataaatacatttcaaagattctcattaaaatgaatctgtagtatttttttcctgcaagcaaaatacctttctttaaataaaattaaaaaaatcagtattctgaattgcaaatgcttttgttttttttttgcagaaaatctgccatgattatttttttaatgaataaggattttccacaaaacaggcttgctctacatgctagatttttaaacagttcagtgacacaatatgctaactacatacacaacagataatatagtaagaaaacactcaacctgatgaaaagttaaaatcttcattaatacactgaaaattgacataactcatgcctttaaaatcaaaaatacaaaaattaaatgttttcctaaaaagatttccttattttaaggattcatttgaaaatgaagctgcatgtaatttgtacagtaagttgtacaagtaaacaggtaatatacataaaaaattaattgacatactcctcaattatcagttgtccacctttaatttccaatactgtactttcttaacaagcatacaaaatatcaaacttctctttagaaaaagtgccgttctttgacatcctttacacaaaaacagtctgagcctgtggcatgttaatgcagttgagaggcaaagcatacgaacttttacaaattctaccttccataaaaagcctcccgaaaaggagattacacgccactataaaaatatcaacctcttgtggtagctgcattagagaaccaaggcttgaagactattttcatatagcatagaaaaaccactatgagagcatattaactgcattggtggcttgggagtgtactgtgccacaggattatgcatagctactgttaggtaccaagactgttatacagttttaaattgattgtaactgagagcataacagaggtactaccagcccatgcaaaataactaaaaatactgagtcactgtgctgaatacttcattcctggagaaaaccaaaggcagcagtaactaaatcaagccaaacaggtgaccaaactttctcctcaaagatttgtgagcacagtgaagtctgaggtatacctttatccattaaatctgtgtgccattgcaagatattaccatttgagaatatacgccatcacaatggtttaaatcttttgtatattagtcattcatatattcttatctacccagtctcttgatttttgaaaagatttcacctacagtagaatattacagaaacaaaatataaatgcatgtctttctaaatgaaacttacatagactaaaagtagagaatatttttaaacaaatatacaatgtgcaggcagacaaagcaggaaaacggccattcaaatgtataataaaaaactaaaaattgactatctccagaaaactatgaagcgcctcaactaaaaggaatgcataatgaaattctaatctaatacaggtcaaaaatgtaaaaaggttataaaccttaacaggaaaaataaaacaacttttactggccattcctgttgaaatgagaatcataaagtaacagaaaagtggctacaaacccacttagagcaccaaacagagagaaaataaaagtccattttcatctctgttattatcataaaatcctgtgtgactacaggtcaaactgctggtggcagaaacagaattctttataaactgcagatgtcctgtacataaaaaatttcactggagttgcactagttctaaagactcttctgttttagcctacctactatatgtattcgatctgagatagataaagtctctttctgtaacccttaattattattgggcaccaaagataagaaaagcaagacggggtacaaaaatgcaaaatttcaacagtaatggcaatgtttttgtcttagtccaaaagggtcctgcattctctcccccttcagtgatttgacaagtctttgtacttaatctgggggcagcaaatcatgcaagcgaaatctgtctctgatgtgtggtcgaacatcttcattctgcgtggaaaaaagacaatttttaaaaaggcataaaatttcaaagatat

SEQ ID NO: 262 - DNA, 11871 bp, Homo Sapiens
agactaggggtgaggctgctgcgaggaagacccggtcagctgtcccttcccccatcggtcctcttaggggaagtggagatgtgggcctcggagctgcgtggcccgggctgtgcggattccctaaacgccgcacttgcgcacagccccttacgtaaccgtcagtgccggggattccctggagggggtcattctattcaaccattatacacaccccgggctcctgccgccgcgccgccgccgcctcacaaaatggcggcgcccatagaggagaccgcggccgcctccccggccccattttgtgggaggcgagagatctgtcaacatggaaaacctctgctgaggatgcatccgagtttggaaaccccacttaagggatggagcctgggggatcacattaaacggaaaatgccaacgacttctaccacctctacgcgtttttagtttttcattttctcgaaggaagcgccagaagcctgtggagtaattgtaactagagggagaacggaaagctgaggtgactgctccggggacttggcgcggcgccttggtggctttggttgctcttccacgctcccggcagctgaccagaatctcttggagggtctcctgggccacctcggccgcgccagtcgtgcagtgagacttctgtagttttaaaatgccacagtccacggcccggtcggcaccgctcgcctgaatcgtgggctttgggaaccttggaggctgctgctccaggaactcgcggtcggccgggagccggggagcttcgttgctgggagcgggcggtattcgcggactccggcggccctggcgggtcgcggccgggatccgagccggggatgacgatgctgatggagctgatggggcaagagtgggaacggaggcacgtacactgaaatttaagtcatccaagttgggacttaagatagcaggttaatattgtctcaggcgagacttagaacgtcttttctggtatcccagtctgcagtgggcaaatctattgtctttatttctcatttaagggcagaatggagggatgacatatttttacttttcaagaggcggttgccacttttaagtcactgttgtgtgtgtgtgtgtacatacacaaacatacgatagtgtgttttcagagcaagtatcaaaggctaaagacttggagtgatactagtgtttaaaagcctttttaaaaaaattaagatgtgatgagaaactggagaattgacttttaaaaatttcttttctgtagaagaggctatcttcaaaatggagtcctaaagtatatctgatggatagaatttaaattcttaacactgtatataccctgtggtcaaaagcatcaacgtaaaacttgatgtttatcagattacttatgtttcaattttcctgtggttagaaaaattaagacagaagtaagctattaacggtatttgcttgtaagagtaacgttaaaggtttaaggaaaggtttgttgaaatcgatatgcatcacacgaatcatttattttcaatgttgttttccagttgcagcaatcatttgtgtttacatgactttgaaaaagggtttagtttatgttgattttgaccctcttatttaatctctagtgcagaagtgcagctttctgcaggctgcgcctcaatcgctaagttccactctccatcctctgccgcgctactcctggcatgtggatcaccaagatacaatttctggtcctgtctgttcttattgatgtcctttacagttaataaatttgattgccactaatcagtctgtatctcttgcaaaaacaccacatttagcatccaagtagagtcagagtatgttttttatgagattgtactaaagtaaccttctattacatttcttattaccatattgcatttcctatagtgggcagcatagagcaggtggatcctgacaaagtaatgttagagatgtgctgacagctttacaatagatattctccaactaatttgacaagatataaaataaaatgtagttcgtagttttcaagcattaatggaaagtgttcctattaaaaaattaccaataacagtggaaattgttgcaatccaatttgtatagtttactgttttgatgacaaagcgcttatgatgggaaaaatgtagtgttgcttttgtaactgcaaacgctgcacgccgtaattagaggtttatgttattttatttgaatttttcattcttaccatcagttttcatattagtcaggaaattgtgataaattaaaaattccctcattcaactaaaccttaaaaaactgtacccagtttcaaatcaagcattatcaggtgtatgattacaacagctgaaataaattgaggaattggtatgccaactcagtggagaaattttgggattttaggtcactctaagatttaaaaaaatagtttgattcgttaaacaaggctattgaagttaaattgatatttccttaaagatgattttagagaaaaattccttggcgagcttcgagaatgcgttcatggcttctgttgcctgtacctactgctatacttttttatgtggactaatttgtcttatttgaaaatttgattacaatatcaaatcctagatgaagcccttccattcttagggtgattctaaggagtactgataactaagctcttaaaaggcgaggaaatagtttattctactgcagattagggtaatcttaatacagacactctgatggtaattctaagcagtgttgataactaagcttttaaaagataaggaaatagtttattctacttcagagtagggtaattttaatgccctgaatatactctgaatcttttatagatagatttctggatgatttggcccaaaaaatctgataagctttggggaattttttaatttttttttctcttaaagagaaatcagaaatgtgggatttttttaaaaatttattttcagtagatattggagattatgctttgtacattaaatccagtttgatttttaagtgataattttcaattaaagactttttaataagacaactaaaaaattaaattttagtcaattacaataatattttttggagaagcattcccagatgtgcttttgacggggagttgatttcattagttgtttgggttgtttaatccagaatttttaaaactgttatgggtttaatttgctacatttgtccattcttattcatttcatctgttttgatcactgaaaagttgtctaaaaactgtgctcattatacacagtttatagtattttaatactttgtttatagtatttaatagcttctgaaaactttaagagaacatactaaaccaaggaactatttattaatggtaatctatatttagtaataaatatatttgtaacttactaaatgtaagtttactaaatgtagattactaaatcactgagtaaatatttcttgaatatttggacaagagatggggggagggagaatgacttgaccctcaagaaacttaactgctacctttaaaaggttataatgaagctgggcacagtggtacacacctgtagtcccagctactcaggaggctgaggcaggaggaccccttgagccgaggagttcgaggctctgtctcttaaaacaaaaaaagttataaaaatattcagactggagggttcctaacttttaatacttaagcagggtctttaccacagagttaaatttaaaattctgtttagaatggtaacaaatttaattatgtacaaaacagcatcactttagtgttaggatcagtgttactcaaagtgttgtaatgttaataacaagcatttaaatcacattgtttgaaaactgggatctacaaaaaatatgattccaataattaactttttaattatgggaaaggcaagggaatgttcagtgaatgtaaaaaaaatatactactgagcaaacaaattgttttaatgaattttgattttctgttttaattttttggtacattgactcttcttgacatggcactttgctattaattaaaaaaaattaaaccccaaagacaaattaattctgtatttaatgcagatttaattcttgactagctgtaatgcttaaggagttggcagtcttgttggcaaaacaataaaataggaattaagctgaaatgtaaaattgtgtaataattaggtttcattaaagtatatatagtttccttaataactacatgagtcagtagtgttgacttaataataagttatttagcttttgcttttctctgaaaacatatcaaactcttcatatatagcatcgaaatagatattcaacctgagccactgtaaattgttgaagcttattgctatacattaagggaaattctatccaacagttcagtgtaaacaattttttaaaggtgctatgattctttaacatgatttgtagtatgtagaactcaagtattctagaataatctttgcatgataatgtatgagaaacatttataaacagtccttcaggtgtacaaaataactgacataatattttgcatttaactacactgcctccaagtattttaaacaaagatgaaatttttagagtattgtgctatatttttataactgaatttccctcttattaacaatactcataacatttagccattaatgattactgatagcttaaataagagtgtagtttctgtttctaatgtctattaattttaaccccatttaaagatatttcctacttatcatactcaaagttaatcagaagttaaataaatgatggtccttctggttctctggaaactgaaaagaagcttctgtttctttagggtatgcaggaattttttttcttcccagtgagctgaatccatcctttacgctgctatttgctaacctcagttgtttttctgctccattaaagttgaggccaccaaaaatagtagtaatatcacaactacaaaaccctgggtggatttgtacccattgcacatacacttcttgctgccaattcctaagagacttttgaaataatagtatattcccagctggacaatatattctacttgtggcctatgtatagtgttcaacaagtccaggagccctatgaaacggaatgtgtttactgcatttttctagggagaagttctcagcaggcacgggcatcttaaagaccctgtgatgcccaaaaggttaaagctctatttgctaatgacagatagtaagtttggaggattgcttcaggtgcagcattttattttgtgggttgttggcctgtagggaaaaacattttgaaattgtagttaaggaataccacttcagttcatcaaattaaaaaaattatggcaaataagcaaaaatctatttctaaagaactacatacaatatattcttacagaaaattttagattaaatgcatgtaactgtttttttggtttgccatgtattgaaaatggatggatgggggattacattagttgatgtatttatttatttatttttgaggcggagtctcactctgttgcccaggctggggtgcagtagcgcagtctcggctcgcaacctctgcaccctaggctcaagcaacactcgcacctccacctcctgaatagctaggactacaggtgcacgcaccataccacacctggctaatttttgtatttttttatagagacaggggtcttgctatgctgcccaggctggtcttaaactcctgagctcaagcaatctgcatgcccaagccattggcccatcttggccttctaaagtgctgggattacaggcgtgagtcaccatggtcagcccatattaatttaaagtaggcttcaaatataattattcactaattgggaatgcctggggatgtatatgaatgtattaccgttttgtgagtagtagtgtgtgcttgtgttcatggatggcattcatcagaatgtttgcaatggtgtagccaggttacactgccatcttcctgttctcctttgtgcttacttgctctgcctgtatttgctgcagtttctagcgagtgtatgtaggtgttggcccagaacttgcttttgtagagatcatacattgtgctaatttatcccaaatcagtttttgtgtattatctgtgggcccaatgtgtaatttgaactttaaggatactacttcagactgcagtgtagcataacctttaaaaaaaaaaatgctagttttgccctaatctgtgcatattccagttgttcaatgggtattagtaatacatgaattacttctgtgccctttttggtgtagagtctcatatgaataattactgttatttaaaacccacgactccatgcattgttttggtgggagagggtagtttcccatcatgttttacatatatgttagcattcagattttcctttttagcccactccctactgaactgaagggaaagggcgtatttgagagaaaacatatgctttactcaggttccaataattaagccaatgcacttgatttaagttatacatttagctcattcttaaagtgtaataaagactttaagcctcctggctcccaaatcagtgctttttctactaaacattctttctgtcttgctaaaaaaatccaattttcagaatcaagttagttgctaagcaaatatgcataaaaccatacatttatctgaattgtttctaatttaaggagtagtatataaaagtttcaacagaaatcattgattagtaaaagtgatggaaaatcagcaaaataaaaatagaattagagtaggctaaaaggcccttctttagggtaatcggaaaactgagttcaaatatagggtctgggacttctcaggtgatattttatcttaaattagaatctgcatgaggtagggtggggccactcatgcctataatctcagcactttgagaggccgaggcaggagcgtcccttgagaccaggagttcgagaccagcctgagcaacatagcaagaccttctctctatttttaaaaaactaaaattggatttaaataaagaatctgcatgaactttcttgtcacttattcttacatattatttgccagtgtgcgatacttaataaccaagtaagacacttgaaatgagtcttttaaggctacaacttaggtaacattttataaatattactgctacatacataatacagtaactttttttagcctcacaataataccttgtacaatttataactgctaaagggcctatagaaggctacccacctatgtaaaaaaaaaaaaaaaaaaaaaaaggtcctagctctgtctggtgtagcttggcaaattatttttgatatgaattgccaggaatataggggtatcattccttgctgataagagcacatacccttcctttgctggctaagctatgtgattctgtaggaccttagtgtcatggccatcctttcagtagtaagcagatttagagaagttgtcccattgttaccttatttcaatagtttttggtctttctatattgtgcataacctcacttaatcagattgttatgactgtttccccccaggaagtataggaagataaaaaaaaaaaaaagccaggccagatatatatgactgaacgtgagctcagcaaatgatataggtgtcttaaacatactttcttttttttttttttaaagggaggggttctggctctgtcacccaggctggagtccagtggctcaatcatggctcactgcagccttgaccttcccaggctcaagcgatcctcctgcctcagccttctgagtagctgagactacaggcatgcagccccacacccagttaatttttttatttttatttttgtggagacaccgtcttgctgtgttgcctaggctggtcttgaactcctgagctcaaccagtcctctcaccttggcctcccaaaatgctgggattacaagcatgagccagggcacttggtccatattttgtttcttaaagtcacaagttaaagctggaggtttcacccagaatcaaagtgccaggtagcattttagtccagcctaggataagcagctgagtttccatgaacacagtacaagaattcagggatatcacttgctaaatgtaaaccagttacctccgtaatttcccaaaaattttattgtgacaaacgagtgccatactctgaacattaaaggcttttacctccagctgtccaaacattgtgcatgttattcgggtagaggcactggtatggtaggagtttctcctttagtgtcttgtaattgacaacagatccagcatttatggaatgtattgttattgtaacttttgagtttccatagccaagaacgtaagagtaataactaggtatagtccattatttttagtaaagttagttttagttagcctttgatggtagacacttctcaggttataattcagactcaataacaaagccagaaagttcaggaagggtagggtagtgctgtggtctgaatgttgaaatcctaactatcaaggcattaggaaatggaacctctaaaaggtgattagatcatgagggcagaaccctaatgaattagtacccttataaaagagaccccagagaactggtttgccccttctgccttgtgaggttacagcaaaaagaccatcatataggaagcaggacctcaccagacaccaaatctgccaacgccttaatcttcgacttcccagactccagaactgagagatataaatttattaagtttataagctacccagtctttggtattttgttataacagcccaaactaaggtaacaagaagcaatcctcacagtgcttgcttaatgtcatgcacctgtcattctagtggtgctcatttgccagtcttttttttttatgaaagaaattagcagtcctgctttctcttgttttgagtgacaggtctcaggtaaggatttattttccagaaagaaagtgactaaatagattccctccagaaagattttcagatcagtagatctgccttaaactaatgtagtctttggacccagttcagaagtggccaaggccaatcctcaatgcatgaaagtaaaagttagactgtatttaagggagacaaattactagttaggaaccatcgaatgaggtcagaggcaagaccttactaacagatgggcaagttaaatgctatcttctgaaaattttagttgcttcatgatggactcatttggagcatatctggaaagttttttggacatgtctaaaacacggggttgaattttccttacaagccagggttaggacaggaggtcgacctgctgtctagatagtctcagcactaccagaagctatttgtaagctgtactactagtctggtgactcaagtaggaagtgtccaggaacctttcttctagacactgcgagaaaccaaagattagtaataagaaattgtttgatagacaagatgaacatcttaaagcatagattcaagacagaggacctttgtacctgacaagtactcaggaagacttgaaaagggcccccgcaggtgagtttcaggctctgtcttccactcatgaacctgcaaaatccaatccttgctgctgaagatttcttaagaaaaatgaacagtgtacctggccacttcagtgtctttagaatcccatcttggtgttatactttgcctattgattctagatggagaggtatcaaatgctttacaaaatctcaaggagttataaactacttttacaatctgtgttataaagtgtattccctggttattataaataggcaaaatgctattccaaatctaacaataaagacttttgccaatactcattgtttcagctttcaaatatgttaagtatgttttctacccatcctacaaaagtatacataatcactaaaacttatgaacaacacatatatgatattaacctgaatatttacagagagctccccggagggatgattttatttattatgttaattctctatttgtttagtttgtgacctgatcttaatagtaacaagtgaatgagttagcagaggaaatcagttaataaatataagagcaacaatgcctgtgaagaagtcaccacatgggccaggcacagtggctcatgcctacgtctgtataatcctagcactttggtaggctcaggtgggaagatcccttgaacccaggagtttgagaccagcctgagcaacatagcaagaccttatctctactaagaataaaattaaaaataaaaacatgaagaaatcaccacagccttagtttagtaacgataacagtattttgtaatatccacagcagaggagactaaggactagatattttagctcctccagaagcgaggaatgtttattgtttttacaattgtctacaatcaagaactacccaaaagcttgaggagcatcagtcatttatgacttttcagaagttaaagtatcatctcaggtgaggacagcactttctgccacctaggaagaatatggagaaagcaaaattttttactactttgtcttaagaacagactgcatgtctagaagccaatttggtttttttctccaagctgccagttccctcttcaatattatacagtgttttgttttggtcatagcaccaattactaatttaaatgagatttaacgaaactctttcaataataaataatacataacaaaatacgtgtgtgaccatatatttgcaagaaaggggttgtgccatgaatctttttttctcagtttaacaaataaatttgcaaaggcaactttcaggaatcagaatgttattttaaatattattaacaagacaacaaattattcagacaactaatcagaattatagactttaaacttacgttatttttcacagaatatagcaacactgaaatccaggcgtccaggaagactattttacttgaaataatatttttaaacccagttttatgatatagaatagaattctatttgcttttctgcagctttagggaagaggggacattttccccttttgatattgctggttttttttttttattttaagaaaacagcaattagaagtgtctaaatatcagatttccattagctagcatcaagagagaagagtaggtacaaacttaaaattcagaaaaggacagaaagggccaggcatactggctcatccctgtaatcccaaacttggggaggctgaggtaggaggattgcttgaggccaggagttcaagaccagcctgagtgacgaagcaagatcccgatctctacggaaagatcagccattcctggtggctcgcagctgtagtcccagctactcagtagactgaggcgggaggattgcttgagcccaggagttcagggctacagtgagctgtgatggcaccactgcactccagcttggatgacacagcaaggccctgtatcagaaaataaagagaaaaaggacagaaagataatgctaacaaatggaatatggagcatataatgtcttgcctctacatgtaattaagaatagaagtaaaatttatctcagattaagattttttttgaaacaatctcaacagtctatattcagataagacagattttaataaaattatatatgtcagtcatctgtttcaaaaatttcagggctatttttagtctttatcaagcataacttacagttatagatagttgtggttttagaagctattctatttgttattccctctgtatcccttaatcccatgcctcaaattatttcagaatactttcccaataaatgtactaacttgttcttttgtattccaaaaatgtgaaaggtgttaaaagtttgtgttttcagtgcctttggaaacacttaaaaacgcatctttgaaattgtgtgtccaaaccagtatttcccaaaatgtgccatgatctgtttataggtgttgagttaaatatatgtatacacacatatattatatacacatatata

SEQ ID NO: 263 - DNA, 1607 bp, Homo Sapiens
atgtttcactgttctcagaaattaagtcctatactgcctgttgtccaatgtctgaaaacagttgtcttgtgttttgcctggttttctagttgttcctctatcatagatggaatccataataaatatgatgccaatgccaaaatctgctactatattactctttaaagcagagactgtataggaagaggaaaaaagaaatcagtgtaaccgtgggggcaaggcaggaagcattctgtttatgtaacacagacgtggcattctttactttctaacttaggacatttgtgatttgaagaagagacacctgaattttcaatatgttagtctttgttggaataattggctcttctcattctttagtcatcaaataatacttattaaataccaactaagtgctttgtgccctgctaggcattacttctctttattctacttcttaacagttggaatatgccaaacaaatgaaataaaaatagttttcctattctagttacaggttggattcttggatttatctcccaagctttgacattcagaaactgaaagtggaatatagtgtattctcagatgtaaagttgatctcatttcctcactggccatctgtttatttgcgtctaagaataacaaaactttcatagtcatatctgtattttttaattactaaaaataatgaatggactgaaccatgcttgccccacttttgaaacaattccttctatagactgttgcagtaggaagctaatacccctgattaagaataaagaccagacctacataagcatatgttgtattggtgtatctgaagtcatgaggatgtgattaatggtccttaagagttttaatttggcgtgtcttaatgcctaaatctcacttaagcttggttgcaaagcctggcaaatcagtcttctgtacatggcaagctaagatgtggcaccatcttcttgaggtttcatatcctaaacctgtctgtccttacaggttaaattcaaaggatagggccaagcttgatttgctgtagtcatagtgaatcatcacagatccattcttagtgcagaagagttaaataattccttggccaagagcatggtgccttccccagaccaatttctaacagtgtcctctgttagatctttaagttaataaattcttttattagatttttgggtcagaaaaacagactatgcttgtactcaggagcccagaaatacataatataattgactaattcctgtctttgaggtcttaacgtggtttcatgtgccttttgatttgtttttacatgtggatcattttcccttaacactttaatatgatacaatttttgtctatcgtttttcttaaataggagggagaaaattttttttagtaggaaaatatctggtggtaagtggcatctttttattccatgtgggatgcagaagtttctcccaaaaactgaagtgacctgctttttgcagataggacccctgtatttctcccatattactttatagctggtagatggtagggctgtacacagcaaatgggtttgaatgcatgatggttttctggtggagctgagataattagtattatgaagccacgcttctgattgtgagaatgagaac

SEQ ID NO: 264 - DNA, 1976 bp, Homo Sapiens
aataaaattgtgtttttgtttccagtgtttattgttagtgtatagaaatgcaattgatttttaaaaatgtatatcttgtattttgtgaccttgcggagctcactttttaattttaggagattttttctttgcatgatccataggattttctatttcaataataatgccaactgcacacagcacagtttatccctttttttctcaatttacatgccattatttctttttcttgttttattgcactggctagaactttgagcactatgttgaataagagtggtaacagcagatagatgttgttgccttgttcctgattttacagagcaagcattcaatctttcattctttataattttagctgtgatatttttgtagatgctgtttatcaagtagagaaagttattctcaatttttatttttctgagagtttttaaaattataaatgcatgttgaatttttcaaaaatctttttcttcatagagtatatgatcatatgctctttcttctttagggtgctcatttgatgggttatattaatttattttcaaatattaaagtagtcttaaaccacttggtcatgatgtataataaattctatttactaatattttgttaaagatttttgcatctatattcttgagggatattggtctgaagctttcttttgttttgtttggtactgtctttggttttgatatcaaggtaatattaacttcatacaatgaattaagaagtgttctgttttcttcccttcaagagattgtgtagaattggtgttaaattttctttaaaagtttggtagaattctccagagaaattatttggcttggagattaatttgggatagagatgagtttttagcttatgaattcaatttacttaatatttaaatatctgttcaaattttctatgtcatattggataaattgtggtagttttctgtttttttttttcctgaggaatagtaaaatttcttctaagttattaaatttagttatgcagagatgtttgtagtattcacttactatctttttgatgtcttcaggatctgttttattcctgatgttggcaattagaataatctttttccttttttgtcagtcttgccagaagtttgtcaatcttattgatcattcaaagaaacagcttttcgtttctattttttttttgttttcatttccattgcttttctgctcttatctttattattgctttccttgtgcttactttatttagatttacactggtcttctttttatagattcttgaggagcaagcttgaattactgatttgaagcattgtctctaccctaatctaagtgctatctatacatctggtgctataaatttccctcttagtcctgcctacatttgtcctcaaaatttcggtatggtgtgtttttattttcattcagttgaatatatttctcggatttttcttaaatcttcttttttggccaatgagttatttggaattgtgttgttcagttttcaagtctttgaggatttttctttctttctattattgatttatagtttgatttccttgttatcagaaaacatactcttcatggtttcaattcatatggcccagtatatggtctttcatggcatacattttatgggtgcttaaaaagaatgtatattcttctgttgttgtgtcctataaaagtctattagattcatttagttaagagtgttttaatcttctataatcttgttgattttctgtctagttgttctatcagttgttggataggggtgttgaaatttccaactttagtcgtggagttgtatagttttccttttagtgatattgcttttcatttcacatcttttgcatcttggttgtttgatacgtatacttttataattgctatgtcttcttggtagattgacccttttgtcattatatggtgtcttactctaattcttttgttttctctgttctatttaatctgatactataatagaag

SEQ ID NO: 265 - DNA, 705 bp, Homo Sapiens
gcagaaaaacacaaaaaagaattgacatgtcccatttaacttaaactattcaaagatccctgcttgacgccctgcaaacacaacttctgcttcacctgcctcaggcagttggagagggagaactagcatgtcctttcacttgttcccagtgtcttgacatctcttggatccagaggatctagaccaatatggccctggggaagctagtggctgagatcacagtgatgacacttgtgacacttgtgctgagcatgttctgcatggagttctatgaaaagatgagtctgaatgtggccacaagtaataacctcctcatattttctaatgacctgtggagcctcttatggagatatgtccagatgagaccaccagagaatgccaagacattaatctctgttcctcctgtcctagggtcctcgtgcttcacctctggctgacattattaggagttgaaagtgggagaaataaaaagatggattgcgggtgtttgcagagaatctgcatttcatgaagaacctttcctagtatcatcagatctctggttctgagtggtgagcctcaagagcgtatgtgaagtcactgctagcacagaaactaggacggttctccatgtgagcccaaacttagaagtggggattttcctggactgtgacctgaaaaccatttcatttttcaacacgtctgatagtttccatttattcacct

SEQ ID NO: 266 - DNA, 3909 bp, Homo Sapiens
acagacaaacaggtactggcaagatagactatgctgatggagtaaccaagtttgtgagtatatgaaaataacgagggatgacatatgggaatattacacaatgataaagttggaatgtcacaatgaataaacaaaatctgattcagagactatgccaagccaggtgataagatcttgaagaaccaagatccagagagaagtgaaaggaatcagtgttccatggaacggaagtgcatcaggaaaggaaagagaaaacagattcagactaaagcacgtgcctgacaatgtgtctgctgcattgcatgaggcagccttgctgcagccaaccatagtggggtccaattaagaggcttaattgaagaattccaagttagcagactgtcctggcactcagaggatattgtgcctggtaatgatagtgttgaattggacagaaagaatattcacaaaggtggctgtccatatccatgggttctgtatccatagatgcagaattcttgaatacagagggttgactgggagatctgacatctgcaggttttggtatccgtggaaggttctgcaaccaatctctggtggatgtgagaggtgattgtacttaagcttcaagaaaggcctcctctgctaaaaatgctctctgattagccattcactgcttcctgaactatgaagacatcttctaggaatactcaggatcttctgctatgtggctttaatttattttaagattaattcctcattaccttcttacacaaagccaccattagcatatcaagcacagctgtacaaatttttaaaaggccaaaagatgtatctgccaattctaggaggatataaacctgaaggcacaaatctgggctggagcacatggtttcccttgtgagaagaaaaagtctccttcctctgaatggacacaccttgcacaccagggcacaaggtttgtctagaagagcacagctgaacatcataaagtgcagaaccacacacctggcatccttgtccctacacaagtttagacggggtttcaccggttagccaggatggtctcgatctcctgatctcgtgatccgcctgcctcggcctcccaaagtgctgagattacagacatgagccaccacgcccggccaccttggatcctttaaaagtaatgtatggtttaaggaggaaatttggttgaatacgtttaaggaaatattaatccaacctgtttaataaacattacctgtgaacattgcattttgaaactgttcaaatataccaaatgattcatattaattagaacaaaaagtccaaaaagagaaaactacaaattctattacactatttaaaatagcatacaaaaacaattttgagcaaaataatgtaaaagtagaaactgataaattaaaaaatagaaacgtagaattaattcaatttaatccctgtatcattggatacacacacagacatcaaagagagagagaacatgaaatatattagaacattaggtatgagaagaaggtatatatccaaaattaaatataaatttaactgctatctgggttattattttaaaatctcacttaaatgaatctatatctgagcagatacaaattatttacatttttctaaagggttaactgataaattctcaaaacatttcaactatcagaaaaatcatcatactgtgtaaacaactgcagaaaacacaaaataataaattctcatgttttcaaactaacaaaattcttctcttaatgatttccaaaacacataaaaagaaaatgacagatcattcctaatatttattcaaattttttaaaaaaattaacgatataatccagcagtatgttatagaaataataagtaaaattagttctaatatgacaaaggtgatttaatatttgagaatatgtaatatgaagcaagtcattccaaatgaaaatttcgtaaacataattttatttttgtaatggcattttagaagatttcaattattctgtaattaaaaatttagctattttagggtaagagagattccatgaatatagtgaatagtaaataacctacatcattgttcattttcattcaaattaataataaaatgaccttactttctttgaccagaaacattcataattgttctggcaattctgatcagtgaatgatgaaacagaattagagttctgtttctaattatttcaaggaaaagggtgaggttgaagatatcctatctaaaactttatgtaatatatataatatatatagatgatatatagatatctattatatctaatggatatacagacattacataagccttaaagagtcagtcaatacttgttatttatataagttcagtatttttttgactataaatactcaaaataaattatgtcatcaaccaaagatgaaaaataatttcatttacaattgctcctccaaaaagtcacaaaaacgacatgggaataattatagaaaaaaactaatagtataataataataaattacaaaaatttttagatttatcaattaaatttaaatgtatggataatcacagtttgaccctagattttaaaaaatcaattctttctaaacattttattagtttatacaaaataaattaaaactccatggtactgattttgtctcttaccaaaatttttgccaagttatctggaaaaattaatttccaggaataattatgaaaaaataaagtccattgcccaaaatactgtactgaggaaaagattatttcttataaacagtcatattaagtttttcttctcatcttgtatctcaaaataaatttcaggttgattaaagtatcaaagttataaaatgaaaatattaatggaaaactgaataaaatacaggtcaatattgaactgatttgtggataggaaataaaatgaaatgattgaaaatataacacaaatttaatatattgctaaataaaaataaatggtactgaagaacattactaaaattaaatgtaaatgaagaactaggaacactataagcaatgcaactaaaaattggtatatttaatctaatctattaaaagcattctagtaacagaccgtggatgtgagaagacaacacaaggaatatgaccagaaaataaaaattaaacatatttaattttaattataaatgctattaaaatcaaattgatttattaacagtaattcacaaacattcaggaacgataaaaataataatacttaataagctaaacagggaatttcacttttaatagaagagtaaatgaagacaatctctctgtaaagcaattcattatcttaaaatattattctttgaaatagtaatttttagaatcagttcctagaaataatcagtgacacacagttttgtatataggataaatatattcatcacaatatgattgacggcaaaataactgagaaacaaatgaaatgtgaactatgataattgaattatagccctaaaatgaatactaatcattaaaatgacattttaaacttttcggaagaatcgtttaattattttatacaaactaatatgtcaacattattttaagaagcaaggaaaagagtcaaataaaataaccaaaatatatctctgtccggaaatagcacatttggagaacatcattattggtctcttagtatatagatttatacagattctttgagttcattatgtttgagaatatttttgtcttgctgttataagtaagccaacaaaagctgtttatagtattcttgtgttataatatattctccttggatctacagataattcgttcacttgtgtctgcaatttgttactaaaaaaatctatggccaatatgactaagcctacctctcatctccatgagtgacttgatattttctgcatggaccctgaagaatttttcatttttcaacttcaatagtataatcg

SEQ ID NO: 267 - DNA, 2477 bp, Homo Sapiens
agacaaggaatctggagttcaatgacgggagacgcacagggcagagcgaaagacttttgcattctggtaaccaactgatcctacccggacccatgatgcataactcagctggtcctgtggcgcacacccagaggccgactcaatgcatgaagactgttttccacacccctatgatttcatccccaaccaagcagcagcatccattccctagccccctgcccaccaaattatccataaaaactctggcttctgagttctcagcaaaactgattttagtaataactccagttcttccacttggctggccttagttaattaaacttattctttactatagtaccgtgttcccagtgaattggttttgtctgtgtagcaggcaggacaacccatcaggcaatcacacagttactctgcagtgcttctttttattttgcttttcaaacaaatttcaaatattattagattgaaataaactatacaaatagcttttcctcacaaaaatgcaatattttgtgtattattcctaggtaaactacaaaacttttatttttggaagtttttttttgcaaaaataaatcaagatgcttatgcatataaatcaagatgaggcaatgaaaaaaaaccaaagaataaccaaagagagacaaatcagttgtcagtgtctgtgaactcatgttctgtcttgcttgtaaaacagagggttcatgtgtggtccgctaaaaagctgatggcccagttagggtagagatacaacaaaggggtgcaagccccagcaacacatgtggggcaacagtgaggcatccctccattcaaactgtaactgtaactccttcctttcttccttcctccctccctcccccttccccctccatccctccacacttcccccttccctttcgcctcccctcccctcccctccactcccctcccctccttcctttctctttctttattttttttttaagagatggggtcccactatattgaccaggctggtctgtaactccgggcctcaagggatcttcccaactccacctctcaaagtgctggattacagcctgagccactggacctggctactgtccattctttgatgaagacaaagtttaccctgaaatcctgttcaggtgagcacacagtttctatcactttctggtaacttcctaaactattccttatggaatagttttaatagtgcacttaaaacacaatgtatttgagttggaagcttcgttcttttgtataaatttttttctccctccctcacttcctcaacatttatttcttccaaaagctgataactcaaatcctggtcattagattggtagattataaatgtaattcccaaaatgactttaatcccttcatcacgccactggcgggcatcgcacagaaatgaaacttgacactttgaataccatcttcttggagacagagaagttttcaaagcatgcaagttcaggctgtgattattcaacatgtaggacatagatggctaatggatttggtgggaggcctgtagccaaatttacctttagtgactaagtggcctaatgcaaatcatagttttacttcctaatagtgaaaaacaaagcatcttaaaatattatctcaggtattgtcagtaatttccgagttacttttggaggctctgactcatttgtatagagtttgctttatgtgtctatcattaaatgcaaaccatgttttgtattaagagttatgttaaccaagtgacatgacctgacctctggtcagtgtttttttgggcatattttgtgatgcttacatccatctgtgctcactctcagtctccatcctgggaacacaggacctgaaatgatatgtaaacattaagaaagagacatagatgtcaggcagatagcgagcatcataaattgtgaacagatagaagttctttgcctttccgtgtgtatttccacttgatcttccagcaatggagctccatagaagtgcgtctagattggtgagtcactctgtacatgtcagcagtgtgttactctgacatgttgagctggagatgtcctgtgtcttagtataagtactttgaggtgctgatctgagaaaatctaagtttctgaataatgtgctctaccattgggacactgtttctaataatgtcaaaggctagttgagattctaggttatcctggtaatccctgaaaaacttcccagaaggtttcatttgaacatcatgtttagtggccacattagtggcttcctcaaaccaaaaagtataataaaattcaatattttttaccacttcatttgtgaatgtgataactgtagttaagctgctgcctgtcaagaagatgccagaagtttgccactggaattttccccccaaaggctcttgttaagatagggcattttttgaggcgggtggatcatgaggtcaagagattgagaccatcctagccaacatggtgaaacccaatctctactaaaaatacaaa

SEQ ID NO: 268 - DNA, 3744 bp, Homo Sapiens
gtcacatgttgtcaaacatggctacctacaccaccatcatagaagagatggaagtgagttcttctgcagcaccccagagccggcctgcagtcaggaaggcctccccagaggcatccacgaagctgcctgccaacctgggtgccccaggcatgggcccctctaagcctgccctaggaggagaacagtttgtgtgacacagggggcggaggctgggtctgaatctttttttttttttttttgaaacagagttcgctgtgtcgcccaggctggagtgcagtggtgcaatctcacctcactgcaacctccgcctcccgagttcaagcgattctcctgccttagcctctctagtagctgggattgcaggtgtgcaccatcacgcctggctaatttttgtattttttagcagagacggggtttctccatattgggcaggctggtctgaactcctgacctcaggtgattcgcccacctcagcctctcaaaatgctgggattacaagcgtgagccaccgcgcccagctgggtctgaatctttaacagttcccctccgctcctggagcccctcccacagccagcccttgctcaccagcgggggaaccaacagccccttcctcaccctcctgggggttggggtctctctccacaataccagtgccgggacgcatccctcgtcttctctgctcctttccgttgtccggaggcctaggcccagtcatccagccagcctccacccagctcctctccctgcacacaaagactgaccccatcaagctgcacttcctgaaacacacccacaaaccagaaactcagcctcccctttgcccgcaggatgcccatgggcaaaactgtcaccaagagaagagaggaggggcccaaaccggctctgtctctgtggagaaagagcctgcctagggctggaccctggttgtgtggcttcaggtactgtaaaagggattgagttcaaactcctgacctcaggtgatccatccgccccagcctcccaaagtgctgggattacaggcgtggaccaacctggtgaaactccatctctactaaaaatacaaaaattagccaggcatggtggcgggtgcctgtaatccgagctactcaggaggcagaggcaggagaactgctgaacctgggaggcagaggttgcagtgagccgagatcgcgccattgcactccagcctgggcaacaagagcgagactccatctcaaagggcaggacccaatctcggaggagctgcaaatctcggcatgctcgacaaattccagcagggcatgaatcatgggctcctgcctcgtgagggccctcctctgccagtggggctggtggagctctggggctcgcctgctgcccagcttggaggcagagccgggcctgacggagtcctccctgcacattccagaggagctcaagccagctttccccccgggatctcacctgacactgcaaggcagagtgccccacgaagagagggtttccttcgcttgcctttttgccctggcaagactggcaaccaggagtccgtgagcaccggtgcctcctcaggggtggcacctctttctgggaagccacacgggtctcagacagctgtgcccttcctgctgccctccagctgccagaaggccatagttcccatgtgccctggaatgtgggactctctttgagacgtccacttggggacctgtcctcaggccctggggtcagcacacaggtgggcagtttctttgggctcagggtcaggctcctactggtgggtgaaggcagccctttgtctcatgtcttgccccagcgttcctgagtagcaggctccctcccccatcctcttggcagctgtccctccctgctccctcccggtgaccacagccaagccaagaggcctgtgctctgttccccacacgtccatgtagagtggctggacaccggtgttgattgctgtggaggtggctggagggagtggacattccattgtaatgatggcaaaaatagccatgatctttcagccactgctgaaactgctggagtcaggcccttcccaggtatgatttgccctccctgatggtgcatttgtctcccagatgtgcagatgtggaagccgatgtcctggggatcaggggaacctcatgagggaggaggcagggggccaggactggctcctgagctctgcaaccccagtgttgccgtctgtcttttaatctttaaaaagaagatacaatgatataattaggatgcggcaatctcagcactgggaggccaaggcggggcggatcacttgaggtcaggagtttgcgaccagcctggccaacatggtgaaatcccatctctactaaaaatgcaaaaaaattagccgggagtgatctcagctactcaggaggctgaggcaggaggatcgcttgaaccggggaggcggaggttgcagtgagccgagatcgcaccactgcactccagcctgggcaacagggcaagattgtgtctcaaaaaaaacaacaaaaacaaaaccaataataataattagaatgctgacactgtctctagcttttctgggtctctcccattcctgtagaatcgttcttgcccacaatcacctgcccatctctcttgcaccccagaaaagttttgcaagttcaggaagagaaaaaaataatctgacatgtactgtctgtattctcccatgacaataatctctctgtggggggaggggtgtccatgtctaccacggtattgaatgaatattgaatgaatggctgaatgtgcatgaaggaaaggagacagtgggtggttcaagtgtggttgttcttgcttccccattccaatcaggacataagcggggggccagggaggacaaggccaggctggcagagtgtcatcaactcacggctgctgcggtgggtggccctcctgtccagcaacagcatcagggggtgggtgagcgtgttaggaggggacagaaaagtaggggccactggcttcccccacccccaatctgccaatcctacctcagaacagtttttttctttttttgagacggagtctcgctctgtcacccaggctggagtgcagtggcttgatctcagctcactgcaatctctgcctccccggttcaagcaattctcttgcctcaggttcctgagtagctgggactacacgtgcgcaccaccacgcccagctaatttttgtgtttttagtagacatggggtttcaccatgttggccaggttggtctcgaactcctgacctcaggtgatccacctaccttggcctcccaaagtgctgggattacggtcatgagccaccgtgcctggccctcagggcaactttagtgctcctccctatacccagcaggggcagaggaaagtccccagggaaagtcctctttgagccgttgatgacagcatggttagtagtagttacaatgccaaaatataaaaagaataattttaaaaaagattttgtgtgcaattttgcagagggaatgtcttgcccttttttctccactcaaaaggaagggagggtattcaaaagagtccaaaagtggaaacagcccaaatccccactggctgatgagtagataaacaaactgtagtgtatccacagcgtgacacgttactcagccttcaaaaggaaggaagcaccaatttatgccccaatgtgcaggaacagtgaaatgtgatgctgagaaagcagccaggcccaagaggccacacagtgtgtgactccactgacacaaaccacccaggacagg

SEQ ID NO: 269 - DNA, 3503 bp, Homo Sapiens
ggagcggggcggggcctgcgggggcggggccccgggccgggccaggactgatggagcgagcgagaacggactgcgcgtgcgtggctgcctggccggcgctgaggggctgagcgtacgcgggcggcggggtgggccgctatgctgcaactgaagcccagtgatctgacagtatggaagtgctttccttccgctcatccgcggccctgggctgcggcaggggggttgggtgtgtcaggtgaaaagtgctccctcccacccttcagacaggtccccaaaccctgcggcctgcgcggaattcctgcattgtcattgccggcccacccactgttcaggctgagagcggtcccccgcccaaaccggcgcttcgccggcgccaagatagaaatgggtcgcccggctggtaaagaggctgccctgcaaccctgggctggagtattgctgtggtcctggatttctggactttatttgcgttctcaagtggcgaagtgttcctcaacctggacccacatcagaagcaggttctccgagcccctaagcagcggcgtgacaaagtaattgtttaccctggaaatagactgttattttttaaaaattattgtcagggcttgctttaatgttcttaatgtttttgtatgagatcctccatgtgagatttgaaaagatccactatgcgggtcatctaaccggtcactagacattgattccacacttactacgtcgagcacagttgacactgggaatacatggatggacttatactagccctaaaataactccttttctattagaactttactaggtaaaggtatttgaatgtctgaactccatgtttagaaggagtcattggttttaaggctctgtcctagtacacctgtaagagcatttgcttaaaattgcctggcctttgtatgttatctctgtcacttcatatttgaaaatcacttgctagaatatggcctgatcaatgctgttatgctagtgagaaaatccacaactaaagactatttgctatatattagcattacggttagaagtctggaagcctttggaggctggcaaatctgagttcaggtctagctcttcgagtttactggctgtgtaaccttaggcaatttacttaacctccgtgagtctcagtttccttatctgtcaaatgaggataaaagaacttagagttgttattgagattaaacgggatgattcatgtaaaatggcttagaataacgactggcaaatcttaagcgcttaccacatgttaattgttatcaatgactttctttacctttcacaccattaatatctgaccaacctctagaagtgatgggcctaaagaactcttggagctaaaattctttgtcacctgtaatgccagcgctttgggaggccaaggcaggcagattgcttaagcccaggagttcttgaccagcctgggcaacatggcgaaaccccggctctacaaaaaattagccaagcgtggtggtgtgtgcctatagtcccagctatttaggaggctgaggtgggaggatcacctgagtccaggaggtcgaggctgcagtgaactgtgatcatgccactgcaatccagcctggatgacagagcaagaccctgtcactaaataaataaataaataaataaaataaaacttttgattttgttgtttatatacttaagaaaggaaccagaaccctccccagtagtcctacactttctgtggcacaaagcaggatggagacccccaggagaagctgagtctttatgttactgttctaaaggagagctgtatactgctcttggcccctctgaaagccattttactctgtactttattctttcagtcatcttcctcagagcattttcccctcaattttgttgtcagttccatatcatatttgcttagtctgagaagtgtttacttttataatagtgtcaggcttcaacacctcatgacttccagatgctcaactacccacctaaattgaggtcaaagttgtattccttgtggttttataatatccctatccagcattcttccattaaggtggctgacaaaagtggtcatttatgaatgcctactatgtgccaggcactctgtgtgttgtatttgcaatcctcatactttgtaagggtcagcaaaattaagtaacctaccccaggtcacacagatcagaagtttatagataagctgagattttttactgtctagtctgtaaaatgacctaggccaaaccatgttaaaataaatgtcctcgtaattttagatgctattctggtaaataccttctgtgaaaacctctacattacaaaaatagggaagctatatattatgaggaagtctataaaaggaaataattcatcagtcccttggaatttttgttgcataaatgctgttttataattgacctgttttctatactatgattgctttttctttattgcccaatgttttcttacatctaaaattaataaccatcttgtttttcttttttcttttttttttttttttttttgagacggagtcttgctccatcgcctaggctggagtgcattggtgcgatctcggctcactgcaacctccgccttctgggttcaagcaattctcctgtctcagcctcccgagtagctgggactacaggtgcctgccaacacacctggctaatttttgtatttttagtagaaacggcgtttcaccttgttggtcagcctagtctcaaactcctgacctcaggtgatccacccgccttggcctcccaaagtgctgggattacaggcgtgagccactgcgcccggccaaccatcttctttttcatttgcttagatttccatgtctttaattcagtttcaaattcccgtcccagctgtgtaaaactccttgttaggtattttaacaattttaccttcttaaagacacctttaagaaccttctagcctgctccattctgagttggttattctgaaactgaatacacagctgtcatcctgtgatctttcaccattgttcagaagattccctttgcctcaatcttgtgtcttcttgttttagtggagaacttcccccaatagttttctgataaaaaggctcactggtaagtctttggacaccagtgtatccagtcaaggtcaaccagaggaaaaatggcattcttaagggggtgctagaggaaagcttaataaagggactgtttacaaaggtgtgaacagtgtgaagagataggactagcaacagcaggaagccttaggcttgaaagggatagaggaaggaatgtttactagaatccagagagagatgcagcttataggaaagtgttgcccaccaagatttatagtcttcagtaaaggaacacagtatccatccctttctttctgccccctggtctcccaccagtgttgccctttgaccaaacccaaccaggagccagaggacaagagacccaagtgaagcaatccatgcaggtctacctccctgagcacaaagtgggaatagagaaggatctcaaggggcaaac

SEQ ID NO: 270 - DNA, 3417 bp, Homo Sapiens
ccttacagtagcgcagcgccaggagggtgtccgcggtctcgcctgccgcccaggggccctctcagtgccgcgctccgccagcctcggccccaccccaaaccccttcctccttcaccgccggctcttacagggaaatcggcgcccgagacacagccagcgggtgttcagaaaggaaaacgctcgctcaacagccttttcggttgattcttacattcaaggtgtgttactatttgtggcaagcatcttttcatttaaatctcgtgacaaccccgtgaggaccatcgtccccattttcctcttgaggatgagggctcagagacaggaggaaaccggtgctctgatcaaagccatacagctggtgacaggtgggcttggctcccagcgccctctctgcaactgaataagctgccttattcagaacgtgctgagatggaacagatttaacatctgacaagcaggaatgtccccaagtggtgtttctcagctagatcctgtttgaaaggacacttcttgcaagcctctcagtgtggactcaaattgtttttagaataaagctaaacagcttcatgcataaaccagcacaagctccctatgtttgtgagtcctaaagcactcaaattaaattcagcataagccagactataaaatcaaaactgttgaaatcctcatgagtcgggaggctgttctgtttgcagggccactgctcttggctgtgtctgtcccagctttgcagggcaggcaggtgccgcccggtgctaggtggcccaattctcctctgcttttctttcttcagagccctgggttatggcactggagtgtcacggggtactgcggtgagggtgcgggaaagggggttctaacttctgtcacccgcgccctagggttcgatagtgttttttcaatctcattaaagggctgacttctatacacacagagattcggaagctgccactgcattattttcatattagctccacctctgttcttttgttaatgtctcccaccaatttataaaatagtctgaggctctggtgggatcagaaacccaaaggtgaacacggcagcagctcctgcgtcataaggtggtgggccggatggtcggtgtatctgtactggtttttcttcacttgtcaacaaaatggaaatggtatttaaaatggaaaatggcaggagtactaaaagtcctaatagatgatagggcattacaatcagtattttagttgtggtagtaacaccgtggtcatacgtttttctttttcttttttttttttttgagacggagtctcgctctgtcgcccaggctggagtgcagtggcgcgatctcagctcactgcaagctccgcctcccgggttcacgccattctcctgcctcagcctcctgagtagccgggactacaggcgcccgccaccacgcccggctaattgttttatatttttagtagagacggggtttcactgtgtgagccaggatggcctcaatctcctgacctcgtgatccgcccacctcagcctcccaaagtgctgggattacaggcgtgagccaccgcgcccggccggttatatgtttttcttttgtcattttaatcatgcagcctgaagtatttatatggatgaatatcatgatgcccgggattggcttcaaagtaaccccatggagacgaggggttaatatgagtgtgtccgaccggcacaagatgggctggataaggctaggatattcattatatgaaaattctacttttataaaggcttggaattatccgtaattaaaacatttcaaaaatcttccacgagctcaaggagactccaagcctatggccctggatcacctccctgagacagctggagcaaatgtcaagcccagtgttgggatggcaccagatggggtgcatgtagcttgggagaccttccttggccctaaaagggagcactgtctcccccacacctccccctgctgggcagcatgggcactgcatgccacaggcagctcggcttggacacttgggcacagagcccatactgggtcctccacgtgactctcaacctaacaaaatgttaaaggagatgctttttctattaacataaatcagcaaacatttatgagcacttcggtaagtggtccttgaagtcttggataggcaagaagagggagaagccacggggcaggggaaagactaacgtgcgtggatttccagcccaatcccagctgtcaccccctgactgcatggccttagacatctcttgccctccccgtacaatggcgacagtaatccatggctctacgggttaaatgaccgctgcaagagagggttcgcagcacagggtagccatgcagaggacttaactgaatgaaggagaagaggagagagcccagagctgacctgatgcaaggctggccacaatgcctgtgtcccttacctgactggctgatgaaaaagcaaacgtcatccctgaacacaggtgtgttcctgtccagaaaatcactagcaagttcaaccatcacaggaagctcagtcagttcctccaaaacttgccgcgtctgaagccaacaagcaagcatggagactaaagtcagtcacaggcacgacagggacatggggcagctgggcttctagggacagtttgtgacacggaacctcactgtccaggtggcgaggggacttcggtcacccacaggccacctcgaagataaaagggctccgtgtcatttctcacgctagctcatgggaatgggtacaagggcttagccaaattcagaaggccacatgagtgataaaactgaaggccagtgtctggtcctagactgccgtcgacttccccacgcacatgtgtcacacttacagccacggcagcgtggtagctggttccacagccaatcacgatgagccgtcggcatcgtcgaatctccttcaagtggtccttcaagccacccaggagcactgcagggcacacgacaaggcgttaatgctgagtctacacagtcaccgcattccctgagactaggctcgggcggaggctccccaccgagtgtaggaattacctgtgttggtttcaaaattcacccgacctctcatagtattgaaaactgattctggctgttcgaagatctccttctgcataaacgcactgaagttacctggtcaaataaacgtctggtcagttttaatttcattatatttcactgcttttcattatgcagcagcgatagtaactcctgtaaagcttactgcagattcccaaaggcatccccagggattaccctgcctgacactcactaccatcagagggaagcaggtcaggaaccaggactatctccaatttacatattggaccctgcagcttgagaaagggagggatttgcccaaggcatgcaagtaacaaatggcctggctgatccctctgggccatgctccctta

SEQ ID NO: 271 - DNA, 1738 bp, Homo Sapiens
gtgttacccaggccggagtgcagtgactacttacaggcacgatcatagtgcactagagccttgaactcccgggctccagtattactcctgcctcagcctcctgagtatctgggactataggagtgcaccaccattcctggcataatcctctttttatgttgagttgaagaaagtcacaagacgtgagacgctttatgttgcagttaatggtctcttcctcccttttctctgttcctgcaaatggacaattattccttctcacaaggtttttggcttcccacttcagcatgcctccagcagtgttctaaaattactctacaattgccaaagtaagagcagcagatgctctaaatctatttccaggacacccgtctcatgatcaaggacaaatggggtccaaactccttggctgccagatgagcaaaactggagtaaagatgctgcgcaaaaggccaaaatgatgtcaaagcagtgtaaactgatacagatcaaagaacaggagtggaaaattgcaagcagggatatgtagcggctctgtatggcccaatgtgctcaaaactctccagaggttgttaatttcctggcaagatgaggttacatcatacagtctgtatttgcatatgtacccatacttgacagtgaaatatggtctaatacacaggttttattattattattatttaatttgaatattcacatttataggttccaaattcaggtcaccaaggataagggaatcaaagctctaaaaattatagaatatttgagcaatgcaataatgactggacaggcagctagatgcttagatggtttccactcaatgcagttgtctcagctacccacaatatattaccgctaggatttctttagctttaggaattgtcgataggcaattcttctgatctgcccataagaacatttttaaggggtcaaaggtgagcccatctcatggcaatacgataaccatgtaaattaggttcactgctagttttcagaaaagccattagtactttctacacaagtggatattaaaaatatctacaagaatattttattataaaataataaaaagtactaatgggacttctatatctatagattattggtaatctttgagcaatatcattgacaaattaattttcagtagcaaaactgaataaaactaagctcttttagctattctccaaaactcttatgacaaaaggattccaccatattgtacgctttagcatttgtaactcgtcaagaattgtttttatttctcaagtgtactacttgtatatagacacatatatgaccttattttatcacacatccaccttaaaaatacatagcaagtaaaagtagctcttaaagaaagtagctcttaaaagtagctctttagaaagcaacattgggtgcaggaactaagaggactggctggtgcttttcatcagtagtaggtggtggtggctaaggtttccactgtgggcacagcccaacacagccctatcaaactgactctgcagatcaccaaatggctaacattacactgaaaagtgtagggaaaatattgatttgtttattttctatgaattgagctaactttcctcactagtcttgttgttaaatagtggagaaaaaaaatttgaaaaaaaaataaaataaatttgaattcaatggagcaaatttggtctaatgcagtacaatactttttaaaatctgtctttgcaaattaaaataaaatactgttatcttg

SEQ ID NO: 272 - DNA, 5012 bp, Homo Sapiens
aggtctcctaagcttgactcctcttcggcatgagactaaggaagctccccaagttccagtcagagcaggcttatggaagagtcttgccctaacagaaaaacagggatgaggctgggaagaggataaagttatagcaggataaagttataagaagataacaaagcaggatgacatcacatgggaccaagaagggggctgcatcatccctggacctgctcctgggggctgtcggattgtgggcgtggccgctttggatgcccaggtgagccctgacacagaggtgcttcctcacattacagtgaggagaggatggggccagtacaaagactgaagaaccagcactcctcctgggtccgtctttgctaagttgagtcatcccagcccaggctcagatgatgggcactgtggacggagagagacctgtcttccagcaggcttctgtgtgcgtggctgctgcagtttctgagggctgacccagttttctcatctctggactttataccttctttgtccctaaatagaccacaacaccactctgtgttctctgcaagcctggggctaggaagcatcgctgaggtaaaggccttttttaaggttctctgccaataacaaacacgtcttcaattatgagagcagtactccatgatcctgaatctctgccaaccaaaagaaagctgtgcacacactgctgaacttttacaactctacaactcagaggacataaggcatgtgtaagccagctgtaaatctcgttgacagtcttgccccacccactggccactaggcagctggatttccaatttcaccccggacacggccagcctatcaaccctctctgcttaatgctctcagttcatttctcatcatttttctacctccactcaccaggccacttaccctcccttcctccttccagcttcctgagccctacagagataacaactagcagagtgcaccagcacgtacattggattatccttttcattgtgtctgagccaatctgcttaatgttcagatacacgtggggaaaaaaaggcaaaatatttttgttttagatcctttcagaaggcacaaaaaaataaagtacaaacacgaatcacttgacaattttatgattaaaaccaacaaatggaaaacagacagtgttgggtgttgctgacataatcaagcatttcgtgcggacccactcaaccaccccatttcttggatctatttctggatgtaccaaatgtgtctgaagatgaactcactttcgcacatcaaagatgtatccagtgttaaacaccggagccagaacccaggtgaaaatctgctggttcagggcaacaccacttccggctttattaaacactcaaaagtcaggttcccaagaaacgcttggatctatgcgcaagtataacatgtcaaaactgttaaatgtgaccatgagaaaaatgacatgagcatgtttcatctttgggtagagggtggtggttttctgggaagacactgtctgagacaccgagtagagaagtcaaatggaagacgtttagcatgtgcttaattcttgcttgataagaacaagaaatcccggaaaaggtcacccacagaacggtaagcaaagtccccagtgaacaagtttgaggtggggcttagcagtttgtttacagttgtggaaaactgttttagtcacttggccaaaaaccatatgaggggaggcaacctgaaaccctagactacttgactctccctgcatttttctgctagaagcaggataaaaggcctaaaattttggctgcatctctatttatgtaacagccacagctgctccccaaaatagctgctgttggccaaaagaattacgggattttgttgctaatatgtgaatctatagtcaatagcactctgctaagtttccttcccttcccttttgccgtcccaggtctaaaaggagatagggaatctcattatttgcacatcaatggtgccatcagttggatgtggatagattttaaaatcgaggctcatcttttcggcaagagcaaattgacatagaacatcttaactctccaccttctgcaggcggcagtgtggctaatattgaggcccttcaaagtcacaactccaaaagagaggaacatacagtgctcctgtgattttgtgggacaaacccagacccggactgctggcgtggcatttaataggatgccctcccctgaaagtaacaaagagaaccctcgtcaaagctatcaaacacattaaaaaaatacaaaagttattttctccttttgattgctatttacttgtgacaatatttgttaaaaatatcacttctgtctttgagaagagatcattctcttcatatagtatggaaaaataaactctgctgaacactcagtcaacattccccaccactgccaggggcttttggctttcacatctccaaataccatcatcagcataaaagtattatgtttttgagtaggcaaacacttttgctatgtctagtgtgctggaagtaagagaaaaaggaagtggcaaggctcatgtagcattttgaagggggagagttacaaaataggatggtttatttgctaacaaaatgaaaggtaacaaggtggtttcaggccttcctaaaaagtcataggatgtcccctcacctcttagaccactttcagccttgctaatgcttggtagattcttaatggaagggtagggagccctataggctaattatcagtgtcaatgcaaaggagggctcaacttctgcacccaggatcatcttaaaacactgagctggatgaatgggagaagacaaggatccataaaaacagtaaaatgtttattttcttagaaaaaaaagtgaggaagagggattcaaaatgattgtgatcacacttccatctgcatctgagcaaagccaatgttgcaagcttaattcttgattaagatacctattaaatcaaacaacctgccactcactcctacgtcacttccaggagtcacatcacagcatgcttttaattgataatagcttctctacttcttctgagcagagaaacaaggcttggcatagcaaccatcccatctccaaagctcaacactgccagtgagaagcaaggctcagtccatctctagactgcgtgcgagagatggggaggaaggagagagggcaggagatgcttgtcttagaagcagaaccagtttagaagagaagtttgttatctgagttcaccactacctcatcttatagaaaataggttggagagcatctgtaaaaccaacagtatctttaaggtgaaattgcagaattttgctgcatacctggacacaagagaagtgaaaagttgcaacaagttttaactagcagcaacaaagaaagttcgataacagttttttttgtttgtttttagcaatattcctttgcaagttcattaagaaacactgtaatttaatggggcgtacaatatggaacgatcttcttttgctatagtgctgttcgctgaatagaaccgacctttgcaaagatttcaactggggtgtaacctatttacacagtagtagctcctggtttgagtggtaaaattggtgctatgtgatatcctcttcttccgaacagtaatcccgacccttggagggaaaaagaaaaaagagcatgtgaatgagaaattcaaagcagagcctgaaatagttacttgtaatcaattttctctcaatatatgtctccttgcaacagaatccaggctttgtcagtgatagctggcacaggggtagctacgtcataaatacatgttagccaatttataagctatatatacttcaaggcatgacagttttaccaagccccaaataagcccttactttatgttggtaagaatttatattataacagccatattcaagagtcagcctttcactaagaaattaccaaatggccaatccattcaggagatcaatttcttatcaggaagaatgaacaagccacattctacagctacatccccgtgcctgaaaatcaacattctacagacagcatacaatccagggatgtctgagtttaattcactctaaaacggattacaaaaaacaacaaacaagaatccttaaacacgcataacaggtctgtgcttggtatgtgtgggatgcacaagaaaggcaaagatgcttctgattcatttgctaactaaaacaggttatctgaagctctaaggactatgtacaatggttatttgtgaacatattttatcctctctcctctaggtcataaactcaatgaagacatgattggggctgggctttaaggatccacatttaaccgagctggcttgtcttggtcaaaacacatgactctcttggtctgtaacccatcacagggcacctgccctgcctgtgtccgatgtcatagataagggttttgtaaaaagtcaggtgttattattatttgtttccttcaactttttctttttcttttaaaatacacactacatgtttcatttttcttggggggggggaatgttcttttaaaagcagaacttatttctaaaagtaccaatacttaacgatactaataataattttgcatataactatttctcagatgtattacatgttttttggtcacattatctatataacagaaatattttacattttcctaatatttaagcattatcaaaatggattattttgtgccacgtggctgggtgctaatcttgactctgtgacttcctagctctgggatcctggtaaaattacctctctgtgtctcagtttcttcatctgtaaaatgaagagaacaatagtacctatttcacagaatagttgaagattaaatgagttaatagtaataaagtgattaaatcatttctggcacatacttttacacatgatgtatatgtgcccatgcccgtgtgtgtttggcaaattacaaaatactgctggctggacacggtggctcacgcctgtaatcccgcactttgggaggccgaggcaggtggatcacctgaggtcaggaatttgaggccagcctgacc

SEQ ID NO: 273 - DNA, 2011 bp, Homo Sapiens
caggaagcaagagagagagacagaggggaggtaacaggctccttttagccatcagctctcatgggaattgacagaacgagaattcactcacccccacccacctcctggaggggattaatctattcatgagggatccacccccatgacccaaacacctcccattaggcctcacctccaacactggagatcagactccaacattagatttggaagggacaagcatccaagctgtagcatggttccaggttggaaatcattttcccttcaacattcgaaggcagtgcactcagtgttgctgttgagaaatctgaagccgtgcagattcccatctccgggttgtatctgtttgctcgggatgccataacaaaggaccacagactggggggtttaaacagcagaagtttactttctcacagtactggaggctggaagtctgaggtcaaggtgctggcggtgtcggtttctcctgagccctctctcttttgccggggctgttctgcttgctggattggaaatgattttagcccctcatgccaggaagaaaacataggcagatttctcaccagctaaaaaggaaggaaaaattgtgaagtgaaattttctactggctgtggtttatccatgttaaattgtaaagcatataacacagatggaatccggcacatgcaaaacactcacaaaacctagttactactactgctggcgctgcggctacacgactacaactactactacagccactactctcctcctactgctactgctgctgctgctagtgtttcgtaaagtggagctacagaaatcaacattttttttcttagctgcacagtgaattcgttttttggactccagtattcttcctgaaggtctgtttcatcctagtatgactctcacttttttttcaaaattttattttattttatttttgaaatggagcctcactctgttgcccaggctggagtgcagtggcgtgatctcggctcactacaacctccgcctctgggttcaagagattctcctgcctcggcctactgagtagctgggattacaggcacgcgccaccacgcccagctaatttttgtattttcagaagagatggggtttcaccatgttggccaggagggtctcaatctcctgacctcatgatccgcctgcctcggcttcccaaagtgctgggattgcaggcgtgagccaccatgcctctacattttaattttttaaaacttaccatctttatcatttttaagtgtacagttaagtggtaataaatacatatgtatctcctatctcatttccttattttcatcccccatcccatttctggactctggctaatagcagtctactcggtatcatcacgagatccacgtttttagtttccacatatgaatgagaacatgcgatatttgtctttctgtgcttggcttatttcacttaacataatggcctctggttccatccatgctgctgcaagtgacaggatttcactctttttatagctgaataatattccattgtgtaaatataacacatttcctttattcatctgttgatgggtacttacgttgattctatattttgaatagtgctgcagtaaacatgggagggagatatctctttaatatactgatttcctttcttttgagtatatacccagcagtgaaattgctagaccaaatggtagttctatttttagtttttttgcagaacctccatactgttctaatttacattcccaccaacagcgtatgaggattcccctttctccacatcttcgccagatctgttatcgcctgcctttatttacttatttttatttttaattcttgtgggtacgtagtaggtatatatgggatacattagctgttttgatatagacatgcaatctgtaataatcatatcatggaaaatggggtatccgtcccctcaagcatttattctttgtgttaccaacaattcaattatactctttcagttattttgaaatgtataattaaattattattgatgt

SEQ ID NO: 274 - DNA, 2313 bp, Homo Sapiens
tctctggtaaatatttcattaggggagatgcggatgcagcagggctgatcctgtctaagcctcctcttgtctcccctcgcccactggattcccaagtggctcctccaaagaagtcccacctctctctcctaccccaccctgccctccctcaggctgctctcctgggtgacgctgtgctccaacattcatggcctgacagctattgcacatgttcctgtgtggcctctgggtcatcaggtatgtgttgggaagtggggatttgtctcttgctcaaaccacgaggaccctgggaggaagaatggcctactttcttcctttcctaaggtcactcacatggtacgggagggggtgatcctaaaagcataggaccatctccattatttctcagctctcccactccactccctgctctgagcttctatatgctagtcctgcctggtggtggcggtggtggtggtggtggtggtgtgtgtgtgtgtgtgagagagagagagagagagagagagaaagagggagaaaaagccatcacagcattctgacccaggcagaagagaagagaggagaaagcaagtcccggtaggaggaggtaggaaccactataaccaaagccagcaggcaaccaggctcagcctctggaatgctgcagcctgaaatgacaggaaacagaaatgggggaactcacagagctccacgcgccctgctcagccccggccatgcccagccctatgctgctcagaggaaggcactcaaaggacacaatgcctccagctcacggaaagccccaccccaccttctccctctccccatggacataggctcattcatgtggggtagggactggaaggggtgtggactccaccgtgacatttaccgaagacatgaactcagcgaacattgtaatttgctgattaaaaatttaatccccatcttaaggtcagaaaaccgggtacgaagaagttggcagaaattggggctggtgggtggggaagagtggagcaagtcagtctgcgttagctgaggggaggggtttgtcaggctggtggggtttgggggcagagtgtagggggaaattgaggaggacccaggagcccgctggcagggataaggatgggggcaggacacatcttcctaagggagctgggtggggtagatactcccagtctattcccagttgcaggagacagaaagagtccggacttcagagtgagatggacctgggctagcatctggctgtgtggccctggggacgagagccctgcccaatacagagtgatctaataccagccacttggatagatgcatttcgtttcttccatcctaggatttctggagaggcagcttgggaaggccaggtgtggataacatgtgtaaagattcattctcattgtagatcttagcaacctcagcatacagattttttttttctatccttaagtcaaaaacttttaccttttcacttaaaggaagaactttccagcttattcaacattaatatacagtatattcaaattgccatgatcactgctactgcactttagggcaattattaagtaaaataagggttacttgacacaagcattgtgatacctcaacagttgatcggataacctagagggctcctaagtgacctgagagccagtagtggatacactggacaaaggatgattcacatcctgggcaggatggagtgggatggtgagatacttcatcgggctactcagaatggtgcacaatttaaaacttgtgaattatttctggacgttttctttctcttttttttttttttgagatggagtctcgccctgttgcccagactggagtgcagtggcaccatcttcgctcactacaacctctgcctcctgggttcaagcaattctcctgcctcagccttccgagtagctgggactacaggtgtgtgccactatgcctggctaatttttttgtattttagtagagacgggcatttcaccatactggccagactggtctcgaactcctgacctcgtgatccacctgccttggcctcccaaagtgctgggattacaggcatgagccactgtgcccggcctggacgttttcatttaatatttttcgactgtggttgtaactgaaaccatgatagtaattttcactttcggaaagtgaaactgcagataagcaggggagacatatttagtcatgtattacaccatttttttctgttttatatattggggttctgcatgaaattgaagtttgaattttcctttgctctcccattatctcgcttgatctcacaaaagccctgcataatcaagatattagtattattcc

SEQ ID NO: 275 - DNA, 18420 bp, Homo Sapiens
agctcctgcaaaggggcccagaatggtggggaagcagaacttctgcctccaactcactttctcaccgtgcaactgcggatccagaggaatctctgcatgtgaggctctgccaggttggggaggagtgtgcgctcaacatctctctccactttttaccattgcaacagcttttcttagctctggggtccaggagtgtgtctcagccttagtcctgaattctgggacatgcacgatggtattcttgcctgtggagagctgctagttgaatttctgtggtggtgagtgatgtcagtgaagtcccattctggtttctctctgatgtcacactgagagcacagttttggtgagaagattatctttgtgtaaaagcaaagaagagaggaaagaacctgcgtttctcctctgcactatccgctgcgtttttctgtagaattgggtgtgccatttgcaagagctgtgtgtgtgcagcagagcaggcagccaaccaatccttgcggttcagtgtgagttgggagggagaaagcgcaaaccactaagtgtagacaacacgcagggagttcatttgggaagtttagcgagtggtgtccaaagcagagttgctccctcagcactatgggcagtttgggccacacaattctttgttgttggggagagaaggctgtcctgtgccttgtaggaggtttggcagcatccctggcctggacaccccatgacagtggcaacccctcccctagcggtgacaaacataaaggtctctagatgttgctaaatgtcctctggtgggggtgggaagggcattgccctgtgtgaggaccgctggtagagactgttgcagggttcagaaaagagatttttgtttttcagttgggacatacatgatcagtcttggggaaggaagcagaagcaatggtggaataggacaaagataaaggaaagaggtggaaagtgatgaacacagaccgcgatgacccggtgtggggtgatatgggcgaggacagcatccagcgaagaggtcctggctcctgactgcaatttggtggctctactgtaccctgtgcaacgggtataggttggtgcttattttctctccatgtggtcagaagtctcatcttcaaagtgcttaagctgtagcccttgccctgtcacctctggttattgctgggacctgggtcacactcctggttcatctgctggccccaggccgggtgaggctcccatgtgcctgctggcctgagaaaggcttatgtgagtcacgggctactaggggcagagagaagggaacaggatggagaaattaagtgaggaataagattgtagaaagccaggaagaagccgaaaggggacttggctctggcagcattttgttttgcatcagtctgtgctggaataagctgtcgaaaggttgtctacccattgccccctggtaccttgtgctgtgctcattgttggcaaaacacttgaatgattgtggcctaaatgtgcagtgataaaagacagaacatagctttgttatttttctaaccagaataggagagtggcttttggaatcaagatttaaaattcagccttatcctcatgatttgcttgtgttttggcttgtattttggcttgtgcttgaaatgacaagaaggatcaagggtttaaatgtgatcttgagaagacatgagagagagaattgatattttcctatctaatatttatattactttcctgtatagagtaggctaaggattttatttggacgctaattgtatgtaattcctatagcagttattttgattaagccaactagatttacctctaattattcattttaagccctagatttaaagataactttttattctctgtaaacaacctaaaagttgccttagatttatttcataatatgtaaaaatgctgaaaaagggctagtttggctggagagacattttaatttttccctttaattttaaatgacaatagtgtgtgtataggagctgcgtttcctaccgaatattcacctggtgtggagactgaataacatgccactctaagggttaataaaagcattaaataacttgcatctgggaaacatcaattgaatagataattgcttctttgtgtttctgcttagtagtggctggacatgtaaagtttctataccacaaaatgaaaacagatgagcaaacaagaggcccggggtcacataaccgatgcgtgctcaaagctcgaagcagcgtcaatcaaacctggagggtaccatgtcgagagatggtatctttccattaatcaggaattggtacccgggtgatagacggcctctgtaatgaaaacctcagttagcaaacagccagaagagagagaaaataatccaaccagccaaataatcaaagaacacatgaggtgtctgtagggagatttccacagtgggaaacccatagaaaaagttctgtctctcactcttgtttttgttttttggttttggatacaatttcatttaagtagaaagatcatccatgattttctcaatcttccttatgtcttttatgcactatacttgccaaagtagcatagacagaaaaaaagcaggaatcctatggatttccacccttagtccttcaactaactttaaaataacttttaattttcttattcaggtctacattctaagtcacactcccctcccacatgtctttgcctgctattttacttcattaatatttaccagcttttctgaatttagacacctaattttgtattttcatgtatttctctgcatatccttcagatccttattttcctcaatattcatgtaaaatatataaactataatttctgtgttcttttaagagatagcaagtacctaaacaaaggggtgttctcccgtgatttttttaactcagcattttttgccagaaatggtcatttgggatttattcccacgcccttgtgtttttccctccccctcccctttccctcccttccctccctttatctttttctctctcccttcctcctgcccacccaccctacatttttccctccctcccttcttgctccctccctctctttcttcctccctcccaccctcctttccttcttttcctctctttctttgtcctttcttctcttccctcctcctttccacccttttcctttcaccactatttattgagtgcttattgcacaagagactttgagtgtccagtgctggcttgtggcaggacaagctgcagacaaaacccctcagacaccgagttgtagaagaaagggctttattcggctgggagcttcagcaagactcacgtctccaacaaccgacctccccaaatgagcaattcctgtcccttttaagggctcacaactctaagggggtccgcgtgagaggatcgtgatcgactgagcaagctgagggttcatgactgggggctgcatgcactggtagttagaacggagaagaacaggacagggattttcacagtgcttttccatacaatatctgtaatctatagttaacctgaccgattaggtcaggggtcgatctttaactaccaggcccagggtgtggcactgggctgtctgcctgtggatttcatttctgccttttagtttttacttcttatttctttggaggcagaaattgcgcataagacgatatgagtagtggtctcctcccttagctaaggactctgactcctccttctgtggggctccatgtattctttctcattggcaacactgggaatagcagggcccagttgagtttggagagtgttgcttagtgctctttagttgcaaccatctgaaaataacatgaaaagaaaggggaatttcctgaaaaatgttggtggtagcaatgagagcaaggctcaaagaataaactggaagctgagaaactaggcttgaaaatagaaatcaaagggactggggaagcaaggaccctgcattcgtctctgggcaggaagggttcgctcagcgcactggtgctgcgataaatatcatgtgcctctgctgttctctcatcacggatcaagagtccaagcctggagggagagcgactgacagccatggtctggtcacacgcctgcctgagagctgcacgggagccggcgaggaaaagcccttgctgcttccagtgtaaggcaggtgtctggatttttcttcaagagagccaacacgatgaatgaaggaacttaaatcatggcacggttagaaagaaaagtagcaagacaggaactactccttccctccaaacaaaaagaaaaacaaaatgagatattcactgtaattaatatgaatttgcaagggaaataatgcagtatatgatctcagtctcaacttatatctttatttcaactatatctacttcagaaaggatttgaagggtttccaataaaagacaaataaaatgttataaatggtagataaatgaagatcaaatatgaccctggtagaggtatgagaattttgtctgtcttgttcaagagctacactggctgcacctgatatagtagatgctcaataagtatcattaccttctgccaggtccctcccaggacacatggggattatgggaactacaattcaagatgagatttgattagggacacagccaaaccatatcagtattatattttattgcaactattggctcaataggtgcactatgtatttttgttcaaagttattgctcaagcgtttaccgtgtatattgttaacttatcacagtttattcttaagtactattatatcatctcccaagtaatataaaaatcttacagcagtcctggcttttcgtggttcttatatgcaggaatttttgttactgtgctttggttagataacatatataattccttcatggacacagtgcaaatttcactttccacagtgtattaactatgtgtaatttcattcagtacaaattttgatgctggtttttagtacaaaaattagtaagtatttaatggacaagcatgatgatcagtgagcaatcatgctgtctctgtgaaagtgtgctggttatttgtcgctgtgtacctgtgcgtctgtatgaatttagtttagacagatatcaaggtgtgtagttgtgtaaactacttgtcctccagtcataaactcacataatttaacttttaaagcaccatcactgttggataagtgtccaggtcacctttattcatttggatacctccatgaagatgttaaaaagccgctttttactaacaaatacaactttaatcgtccagctagtggaccaaggagttatttcaatgtttaaagcctactgtcttagacaaacttttcaacagactactgaagctacaactggagatcatgcaatttttaagcgaagttttgaaagatatattacttaaaaatgcagttgaaatacttaagcatcatggcggcaaagaaagtgagtaatatgtgtgtgcagtacagcagaaacttgtattgctctgtgaaaataacatgcaggataccaacagaatgcaagtggagctattggctcattttgctcctgcttgtgcagaacttttcatgtcaggccatctcctgggctactggtgagtttatggatcggcccagctgtagtctatcctgttgttcctgaagtggggtggaggtcagccagcagcctgcaaaaatgttagaaaataagagtcaagcaggacttctgatgcccccagatcatgttattgttatgatcagccatccacagcaagtgtcttatttgcattatatccgatgatagtgatggatctgcattgctgtttgcctcttgtaacccacagtgtgagaatgcaaaatccagggttaggagtgcagtcagtggcagtgtgactaggtgtttctctgtaggatactaagaaaaatacagcccaggaaactgttagtgctttcattttgtttcactataggtctgcctggatgatcaaaacagatgggaaggagccatggtggggcaatgatcctgttctgttgcctcctggagattcaagcattatatatggagagctatcatctctacccctcctcccggtttactctcatggtgagctcaggtagagtttagcagggatgttcatgtgaatatcgtctgtgttcgtgaataggctcgtatttcagttgcaagcaacatgataaccttaaagttcagttgctggttaataactgtcttttttattaagttgatactgaacttgatgtctttttgcagtactaacagagattactggtgctaccttttagcttttgatcatttatgcaagcctagatctttagctttacgttgtaaaaggggtatttttttcaacatttttttggtgagagtattaaagttgacattattatgatcacaagtgtaaacaggtatataaggaagtggcgatacattgttaagactgctgttattcatgatgcttagccaaatggaggtgcaattaatactgccatgtagaactggaataacgtcagctcaggaacagcaagtttagatagtttgactgtagtgaattttcatgaatggaatagttaatcattttagtggatcttgggggtcaattcaggctgttttacttgatccacttcttatcattatcctaacaaagtcttctgagataacacagcactgatagttgctaacagactttatatctaccacgttattagcattttatcttgatacactgataaaataagcttcaggaatacttaaaagattgcaatggcttccagctgccaaatgctagatttaattattttttaggaccaacatgagggtttagacacaccacttgtggtgcagcacacatgtattatccaaactgaaattagcaattcaactgaagtccatgtagagtcgaaaaatgtgaatatttggagatgatctagctcactttattttgtagaaaagaaaacagattcagggaaagggcatgcattgcctaaggtgattcagcaggtttggagcagaaatgcaatacaatctctgttcttttgcttctcagatccagaattttttcacagtactgaactacttatgtttctgattccttattttttctgttttatattttgccaatattgtcttaccaagatcctattctttaccccaaatatttaaattcattaccactattgtctctttataagtaaaagtactagttgttattataaatgattattcgatcacttttcatttttttttgggtccagcacaaagttagtaacaaataaacattataggccttggcaatccaaggggagctcaagtcctccagggcacgtcaggaaaaggctaaacgacagctgagcttcgagtggacagaatacagctctcatacggactgttgagtatttgatgttcttcaacaatttcattcatcttcagttttttcctctttgaagtgatggatttagtccttgctatactcgactttcaagtttcttttgaaataattatagattcacaggaagttgcaaaaggtacagggatgtcttaggtactcttcactaattctcccaacggtgacatctcgcatagccatagagcatatcaaaacctggaaactgacataggtacaattcagaaagcttgctcagatcacaaccattttgtacacatttgtttttgtatgtatgtgtgtgtgtatttgtgtgcatgtgttctgtgcatttttatctcgtgtagatctctgtaactacaacctcgacagtcaagatacagaactgtagcctcaccgccaggctccaacttgcaatctttgtggacactctgacacattttcctccatcccttccccttggcaaccccatagtctgttctccatctttacaattttatttctataattcatataaatgtaattgtacaaaatcgtatttttgaagggaagaaacaagtcacagatatttttgttagcactgcaaaataatctttaatgctaatttattctatgttctatttgtctcaaaaaatgtgctttgttctttcccatattttctgatatcaggataggaaatcaatagcaaacaaaacataattccattcatttttttccacagcttgtttctcactgctgtttcctaacggttattgttccatttactctttctctctgttttccatcacataaaagtaactttgtgttccttatctcttctaagaaaacttggtaatgagtctttaattgaagcccagaccacccttgttttgattttgtgttatgggtgttcttttttgtgatcgctttcatggagagtccttgtgaagctgggcttttccaatggtttgtcaaaatggaaatagatatttaacaaaccaaacacaaaatgaccttgctccaggaatgcatcatttctgagaaaacactacctcttccaactagagattgtgaatattactcatattatcctttactcccttttattaaaactgtattttttttacacatttgtataactcgggtaatgaaatgtgaaactaagtgattgcctaccaattacaattgatattaacgatgctagtgagaggccacctctacagtggctgcgccgtgtctagggacttgctagctttgctaagttacatgggattgcctgcgtactaaatgcaaacttactcatgtacataggaaaccatttgtattaatatgattaagaagccctgcctaaccctgatgaaaaattacttgaaaataacagaagacagagtccttattttaaagtacattaactattgggagtaattactattagtccaaccataactggatctaatgagactgaatagaaacaaattagacataattggaagctaagcaaaagtcaattaaattcctataattttacctttataaaaattattgaattaaatgacccggatcaattagcagaggaaataaagccatgaagaatatttccaggaaactattaccttttttgagggaaaaatattgtttcacttaatgattagagtttagtaaaatgtagcttaatgaattttgctgccttagcagtttaataacttcaaatgaagtaattatgcaaattttttgatagttttacctacaaagtaatgcaggagttgttttaaggaatccaggagtagaatttatttgatagaataaaataacatatttataaaaatcagcaaattcagatggtttggaataaagatatgattgcttttactcaatgttcactttagggctgggtcagctgtgtgggaattgcagttgacctgttgtagaaattgtgtgcttggaaatatatcaccacattgctccatgtagactccctctgtgattcaagtcttgttcctacagcactgctgtcaaccctcaaccaccgtcaccctatagaccccaagtcagtttgtattcagtaatgcaagtggtgttctgtgcaactggtcacccaagaacttggtgctaagaaactgagaaagtgatgaccaagacaatctcatcaaaacacagccagggccagtcacagtatcgtaatttctgctttctggatgttcaaggaaatgtagatcatggctccttctgtgatgcctcattatcttcaaaaggagctataagcgtacactcatttccaaatgtgatggaataagatcgcagtttcaatgaggtcctgaaggataattaattatataatagttatcaaaatattaattctgtaaggacagtcacaaaggaaagaacagtggcaaataggtctcaggaaatacatcaaatgggatgttcaggtgtgatgcagcttcgtacatactatgctaaatacattatgtctgtaattaaaccagctgcatacacaatgcaggtgtggcaaattctttgctgaaacatgtatgccagtttcctcattttttaaaatgacaagtgcatgcttaatcaggttagagtggatagattatgatattatcaatgcactggacaaatccattaatgatacagtgagattttgtgcagaaaaatggaatagagaggtgtgaatccaaactttgaagaataaagaacatacatttgtaattaggaaatatctctcactttcatcccttatgtgccacacatagcacaatccagccccacccagccatgactcttacatttatcactcctgacaaagccggcctggcaattcagacccggagcccggagaaaaaagaggaatcccatgatttctggcaaacactgctgcttcttttgtagtggtgtgagatgaatgcctctacatgcacacaagtgccatgttgagggggatgaatctttcaagatttgtttaaagtcaaataatgtgaaggtccatgactgacctccaggcctctcagagcttcagttaactcctttgtgttaggggatgttagaagaacgtttacaagtcagagcaggtgatgctcaggagcaagagtgaatgaggaggaggaacccaaacaggtccagcacagaacatcagcatctgagcatgaagtctacccctgagaaaaagtggtccaaaggtttgtgtgaaccccattctccaggccttacaaaccctgtgatttctgcctcattctgtcccgtcctgtcactttgagtctgaattggaagagagaaaaacagtaactagattagtaaagtaaggaggagtgaagagcaggaaggtggaggtcgtggtggtggaagatggaaacctctgcgagtgaaatagaacagtttggatgtcagctgtgactgctctagatctcctaaaacccactccatttttattaaaaatatacattgcatttttccagtgtacacgatatcatgttaagagttcataaagttttgaggatgtgagtcatcagaaaggaggtttaaagaaccgattattttggtggtctgactcctttaccccagtaggaaaagctgccattttgcttatgccctgtgctgaatctcagaatgcctgtcaacccaacacgcttcagcatgaactttaactcaaaaaatcaaaaagtaccaggatcaatttacaatcctagctatatgatattttagaaattacaaagcctgtaaatgagctattttgtcaacttcatagatgagaaatctaagagtgggttagtaagttctcttagatttctcatatccataaagtggatagaacatctaatttagaggcttgttgaaggacagacagaaatggcatttataaagtatctagtgaaactactgctagggattatatgctcagtaaatgatgagcactataatcacaaataatttgatctttgccagtgtaaaatgtatttgtctgtctgcttggtttttctcggaggcatagtttccctctgtcactcaggctggagtgcagtgctgtgctcactgcaacctctgcctcccaggttcaagtgattctcctgcctcagctgggattgcaggagcccgccaccatggcccaactaatttttgagtttttactagagatgggatttcaccatgttacccaggatggccttgaactcttggcctcaagcgatccatccaccttggcctccgaaagtgctgggattacaggcgtgagccactatgcccggccacatttatgttaattcagagaacaatttttcagtaaggttgtacaaatgattgtcctacattcctgcatgtttgaaactctttttctcttttcatctccatatgtgaatgacagtttggctaggtatagaatgcttggtttacactttttattgttcataaatctatagtcttatctttgtttctatcctctataccagcttgagtaggattaagtgtgggattcactataaaactctatacccactgaacaagtcctcttttccccctccgctagtccctggcacctgtcattttacgtctctgtttctaagagtttgactactttaaaaacctcatataagaaggatcatgcagcactgtgtttgtatttttgtgactggtttatttcacttagtatagtatccccaaggtttatctatgttatgacatatgacacgatttctttcttttttaaggctgaataataatttattgtgtatataccactttttaaaatccattcatctcttgacagatatttaggttgcttttacctcttggctattatgaataatgctgcaatgaacatgagatgaacaagctccttttttatctctttacttttgttagaagcttttaattcctgattaatgagttctgaatgtatgcagaggtctctacctggcagtgacctaaaagccttgtcttctgccaccctgctcagccttcagattcaagtctctagattcttgaggttgggaaatgtttccggagcagccatggttttgcattcattggccattcaggttttctgctttgccgtttcccccccattcaggttttctgctttgccatttccccgggggtttccttaccctcttggaagaacaaccatgcattaagtccatgttgactgtattttacctgctgtttctatgtgttttgcaataagggcttttcaaaatacccataacttgtggctaaaaatgaggtttgttccaatgtgccttagaaagatccagtttcatacttacctggcagggcagataccatgatcttaaaggcagttttcccagggcaaggcttatccattccactctggatccattataggggcatgctgatccctggaattgccccaaatgtgggaagctctactgcaaaatttttggtagtgagcgatggcattatgcattcatgtacgaattcaactgagtatccagtttcatacaaataataataacatcttctataaaatgtattcttgtgtattaacacatggggctctgtagtactccagctgagatatatgggaatcttaccctagttttgccattttctcctaacatcagtctacttcttttaatattcattgcttctccccatttctgtagttcagtgcatgttcctttcctctgcaggaactacttctctttcctcacccaactcataaatctctgcctcccaccctaagggtaggcacatgacccaacctgggagatcagaatgccacacccccaatacaggattggtttgtgagtaggcagatgattctgtccatgcacagaactaagtagaagagagtttttacacctcagcttagcttgatgctagcagagagctactggagttctatttcctcctctagggaagaaaaggattttggtttggagataaagccaagataccaagaaagtgggaatgaaagacttagagacagggagtcctggccccttttcagatgctcagatgctggcactagcttgaggcccagtcctgcttctgctcttcccaacagccccttttcagatgttggcactagcttgaggcccagctctacttctgctcttctcaacatttggtaaggggagctcccaatttcttttctaagatagctggtttgacttggatatccatctcttctaatcaagggtcctgattccttgtcattgtcatcaaaaaaatatttgtaaatatttcacttctcgctggtgttgaacaaagtgatttgcacagatacaatctctgcatcttaatagcttacattctaagagctgtacacctggcactctttctctggaactataactgctaagttcacgaatctttattaataatgcttttcagatatatagttaaaaaataattttaatagttgaaaggcatccatctttccaagaggttcagacatactgcaattgagtgctaagtaacttttattttgtattttttaatatttgtatttccataggttattggggaacaagtggtactcaagatggatgaaggacttaaatccaagacaagaaactataaaaattctaaaagacaacattggaaaaactcttctagacattggcttaggcaaggatttcacgaacaagaacccataagcaaacgcaataagaacaaaaataaatagctgggacctaatcaaactaaagagcttttgcacagcaaaaggaacagtcagcagagtaaacagacaacacacagagtgggagaaaatcttcacaatctatacatctgacaaaggactgatatccagaatctacaatggactcaaacaaattagcaagaaacaaataatcccatcaaaaagtgggctaaggacatgaatagacttttaggtatttgtgtgtgcagacctcttggtgtcaaggctaaactgttcctttctctgacacatgggaaattgatgcacaataccttgcagtgtataattccaggcccctaggcactggagactgggttatcttttcactcaactgacagttgatacattgtttgcactgaaaaatctggctttgttgaaccacaccagtttatgtttttaattccaaatcttaccttgttatgaactatttttttgtcctttcctctagagaaatgctaatgctgcttgcttacatggaaagtaaagttaaggagttggtgttgacattttggcttgctgtcacaggcaaaaaagaatagtgctgtttttgtgtgtttaattttctttcactttccccactctgtgtattggaggatgcctttagcaataagtagtccttatccaggtcactcactcattaaccgccaaccactgacagtaatgtctttactagatattttgcttcttttgattaatttgtctctatttcctttgttctaaagcctatagtgagtaatcatatttggagtaatagcagagctccctgctgtgttttcatttgcttaaatcaagacttagctgctgtattgaggaaccaagactgagatgtggggctaggagggcctagggtctgtcaggcactcttcagtgacttgaggtgctgaatgactcacactgtactgggagatgaccacctgtgtgcatccaacacagtcacagatagtgccattgagccaccaggagcagccacagaccatcagtggttgtgctttggaatacgcaattttgtgtttctggtgagctgtaatcttttcttttcccatagaattatttttcattgaattatgctattaaaactcatctttgggtttcttgtaacgtcattgccgagaacgttatttttgcatttcacagtgatttcttgaggaggaagtaagaagtaattgttttctggactcactgtctgaaaaacttgcactttactgaagcgattgttttgtttacactaagtaacaatatgagttttgttagctttttggatggactacaaagcataaaaccaactttgttcctcatctctggcaaagatggagggttgttggcttgtgttgtgtgatgagtcttatacctggctctgtctgctcttgccttttgccttacatttcaaagacctcacttttttcttttctttttttaaaaaatattttatcacatgattttctatacattttaataaaatttcttttttgtaaaaaaagcaaagcataaataaaatagggtagccatttcttctaaggttatgttgaatctaacccaaactcttatcagagaaaactctgctttagatgtagcctaaagcaggaagcaacaaacctgtatacagccaaagtatcatctcaagggcctgcattcaaatctcacacatgtggcttgaaagtgatctcttttgcccttatttcaaggcctaatcttaggttacatagtacttaaagaagcttcagtatgcaatttcaaagcctgtagtagatgtaaaatgagaaaattagaaataaggagaaaagctgctacatgaggacactgacagcaaggaaagggagagaaaaactcacaaagtaagtggaaaaatagaccaatgcaaataaccccacatagtttaacagacctcatcatatctattgtgtacatgtttgtatgacatagattatatctattatatgtaatccagtgttcatagtgttgacttagaaattatcaaccaaattcaaagcttttaggctttgaaaattgtttgaaaagattttcacccaaaatatttaaattattaaaaaaaattattgttgattaaagttgtaatcctcaattaattagaagttttggctatccagagaccttatattccaaagactttagagagttgtttgttagatcacataaattattaccaatatcctacatttaagcttctaatttacgtaaattgtgagcaaaattgagagccacacaaatattcaatctctgaagctcttatggcagcattgatcaaataggttagagaacacatggatacagctttattgccttctagttttactgcaaacgtgttatttaatagtatgcaaatgattggctagatgtacagactgccagggccttcatagcaaacaggttttgtgtttaccctagcatacaaaaatgcttcatctacgatgtatgctgtaactgtgtgtattgtctaccctagcatgcaaaaatgcttcatctaaaatgtatgctataactatgtgtattatattatctataattatatttctccttggtttaatattagatattttcaggtacaagaaatgtatgcacattatagattcaatgcatgtaggttatatgtgtaaatatttattgataagaggcattaaacccctgccttctatgctggataaactcctgaacttagcctccaaaacaccacagtagcctccctggtaagcacagggctctttctctacccttttgtgtctcccacgctcccacttgtctacaagagctgagtgtagaccaagagcaataaagttcatttccccaaaataaggcgtagcattcaggttttgtgatacctgattggtttacattgtttacaggtggggcctcgaaggggtaaaaatcagaagcttcttattctgagcgcaagggcaagatcattgagcagacattgacctcccttcagacatttcttgggaggaacagaatgagaatttcaggggccagtgcctgcaccctactagctgtggcagcctggtgctcatctacttctccagcttgggaaggcctaggttaaccccagtctttggaggcattgttattcctcttctctccctgcttccccgtgtttgtgttctgggcccggtgtaacactgaggttcagaattgctttcaagagaggagcccatttctgtgtctatgcaaggctggacaatttctccaagtggttcagcctgtgggggttaacggggcaaaagcatctcagctagtaataaacactgcttcgcctcttgcttttttatttttatttttgcaaaacttctctgtaggtgtgtatttctctagaggatttcaaaaattctctgtaggtgcgtatttctgtagaggaaggagtggtgactgggccagggtgaatggattatttgatctatattatcttgaattttatatcttttattttaaaatttgggtgttttttgaagtaggaaatcaatgcacatggctgaatatctaaaaagtgtaaaagtatacattgaaaagtcttcctcctaatctcgtgattgtcttcgtttcagtccccatggccacatcatgaggctactgatgtcattagtttcttttgcgttcttctagggtttctgttggcatatgcaagcaacaataaatgtatacctttatgttttctctttttacagcaaggacagtttattaaacacactgttttaaaccttattttttctctaaataatatttcatataagtcagtatgtagactttatgtatttttaaaatgaagacatagcgttccactgaacttagacaataatttacttaactagtccaagattgaagaataaaattattttgaatcttttgttaatagttaatagctttgatgagtacacttatgcatacattattttacacatgttcaagtatgttgtataaaccccaaagtgggaatgctctgtcaaatattacaggtatttgcaactttgatagatactaattgccctcgatagaggtagtaaaagcttacactccacagccttactgatgatatatattataaaacttttagttcttgccaatctaaacgtgaaaaatggtatttcatggtaatttaaatgcttttctcgttttataactgaggttgacatctatcaaaaaattatttgaatttttctgagaactattaatctttgaatccttttctgttgtttatcttttccttcttcatttctaaaagttcctatacagagagattcacccgttatctgtgatatgattacaaatgtctgccctccaatttgttatatgtctttagatccaaataccttattttttgccatgtagaaatttttaatttgtatgtgataaaatgttaatactttatggattctggattttcagaaataaaaaggtcatcctcacttccaggttttaaagaaattctttaatgttatttta

SEQ ID NO: 276 - DNA, 2307 bp, Homo Sapiens
gccgcgccgcaaagcaaaggtcgtgcgttgccggcttggtagcgccttccttctccgacttcccagacttcccagtctgcgcaggcttacttggggacgcagggaactaccaagaaagtgtcagaggaaaggaaaggtgaaacagacgaggaactggaacgggaataagtgggaaagaagccaaggggtttgagagagacttgctgccctgggtttttggtttttgttttttgagacaagagtctggctctgtcgcccaggctgcagtgcaggggcgcgatttcagctcattgccgcctcaacctcctgggcttaagcgagtctcttgtctcagcccccgacgtagctgggactacaggcacacaccgccatacctggctaatttttgtatgttttgtagcgacagatttttgccatgttgcccaggctggtctccaactctcaagctcaaataatccaactgtttgggcctcccacagtgctgaggttacaggcctcagccaacgcgcctggccctgctctggtttttttagggagtaagttgttgcggaaggacgcaggtcttagccatatttttgaataatacttcgttatgggaatgaaaccgcctttgcaaaattatgactgatttgggaggccgaggcgggatcacttgcagtcaggagttcaagaccagcctggccaacgtggtgaaacctcgtctctactaaaaatacaaaaattagctgggcatggtggtaaacgcgcctgtagtcccagctgctcaggaggatgaagcaggagaatcgcttgaacccgggaggtggaggttgcagtgagccaacgtcgcaccactgcactccaccctgggcgacaagagtgaaactacgtatcaaaaaaaaaaagaaaaaacctctgctccctgaatgctcagggagactgatttgagtaataatagaactccggtctcacacagctggctctgcatgaattactctttctctattgcaattcccctgtcttgatgaatcagctctgtctaggaagcgggaaaggtgaaccccttgggcggttacagcaagaggagatagtccagagactcagccctcgtatcttgaagggtttcttggttttttgtttttgttttcttaaccaagttgtctgctccaattgctggatttcattcacaaggctttgctaggaccagttgtggcccttggaaactcgtggaggagaaaagctgtgaaaataggcacacatgctggaggaggaacagagggcaacacacataatactggataataaacttgagaggcaaaaattaaacaaaccgacaaacaaagttggaaacccagactgtccaaagcagcttgtaatcaggcttacttcatttatattagcttattgatgtggcaactatttgacttttacttacatgatccgctgtttctgtggtgtggttccaatacaccgacgttacaaaactttgaccatcttaaaagccagattaatcgaattttaacaaccattgttctgaaaactgcagaactctcgacaggtattgactgttcaaactacactgtcaacctagacgctgaggcacgagatagaacttaaagcatttactttagccaaagtgaggacagctgcccagaagacccagacccaagtaaccttaaatgtgaactcctgtccacctttgttacaatcaggtttttaaaggcaaaaaggggacagggagttgactgatacaaagttgtaaagaattactggtttgtagaaatagtattggttagtggttggctatacgttaagctatagggtgcgagttacagtgtccagtgtaccattattaggttaatttttagctacttgtggctatagtaagcagtttaaagagatgaatgcataacaaagtggggagtaggatgtaattgctgtctcattttaatgtctctctgggcctggtaatttaaaaggatttaccttcctcatataaaagttcttttctcggcactgagagatttgattatactctagcatagcttccagtagcttaaggccttgtccctaggctgaccccagatcccgttaaaatgcttccctgaaatcaaaactcaatgcctggagaatttactgtttgttccagccaaaacttgatgataggcagataggtccctgaaccccttcttagagcagtcactttagaaagcttgtttctctacccttggtgatgtaagtctaccacccaacacagtttcctcaaagacttgggagccatctctttgaaatgcaaatattcagaaagataactcaccctagctccta

SEQ ID NO: 277 - DNA, 32707 bp, Homo Sapiens
gcacccacagccggtaggcccccagcagcaccagagccaccagcgccacgttcagcagcatttccccgccccccgtcagaagcgccaacgccgccgccgcccagcctcccccttccgctgccgctcccgcgtcgcctggactctcgctgccgccgtcgttgctgctctcgctgccactccccagggtgcctagcttcacgtccccatcaccagccgccatcactgcccgccagcgccttcctcctcctccccgccccctgccctccccaaccccacggccggccccgcccatctgggggcctctcagccaataacgtgagaagagggggcggggtcaggccggctcctgattgggtgttgacggggtaacgttgtctcggatctcccgccccctcccttctttcgctggccgcgcacgcgtgcaacgccccgcccacctcgccccacacttccctgctctcactccaagcctccgctaggttaagtagacgagccgggcgggtctgaagaaaagatgctacgacggccgcgcggacgctcatgggcggggcgagaccacagcgcgtgcgcgggctcctgagcgccacgcgctcgcctttcgttcgtaacccctgcgggaggcacgccccgcccagtctccaggctctgcgcgtgcgccctggaatcgcttcccttcctaggcctgcgttcgcgtccgcaaactcccgcctccttgcgctccccccgcccgggagcttcacgtgcgccttggcggccgcgggggcaggtccgggctggacgcctggcggaggacgcgggcaggtggcttgtgggaggctggggcatagttgagctgcaaggcgcaaaccgatgaggggcgtctgcttttcaccagggcgccgtcgcttttgtcgggaaaccggcagcgtaggcgcgcagaccgggaagcggcaagaagatttggccacgagctggggtcttcctggaacggagagaaagcacggaacccgcaccgggcttctctggcatcggcagtctacgtgctcctcgcgctggcaccgagcagccactccccgctgggtttggcaaaggctgctcttgtagaattttaaaggatttagagtctcattattccttgaatcataacttctgcggccgtagggaagtggacaggttgaggtggtctttctattcgtcattcactcttatttgcaggttctgtttcatgtacttggacgtcttttagcctctcacaccttgaaattctagtgtgaaaaagtgacctctgaagtctcacgcactcaactcgtttgacgaactcgtttgacgtgttctctcttgccctttgttgtctgttgtcttgagtctcatagaataggtttgaacctttcactgtcggttttgtaggagtcactgaggatattgacgaggcaagtgacagggtcgacactcttgtagagaggctgtatagcaaccaggtgtctgaaggattagaggctggggaaagagtgggaaagcagttagtaggctagggtatttgtgcgtgaggtgaggagactcagagctaggggagacattagagcaggggttggcaaacattttttgtaaagggcccgatcatattttaagtctctgccttaactactcagctctaccttgtaacgagaaagcagccatagacaatacttgaatgagtgtagctgtcttcagtaaaactatggacattgaatttttaatataatttcaggtatgaaatattcttttgatttttaagaaaatcattgaaatatgtaaatttttttttttttagttctggagaggtgcaaaaacaacttataagccatattgctgagccctgcattagaggtacctgagggagagcgacacaattggtagtaaatgaccatatactctatccttcaatatggaacacttttggaagtaaagtagggcattaataattatagccagagaccaggagttatatcagttttatcccaggcaaacctaaaggaatagtcaccttaaggttaagggttaggagaagtcaaaattgctttaggacttggtaacagaaaatgggaggtgccagtgatggaaataggaagataaagaagaaactggttttgaggagaagatagctgtagcagtcccaagagctgtatacagttgagacaacattgataggaaggaagaaagcaccccagaagcaggccactccttatatcttattgaccagaactgggctattagctgtccctaaagcagtaacagacaaggagcatgggacatccatgattgcctagtgtttatctggcttttttaattcttattcaggactgtgttgagcattgctggacatttaccatctctggttccttccagctaaatgtcagtaccacacctcaggcattgtgacaccgtaaatcaaccgtttttccctcccaccccccagaggtgtggtactggttgagaaccagtagcttagaccctcaggatttaccttggggctgaattagtgtgtgtaggtttcttttccagttggtttggagggaagagaggaattggacagtattaaagttctgctgtcaaggaagtgggctggggaatgttgggtagctaaccaacattggctgccacgtgaagtaaaaaagttttcctttatatccttgataaaatagtgtctcgacttcttcacacttgaagccttcccaaaaccccagcttttttgattctcattgtaagccccttgaactggactagttggaagttcttattttccaccctaagtaacaagctcttgtcccaataggatactcttgctttgagtactgcaataactttccaattggtgacttgccgtcagtcttttcctatttcattcctacacgaagagactagaactgtgttctgatttcctttgctcagacaccaatctccaggggtgctctgtaatttgaagaggacaactcagaaagcactcaagggcctccataagtccctgagtggcttccctgccttcccgttccccagcaaacaatcccttggataccctctattaaatgatacgtttccccttacaatacctagtcccttgccccatatatgctatgtgtattgcacagtctaggacttgactcatgctgtttcctcacggagcatgcccttcttatttctaaccatacaaattccatgacctatccattctttcaattctacttccacctgaggcctctatcagcccacattaacctaccttctttgaatttctgtgtgttccttacctgtaccacccattttggccttttattttatgctcttcttgactattctgttattgaaactgtcctttagatcccaagatttctactttttccctgcggatgcttttttattttttttatttttgacttctttctaccctccttttcctcttacatccctgctttgcctagaggacatctacaagaatcgtcatgtacattcttttctcctgttgttagcttttttcccctgacacttcatctatttactgatttacttgtaaatctctggaagatattagtactagccaccaaatatttctatttctttttccacacacgtagatttggatttccctactccttttacctcaagaatggccaatgaaatgtgattggaagtgacttgtgtcatttccaaataaaagctttaagagcctgtggacatttatcctgcgctgtttcttcctgccaacagtgatgaaatattttaattatctattgtcccatgacaaagcaccttaaatcttaatggtttaaaacagtcaccattttattatgtgtaacagttttgtgggttgactaggctcatgggcagttgtctaatcttgctcagggtctctcatgtggttccagcctggtattgtttggggctggagtttttggaggctcaactaggttgctagagtagctgagcttttctatttacccatgccgttccaaagactctctgattcacatggcttcttcagcagagtagcctgacttctttcttgcatggtggcttaggattctcaaatgcaataaaagcaaaaacttcgaggttttgtaagtcttaggtctggaaatgacatgttgtattggtaaaagcagttacagggccagctcaattttaaggggagaggaaataaacacttgataggggtggagggagagtgacaaagaatttgtggccatctttattacaaaaatttttgtcaaccacagagttacaggaaaatgtggccatctttaatcactactccaacgatgtttcaaattgagtgggcttccatcagccagggtctcggagacaggacaaagtggaaaacagctcccaaataacatacctagggcattttggggacagactctacagtttactagtggccccaggacatcctgcaaaagaggtgaaatcagtattggagaagtggtctcatgaagatgggagcacgactactacaattgactgctgacttctcacccaaggaagtaactgtatcccagcctaatctcagtggataagcccacagggttaaggtcctcacaacattgtgcaacaagtgtgaaagatgtagtctccatttacggctactgaaataggctgagagaggagatgttcaagaaaaagaacaacttcagtggaagaagaagaagataggagcccaggtcctgtgtttcaccaagacagccgtgcaaagcagatgctgccaaaaaggtgcaaagtggtttgtcagctcttctgcatgttctaacaaattagacatgcatcccaaaaggtatactacaatattaaagcttatttatacacactgtaaagtttcccctgagtgtcctggcaggcacttgcatggctgggcagtatccgtggactgattcctttgtgaattacatggagctgacagggctgaaacccacagctgactcggaggaggatggaagcttgtgctgggcaaggggctgaagcccctctgtgtaagtcatattaatctcctctgagcagagtgctacaaaattactaaagctgcttcttgaagacacttctaatgcagtacctaatgaaaatgtcaggtgcgacaagttattagttgctgcactgctgttctgaagtcccaggtatttctctacctgttatccatgaatgtgagttttgtggggaaggcagtcacaggctgaggaaagcatcagcagtcatgtgtgctgtcaggcctgtaaagtgagtgaggacaatgaagctggttgaagtgccccaggaaatggccagacttccatagtggaggtgaggtgaagaattgagtccgggcaaaggtgtgtggggagaagaagctgcctggtgtacgatgctgagtaatgatacaacccaaatcatctgactctgcagatttgaaagttgccgttattattaagaattcagatgggaaaagaaatatggtttgggttatttccatagtcattccagaaatccaggctcagtttggcatttattgacataactgtttatattggatctgtgtagaagtttgtatctttctgacttgcatgatacttcagcctttccttggagtctctgtggcttctcttcctcctttgctcacctccagtcattgtcaaatggctttgtgcaagttactctttctcggcctccatttttttggatcctgcctttgccgccctccttgcctgtactctgtccagtccaggccctctggacctcttgcctggacctccaagctctccctcctcccatctcttccctttcaaccttcctacccagagcacagcagtagtaacagctaacaccatttaataggtatcctttctatgccaggccctggggttgctatgtcacatatattatttgtaatgtttgcaataaccctggaaatggtattattacctccattgtacagtttggaaggcaccaaaaaaggcacatgggcccacattcatgcaagctaatgaggggcaaaactggaatgagaacccagggccactgggtccctcagcttatgctgttccctaaccatactgcttcctccactcagaatcctttagtggctcccattgcctaatagatcaagtctgggctccttatcttggcttctgggtcctctaaaatgtagtctgctaggtttccaggctttcctctccacccctcacacatcctactctttagccaaaaaaacagacaaaaaccctaaaaacaaaaaaatccatttttttatttatacccgtgctttctttcctaagtgcttttatatgtgctatttctcctgccaggagcagagactgtcatgctttcctctgtataagtaagtgttgcccaagaaaacattgaacagaggtgggctagagatccatttattttctggttcacaaagggcatattggatctttattaaatagtctaaaatgtcctttcaataatgtttttctttaatatctttttaaaagacatttaaagtgaatcagaaagcaattaaatgattaattgctgtggctgaattctgctgccctcagcctctgtggatgctatctcaccgattaacctccatttctaagctctgtctgattgagggaagcaatgacagaaaacgcttggcctgtcacatgactgatccttgctgtcatgagccatcgttttctaactgcaagctttcattttcaaagccctggcatgatttcaggagctgtaaaccctcatgtgagtaagtgagcagtaagaactggcagtttttcaatcttaagtctctccagctttaaacccacatttagctgtgattctttttttctccttaagttggacatttttttagtgaatacttttttgataaataaagtggggtgaaggtgaacttgactgagacagatatgggttggtccgtttagggctgaccctggaaaaaaaaagttatatcagtcttgacattaattccgtagtcagagtaggtgagagaggagtagattagtatatagggttcccagccttcccagtacaaccatggactcagagttggggacactaaaaatgtacatgaagtttatgatttcactggtagagatggcccacaatgccagtttggacaggcattactctaaacgtggtggggaagtcaggagacatctactccaaggcataacctctaggacagtttgtggggtatcagggaaggatatatcattggaaagatttctagttgccatacacaaataattgggcttcagtttaatgcataattaactgttctcagtgtgttattagttggacaattggattattacattatttacattagtgtttataggtaatctgaaaacaaaaatgtgaatataatatgaactacctcaaagatttgtctctgcttaatagttttatttcaaatttgtatatcaaatgtttcattacccttttttcattttattttttagctttcaaaacaaattagcaagaggaggaaagaggagagggagaaactgtgcacaccaccagaatgttatagtaggcgatatcatgaaagcaatgttggaactttatactcaggttttgattgtgcatctatctctttgttgtcttatcctttatcttcatttttaccaagtaattattgaccatcaaatgccattatggtaccaacttaagaaatggatgtaaagaattctacagggaaaaaaagcacattgtcagtgtatgaaatttatttagaagacagttacagacacatataaaaatgatagcagcttatgtttgcgaagcactcactatatgccaagcactttctgttagctaataataatatttgctcatttaatattagctcacataataatattaatattattagctcatttaatcctctcaacaactgtctagggtaggtactattatccctattttatggacaaggaaattaagtcaacaagagatgaaataatttgtttacagtcacatagctaggaagtggtagagtcataagttgaacccaggcagtctgaatccagaataataataataaaaaaaggtataaccagggtggaaacttattttgctcttttcaggtttcctagactttccatcaccaccagtgaattctgagtgacaatagtgtggaatttggaagaatggaagagaaactgaagtggagagatggtgaaagagaagaaaaaatgaagaaagatgcttgcaaaaatactgctgtgggtcctgagatgaggattctgggagggctgaaatggatgcccctgacagctccctttgagttcctgttcatctgaagtacaccagctttctagatatgctgtcactttccttctgcagagccacagtggtgtcctgtcttctcagacctcttctcacctcaaatcacttaggactcggccaccagacagatttgggatttcagaacttttcagatgttagaaagttcttttctaaatgtgatgaggaattacggaatcataaaatggaagcagagttaaactcagacatgtgggcactcaaggcaattaggagctttctgcgatgagaaagggatcagactgatccttaagactttatgcaaccccagagtattgcagccacctgcatgccgaaggtgtcaagagtgttctcactgctgcctataggagggtcttcagcctccagtgatccaaagtaccaggtaaaatatttaagccaacagaaagaacgtgttttattgtgttttacatgtcataaagcattctctatcatgagatatcactctgtatcggtaagacaggcttgaatttctgtcttggttctgccactgactagctttattccttaggctaacctgttggaatctcagttttctcactgtaaagtgaggataattattttatgaggatagttatgaaaattaaataacataatggttgcaaaacacttagcacagcactaagacacaaaatagacaataagtgttagttacctttattcctgtcccctttcctatccagacaaaggctcagtataaggacaaatattgtttagaacttctttttaaacctacgagccttacctttcaagaaccgcagatttgttcctgaaagttacctgtgtagtgagggttttataaatcaaattttactttcaatgtacagaggagctctttgacagagtcccttttcctgagaagtcattgtgggtttggcatcctgttcagcctggctggggccaggggagctgaactgtaatgacaagcagatgtactattgttctatgaaaatagtgtctggctccagatggggtttaggaaaaagtagtgatgatttctgttgaggaggatgggaattctgacccactgagctagctggtgaagaaggagagtaagacatgtgggtaaatgcaggttaagaaaaaggacctctagatcaactgaaagcctactagaagaacattaaaagcagataagaaaacaaggaagcaaacaaaactcgacaagagaaagaagagaccattaggaaacatccaggataattgctgtcatcattaaagctcccatttgttaatctgttacatatgaggcccaacactggatgatttaccaacatttaacctatcctctcacttttcaatgaattggatattgtcaaccccattattaatggaaaaatgggagctctagaatattgaagtcacttggctattaagtgatggagccaggactgggattcagaatccaacactcatattctttccatgaggtgtagattccattgagaagaaggtgtgtgcctaacaccgtgagaaagtcttggccctggtaatgctggtgaggccagtggctgagaaaagaatagctcttacctaaggctgagaacagaagacccaaggttgtggaaaactgacagtggtgcccttcctcacacagagtgcaaagattggtggcttacctgcttcagactcttggacgtgctcttaaatgcagatcctggcagtcagagaggaaaggctgagaaaagttcactctttgccaaagtaataaatccttctctttgatccctcaaaagttgatagacgaaaactcctcaaagcacctaggggtaggaaccccacttgagagttgtgggttctccatttcatcacagggatttgctgtgaaggaatcctgtggtaaactccataagaaaatgtaaataacatcccctctccaatttatcttttctgtaaatctggcttttcatatattaggtttctttacagtaagttgaaaccttaagaatagatttcaaaatatttaggaaatggcctatttattttgaatgatattcaacaccattaaactagagtgttgggagaatatttggacattccataatgatttgacttgtaacttaatataacagaactaaaaacaaaaaccacatgatcatctcaatagatgcagaaaaggcttttgatacaattcaacatcccttcatgttaaaaacccttgacaaacaagacatcacagaaacatacctcaaaataataagagccgtctatgacaaacccacagccaacatcacactgaatgggcaaaagctggaagtattcctcttgagaaccagaacaagataagaatgtgtcctattcaacatagtactggaagtcctagccagagcaatcagataagagaaagaaaaggcatctaaataggaagagaggaaattaaactccttttgtgaatataacatgatttgatacctagaaaatcccatagtctctgcccaaaggttcctagacatataaacaactttagcaaagtttcaggatacaaaatcaatgcacaaaaatcagctgcatttctatacaccaacaatgtccaaggtgagaaccaagtcaggaacacaatctcattcaccgtagccacaaaaagaataaaatacctaggaatacagctaaccagagaggtaaaagatctctacgagaattataaaacactggtgaaagaaatcaagagaagacaaacaaatggaaaaacatttcatgctcatggataggaaggatcaatattgttaaatggccacactgcccaaagcaatttacagatttggtgctatttctatcaaactaccaataacattttttatagaattaaaaaaaaactattctaaaattcatgtggaaccaaaaggagcctgaacaaccaaagcatttctaagcaaaacaaacagacgaaaacaaaaaacccaaacaacaacaacaaaaaccagaggcacactacccaacttcagactgtactacaaggctacagtacccaaaacagcatggtactggtacatagacacatagaccaacaggttaaagaatctagaaataaaaccatacacctacaactaattgatattcaacaaagtcaatgaaaacaaccaatggggaaaggactttctattcaatatatgatgctgggataactggctagccacatacagaagattgaaactggatccctcccttttaccatatgcaaaaattgagccaagatggattaaagacttaaatgtaaaacctaaaactataaaaaccctagaagaaaacctaggaaataccattctggacataggccctggcaaagatttcatgacaaagactccaaaagcagttgcaacaacaacaacaaaaatagataaatgggacctaattaaactaaagagcttctgcacagcaaaagaaattatcaacagagtaaacagacaacctacagaatgagagaaaatacttgcaaactatgcgcccaacaaaggtctactatccagaatctatagggaacttaaataaattaacaagcaaaaaccaaacaaccccaataaaaaatgggcaaaggaaatgaatagacacttttcaaaggaagacatacacgtggtcaataagcctatgaaaaaatgctcaacatcactaatcattagagaaatgcaaatcacaaccacagtgagacaccatctcacaccagccagaatggctattattaaaaagcaaagaaggctgggcatagtggctcatgcctgtaatcccagcactttgggaggctgaggcaggtggatcacgaagtcaggagatcgagaccatcctggctaacacagtgaaaccgcatctctactaaaaatacaaaaaattagccgggcgtggtggcgggcacctgtaatcccagctactcgggaggctgaggcaggagaattccgtgaacccaggaggcggagcttgcagtgagctgagattgtgccattgcactccagccagggtgactgagcaagactccatctcagaaaaaaaaaaaaaaaaaaaaaaaaagcaaagaaataacagatgctggtgaggttgtggagaaaagggaatgcttatacactgctcttgggaatgtaaattagttcagctactgtggaaagcagttcggagatatctcaaagaacttacaacagaactaccatttgacccagcaatcccattactgggtatatatccaaaggaatataaattgttttcccataaagacacctgcacatcgcaacactattcacaacagcaaagacgtggaatcattctaaatgcccatcaatggcagactggataaagaaaatgcgttacatatacattaaggaatactatgcagccataaaaacgaatgaaatcctgttctttgtagcaacatgggtggagttggaggccattatcataaatgaattaatgcaggaatagaaaaataaatactgaatgttctaacttataagtgggagctaaatgatgaatacacatggacacaagaagtaataaacactggagcctatttgagggtggagtgcaggagtgagtgaggactgaaaaactacatattgggtactgtgctcgttgcctgggtaatgaaataatctgtacaccaaacccccatgacacgcaatttacctatgtaacaaacctgcacatgtaccccctgaacctaaaataaaagttggaaagaaaaaaaaaatgaacctctgagacaatattataaaaattagcacattcaaaccacggaaattgtcaaagtgtagctaaaatattaaaccttttagatatgttgtctagatataattatcccattttatagccagtgttatggacatccaaagacaatgtcaattttgctaataaactgcatcaaataagtgcatgggaaaaaataaaaagttgatacattaaaaaaatgtttttgatacataacttttattttgaaaacttgaaataaattgccattgtgaatttggcagcttttaccctggcatgcctacaaagaatgtgatatacatttaatcacgaagaatgccacccagtgataacagtggtactggggttatgattatgttttaatttgttttgtgcagaaaggcatgaccatttgcaaagctgtcctatgaaacgtatcatgtactagtcacctcatgttatcagcatgctcctggaggagtaggcaatggattttttcaccagttcgcactgtgcaatctcttcctcatgtgtgtgaactttgtgggatgtcaagtaccccattaaaattgaatgaagtatttgaggggctcccacaaaccctctagtgatcttctttcaacaaacagcattttattgtgtaaattagaaaaacaacacagagtctggcttaaagaggatggaaaactggcattacaccaagaaagaacctgaacttcagtctttgacctcaggagacatccaagtattaaaacagaattttttttttttatttacatggaaaccctgatggaccaggaaattctttataatgtagagtctggtgctaagtcttactttcaggtgaacccaaatgaagattattgaactcactgttgaatctcatcccctgtctttttaacagcagtaagacccctcttggtcagccacaatatggggaaactcctcagcagctgctgttatccctaatattattgatatcacttctacttgctcttgctatgtttgtttcttttcagcagagctttcacagtactctaaaaagtagaggctcttaacattaaaagtttccttagccttttcaataaccctttcctggttgtctatgctggtggcagcctcaacctgaacctgagtgaatttgtttttctggcctgagctttgctgagcctcttaaggggtagaccgtctatgtgtgtttcttttatgtgagataaaacgcacaatttattaaatatcttctgattcttagacaggatctcaagggtggagctactccagggctcattgattttcatggctttttggctgtttgaaaaagagcctcctttgacatcatgtgggtttttgctatttctatttaagggtatatcttacatgtcagatatattattattgctgttttagttctagacagcaagtgatatgagcaaacaacaaagcttccatgctgtgaaattatgcatttattaaagctatcagttgacacttagctttgaattatttatatttttctataaactgtcgacaatcataacgggaccagaaccataggttcatatgggaaggtgatttactcatcttcctttcttgcccttaggaggagttgcagacagagtattatctttttttttttttttttgagacaaagtcttgctctgttgcccaggctggagtgcagtggcgcaatctctgctcactgcaacctctacctcttgggaccatgcctggctaatttttgtattttcagttgagacgaggtttcaccatattggccaggctggtcttaaactcctgacctcaggtgatccatctgacttggcctcccaaagtgctgggattacaggtgtgagccaccaggcctggcccagagcattatctttatcatgactttttcctttatatgtattgactatttgcaggtgtatcacaactacaggagacagaaagggaagcggtatacctctttctgcatgccttgtgtttaaagcgtgcctagattctgataaaggcttgcctgacagaaaaggcagaatgccaggggtctatcccaagatactgagtcattcctgtgtccttaaatgccaaagaggtaggatcaaaacaccagatctaaaacttgacaatataagttgttagacttaatctccaccagactcaacttgtatctcagcttctcactaatctcctatttctcattcactcactggtaccttcagcttattctctgttttctcctttgtttgtcaggttttggcatgatatctcagacactttttttctccttgcttcattcagccagccccaggtgatttgccttcccagaccactggctttctcctgaaaagagaagacacaattgacttctggtctttcttgctgtccatactacatagattgttattccaaagcttggtccaggctgagttcttggacactgctttaaatgagtggcccttgaccagaagggagatctagaaacaaacacaattttcctggggaagctgaggcattgtgtttgaggcccacgtatctttgtactccttccgtcctgtgatccagaagtctatttatgccagtcttgcttcaacctctctcacaattgcaggggaaaagtctactgaagggagagaacatttcagctaggggatataacttaaggtgagaaataaaagtgagacgaagaaaacatgtttggtgaactggtttgaccagaactcatgtttcaagttggaaatgttcaaataggaggaagataactaaggtaaaaatattaaagactactattaaaaatttggaattcaatagttaaacaccacaattagagatatttttatgacattactgatattaggattgtcatttactgagaaaagtgtgtaaaaatctcccactatgattgataatagaatgtttattttccttgaagttatttcaattattactttatttattttcgagactgtgttattcattgcatacaagttgaggattgtgatatcttcctcgtgaattgacttttgtcatcatataatgactttcttacctggaacaatgcattttgcctttaggattactttgtatgatattaatactttgtcaccagctttcttttgtttaatgtttgccccatagtaaaatattatcttgccttttggaacatcttggaatttttcctcctgcctttctaacctatcttcactgtgtccttctatttcttctttttttcctcctactcctgattacccccaaaacccaggccttgaacataggggtatatctgtgtgtgtacgtagatgcacgtgccaacttttttatctcaaggctttaactgttactctatcattgaaactgcatttcacaccttctctttagtctcaaattcccaactgccactcatcatcttcccttcccttgcctatatctctactctattctctttttctcttgggcttgcagccttggagtcaaccttttttccgctttatgctctatattaagctgtcataaatgccatgacctttgctgaaatgcctaacagattctcagcaataagctcacagggaaagggcaaagccaggagtgcaggacgaggggaggatcagtggcagccatcctgtagattatctactgaaattctttccattcctttgaatttctgctcctttgaagccctggattataataattatcttggaaagtttttcagtccgagatccaaaaattcttaattgggacctcttcagtgaaaatgacattcagtgaaaatccctggcaacattttcctagatgagaaaaagaattaggaatcagatgaagacgtgagaaagccatgacttcacaatgtgtaaagcatgtgctgatagcttgtggaagagtgtcttaggaggtccctgtcccaatgaggataacttcttaatcagaatcttgtttccaagttctccctcaactccaggataaactttaaaaaggaaaacaaaatccttgctagaaaattttccatcatttttctcttttctgtatgagtagcatggatgaaagagttctgtgactgagttgaggtttgcatctaactattgagccatggcaaaaaatattaagcatcactatttgttgtcatataaggaatttagtggggtttgaggttttaaatgttattgtttttctctatagtaatatcccttcaatccccttggttatctttctagagcaatataaaatgacctgacttctgtgagaagtctttagcttttggaaatcctcacctaggtttctttcacctagagaattggtttctgagaaaatcctccttccttttactgaacagtgaactgggagcctttaaatggagtggaggtggaggaagatggaagtgaggcaggtagaatttgtcattctgtccccctgggagaatgaggaaattagcatccagttctctagaacctagagtttcagggatctatttgagtgggaaaaagcattccttgtttttttgtgacctacttaaacattctgtgaaagttgtaatcatttgaggttttctaagaaaagaaaaaaaaaagtctaaatataatcctaaaagggagctaacctaacaacaaagaacacccggttgcagagattatttctctggaaattggcaaaaagagacaaaaatcttccctggcgattactggctatacctgctgctacacctgatttcatgctttttattcctggcagcactattggccttctccaatgtgggcttctccaaacttcacacccaggggcacacaaatcctatttctcccatctggaaagctctgctcacttcttcccaagtccgcttcccacctgcctttgaaatgcagctaaagaccacttcacagagattccctcaatgctagctcttccgctatgcccttcattctttctcttaaacccctagaactcttagaacctgttaacagtgtatgacatcctaagtgctctaattcagggacagcagagaatgcagtccaggctcctggtccagtagtggggatggattgtgctggtccacccgcatgctgccattcagtctgctttatcgtgagcacttcccatttgccagcaggggctaatggtgtaggccaaccatggaagaacgtgaagctcatctcagtttagctgactggatgcagcctgcagcaagcatgtgttgttgtttcatacattcctgtctttgctctgtgtgcacatttgggtttcatcttttcctcctagcggcacacgttcccatagactttgtgcttgcatgtattaaggaacattgcgttgtcaaaaggtaataataagagcagctaaaaattattgagaacacgtgatgttgtaggcactcttttaaacatttttatatgcatttaatccttgcaacaatactgtaaggtagttattatcccattttatggatgaagaaaataaagtactgagaggttatgttactttcccagggccacatggctagtaaattctaaagcccaagctattgaccttgagcctatgctcactccaggctttggagttgtaggagatgtgcaaggcttaatgaacactgagtgaacttatgaggcagttcagtcatctgacatcctcattaaatctgatttgaagaaatgacagagagaaagttgatagagcttagaaatttggttctaggtgagaccttaaaagtcatgtcaccaaggaataagagaccctcaagaggttagataagtcctctgtgcatcatttcctcctgacctgtatctcaacgtcaaagctgtcaacaaaaatgaacagggagcagcacttagtttgtatgatgtattcataatgtttggggtgccaaacagaagtcttatgacatggtatttttgcccggctaggtttttctatactagggcatggccatggttttaatgctttatttattaaagttattagaagataaatatgtgcaatcattgaaacttttcttattttcaaataagaaagggaaacttaaaaaatttagatttagcaactaacttttatttagaactgccatatgatctaacataaagttttcttacaatctgaatttgaaacattcaggattattttactaagatctgaaaaggtaatttgacatactatctataaaagtgtgaattaccctggggattaggaggtgaggttctgtagtaattaggtatgccaaaaataattttttaccctcctccccctcttccttctttcttttctgcatttacatgtattgctcttggtctctcatgtcattctttcaggattttctaatgtaatgaatttctctttctctaccctagagagtaccattatttccattctttcatggaactgtaagtgtgtgcaatttgttgacctcgtggtatttcaaagaactgtaaaatctcaattatcaggaatgcccagggaaaggggcttttaatggaatggatttttctcttaaactgaaggttaatcaggactcttctctcccccccgtttcaaatttattggttgcaattttttttccctaatctgtgagtgtactttctgggctttgctgaaatgggaggttatctgattgactagcaatcataagccctatgtttaagtccacattcttccatttgccagctctatggtttgaggaagttatgacactgagccatttgaaaaatggagatagcaacacttgtcctacctatgtcacctgggctgtttagtgtatcaaattatataaagacaatggacttgctttgtacaagtcttaagttttattttaatgaattatgacaactaccaagttctgagtgcctaggggccaggtgctccatacacattattgttatttccacaataaacctactatatatatagatgtatatagatgagaaaagtaaggcttgggagataagtgacttgcccaagattatgtaaataacagtggaactaaatttctttacagcaaattgataccttgattaatcaaaagtctttattctaagtaccatttcttgtggataaagagagtatagaagattgcctagaagcatactgaccttaggatgcattgttttgcttagggttcttttagttataaggaacagagatgttaggtttcagagggatttcagagaaacccaatgacagaaattgaattatagttgggtgttaaggaagctgtcatgaatcaagcctactcttgcctctcctctttcttctcctctccttccttcttttcgctctctctttgtccacacaggcaaaatcttccttacatatgtggccttcactctcttttgtctattgactggcttcctcataactgtagcttgcatatggttcatcatatggtttgggtctgtgtccccacccaaatctcatgttcaattgtaatcccccatgttggaggaggagcctggtgggacgttccttggatcatggggatggtccttcatgaatggtttagcaccattctcttggtgctgttcttgtgacagtgagtgagttatcgtgagatctcgttgttttaaagtatgtggcacctcccctgtctctctcttcctcctgctccagccatgtgaagtgccttgcttcccttttgccttctgccatgattggaagttccttgagacctccccagaagctcctgtatagcctgcagaaccgtgagccaattaaacctcctttctttataaattacccagtctcaggtatttctctatagcaatgtgagaatggactaatacagaccgtagtagggactctacacctccatatagcatagtatctcttgatctgtccatttagcttttgccctgttgcttactggaaattctctaggtcttgtgattcagattcctgaaggaggattcttactggcccagctcatctattctagtcagatcccaggtcactgactgctacaagctcatggattggctgcttttgcatcaggtgtcctgctttggtgctgcccacttagcaaagctaagggaagactaggaaataaaagcaatgtgacagctacatctatcatcactattaaagaaggctatatatcacgatatatttgtttttgtaaaaatccttaatattttattgttatcttttagttcttattctcttcttttcaacgtagtccctcgtctttcaaaatatttctcagtaattgggttcctgttgactcaaattttatgacacagaaccttgtttataacctcctaacttaccattactaatatcagttctgtagtcatatataccacaattttatatgtttttgaagaaggtagtaggaaaatatgtcatagtttaagttttatactaagcataagtcatgtcatagtagaagtcttttttctattaatagaagatgtcatgtctcaaggttattgttggaatataccgtaattaatttttttaatccttaaaataggagaattgagggtttccgagtagtgtgaatacatgaaaagtgaaaaaaatgggtcatcttctaggaaggcctgcagaacttaaaactgagaacaggccttagacttgctttctttcctctcctggcacttcctgggttttgttttcctccctgctggtaggttttgatgggaaggcattatatttctgtttatctgaatatctattttactcacaaacttttttcttttatcatagctgatatgaagtgaaaacatgtatcacttggctcagcctgaactgctgtgtgataggatgtccctgtatcaaccatgaaccagaagtggaacagggacctaattaatatttatgctgaccttggtggctgttgtaaaataaactaccatacatctaaaacctcaccacactgggttggatagctaaaacttctatactattcatggcttaacttctgagatttatatgcctcttgaagagaaagtactcatcactgctgaaagtttaactttctatttttgttatggcctccattacatttccaaatattcctttacttaattttatccataaacctgaagccttcactttcttagtgaggtactagattctttgtatataaatttgactgtattggaaagcctgggtccatgtgtttttagtccttaactctccagtccttgtagatttccttgtatataaacactttaactgagttatagaacctcttcctctgtgaactggtgtcaggctctggtggtaggtcctcttcctactctacatgctgcctaccctcttgtatggaaaaagattaactgttttcctcacactcagcgcaaaacacttctggtcaccaaaacgtgtgggtttctcccacacaaagcaattctctgacaccagctggatatcctacagttcagttcaattctgtgctaactgaagttggcacagactccacgtgttaagggctcagcccctcaagactgtccccggcttcagatgtcagtcactagtggtagtttcccatgttacccatgacttgtgtcagacttggctgtaaactggagggtcccaaagcccccttctctggtttgatcacttgttagaacagctcacagaatgaggaaggtgctttacttattattagccattgattataagatgatataagtcaggaacattcagaaggaagagatgcacaggtgaaggtatgtgggaaggggtgtgaacttctgtgccctctctgggaccaccactctccaggtacctcctcctgtttggcaacccagttatggaggcttcattacataagcatgattgattaaatcaggccactagtgattttttaaaaaatttaattaacacctaataattgtacatctttatggggtgcaatgtgatattccaatttatgtatacatgtgtaataatcaaatcagggtaattagcatatccatcacttccaacatttacaatttgtttgtgttgggaacattcaaaacctctcttctagctacttgaaaatatataataaattaacgttaactatagtcatcctacagtgctaatagaacgctaaaactttttcctcccatttagctgtgattctgtatctgttaaccaaactctccctcttccctacttccccctacacttcccagcctctagtaactactattctactgtctatttatataggatcaactttttcagctctcacaaatgagtaagaacatgtggtatttttctttctgtgcctggcttgtttcacttaacataacgtcttcccagctcatccatgttgctgtgaatgataagattttgttcttttttatggccgattagtatttcattgtgtacatataccacattttctttatccattcatctgttgatggacactaaggctgattctatattttgtctagtgtgaatagtgctgcaataaacatgggagtgcagatatctcttcaacatactgatttcctttcctttggatatatacccactagtgggattactggatcatatggtagttctatttttagttttttttgaaaaatctccatactgcttcccataatggctgtactaatttacatttcaaccaacagggtataagaattcccttttctccacatcttcaccagcatttgttatttttttgtctttttataataaccattctaactgaggtgagatggtatctcattgtagttttgatttgaatttccctgatggttagcaacgttgagcatttttcacacacttgttggtcatttgtatgtcttcctttaagaaatgtctattcagatcatttgcccattttaaaattgggttatatggtttttttgctgtttgctgtttgagttctttgtgtattctggatcttaatcccttgtcagataaatggtttggaattatcttctcctgttctacaggttatctcttcactctgttgattgttttctttgctgtgcagaagcttcatagtttgatataatcccatttgtctatttttgcttttgttgcctgtgcttttgaggccttatccataaaatctttgcccagaacagtgtcctaaagtggttcccctatgttttcgttgagtagtttcatagtttttatccttacttttacatctttaataaattttgggttgattttatatatgatgagagataggggtctagttttattcttctgagtatgaatatccaattttcccagcaccatttactgaaaagggtgttttttcttcagtggatgttttcagtgcctttgttgaaaatcagttggctataaatacatgaatttatttctggtgccatttgtctatgtgtctttttatgccagtaccctgttgtttggttactatggctttgtagtgtattttgaagtcgggtagtgtgatacttccaccttcattctttttcctcgggattactttcactagttgaggtcttttgtagttccatacacattttaggatttttttttcctacttcagtgaagaatgttaaaggtattttgataggaattgcattgaataaatagattgctttaagtagtatgatcattttaacaatattagtttttccaatccgtaatcttgggatgtctttccatttttttgtgtcttcttcaatttctttcttaagtgttttatagttttatagttttcaacgcagagatatttcaccttcttggttaaatttgttcattttttttatagttattataaatgggattgccttcttgtattagtttgttttcacacggctataaatagctacctgagactgggtaatttataaacaaaagaagtttaactgactcacagttccacatggctagggagacctcaggaatacaatcatggcagaaggtgaaggagaagcaaggcacatcttacatggtggcaggagagagtgtgtaggggaaactgccacttttaaaccattggatctcatgagaactccctcactatcatgaaaatagcatgggggaaaccgcccccatgatccaatcaccccccaaccaggtccctccttcaacatgtggggattacaattcaagatgaaatttgggagaggacacagagccaaaccatatcacttcttgatttctttttcagctagttaattgcagtatagaaacactattgattttggtatgttgattttataacttgcaatttcactgaatttgtttcttttctaagagttttttgatggagtctttcgatgaaggtttttccatatataagaatatgtcctcagcaaacagggaaaattttacttccatctttccaatttggatgccctttattttgttctcttgcctaattgtgctctggctaggactttaagtattatgttgagtaagagtggtgaaagtgggctttgcgtcttattccagttcttagaagaactccccccaaccgccattcaatatgatgttagctgtgggtttgtcatatatggcctctattgtgttgaggtatattatttctgtacataatttattgagagttcttgtcatgaaaagattttgaattgtagcacatgctttttctgtgaatactgagaggattatattagtttttattcttcattctgttgatgtgatgtgtgatgtatattgatttgcatatttgaaccatccttgcatccttgagataaaccccacttgatcatggtgtataattcttttgatgtgctattgaatttcttttgctagtattttgctgtggatttttgcatctatgttcatcaaatatattggtctatagttttctttctttgttgtgttcttttctggttttggtgtgagaataattctggcctcgtagattaggtttggaagaattccactccccacctccattttttggaatagtttgagatgaattggtgttagttcttatttaaaagtttggggagtaacaacagcataatgttagaggtgcctagtattcattccccttacaagaaaaaaccaaggcaatgaatacacagctaagatttgactggagtgtgggaaggagcaccttggaaggcagcaaagaggtggagatgcacctgtggtaaatggaagtccaggagggcagcacgcaggcactcagcctctgaagctctgtctgccccacccagattagatatgtctgaagtcaggagacacttcctgttctggcaaaaatctgagtagaagacccttgccagcttccattgccactgccaatacctacagtccttataacaagagaattccacaatcctttcaagccatgagcccaattgggagaactgtggggattatactaaattagcagtacaaggtgtgcactctccaccccctgcccactccctatgagccaggctgctgcagcatggtgccatcttgagaccagagtcacctctggtgtgcaccctgctctgggagccactagccactgtgcctcacaagcactgggactccatcttcatcccaccaagcccataggtcattgaaccccacaacctcatctgtgcagagcctgggcccaagatcagctatgactcctgcactacagggaaaccaactcctgctgccttacctccagctgaaggaacagtctgattgtctcatccagggtgaacccccccttaagctggcgaaaacactacatgccatccttcaaacaggagaaactttcaagcttccgtgtagctgacatatccctgagtcagtggaatgactataggccatactcagaacctgagaaacaatgtagcagtgccactgccccaagcagacacaccccttgtctgcccaatggccctaatgatagggacaggagatagcgaaatactgggtagaagagggtggttccctggcaaaggccccaccctcaagcctggaaacccatggccctaaatgggaacaggcattcctatttttgcacccaaaagttcccttttggcccaccacactctgcatcctgaacccatataaaccccaaatcccaggctccacgagcagatgaacagaagagcagaagagcagcagagaaggagagaagagaaggagcatctgaacgttgagaggagttcagctgggaatgattggagatgagatcggcgctagatggccaaactccaggggaagatcatcttcccactccatcccctttccagctccccatccatcctgttgagagccacctccaccaatcaataaaaccctcgcattcaccatccttcaagtccgtgtgtgacctgatttttcctggatgctggacaagagctcaggatacagaaagcccttgcaaaaaggcagagtgttcactgagctgtttaacacttaagctgtccatggacagcaaagctaaaagagtgcgctgtaacacatgctcactgggacttcaggagtcgcagacacccacccctagattctattgtggggccggagcccaaaagtgctcacaccagcttctgcacctgcccatctgcatgctccccgtcatgtaaggggtttgagtgccagtaagccatcatccttttacttatttaacatttaatatgtatatggtgttggtgcatgataacatcatggaccagatataatgtttgtctccaaagagcttgtatagctatagggaaataagacttagacactgggcagagggaggtaaaactgacaatgagttgtgggatattacagataggaaagaacataggtgtggtgttttcatttttgtctgcaggttacaaagctatgcataaagaatagtaggaatagtcttctgctcattatattgacaaatgtgatttttaaaaagccaaggtaaattgatgtatttttagaaacatgaaaaatacttacaaaaatacttttaacatttaaaaaaatattgctagcataaagaaagtgggagagtggtccttctggccaaaaatgccatttgacttcttgtcatgcagccactggctacattttttataccttttctgaccctccagtttccacttctgtcactacatttttccatttctaatatcacactgcatgctgatttttgacttttggaactgatggcattttcaccctataaaagtgtcataaagacacattaatattcaaatgatcacttattttgtaaatagggaatttttgcatatattaaaccagtagctttcacttcacttcacataagtcatgtttctttgtggttgtccattttcaaatctgtgccacaagactatgtactgggaaggagaaaatgagaattaccacaaacaaaaaaaaaaagtgatagactctgaatcagagttcactttcttgacctctctagtgagataatagtcttgaaaggcaggcttcgtggaaagagaaatttcttttcattgttttattttttccaaatctattttttaaaacttttctatttagaaataattttagactcaaaggaaagttgcagaaatcagagttcctgcataccctttaacagcttcccccagtgttaacattttacattaccatagtaagagtatgaaaaccaggaaattaacagtgacataaaactgtcaccttatctatgaatctttatccagtttcaccagatttcctattaaagtgtttttcttgtcaaggatccaatccaggctcccacattgcatttggttgtattgtctccttggttttgtccaatattagacccaccttgagtctttcctttctttcttttcttttttttaaatttcatggctaacacacttaaagagaactggtcagttatttatagaatatcccttaatttggaatggtctttcttttaattattacattgaggttgtgccattttggcaagaatgccactgaagcgatgtgcccatcttagctcatcatatcagtgggcacatgatgtcgatatgccttattactggtgatgttagcctgtgtcactcaattaaggtgatgtctgccaggtttctcaattatgaagccactatttttcccttgacaatcactgaatatcttctggggagatacttgaagactatgcaaatatttcacttcttgccatatttttgcacactaatttgagcagccattgattgttcttgcctgcaacatttattactgtgctgttgcctaatggttattttttattttccctacttctaaatttattcattggtaatccattgtaagaagttgtcccttctccctcatttacttatttattcaattatttgtttacattagcatgaactcatgggtcatcatttgatactatcataacttactttgttgctcaaatttaactagctctggtctttgggagatccttcatgttgcttctctgtcttttcaacatgtccccagatttttttgagtacattctcacttggcaacatgagttttcctggattgtcttttatttcccttgccctagctctggaatcaccatttccctggagttaattctgtagccttgatttcttttattcaggaatggtatttacagctaagatctgggcagatatgctattgctataaggggttattgaaacaggaaatcttccctgaccccttcacaggacttgtgaagggggtaattcatttactgagcccacagctctcaatccctcatgggatggggagcatgcaggtgagtgggtacaggggctggcatgagtgcttctgggcactggcaggaacagaacttcgtgtggccctgtagcagcatctgcagggggtacctgtgacccatggagccttagaaggtgtgtgttacagttgtgctcttttagctttgccctctggtgatggcttaagtgtttaacagctcagtgtgacagccctctgtatcctgagctcttgtttggtgtccaggaagaagcaagttgcatgaacgaattgaggatgctaaatgcaggggattttgttgccgatgaaagtggctctcagtataatggagagctggaaaggggatggagtgggaaggtggttttccctggagtacagccatcctgggccaaactcttctctgagatcccaccatcaagccgtccctctgaaatcaagctgcttctcctcaacatcaagctgctttttctcttctttcctttgctgttgccagtggagcctggggtttttatgggtacacgatagggggtggaaaaggcaacattcaagagggaaaacaggaatgcatgttctcactttgggctgaggttccaggcttgagggtggggcttcaacagggaccccaccctcttctacccactattttccctgcctcctgtccatatcagtattgtctctagtcctgctcagtcaacagaagtaggatatatatacatccatccgtaagtatacatattaaaaattatacatttatacctctgattccaacccaacaccactggtttcattctagcctttctgttctttgtaacttcttttgctgatagtgaggaactagctcattatatttacttaagttttgatcctagtatatacacaaactagttttggaataatcaacctacattagcctagaatacagaatttgggttcaatttttttttgtcattagccttacagtattcatgcaaaatactcttttccaaagatatttagattagttctttcttcaccactctcttcactttgattatgttagttatttgtgatatagttaggttcatttgtcactgtttgtcttccatttgaggttcctatcacatcctggtttatttttaattatttatcgtgtgtgtgtgtgtgtgtgtgtgtgtgtgaaccattaccatggttctaagaatcagaactatgaaaaaaaaagtattctcagagaaacatttcttccgcattcggccttgtcctattgttctttccaccctgttctcactcaccccctctaggtaaccaatctcattaacttctggtttatctttcctgtgtttattttgcatttgtacaaatgagcagatatgtgtatattttctttctccttttatacacaaaggttagcactatagataatcttttttactttgcttttttgtaaaaaaataataacagtatatcctggaaatcacagacattttccatattcttttttactgctgcatagtgctccattgtatgaaggtaacttcatttatccaacaactgtcctctgtataataattttggttgcttccaatttttttgcaattacaaacaatgctgcaatgactaaccttggacatattcgtctgtgtgtgtgtatgattgggggtgtatctgcagggtagatttctagaagtgagattgcaggcccaaaaggtaagtgcatgtgtagttttgttaggttttgccaaaattccctccagaaagcttctaccagtttgcattgtgtgaaattatctatttccttatagcctcctgacagaatatatcctcacacttttttattttttctgatataagaagtacaacatggtatcacagtattgttttgattttatttctgtaattataagtgaatttgaacgttctaaccttttaaaaacatttctgttcatgtattttgccgtcttgctatgaggtttttgtcctttgtctcataacactttgatatattttctcccggtttgtccgttgtcatttgactctatttactcttggtatgtaatttaaaaaacatttttgtagtcaaaatttttttttattttattgcttctggattttgaattatagttagaaagcctttctcatatctaggttgaaaagcaatccccccgtgcttttttctaggatttttatggttccgtcccttgttttctatttagattcctaatcctcttggagcacatttttgtttatggtgtaagttacagatctaattttatcttttttccccagtggatgcccaattgtttgagcactatttattattataaagtccatctttgaggccaggcacagtggctcacacctgtaatctcagcattttgggaggccagggtttgaggattgcttgagtccaggagttcaagaccagcctgggcagcatggtgaaaccccgtctctactaaaaatacaaaaattaggtgggcatcatggtgcaggcctgtaatcccagctactcaggaggtggagccacaagaatcgcttgaacctgggaggcagaggttgcagtgagctgaggtggtgccactgcactccagcctgggcgacagagtgaaactctgtctcaaaataaaaaataaaataaaataaaataaataaaataaagtccatctttgtaccagtcatttgagatcccacctttatcacatattacatttccagattaacttgtgtctatttctaagctttctattctattccactggtctatttgtttattcttgtactagcaccacacttttaattatagagaatttatagtatgttttaattcctgatatatgacttatccccaaattgatttttcttttgagtgtgtcctggctactgttatgtgtttgtttttctatatgaactgtaatattagcttgtctaacttcatgaagaagcttgttggtattttctttgagactgtcctaaatatataaattgatttagggagagctgacatatttataatattgagttgcattattcaagaacagaagatgtctttccatttgttcaagtctacctgtctattcttgatacttcatgtctttcaaaaatgcttcttgtctattcttgactctttactcttccatatgcattagaattaacttgtcaagttctgttaaaaacttgttgattgaaa

SEQ ID NO: 278 - DNA, 32633 bp, Homo Sapiens
gcacccacagccggtaggcccccagcagcaccagagccaccagcgccacgttcagcagcatttccccgccccccgtcagaagcgccaacgccgccgccgcccagcctcccccttccgctgccgctcccgcgtcgcctggactctcgctgccgccgtcgttgctgctctcgctgccactccccagggtgcctagcttcacgtccccatcaccagccgccatcactgcccgccagcgccttcctcctcctccccgccccctgccctccccaaccccacggccggccccgcccatctgggggcctctcagccaataacgtgagaagagggggcggggtcaggccggctcctgattgggtgttgacggggtaacgttgtctcggatctcccgccccctcccttctttcgctggccgcgcacgcgtgcaacgccccgcccacctcgccccacacttccctgctctcactccaagcctccgctaggttaagtagacgagccgggcgggtctgaagaaaagatgctacgacggccgcgcggacgctcatgggcggggcgagaccacagcgcgtgcgcgggctcctgagcgccacgcgctcgcctttcgttcgtaacccctgcgggaggcacgccccgcccagtctccaggctctgcgcgtgcgccctggaatcgcttcccttcctaggcctgcgttcgcgtccgcaaactcccgcctccttgcgctccccccgcccgggagcttcacgtgcgccttggcggccgcgggggcaggtccgggctggacgcctggcggaggacgcgggcaggtggcttgtgggaggctggggcatagttgagctgcaaggcgcaaaccgatgaggggcgtctgcttttcaccagggcgccgtcgcttttgtcgggaaaccggcagcgtaggcgcgcagaccgggaagcggcaagaagatttggccacgagctggggtcttcctggaacggagagaaagcacggaacccgcaccgggcttctctggcatcggcagtctacgtgctcctcgcgctggcaccgagcagccactccccgctgggtttggcaaaggctgctcttgtagaattttaaaggatttagagtctcattattccttgaatcataacttctgcggccgtagggaagtggacaggttgaggtggtctttctattcgtcattcactcttatttgcaggttctgtttcatgtacttggacgtcttttagcctctcacaccttgaaattctagtgtgaaaaagtgacctctgaagtctcacgcactcaactcgtttgacgaactcgtttgacgtgttctctcttgccctttgttgtctgttgtcttgagtctcatagaataggtttgaacctttcactgtcggttttgtaggagtcactgaggatattgacgaggcaagtgacagggtcgacactcttgtagagaggctgtatagcaaccaggtgtctgaaggattagaggctggggaaagagtgggaaagcagttagtaggctagggtatttgtgcgtgaggtgaggagactcagagctaggggagacattagagcaggggttggcaaacattttttgtaaagggcccgatcatattttaagtctctgccttaactactcagctctaccttgtaacgagaaagcagccatagacaatacttgaatgagtgtagctgtcttcagtaaaactatggacattgaatttttaatataatttcaggtatgaaatattcttttgatttttaagaaaatcattgaaatatgtaaatttttttttttttagttctggagaggtgcaaaaacaacttataagccatattgctgagccctgcattagaggtacctgagggagagcgacacaattggtagtaaatgaccatatactctatccttcaatatggaacacttttggaagtaaagtagggcattaataattatagccagagaccaggagttatatcagttttatcccaggcaaacctaaaggaatagtcaccttaaggttaagggttaggagaagtcaaaattgctttaggacttggtaacagaaaatgggaggtgccagtgatggaaataggaagataaagaagaaactggttttgaggagaagatagctgtagcagtcccaagagctgtatacagttgagacaacattgataggaaggaagaaagcaccccagaagcaggccactccttatatcttattgaccagaactgggctattagctgtccctaaagcagtaacagacaaggagcatgggacatccatgattgcctagtgtttatctggcttttttaattcttattcaggactgtgttgagcattgctggacatttaccatctctggttccttccagctaaatgtcagtaccacacctcaggcattgtgacaccgtaaatcaaccgtttttccctcccaccccccagaggtgtggtactggttgagaaccagtagcttagaccctcaggatttaccttggggctgaattagtgtgtgtaggtttcttttccagttggtttggagggaagagaggaattggacagtattaaagttctgctgtcaaggaagtgggctggggaatgttgggtagctaaccaacattggctgccacgtgaagtaaaaaagttttcctttatatccttgataaaatagtgtctcgacttcttcacacttgaagccttcccaaaaccccagcttttttgattctcattgtaagccccttgaactggactagttggaagttcttattttccaccctaagtaacaagctcttgtcccaataggatactcttgctttgagtactgcaataactttccaattggtgacttgccgtcagtcttttcctatttcattcctacacgaagagactagaactgtgttctgatttcctttgctcagacaccaatctccaggggtgctctgtaatttgaagaggacaactcagaaagcactcaagggcctccataagtccctgagtggcttccctgccttcccgttccccagcaaacaatcccttggataccctctattaaatgatacgtttccccttacaatacctagtcccttgccccatatatgctatgtgtattgcacagtctaggacttgactcatgctgtttcctcacggagcatgcccttcttatttctaaccatacaaattccatgacctatccattctttcaattctacttccacctgaggcctctatcagcccacattaacctaccttctttgaatttctgtgtgttccttacctgtaccacccattttggccttttattttatgctcttcttgactattctgttattgaaactgtcctttagatcccaagatttctactttttccctgcggatgcttttttattttttttatttttgacttctttctaccctccttttcctcttacatccctgctttgcctagaggacatctacaagaatcgtcatgtacattcttttctcctgttgttagcttttttcccctgacacttcatctatttactgatttacttgtaaatctctggaagatattagtactagccaccaaatatttctatttctttttccacacacgtagatttggatttccctactccttttacctcaagaatggccaatgaaatgtgattggaagtgacttgtgtcatttccaaataaaagctttaagagcctgtggacatttatcctgcgctgtttcttcctgccaacagtgatgaaatattttaattatctattgtcccatgacaaagcaccttaaatcttaatggtttaaaacagtcaccattttattatgtgtaacagttttgtgggttgactaggctcatgggcagttgtctaatcttgctcagggtctctcatgtggttccagcctggtattgtttggggctggagtttttggaggctcaactaggttgctagagtagctgagcttttctatttacccatgccgttccaaagactctctgattcacatggcttcttcagcagagtagcctgacttctttcttgcatggtggcttaggattctcaaatgcaataaaagcaaaaacttcgaggttttgtaagtcttaggtctggaaatgacatgttgtattggtaaaagcagttacagggccagctcaattttaaggggagaggaaataaacacttgataggggtggagggagagtgacaaagaatttgtggccatctttattacaaaaatttttgtcaaccacagagttacaggaaaatgtggccatctttaatcactactccaacgatgtttcaaattgagtgggcttccatcagccagggtctcggagacaggacaaagtggaaaacagctcccaaataacatacctagggcattttggggacagactctacagtttactagtggccccaggacatcctgcaaaagaggtgaaatcagtattggagaagtggtctcatgaagatgggagcacgactactacaattgactgctgacttctcacccaaggaagtaactgtatcccagcctaatctcagtggataagcccacagggttaagagatgttcaagaaaaagaacaacttcagtggaagaagaagaagataggagcccaggtcctgtgtttcaccaagacagccgtgcaaagcagatgctgccaaaaaggtgcaaagtggtttgtcagctcttctgcatgttctaacaaattagacatgcatcccaaaaggtatactacaatattaaagcttatttatacacactgtaaagtttcccctgagtgtcctggcaggcacttgcatggctgggcagtatccgtggactgattcctttgtgaattacatggagctgacagggctgaaacccacagctgactcggaggaggatggaagcttgtgctgggcaaggggctgaagcccctctgtgtaagtcatattaatctcctctgagcagagtgctacaaaattactaaagctgcttcttgaagacacttctaatgcagtacctaatgaaaatgtcaggtgcgacaagttattagttgctgcactgctgttctgaagtcccaggtatttctctacctgttatccatgaatgtgagttttgtggggaaggcagtcacaggctgaggaaagcatcagcagtcatgtgtgctgtcaggcctgtaaagtgagtgaggacaatgaagctggttgaagtgccccaggaaatggccagacttccatagtggaggtgaggtgaagaattgagtccgggcaaaggtgtgtggggagaagaagctgcctggtgtacgatgctgagtaatgatacaacccaaatcatctgactctgcagatttgaaagttgccgttattattaagaattcagatgggaaaagaaatatggtttgggttatttccatagtcattccagaaatccaggctcagtttggcatttattgacataactgtttatattggatctgtgtagaagtttgtatctttctgacttgcatgatacttcagcctttccttggagtctctgtggcttctcttcctcctttgctcacctccagtcattgtcaaatggctttgtgcaagttactctttctcggcctccatttttttggatcctgcctttgccgccctccttgcctgtactctgtccagtccaggccctctggacctcttgcctggacctccaagctctccctcctcccatctcttccctttcaaccttcctacccagagcacagcagtagtaacagctaacaccatttaataggtatcctttctatgccaggccctggggttgctatgtcacatatattatttgtaatgtttgcaataaccctggaaatggtattattacctccattgtacagtttggaaggcaccaaaaaaggcacatgggcccacattcatgcaagctaatgaggggcaaaactggaatgagaacccagggccactgggtccctcagcttatgctgttccctaaccatactgcttcctccactcagaatcctttagtggctcccattgcctaatagatcaagtctgggctccttatcttggcttctgggtcctctaaaatgtagtctgctaggtttccaggctttcctctccacccctcacacatcctactctttagccaaaaaaacagacaaaaaccctaaaaacaaaaaaatccatttttttatttatacccgtgctttctttcctaagtgcttttatatgtgctatttctcctgccaggagcagagactgtcatgctttcctctgtataagtaagtgttgcccaagaaaacattgaacagaggtgggctagagatccatttattttctggttcacaaagggcatattggatctttattaaatagtctaaaatgtcctttcaataatgtttttctttaatatctttttaaaagacatttaaagtgaatcagaaagcaattaaatgattaattgctgtggctgaattctgctgccctcagcctctgtggatgctatctcaccgattaacctccatttctaagctctgtctgattgagggaagcaatgacagaaaacgcttggcctgtcacatgactgatccttgctgtcatgagccatcgttttctaactgcaagctttcattttcaaagccctggcatgatttcaggagctgtaaaccctcatgtgagtaagtgagcagtaagaactggcagtttttcaatcttaagtctctccagctttaaacccacatttagctgtgattctttttttctccttaagttggacatttttttagtgaatacttttttgataaataaagtggggtgaaggtgaacttgactgagacagatatgggttggtccgtttagggctgaccctggaaaaaaaaagttatatcagtcttgacattaattccgtagtcagagtaggtgagagaggagtagattagtatatagggttcccagccttcccagtacaaccatggactcagagttggggacactaaaaatgtacatgaagtttatgatttcactggtagagatggcccacaatgccagtttggacaggcattactctaaacgtggtggggaagtcaggagacatctactccaaggcataacctctaggacagtttgtggggtatcagggaaggatatatcattggaaagatttctagttgccatacacaaataattgggcttcagtttaatgcataattaactgttctcagtgtgttattagttggacaattggattattacattatttacattagtgtttataggtaatctgaaaacaaaaatgtgaatataatatgaactacctcaaagatttgtctctgcttaatagttttatttcaaatttgtatatcaaatgtttcattacccttttttcattttattttttagctttcaaaacaaattagcaagaggaggaaagaggagagggagaaactgtgcacaccaccagaatgttatagtaggcgatatcatgaaagcaatgttggaactttatactcaggttttgattgtgcatctatctctttgttgtcttatcctttatcttcatttttaccaagtaattattgaccatcaaatgccattatggtaccaacttaagaaatggatgtaaagaattctacagggaaaaaaagcacattgtcagtgtatgaaatttatttagaagacagttacagacacatataaaaatgatagcagcttatgtttgcgaagcactcactatatgccaagcactttctgttagctaataataatatttgctcatttaatattagctcacataataatattaatattattagctcatttaatcctctcaacaactgtctagggtaggtactattatccctattttatggacaaggaaattaagtcaacaagagatgaaataatttgtttacagtcacatagctaggaagtggtagagtcataagttgaacccaggcagtctgaatccagaataataataataaaaaaaggtataaccagggtggaaacttattttgctcttttcaggtttcctagactttccatcaccaccagtgaattctgagtgacaatagtgtggaatttggaagaatggaagagaaactgaagtggagagatggtgaaagagaagaaaaaatgaagaaagatgcttgcaaaaatactgctgtgggtcctgagatgaggattctgggagggctgaaatggatgcccctgacagctccctttgagttcctgttcatctgaagtacaccagctttctagatatgctgtcactttccttctgcagagccacagtggtgtcctgtcttctcagacctcttctcacctcaaatcacttaggactcggccaccagacagatttgggatttcagaacttttcagatgttagaaagttcttttctaaatgtgatgaggaattacggaatcataaaatggaagcagagttaaactcagacatgtgggcactcaaggcaattaggagctttctgcgatgagaaagggatcagactgatccttaagactttatgcaaccccagagtattgcagccacctgcatgccgaaggtgtcaagagtgttctcactgctgcctataggagggtcttcagcctccagtgatccaaagtaccaggtaaaatatttaagccaacagaaagaacgtgttttattgtgttttacatgtcataaagcattctctatcatgagatatcactctgtatcggtaagacaggcttgaatttctgtcttggttctgccactgactagctttattccttaggctaacctgttggaatctcagttttctcactgtaaagtgaggataattattttatgaggatagttatgaaaattaaataacataatggttgcaaaacacttagcacagcactaagacacaaaatagacaataagtgttagttacctttattcctgtcccctttcctatccagacaaaggctcagtataaggacaaatattgtttagaacttctttttaaacctacgagccttacctttcaagaaccgcagatttgttcctgaaagttacctgtgtagtgagggttttataaatcaaattttactttcaatgtacagaggagctctttgacagagtcccttttcctgagaagtcattgtgggtttggcatcctgttcagcctggctggggccaggggagctgaactgtaatgacaagcagatgtactattgttctatgaaaatagtgtctggctccagatggggtttaggaaaaagtagtgatgatttctgttgaggaggatgggaattctgacccactgagctagctggtgaagaaggagagtaagacatgtgggtaaatgcaggttaagaaaaaggacctctagatcaactgaaagcctactagaagaacattaaaagcagataagaaaacaaggaagcaaacaaaactcgacaagagaaagaagagaccattaggaaacatccaggataattgctgtcatcattaaagctcccatttgttaatctgttacatatgaggcccaacactggatgatttaccaacatttaacctatcctctcacttttcaatgaattggatattgtcaaccccattattaatggaaaaatgggagctctagaatattgaagtcacttggctattaagtgatggagccaggactgggattcagaatccaacactcatattctttccatgaggtgtagattccattgagaagaaggtgtgtgcctaacaccgtgagaaagtcttggccctggtaatgctggtgaggccagtggctgagaaaagaatagctcttacctaaggctgagaacagaagacccaaggttgtggaaaactgacagtggtgcccttcctcacacagagtgcaaagattggtggcttacctgcttcagactcttggacgtgctcttaaatgcagatcctggcagtcagagaggaaaggctgagaaaagttcactctttgccaaagtaataaatccttctctttgatccctcaaaagttgatagacgaaaactcctcaaagcacctaggggtaggaaccccacttgagagttgtgggttctccatttcatcacagggatttgctgtgaaggaatcctgtggtaaactccataagaaaatgtaaataacatcccctctccaatttatcttttctgtaaatctggcttttcatatattaggtttctttacagtaagttgaaaccttaagaatagatttcaaaatatttaggaaatggcctatttattttgaatgatattcaacaccattaaactagagtgttgggagaatatttggacattccataatgatttgacttgtaacttaatataacagaactaaaaacaaaaaccacatgatcatctcaatagatgcagaaaaggcttttgatacaattcaacatcccttcatgttaaaaacccttgacaaacaagacatcacagaaacatacctcaaaataataagagccgtctatgacaaacccacagccaacatcacactgaatgggcaaaagctggaagtattcctcttgagaaccagaacaagataagaatgtgtcctattcaacatagtactggaagtcctagccagagcaatcagataagagaaagaaaaggcatctaaataggaagagaggaaattaaactccttttgtgaatataacatgatttgatacctagaaaatcccatagtctctgcccaaaggttcctagacatataaacaactttagcaaagtttcaggatacaaaatcaatgcacaaaaatcagctgcatttctatacaccaacaatgtccaaggtgagaaccaagtcaggaacacaatctcattcaccgtagccacaaaaagaataaaatacctaggaatacagctaaccagagaggtaaaagatctctacgagaattataaaacactggtgaaagaaatcaagagaagacaaacaaatggaaaaacatttcatgctcatggataggaaggatcaatattgttaaatggccacactgcccaaagcaatttacagatttggtgctatttctatcaaactaccaataacattttttatagaattaaaaaaaaactattctaaaattcatgtggaaccaaaaggagcctgaacaaccaaagcatttctaagcaaaacaaacagacgaaaacaaaaaacccaaacaacaacaacaaaaaccagaggcacactacccaacttcagactgtactacaaggctacagtacccaaaacagcatggtactggtacatagacacatagaccaacaggttaaagaatctagaaataaaaccatacacctacaactaattgatattcaacaaagtcaatgaaaacaaccaatggggaaaggactttctattcaatatatgatgctgggataactggctagccacatacagaagattgaaactggatccctcccttttaccatatgcaaaaattgagccaagatggattaaagacttaaatgtaaaacctaaaactataaaaaccctagaagaaaacctaggaaataccattctggacataggccctggcaaagatttcatgacaaagactccaaaagcagttgcaacaacaacaacaaaaatagataaatgggacctaattaaactaaagagcttctgcacagcaaaagaaattatcaacagagtaaacagacaacctacagaatgagagaaaatacttgcaaactatgcgcccaacaaaggtctactatccagaatctatagggaacttaaataaattaacaagcaaaaaccaaacaaccccaataaaaaatgggcaaaggaaatgaatagacacttttcaaaggaagacatacacgtggtcaataagcctatgaaaaaatgctcaacatcactaatcattagagaaatgcaaatcacaaccacagtgagacaccatctcacaccagccagaatggctattattaaaaagcaaagaaggctgggcatagtggctcatgcctgtaatcccagcactttgggaggctgaggcaggtggatcacgaagtcaggagatcgagaccatcctggctaacacagtgaaaccgcatctctactaaaaatacaaaaaattagccgggcgtggtggcgggcacctgtaatcccagctactcgggaggctgaggcaggagaattccgtgaacccaggaggcggagcttgcagtgagctgagattgtgccattgcactccagccagggtgactgagcaagactccatctcagaaaaaaaaaaaaaaaaaaaaaaaaagcaaagaaataacagatgctggtgaggttgtggagaaaagggaatgcttatacactgctcttgggaatgtaaattagttcagctactgtggaaagcagttcggagatatctcaaagaacttacaacagaactaccatttgacccagcaatcccattactgggtatatatccaaaggaatataaattgttttcccataaagacacctgcacatcgcaacactattcacaacagcaaagacgtggaatcattctaaatgcccatcaatggcagactggataaagaaaatgcgttacatatacattaaggaatactatgcagccataaaaacgaatgaaatcctgttctttgtagcaacatgggtggagttggaggccattatcataaatgaattaatgcaggaatagaaaaataaatactgaatgttctaacttataagtgggagctaaatgatgaatacacatggacacaagaagtaataaacactggagcctatttgagggtggagtgcaggagtgagtgaggactgaaaaactacatattgggtactgtgctcgttgcctgggtaatgaaataatctgtacaccaaacccccatgacacgcaatttacctatgtaacaaacctgcacatgtaccccctgaacctaaaataaaagttggaaagaaaaaaaaaatgaacctctgagacaatattataaaaattagcacattcaaaccacggaaattgtcaaagtgtagctaaaatattaaaccttttagatatgttgtctagatataattatcccattttatagccagtgttatggacatccaaagacaatgtcaattttgctaataaactgcatcaaataagtgcatgggaaaaaataaaaagttgatacattaaaaaaatgtttttgatacataacttttattttgaaaacttgaaataaattgccattgtgaatttggcagcttttaccctggcatgcctacaaagaatgtgatatacatttaatcacgaagaatgccacccagtgataacagtggtactggggttatgattatgttttaatttgttttgtgcagaaaggcatgaccatttgcaaagctgtcctatgaaacgtatcatgtactagtcacctcatgttatcagcatgctcctggaggagtaggcaatggattttttcaccagttcgcactgtgcaatctcttcctcatgtgtgtgaactttgtgggatgtcaagtaccccattaaaattgaatgaagtatttgaggggctcccacaaaccctctagtgatcttctttcaacaaacagcattttattgtgtaaattagaaaaacaacacagagtctggcttaaagaggatggaaaactggcattacaccaagaaagaacctgaacttcagtctttgacctcaggagacatccaagtattaaaacagaattttttttttttatttacatggaaaccctgatggaccaggaaattctttataatgtagagtctggtgctaagtcttactttcaggtgaacccaaatgaagattattgaactcactgttgaatctcatcccctgtctttttaacagcagtaagacccctcttggtcagccacaatatggggaaactcctcagcagctgctgttatccctaatattattgatatcacttctacttgctcttgctatgtttgtttcttttcagcagagctttcacagtactctaaaaagtagaggctcttaacattaaaagtttccttagccttttcaataaccctttcctggttgtctatgctggtggcagcctcaacctgaacctgagtgaatttgtttttctggcctgagctttgctgagcctcttaaggggtagaccgtctatgtgtgtttcttttatgtgagataaaacgcacaatttattaaatatcttctgattcttagacaggatctcaagggtggagctactccagggctcattgattttcatggctttttggctgtttgaaaaagagcctcctttgacatcatgtgggtttttgctatttctatttaagggtatatcttacatgtcagatatattattattgctgttttagttctagacagcaagtgatatgagcaaacaacaaagcttccatgctgtgaaattatgcatttattaaagctatcagttgacacttagctttgaattatttatatttttctataaactgtcgacaatcataacgggaccagaaccataggttcatatgggaaggtgatttactcatcttcctttcttgcccttaggaggagttgcagacagagtattatctttttttttttttttttgagacaaagtcttgctctgttgcccaggctggagtgcagtggcgcaatctctgctcactgcaacctctacctcttgggaccatgcctggctaatttttgtattttcagttgagacgaggtttcaccatattggccaggctggtcttaaactcctgacctcaggtgatccatctgacttggcctcccaaagtgctgggattacaggtgtgagccaccaggcctggcccagagcattatctttatcatgactttttcctttatatgtattgactatttgcaggtgtatcacaactacaggagacagaaagggaagcggtatacctctttctgcatgccttgtgtttaaagcgtgcctagattctgataaaggcttgcctgacagaaaaggcagaatgccaggggtctatcccaagatactgagtcattcctgtgtccttaaatgccaaagaggtaggatcaaaacaccagatctaaaacttgacaatataagttgttagacttaatctccaccagactcaacttgtatctcagcttctcactaatctcctatttctcattcactcactggtaccttcagcttattctctgttttctcctttgtttgtcaggttttggcatgatatctcagacactttttttctccttgcttcattcagccagccccaggtgatttgccttcccagaccactggctttctcctgaaaagagaagacacaattgacttctggtctttcttgctgtccatactacatagattgttattccaaagcttggtccaggctgagttcttggacactgctttaaatgagtggcccttgaccagaagggagatctagaaacaaacacaattttcctggggaagctgaggcattgtgtttgaggcccacgtatctttgtactccttccgtcctgtgatccagaagtctatttatgccagtcttgcttcaacctctctcacaattgcaggggaaaagtctactgaagggagagaacatttcagctaggggatataacttaaggtgagaaataaaagtgagacgaagaaaacatgtttggtgaactggtttgaccagaactcatgtttcaagttggaaatgttcaaataggaggaagataactaaggtaaaaatattaaagactactattaaaaatttggaattcaatagttaaacaccacaattagagatatttttatgacattactgatattaggattgtcatttactgagaaaagtgtgtaaaaatctcccactatgattgataatagaatgtttattttccttgaagttatttcaattattactttatttattttcgagactgtgttattcattgcatacaagttgaggattgtgatatcttcctcgtgaattgacttttgtcatcatataatgactttcttacctggaacaatgcattttgcctttaggattactttgtatgatattaatactttgtcaccagctttcttttgtttaatgtttgccccatagtaaaatattatcttgccttttggaacatcttggaatttttcctcctgcctttctaacctatcttcactgtgtccttctatttcttctttttttcctcctactcctgattacccccaaaacccaggccttgaacataggggtatatctgtgtgtgtacgtagatgcacgtgccaacttttttatctcaaggctttaactgttactctatcattgaaactgcatttcacaccttctctttagtctcaaattcccaactgccactcatcatcttcccttcccttgcctatatctctactctattctctttttctcttgggcttgcagccttggagtcaaccttttttccgctttatgctctatattaagctgtcataaatgccatgacctttgctgaaatgcctaacagattctcagcaataagctcacagggaaagggcaaagccaggagtgcaggacgaggggaggatcagtggcagccatcctgtagattatctactgaaattctttccattcctttgaatttctgctcctttgaagccctggattataataattatcttggaaagtttttcagtccgagatccaaaaattcttaattgggacctcttcagtgaaaatgacattcagtgaaaatccctggcaacattttcctagatgagaaaaagaattaggaatcagatgaagacgtgagaaagccatgacttcacaatgtgtaaagcatgtgctgatagcttgtggaagagtgtcttaggaggtccctgtcccaatgaggataacttcttaatcagaatcttgtttccaagttctccctcaactccaggataaactttaaaaaggaaaacaaaatccttgctagaaaattttccatcatttttctcttttctgtatgagtagcatggatgaaagagttctgtgactgagttgaggtttgcatctaactattgagccatggcaaaaaatattaagcatcactatttgttgtcatataaggaatttagtggggtttgaggttttaaatgttattgtttttctctatagtaatatcccttcaatccccttggttatctttctagagcaatataaaatgacctgacttctgtgagaagtctttagcttttggaaatcctcacctaggtttctttcacctagagaattggtttctgagaaaatcctccttccttttactgaacagtgaactgggagcctttaaatggagtggaggtggaggaagatggaagtgaggcaggtagaatttgtcattctgtccccctgggagaatgaggaaattagcatccagttctctagaacctagagtttcagggatctatttgagtgggaaaaagcattccttgtttttttgtgacctacttaaacattctgtgaaagttgtaatcatttgaggttttctaagaaaagaaaaaaaaaagtctaaatataatcctaaaagggagctaacctaacaacaaagaacacccggttgcagagattatttctctggaaattggcaaaaagagacaaaaatcttccctggcgattactggctatacctgctgctacacctgatttcatgctttttattcctggcagcactattggccttctccaatgtgggcttctccaaacttcacacccaggggcacacaaatcctatttctcccatctggaaagctctgctcacttcttcccaagtccgcttcccacctgcctttgaaatgcagctaaagaccacttcacagagattccctcaatgctagctcttccgctatgcccttcattctttctcttaaacccctagaactcttagaacctgttaacagtgtatgacatcctaagtgctctaattcagggacagcagagaatgcagtccaggctcctggtccagtagtggggatggattgtgctggtccacccgcatgctgccattcagtctgctttatcgtgagcacttcccatttgccagcaggggctaatggtgtaggccaaccatggaagaacgtgaagctcatctcagtttagctgactggatgcagcctgcagcaagcatgtgttgttgtttcatacattcctgtctttgctctgtgtgcacatttgggtttcatcttttcctcctagcggcacacgttcccatagactttgtgcttgcatgtattaaggaacattgcgttgtcaaaaggtaataataagagcagctaaaaattattgagaacacgtgatgttgtaggcactcttttaaacatttttatatgcatttaatccttgcaacaatactgtaaggtagttattatcccattttatggatgaagaaaataaagtactgagaggttatgttactttcccagggccacatggctagtaaattctaaagcccaagctattgaccttgagcctatgctcactccaggctttggagttgtaggagatgtgcaaggcttaatgaacactgagtgaacttatgaggcagttcagtcatctgacatcctcattaaatctgatttgaagaaatgacagagagaaagttgatagagcttagaaatttggttctaggtgagaccttaaaagtcatgtcaccaaggaataagagaccctcaagaggttagataagtcctctgtgcatcatttcctcctgacctgtatctcaacgtcaaagctgtcaacaaaaatgaacagggagcagcacttagtttgtatgatgtattcataatgtttggggtgccaaacagaagtcttatgacatggtatttttgcccggctaggtttttctatactagggcatggccatggttttaatgctttatttattaaagttattagaagataaatatgtgcaatcattgaaacttttcttattttcaaataagaaagggaaacttaaaaaatttagatttagcaactaacttttatttagaactgccatatgatctaacataaagttttcttacaatctgaatttgaaacattcaggattattttactaagatctgaaaaggtaatttgacatactatctataaaagtgtgaattaccctggggattaggaggtgaggttctgtagtaattaggtatgccaaaaataattttttaccctcctccccctcttccttctttcttttctgcatttacatgtattgctcttggtctctcatgtcattctttcaggattttctaatgtaatgaatttctctttctctaccctagagagtaccattatttccattctttcatggaactgtaagtgtgtgcaatttgttgacctcgtggtatttcaaagaactgtaaaatctcaattatcaggaatgcccagggaaaggggcttttaatggaatggatttttctcttaaactgaaggttaatcaggactcttctctcccccccgtttcaaatttattggttgcaattttttttccctaatctgtgagtgtactttctgggctttgctgaaatgggaggttatctgattgactagcaatcataagccctatgtttaagtccacattcttccatttgccagctctatggtttgaggaagttatgacactgagccatttgaaaaatggagatagcaacacttgtcctacctatgtcacctgggctgtttagtgtatcaaattatataaagacaatggacttgctttgtacaagtcttaagttttattttaatgaattatgacaactaccaagttctgagtgcctaggggccaggtgctccatacacattattgttatttccacaataaacctactatatatatagatgtatatagatgagaaaagtaaggcttgggagataagtgacttgcccaagattatgtaaataacagtggaactaaatttctttacagcaaattgataccttgattaatcaaaagtctttattctaagtaccatttcttgtggataaagagagtatagaagattgcctagaagcatactgaccttaggatgcattgttttgcttagggttcttttagttataaggaacagagatgttaggtttcagagggatttcagagaaacccaatgacagaaattgaattatagttgggtgttaaggaagctgtcatgaatcaagcctactcttgcctctcctctttcttctcctctccttccttcttttcgctctctctttgtccacacaggcaaaatcttccttacatatgtggccttcactctcttttgtctattgactggcttcctcataactgtagcttgcatatggttcatcatatggtttgggtctgtgtccccacccaaatctcatgttcaattgtaatcccccatgttggaggaggagcctggtgggacgttccttggatcatggggatggtccttcatgaatggtttagcaccattctcttggtgctgttcttgtgacagtgagtgagttatcgtgagatctcgttgttttaaagtatgtggcacctcccctgtctctctcttcctcctgctccagccatgtgaagtgccttgcttcccttttgccttctgccatgattggaagttccttgagacctccccagaagctcctgtatagcctgcagaaccgtgagccaattaaacctcctttctttataaattacccagtctcaggtatttctctatagcaatgtgagaatggactaatacagaccgtagtagggactctacacctccatatagcatagtatctcttgatctgtccatttagcttttgccctgttgcttactggaaattctctaggtcttgtgattcagattcctgaaggaggattcttactggcccagctcatctattctagtcagatcccaggtcactgactgctacaagctcatggattggctgcttttgcatcaggtgtcctgctttggtgctgcccacttagcaaagctaagggaagactaggaaataaaagcaatgtgacagctacatctatcatcactattaaagaaggctatatatcacgatatatttgtttttgtaaaaatccttaatattttattgttatcttttagttcttattctcttcttttcaacgtagtccctcgtctttcaaaatatttctcagtaattgggttcctgttgactcaaattttatgacacagaaccttgtttataacctcctaacttaccattactaatatcagttctgtagtcatatataccacaattttatatgtttttgaagaaggtagtaggaaaatatgtcatagtttaagttttatactaagcataagtcatgtcatagtagaagtcttttttctattaatagaagatgtcatgtctcaaggttattgttggaatataccgtaattaatttttttaatccttaaaataggagaattgagggtttccgagtagtgtgaatacatgaaaagtgaaaaaaatgggtcatcttctaggaaggcctgcagaacttaaaactgagaacaggccttagacttgctttctttcctctcctggcacttcctgggttttgttttcctccctgctggtaggttttgatgggaaggcattatatttctgtttatctgaatatctattttactcacaaacttttttcttttatcatagctgatatgaagtgaaaacatgtatcacttggctcagcctgaactgctgtgtgataggatgtccctgtatcaaccatgaaccagaagtggaacagggacctaattaatatttatgctgaccttggtggctgttgtaaaataaactaccatacatctaaaacctcaccacactgggttggatagctaaaacttctatactattcatggcttaacttctgagatttatatgcctcttgaagagaaagtactcatcactgctgaaagtttaactttctatttttgttatggcctccattacatttccaaatattcctttacttaattttatccataaacctgaagccttcactttcttagtgaggtactagattctttgtatataaatttgactgtattggaaagcctgggtccatgtgtttttagtccttaactctccagtccttgtagatttccttgtatataaacactttaactgagttatagaacctcttcctctgtgaactggtgtcaggctctggtggtaggtcctcttcctactctacatgctgcctaccctcttgtatggaaaaagattaactgttttcctcacactcagcgcaaaacacttctggtcaccaaaacgtgtgggtttctcccacacaaagcaattctctgacaccagctggatatcctacagttcagttcaattctgtgctaactgaagttggcacagactccacgtgttaagggctcagcccctcaagactgtccccggcttcagatgtcagtcactagtggtagtttcccatgttacccatgacttgtgtcagacttggctgtaaactggagggtcccaaagcccccttctctggtttgatcacttgttagaacagctcacagaatgaggaaggtgctttacttattattagccattgattataagatgatataagtcaggaacattcagaaggaagagatgcacaggtgaaggtatgtgggaaggggtgtgaacttctgtgccctctctgggaccaccactctccaggtacctcctcctgtttggcaacccagttatggaggcttcattacataagcatgattgattaaatcaggccactagtgattttttaaaaaatttaattaacacctaataattgtacatctttatggggtgcaatgtgatattccaatttatgtatacatgtgtaataatcaaatcagggtaattagcatatccatcacttccaacatttacaatttgtttgtgttgggaacattcaaaacctctcttctagctacttgaaaatatataataaattaacgttaactatagtcatcctacagtgctaatagaacgctaaaactttttcctcccatttagctgtgattctgtatctgttaaccaaactctccctcttccctacttccccctacacttcccagcctctagtaactactattctactgtctatttatataggatcaactttttcagctctcacaaatgagtaagaacatgtggtatttttctttctgtgcctggcttgtttcacttaacataacgtcttcccagctcatccatgttgctgtgaatgataagattttgttcttttttatggccgattagtatttcattgtgtacatataccacattttctttatccattcatctgttgatggacactaaggctgattctatattttgtctagtgtgaatagtgctgcaataaacatgggagtgcagatatctcttcaacatactgatttcctttcctttggatatatacccactagtgggattactggatcatatggtagttctatttttagttttttttgaaaaatctccatactgcttcccataatggctgtactaatttacatttcaaccaacagggtataagaattcccttttctccacatcttcaccagcatttgttatttttttgtctttttataataaccattctaactgaggtgagatggtatctcattgtagttttgatttgaatttccctgatggttagcaacgttgagcatttttcacacacttgttggtcatttgtatgtcttcctttaagaaatgtctattcagatcatttgcccattttaaaattgggttatatggtttttttgctgtttgctgtttgagttctttgtgtattctggatcttaatcccttgtcagataaatggtttggaattatcttctcctgttctacaggttatctcttcactctgttgattgttttctttgctgtgcagaagcttcatagtttgatataatcccatttgtctatttttgcttttgttgcctgtgcttttgaggccttatccataaaatctttgcccagaacagtgtcctaaagtggttcccctatgttttcgttgagtagtttcatagtttttatccttacttttacatctttaataaattttgggttgattttatatatgatgagagataggggtctagttttattcttctgagtatgaatatccaattttcccagcaccatttactgaaaagggtgttttttcttcagtggatgttttcagtgcctttgttgaaaatcagttggctataaatacatgaatttatttctggtgccatttgtctatgtgtctttttatgccagtaccctgttgtttggttactatggctttgtagtgtattttgaagtcgggtagtgtgatacttccaccttcattctttttcctcgggattactttcactagttgaggtcttttgtagttccatacacattttaggatttttttttcctacttcagtgaagaatgttaaaggtattttgataggaattgcattgaataaatagattgctttaagtagtatgatcattttaacaatattagtttttccaatccgtaatcttgggatgtctttccatttttttgtgtcttcttcaatttctttcttaagtgttttatagttttatagttttcaacgcagagatatttcaccttcttggttaaatttgttcattttttttatagttattataaatgggattgccttcttgtattagtttgttttcacacggctataaatagctacctgagactgggtaatttataaacaaaagaagtttaactgactcacagttccacatggctagggagacctcaggaatacaatcatggcagaaggtgaaggagaagcaaggcacatcttacatggtggcaggagagagtgtgtaggggaaactgccacttttaaaccattggatctcatgagaactccctcactatcatgaaaatagcatgggggaaaccgcccccatgatccaatcaccccccaaccaggtccctccttcaacatgtggggattacaattcaagatgaaatttgggagaggacacagagccaaaccatatcacttcttgatttctttttcagctagttaattgcagtatagaaacactattgattttggtatgttgattttataacttgcaatttcactgaatttgtttcttttctaagagttttttgatggagtctttcgatgaaggtttttccatatataagaatatgtcctcagcaaacagggaaaattttacttccatctttccaatttggatgccctttattttgttctcttgcctaattgtgctctggctaggactttaagtattatgttgagtaagagtggtgaaagtgggctttgcgtcttattccagttcttagaagaactccccccaaccgccattcaatatgatgttagctgtgggtttgtcatatatggcctctattgtgttgaggtatattatttctgtacataatttattgagagttcttgtcatgaaaagattttgaattgtagcacatgctttttctgtgaatactgagaggattatattagtttttattcttcattctgttgatgtgatgtgtgatgtatattgatttgcatatttgaaccatccttgcatccttgagataaaccccacttgatcatggtgtataattcttttgatgtgctattgaatttcttttgctagtattttgctgtggatttttgcatctatgttcatcaaatatattggtctatagttttctttctttgttgtgttcttttctggttttggtgtgagaataattctggcctcgtagattaggtttggaagaattccactccccacctccattttttggaatagtttgagatgaattggtgttagttcttatttaaaagtttggggagtaacaacagcataatgttagaggtgcctagtattcattccccttacaagaaaaaaccaaggcaatgaatacacagctaagatttgactggagtgtgggaaggagcaccttggaaggcagcaaagaggtggagatgcacctgtggtaaatggaagtccaggagggcagcacgcaggcactcagcctctgaagctctgtctgccccacccagattagatatgtctgaagtcaggagacacttcctgttctggcaaaaatctgagtagaagacccttgccagcttccattgccactgccaatacctacagtccttataacaagagaattccacaatcctttcaagccatgagcccaattgggagaactgtggggattatactaaattagcagtacaaggtgtgcactctccaccccctgcccactccctatgagccaggctgctgcagcatggtgccatcttgagaccagagtcacctctggtgtgcaccctgctctgggagccactagccactgtgcctcacaagcactgggactccatcttcatcccaccaagcccataggtcattgaaccccacaacctcatctgtgcagagcctgggcccaagatcagctatgactcctgcactacagggaaaccaactcctgctgccttacctccagctgaaggaacagtctgattgtctcatccagggtgaacccccccttaagctggcgaaaacactacatgccatccttcaaacaggagaaactttcaagcttccgtgtagctgacatatccctgagtcagtggaatgactataggccatactcagaacctgagaaacaatgtagcagtgccactgccccaagcagacacaccccttgtctgcccaatggccctaatgatagggacaggagatagcgaaatactgggtagaagagggtggttccctggcaaaggccccaccctcaagcctggaaacccatggccctaaatgggaacaggcattcctatttttgcacccaaaagttcccttttggcccaccacactctgcatcctgaacccatataaaccccaaatcccaggctccacgagcagatgaacagaagagcagaagagcagcagagaaggagagaagagaaggagcatctgaacgttgagaggagttcagctgggaatgattggagatgagatcggcgctagatggccaaactccaggggaagatcatcttcccactccatcccctttccagctccccatccatcctgttgagagccacctccaccaatcaataaaaccctcgcattcaccatccttcaagtccgtgtgtgacctgatttttcctggatgctggacaagagctcaggatacagaaagcccttgcaaaaaggcagagtgttcactgagctgtttaacacttaagctgtccatggacagcaaagctaaaagagtgcgctgtaacacatgctcactgggacttcaggagtcgcagacacccacccctagattctattgtggggccggagcccaaaagtgctcacaccagcttctgcacctgcccatctgcatgctccccgtcatgtaaggggtttgagtgccagtaagccatcatccttttacttatttaacatttaatatgtatatggtgttggtgcatgataacatcatggaccagatataatgtttgtctccaaagagcttgtatagctatagggaaataagacttagacactgggcagagggaggtaaaactgacaatgagttgtgggatattacagataggaaagaacataggtgtggtgttttcatttttgtctgcaggttacaaagctatgcataaagaatagtaggaatagtcttctgctcattatattgacaaatgtgatttttaaaaagccaaggtaaattgatgtatttttagaaacatgaaaaatacttacaaaaatacttttaacatttaaaaaaatattgctagcataaagaaagtgggagagtggtccttctggccaaaaatgccatttgacttcttgtcatgcagccactggctacattttttataccttttctgaccctccagtttccacttctgtcactacatttttccatttctaatatcacactgcatgctgatttttgacttttggaactgatggcattttcaccctataaaagtgtcataaagacacattaatattcaaatgatcacttattttgtaaatagggaatttttgcatatattaaaccagtagctttcacttcacttcacataagtcatgtttctttgtggttgtccattttcaaatctgtgccacaagactatgtactgggaaggagaaaatgagaattaccacaaacaaaaaaaaaaagtgatagactctgaatcagagttcactttcttgacctctctagtgagataatagtcttgaaaggcaggcttcgtggaaagagaaatttcttttcattgttttattttttccaaatctattttttaaaacttttctatttagaaataattttagactcaaaggaaagttgcagaaatcagagttcctgcataccctttaacagcttcccccagtgttaacattttacattaccatagtaagagtatgaaaaccaggaaattaacagtgacataaaactgtcaccttatctatgaatctttatccagtttcaccagatttcctattaaagtgtttttcttgtcaaggatccaatccaggctcccacattgcatttggttgtattgtctccttggttttgtccaatattagacccaccttgagtctttcctttctttcttttcttttttttaaatttcatggctaacacacttaaagagaactggtcagttatttatagaatatcccttaatttggaatggtctttcttttaattattacattgaggttgtgccattttggcaagaatgccactgaagcgatgtgcccatcttagctcatcatatcagtgggcacatgatgtcgatatgccttattactggtgatgttagcctgtgtcactcaattaaggtgatgtctgccaggtttctcaattatgaagccactatttttcccttgacaatcactgaatatcttctggggagatacttgaagactatgcaaatatttcacttcttgccatatttttgcacactaatttgagcagccattgattgttcttgcctgcaacatttattactgtgctgttgcctaatggttattttttattttccctacttctaaatttattcattggtaatccattgtaagaagttgtcccttctccctcatttacttatttattcaattatttgtttacattagcatgaactcatgggtcatcatttgatactatcataacttactttgttgctcaaatttaactagctctggtctttgggagatccttcatgttgcttctctgtcttttcaacatgtccccagatttttttgagtacattctcacttggcaacatgagttttcctggattgtcttttatttcccttgccctagctctggaatcaccatttccctggagttaattctgtagccttgatttcttttattcaggaatggtatttacagctaagatctgggcagatatgctattgctataaggggttattgaaacaggaaatcttccctgaccccttcacaggacttgtgaagggggtaattcatttactgagcccacagctctcaatccctcatgggatggggagcatgcaggtgagtgggtacaggggctggcatgagtgcttctgggcactggcaggaacagaacttcgtgtggccctgtagcagcatctgcagggggtacctgtgacccatggagccttagaaggtgtgtgttacagttgtgctcttttagctttgccctctggtgatggcttaagtgtttaacagctcagtgtgacagccctctgtatcctgagctcttgtttggtgtccaggaagaagcaagttgcatgaacgaattgaggatgctaaatgcaggggattttgttgccgatgaaagtggctctcagtataatggagagctggaaaggggatggagtgggaaggtggttttccctggagtacagccatcctgggccaaactcttctctgagatcccaccatcaagccgtccctctgaaatcaagctgcttctcctcaacatcaagctgctttttctcttctttcctttgctgttgccagtggagcctggggtttttatgggtacacgatagggggtggaaaaggcaacattcaagagggaaaacaggaatgcatgttctcactttgggctgaggttccaggcttgagggtggggcttcaacagggaccccaccctcttctacccactattttccctgcctcctgtccatatcagtattgtctctagtcctgctcagtcaacagaagtaggatatatatacatccatccgtaagtatacatattaaaaattatacatttatacctctgattccaacccaacaccactggtttcattctagcctttctgttctttgtaacttcttttgctgatagtgaggaactagctcattatatttacttaagttttgatcctagtatatacacaaactagttttggaataatcaacctacattagcctagaatacagaatttgggttcaatttttttttgtcattagccttacagtattcatgcaaaatactcttttccaaagatatttagattagttctttcttcaccactctcttcactttgattatgttagttatttgtgatatagttaggttcatttgtcactgtttgtcttccatttgaggttcctatcacatcctggtttatttttaattatttatcgtgtgtgtgtgtgtgtgtgtgtgtgtgtgaaccattaccatggttctaagaatcagaactatgaaaaaaaaagtattctcagagaaacatttcttccgcattcggccttgtcctattgttctttccaccctgttctcactcaccccctctaggtaaccaatctcattaacttctggtttatctttcctgtgtttattttgcatttgtacaaatgagcagatatgtgtatattttctttctccttttatacacaaaggttagcactatagataatcttttttactttgcttttttgtaaaaaaataataacagtatatcctggaaatcacagacattttccatattcttttttactgctgcatagtgctccattgtatgaaggtaacttcatttatccaacaactgtcctctgtataataattttggttgcttccaatttttttgcaattacaaacaatgctgcaatgactaaccttggacatattcgtctgtgtgtgtgtatgattgggggtgtatctgcagggtagatttctagaagtgagattgcaggcccaaaaggtaagtgcatgtgtagttttgttaggttttgccaaaattccctccagaaagcttctaccagtttgcattgtgtgaaattatctatttccttatagcctcctgacagaatatatcctcacacttttttattttttctgatataagaagtacaacatggtatcacagtattgttttgattttatttctgtaattataagtgaatttgaacgttctaaccttttaaaaacatttctgttcatgtattttgccgtcttgctatgaggtttttgtcctttgtctcataacactttgatatattttctcccggtttgtccgttgtcatttgactctatttactcttggtatgtaatttaaaaaacatttttgtagtcaaaatttttttttattttattgcttctggattttgaattatagttagaaagcctttctcatatctaggttgaaaagcaatccccccgtgcttttttctaggatttttatggttccgtcccttgttttctatttagattcctaatcctcttggagcacatttttgtttatggtgtaagttacagatctaattttatcttttttccccagtggatgcccaattgtttgagcactatttattattataaagtccatctttgaggccaggcacagtggctcacacctgtaatctcagcattttgggaggccagggtttgaggattgcttgagtccaggagttcaagaccagcctgggcagcatggtgaaaccccgtctctactaaaaatacaaaaattaggtgggcatcatggtgcaggcctgtaatcccagctactcaggaggtggagccacaagaatcgcttgaacctgggaggcagaggttgcagtgagctgaggtggtgccactgcactccagcctgggcgacagagtgaaactctgtctcaaaataaaaaataaaataaaataaaataaataaaataaagtccatctttgtaccagtcatttgagatcccacctttatcacatattacatttccagattaacttgtgtctatttctaagctttctattctattccactggtctatttgtttattcttgtactagcaccacacttttaattatagagaatttatagtatgttttaattcctgatatatgacttatccccaaattgatttttcttttgagtgtgtcctggctactgttatgtgtttgtttttctatatgaactgtaatattagcttgtctaacttcatgaagaagcttgttggtattttctttgagactgtcctaaatatataaattgatttagggagagctgacatatttataatattgagttgcattattcaagaacagaagatgtctttccatttgttcaagtctacctgtctattcttgatacttcatgtctttcaaaaatgcttcttgtctattcttgactctttactcttccatatgcattagaattaacttgtcaagttctgttaaaaacttgttgattgaaa

SEQ ID NO: 279 - DNA, 33633 bp, Homo Sapiens
gcacccacagccggtaggcccccagcagcaccagagccaccagcgccacgttcagcagcatttccccgccccccgtcagaagcgccaacgccgccgccgcccagcctcccccttccgctgccgctcccgcgtcgcctggactctcgctgccgccgtcgttgctgctctcgctgccactccccagggtgcctagcttcacgtccccatcaccagccgccatcactgcccgccagcgccttcctcctcctccccgccccctgccctccccaaccccacggccggccccgcccatctgggggcctctcagccaataacgtgagaagagggggcggggtcaggccggctcctgattgggtgttgacggggtaacgttgtctcggatctcccgccccctcccttctttcgctggccgcgcacgcgtgcaacgccccgcccacctcgccccacacttccctgctctcactccaagcctccgctaggttaagtagacgagccgggcgggtctgaagaaaagatgctacgacggccgcgcggacgctcatgggcggggcgagaccacagcgcgtgcgcgggctcctgagcgccacgcgctcgcctttcgttcgtaacccctgcgggaggcacgccccgcccagtctccaggctctgcgcgtgcgccctggaatcgcttcccttcctaggcctgcgttcgcgtccgcaaactcccgcctccttgcgctccccccgcccgggagcttcacgtgcgccttggcggccgcgggggcaggtccgggctggacgcctggcggaggacgcgggcaggtggcttgtgggaggctggggcatagttgagctgcaaggcgcaaaccgatgaggggcgtctgcttttcaccagggcgccgtcgcttttgtcgggaaaccggcagcgtaggcgcgcagaccgggaagcggcaagaagatttggccacgagctggggtcttcctggaacggagagaaagcacggaacccgcaccgggcttctctggcatcggcagtctacgtgctcctcgcgctggcaccgagcagccactccccgctgggtttggcaaaggctgctcttgtagaattttaaaggatttagagtctcattattccttgaatcataacttctgcggccgtagggaagtggacaggttgaggtggtctttctattcgtcattcactcttatttgcaggttctgtttcatgtacttggacgtcttttagcctctcacaccttgaaattctagtgtgaaaaagtgacctctgaagtctcacgcactcaactcgtttgacgaactcgtttgacgtgttctctcttgccctttgttgtctgttgtcttgagtctcatagaataggtttgaacctttcactgtcggttttgtaggagtcactgaggatattgacgaggcaagtgacagggtcgacactcttgtagagaggctgtatagcaaccaggtgtctgaaggattagaggctggggaaagagtgggaaagcagttagtaggctagggtatttgtgcgtgaggtgaggagactcagagctaggggagacattagagcaggggttggcaaacattttttgtaaagggcccgatcatattttaagtctctgccttaactactcagctctaccttgtaacgagaaagcagccatagacaatacttgaatgagtgtagctgtcttcagtaaaactatggacattgaatttttaatataatttcaggtatgaaatattcttttgatttttaagaaaatcattgaaatatgtaaatttttttttttttagttctggagaggtgcaaaaacaacttataagccatattgctgagccctgcattagaggtacctgagggagagcgacacaattggtagtaaatgaccatatactctatccttcaatatggaacacttttggaagtaaagtagggcattaataattatagccagagaccaggagttatatcagttttatcccaggcaaacctaaaggaatagtcaccttaaggttaagggttaggagaagtcaaaattgctttaggacttggtaacagaaaatgggaggtgccagtgatggaaataggaagataaagaagaaactggttttgaggagaagatagctgtagcagtcccaagagctgtatacagttgagacaacattgataggaaggaagaaagcaccccagaagcaggccactccttatatcttattgaccagaactgggctattagctgtccctaaagcagtaacagacaaggagcatgggacatccatgattgcctagtgtttatctggcttttttaattcttattcaggactgtgttgagcattgctggacatttaccatctctggttccttccagctaaatgtcagtaccacacctcaggcattgtgacaccgtaaatcaaccgtttttccctcccaccccccagaggtgtggtactggttgagaaccagtagcttagaccctcaggatttaccttggggctgaattagtgtgtgtaggtttcttttccagttggtttggagggaagagaggaattggacagtattaaagttctgctgtcaaggaagtgggctggggaatgttgggtagctaaccaacattggctgccacgtgaagtaaaaaagttttcctttatatccttgataaaatagtgtctcgacttcttcacacttgaagccttcccaaaaccccagcttttttgattctcattgtaagccccttgaactggactagttggaagttcttattttccaccctaagtaacaagctcttgtcccaataggatactcttgctttgagtactgcaataactttccaattggtgacttgccgtcagtcttttcctatttcattcctacacgaagagactagaactgtgttctgatttcctttgctcagacaccaatctccaggggtgctctgtaatttgaagaggacaactcagaaagcactcaagggcctccataagtccctgagtggcttccctgccttcccgttccccagcaaacaatcccttggataccctctattaaatgatacgtttccccttacaatacctagtcccttgccccatatatgctatgtgtattgcacagtctaggacttgactcatgctgtttcctcacggagcatgcccttcttatttctaaccatacaaattccatgacctatccattctttcaattctacttccacctgaggcctctatcagcccacattaacctaccttctttgaatttctgtgtgttccttacctgtaccacccattttggccttttattttatgctcttcttgactattctgttattgaaactgtcctttagatcccaagatttctactttttccctgcggatgcttttttattttttttatttttgacttctttctaccctccttttcctcttacatccctgctttgcctagaggacatctacaagaatcgtcatgtacattcttttctcctgttgttagcttttttcccctgacacttcatctatttactgatttacttgtaaatctctggaagatattagtactagccaccaaatatttctatttctttttccacacacgtagatttggatttccctactccttttacctcaagaatggccaatgaaatgtgattggaagtgacttgtgtcatttccaaataaaagctttaagagcctgtggacatttatcctgcgctgtttcttcctgccaacagtgatgaaatattttaattatctattgtcccatgacaaagcaccttaaatcttaatggtttaaaacagtcaccattttattatgtgtaacagttttgtgggttgactaggctcatgggcagttgtctaatcttgctcagggtctctcatgtggttccagcctggtattgtttggggctggagtttttggaggctcaactaggttgctagagtagctgagcttttctatttacccatgccgttccaaagactctctgattcacatggcttcttcagcagagtagcctgacttctttcttgcatggtggcttaggattctcaaatgcaataaaagcaaaaacttcgaggttttgtaagtcttaggtctggaaatgacatgttgtattggtaaaagcagttacagggccagctcaattttaaggggagaggaaataaacacttgataggggtggagggagagtgacaaagaatttgtggccatctttattacaaaaatttttgtcaaccacagagttacaggaaaatgtggccatctttaatcactactccaacgatgtttcaaattgagtgggcttccatcagccagggtctcggagacaggacaaagtggaaaacagctcccaaataacatacctaggtatatgaataagaaatacatctctgctgtcctgagtcacttagctatttggagttgtttggtatcaacttttgcatactaatataaaaattggtactggaaatagggtggtgctataacaaaaatctaaaatatgagtcactgacatatataataattgagttagaaatactagtggttggttgttaggcagcatccagctttgactcacttatgcatttcccagtgaacctagctcagaagtttgcaccatgatattcaataaataattcttaaataagagagattgtttcttgtaatttttccctattttagggaaaaactttttttttttttccatatcacatttttcttgaaacattggagtgccacgaacatatcatttgatgctctgtttgagtgccaccagtgagtttcccgatgtttaagtttggctcgtgggcagcccaccttcttcctctccactttctcttgggagccatcctgctcatggaaagtgtgctttctcctctgctacctcacacaagtttcaaaggagcttgctcctgccaggggaggcttggggtaagccaaacagcatcagctccccgggggaagggaaatttcaggtttggagctaagttcacttccagggagtgacaaagcctgtttgaactttaattcacagagtaaaagagttcaatgttggccattaatgatttggactttaacatgaagttggtactgattactttgggccataatttagaaggacagagtgatttaatctctgaacttttaatttctctctggaaaattaatactgggagagggttaaaatcaaattgagaacatcttgttggttcttagttattaaagtatttgatcacattttagaaattctgataactttgggcaagctgacaggacatagtttgagatggcgatagaacatattgtgaattacagccttggatacagaatagcattggaactgatttaatcgataaattgttctgacccattcagggcattttggggacagactctacagtttactagtggccccaggacatcctgcaaaagaggtgaaatcagtattggagaagtggtctcatgaagatgggagcacgactactacaattgactgctgacttctcacccaaggaagtaactgtatcccagcctaatctcagtggataagcccacagggttaagagatgttcaagaaaaagaacaacttcagtggaagaagaagaagataggagcccaggtcctgtgtttcaccaagacagccgtgcaaagcagatgctgccaaaaaggtgcaaagtggtttgtcagctcttctgcatgttctaacaaattagacatgcatcccaaaaggtatactacaatattaaagcttatttatacacactgtaaagtttcccctgagtgtcctggcaggcacttgcatggctgggcagtatccgtggactgattcctttgtgaattacatggagctgacagggctgaaacccacagctgactcggaggaggatggaagcttgtgctgggcaaggggctgaagcccctctgtgtaagtcatattaatctcctctgagcagagtgctacaaaattactaaagctgcttcttgaagacacttctaatgcagtacctaatgaaaatgtcaggtgcgacaagttattagttgctgcactgctgttctgaagtcccaggtatttctctacctgttatccatgaatgtgagttttgtggggaaggcagtcacaggctgaggaaagcatcagcagtcatgtgtgctgtcaggcctgtaaagtgagtgaggacaatgaagctggttgaagtgccccaggaaatggccagacttccatagtggaggtgaggtgaagaattgagtccgggcaaaggtgtgtggggagaagaagctgcctggtgtacgatgctgagtaatgatacaacccaaatcatctgactctgcagatttgaaagttgccgttattattaagaattcagatgggaaaagaaatatggtttgggttatttccatagtcattccagaaatccaggctcagtttggcatttattgacataactgtttatattggatctgtgtagaagtttgtatctttctgacttgcatgatacttcagcctttccttggagtctctgtggcttctcttcctcctttgctcacctccagtcattgtcaaatggctttgtgcaagttactctttctcggcctccatttttttggatcctgcctttgccgccctccttgcctgtactctgtccagtccaggccctctggacctcttgcctggacctccaagctctccctcctcccatctcttccctttcaaccttcctacccagagcacagcagtagtaacagctaacaccatttaataggtatcctttctatgccaggccctggggttgctatgtcacatatattatttgtaatgtttgcaataaccctggaaatggtattattacctccattgtacagtttggaaggcaccaaaaaaggcacatgggcccacattcatgcaagctaatgaggggcaaaactggaatgagaacccagggccactgggtccctcagcttatgctgttccctaaccatactgcttcctccactcagaatcctttagtggctcccattgcctaatagatcaagtctgggctccttatcttggcttctgggtcctctaaaatgtagtctgctaggtttccaggctttcctctccacccctcacacatcctactctttagccaaaaaaacagacaaaaaccctaaaaacaaaaaaatccatttttttatttatacccgtgctttctttcctaagtgcttttatatgtgctatttctcctgccaggagcagagactgtcatgctttcctctgtataagtaagtgttgcccaagaaaacattgaacagaggtgggctagagatccatttattttctggttcacaaagggcatattggatctttattaaatagtctaaaatgtcctttcaataatgtttttctttaatatctttttaaaagacatttaaagtgaatcagaaagcaattaaatgattaattgctgtggctgaattctgctgccctcagcctctgtggatgctatctcaccgattaacctccatttctaagctctgtctgattgagggaagcaatgacagaaaacgcttggcctgtcacatgactgatccttgctgtcatgagccatcgttttctaactgcaagctttcattttcaaagccctggcatgatttcaggagctgtaaaccctcatgtgagtaagtgagcagtaagaactggcagtttttcaatcttaagtctctccagctttaaacccacatttagctgtgattctttttttctccttaagttggacatttttttagtgaatacttttttgataaataaagtggggtgaaggtgaacttgactgagacagatatgggttggtccgtttagggctgaccctggaaaaaaaaagttatatcagtcttgacattaattccgtagtcagagtaggtgagagaggagtagattagtatatagggttcccagccttcccagtacaaccatggactcagagttggggacactaaaaatgtacatgaagtttatgatttcactggtagagatggcccacaatgccagtttggacaggcattactctaaacgtggtggggaagtcaggagacatctactccaaggcataacctctaggacagtttgtggggtatcagggaaggatatatcattggaaagatttctagttgccatacacaaataattgggcttcagtttaatgcataattaactgttctcagtgtgttattagttggacaattggattattacattatttacattagtgtttataggtaatctgaaaacaaaaatgtgaatataatatgaactacctcaaagatttgtctctgcttaatagttttatttcaaatttgtatatcaaatgtttcattacccttttttcattttattttttagctttcaaaacaaattagcaagaggaggaaagaggagagggagaaactgtgcacaccaccagaatgttatagtaggcgatatcatgaaagcaatgttggaactttatactcaggttttgattgtgcatctatctctttgttgtcttatcctttatcttcatttttaccaagtaattattgaccatcaaatgccattatggtaccaacttaagaaatggatgtaaagaattctacagggaaaaaaagcacattgtcagtgtatgaaatttatttagaagacagttacagacacatataaaaatgatagcagcttatgtttgcgaagcactcactatatgccaagcactttctgttagctaataataatatttgctcatttaatattagctcacataataatattaatattattagctcatttaatcctctcaacaactgtctagggtaggtactattatccctattttatggacaaggaaattaagtcaacaagagatgaaataatttgtttacagtcacatagctaggaagtggtagagtcataagttgaacccaggcagtctgaatccagaataataataataaaaaaaggtataaccagggtggaaacttattttgctcttttcaggtttcctagactttccatcaccaccagtgaattctgagtgacaatagtgtggaatttggaagaatggaagagaaactgaagtggagagatggtgaaagagaagaaaaaatgaagaaagatgcttgcaaaaatactgctgtgggtcctgagatgaggattctgggagggctgaaatggatgcccctgacagctccctttgagttcctgttcatctgaagtacaccagctttctagatatgctgtcactttccttctgcagagccacagtggtgtcctgtcttctcagacctcttctcacctcaaatcacttaggactcggccaccagacagatttgggatttcagaacttttcagatgttagaaagttcttttctaaatgtgatgaggaattacggaatcataaaatggaagcagagttaaactcagacatgtgggcactcaaggagctttctgcgatgagaaagggatcagactgatccttaagactttatgcaaccccagagtattgcagccacctgcatgccgaaggtgtcaagagtgttctcactgctgcctataggagggtcttcagcctccagtgatccaaagtaccaggtaaaatatttaagccaacagaaagaacgtgttttattgtgttttacatgtcataaagcattctctatcatgagatatcactctgtatcggtaagacaggcttgaatttctgtcttggttctgccactgactagctttattccttaggctaacctgttggaatctcagttttctcactgtaaagtgaggataattattttatgaggatagttatgaaaattaaataacataatggttgcaaaacacttagcacagcactaagacacaaaatagacaataagtgttagttacctttattcctgtcccctttcctatccagacaaaggctcagtataaggacaaatattgtttagaacttctttttaaacctacgagccttacctttcaagaaccgcagatttgttcctgaaagttacctgtgtagtgagggttttataaatcaaattttactttcaatgtacagaggagctctttgacagagtcccttttcctgagaagtcattgtgggtttggcatcctgttcagcctggctggggccaggggagctgaactgtaatgacaagcagatgtactattgttctatgaaaatagtgtctggctccagatggggtttaggaaaaagtagtgatgatttctgttgaggaggatgggaattctgacccactgagctagctggtgaagaaggagagtaagacatgtgggtaaatgcaggttaagaaaaaggacctctagatcaactgaaagcctactagaagaacattaaaagcagataagaaaacaaggaagcaaacaaaactcgacaagagaaagaagagaccattaggaaacatccaggataattgctgtcatcattaaagctcccatttgttaatctgttacatatgaggcccaacactggatgatttaccaacatttaacctatcctctcacttttcaatgaattggatattgtcaaccccattattaatggaaaaatgggagctctagaatattgaagtcacttggctattaagtgatggagccaggactgggattcagaatccaacactcatattctttccatgaggtgtagattccattgagaagaaggtgtgtgcctaacaccgtgagaaagtcttggccctggtaatgctggtgaggccagtggctgagaaaagaatagctcttacctaaggctgagaacagaagacccaaggttgtggaaaactgacagtggtgcccttcctcacacagagtgcaaagattggtggcttacctgcttcagactcttggacgtgctcttaaatgcagatcctggcagtcagagaggaaaggctgagaaaagttcactctttgccaaagtaataaatccttctctttgatccctcaaaagttgatagacgaaaactcctcaaagcacctaggggtaggaaccccacttgagagttgtgggttctccatttcatcacagggatttgctgtgaaggaatcctgtggtaaactccataagaaaatgtaaataacatcccctctccaatttatcttttctgtaaatctggcttttcatatattaggtttctttacagtaagttgaaaccttaagaatagatttcaaaatatttaggaaatggcctatttattttgaatgatattcaacaccattaaactagagtgttgggagaatatttggacattccataatgatttgacttgtaacttaatataacagaactaaaaacaaaaaccacatgatcatctcaatagatgcagaaaaggcttttgatacaattcaacatcccttcatgttaaaaacccttgacaaacaagacatcacagaaacatacctcaaaataataagagccgtctatgacaaacccacagccaacatcacactgaatgggcaaaagctggaagtattcctcttgagaaccagaacaagataagaatgtgtcctattcaacatagtactggaagtcctagccagagcaatcagataagagaaagaaaaggcatctaaataggaagagaggaaattaaactccttttgtgaatataacatgatttgatacctagaaaatcccatagtctctgcccaaaggttcctagacatataaacaactttagcaaagtttcaggatacaaaatcaatgcacaaaaatcagctgcatttctatacaccaacaatgtccaaggtgagaaccaagtcaggaacacaatctcattcaccgtagccacaaaaagaataaaatacctaggaatacagctaaccagagaggtaaaagatctctacgagaattataaaacactggtgaaagaaatcaagagaagacaaacaaatggaaaaacatttcatgctcatggataggaaggatcaatattgttaaatggccacactgcccaaagcaatttacagatttggtgctatttctatcaaactaccaataacattttttatagaattaaaaaaaaactattctaaaattcatgtggaaccaaaaggagcctgaacaaccaaagcatttctaagcaaaacaaacagacgaaaacaaaaaacccaaacaacaacaacaaaaaccagaggcacactacccaacttcagactgtactacaaggctacagtacccaaaacagcatggtactggtacatagacacatagaccaacaggttaaagaatctagaaataaaaccatacacctacaactaattgatattcaacaaagtcaatgaaaacaaccaatggggaaaggactttctattcaatatatgatgctgggataactggctagccacatacagaagattgaaactggatccctcccttttaccatatgcaaaaattgagccaagatggattaaagacttaaatgtaaaacctaaaactataaaaaccctagaagaaaacctaggaaataccattctggacataggccctggcaaagatttcatgacaaagactccaaaagcagttgcaacaacaacaacaaaaatagataaatgggacctaattaaactaaagagcttctgcacagcaaaagaaattatcaacagagtaaacagacaacctacagaatgagagaaaatacttgcaaactatgcgcccaacaaaggtctactatccagaatctatagggaacttaaataaattaacaagcaaaaaccaaacaaccccaataaaaaatgggcaaaggaaatgaatagacacttttcaaaggaagacatacacgtggtcaataagcctatgaaaaaatgctcaacatcactaatcattagagaaatgcaaatcacaaccacagtgagacaccatctcacaccagccagaatggctattattaaaaagcaaagaaggctgggcatagtggctcatgcctgtaatcccagcactttgggaggctgaggcaggtggatcacgaagtcaggagatcgagaccatcctggctaacacagtgaaaccgcatctctactaaaaatacaaaaaattagccgggcgtggtggcgggcacctgtaatcccagctactcgggaggctgaggcaggagaattccgtgaacccaggaggcggagcttgcagtgagctgagattgtgccattgcactccagccagggtgactgagcaagactccatctcagaaaaaaaaaaaaaaaaaaaaaaaaagcaaagaaataacagatgctggtgaggttgtggagaaaagggaatgcttatacactgctcttgggaatgtaaattagttcagctactgtggaaagcagttcggagatatctcaaagaacttacaacagaactaccatttgacccagcaatcccattactgggtatatatccaaaggaatataaattgttttcccataaagacacctgcacatcgcaacactattcacaacagcaaagacgtggaatcattctaaatgcccatcaatggcagactggataaagaaaatgcgttacatatacattaaggaatactatgcagccataaaaacgaatgaaatcctgttctttgtagcaacatgggtggagttggaggccattatcataaatgaattaatgcaggaatagaaaaataaatactgaatgttctaacttataagtgggagctaaatgatgaatacacatggacacaagaagtaataaacactggagcctatttgagggtggagtgcaggagtgagtgaggactgaaaaactacatattgggtactgtgctcgttgcctgggtaatgaaataatctgtacaccaaacccccatgacacgcaatttacctatgtaacaaacctgcacatgtaccccctgaacctaaaataaaagttggaaagaaaaaaaaaatgaacctctgagacaatattataaaaattagcacattcaaaccacggaaattgtcaaagtgtagctaaaatattaaaccttttagatatgttgtctagatataattatcccattttatagccagtgttatggacatccaaagacaatgtcaattttgctaataaactgcatcaaataagtgcatgggaaaaaataaaaagttgatacattaaaaaaatgtttttgatacataacttttattttgaaaacttgaaataaattgccattgtgaatttggcagcttttaccctggcatgcctacaaagaatgtgatatacatttaatcacgaagaatgccacccagtgataacagtggtactggggttatgattatgttttaatttgttttgtgcagaaaggcatgaccatttgcaaagctgtcctatgaaacgtatcatgtactagtcacctcatgttatcagcatgctcctggaggagtaggcaatggattttttcaccagttcgcactgtgcaatctcttcctcatgtgtgtgaactttgtgggatgtcaagtaccccattaaaattgaatgaagtatttgaggggctcccacaaaccctctagtgatcttctttcaacaaacagcattttattgtgtaaattagaaaaacaacacagagtctggcttaaagaggatggaaaactggcattacaccaagaaagaacctgaacttcagtctttgacctcaggagacatccaagtattaaaacagaattttttttttttatttacatggaaaccctgatggaccaggaaattctttataatgtagagtctggtgctaagtcttactttcaggtgaacccaaatgaagattattgaactcactgttgaatctcatcccctgtctttttaacagcagtaagacccctcttggtcagccacaatatggggaaactcctcagcagctgctgttatccctaatattattgatatcacttctacttgctcttgctatgtttgtttcttttcagcagagctttcacagtactctaaaaagtagaggctcttaacattaaaagtttccttagccttttcaataaccctttcctggttgtctatgctggtggcagcctcaacctgaacctgagtgaatttgtttttctggcctgagctttgctgagcctcttaaggggtagaccgtctatgtgtgtttcttttatgtgagataaaacgcacaatttattaaatatcttctgattcttagacaggatctcaagggtggagctactccagggctcattgattttcatggctttttggctgtttgaaaaagagcctcctttgacatcatgtgggtttttgctatttctatttaagggtatatcttacatgtcagatatattattattgctgttttagttctagacagcaagtgatatgagcaaacaacaaagcttccatgctgtgaaattatgcatttattaaagctatcagttgacacttagctttgaattatttatatttttctataaactgtcgacaatcataacgggaccagaaccataggttcatatgggaaggtgatttactcatcttcctttcttgcccttaggaggagttgcagacagagtattatctttttttttttttttttgagacaaagtcttgctctgttgcccaggctggagtgcagtggcgcaatctctgctcactgcaacctctacctcttgggaccatgcctggctaatttttgtattttcagttgagacgaggtttcaccatattggccaggctggtcttaaactcctgacctcaggtgatccatctgacttggcctcccaaagtgctgggattacaggtgtgagccaccaggcctggcccagagcattatctttatcatgactttttcctttatatgtattgactatttgcaggtgtatcacaactacaggagacagaaagggaagcggtatacctctttctgcatgccttgtgtttaaagcgtgcctagattctgataaaggcttgcctgacagaaaaggcagaatgccaggggtctatcccaagatactgagtcattcctgtgtccttaaatgccaaagaggtaggatcaaaacaccagatctaaaacttgacaatataagttgttagacttaatctccaccagactcaacttgtatctcagcttctcactaatctcctatttctcattcactcactggtaccttcagcttattctctgttttctcctttgtttgtcaggttttggcatgatatctcagacactttttttctccttgcttcattcagccagccccaggtgatttgccttcccagaccactggctttctcctgaaaagagaagacacaattgacttctggtctttcttgctgtccatactacatagattgttattccaaagcttggtccaggctgagttcttggacactgctttaaatgagtggcccttgaccagaagggagatctagaaacaaacacaattttcctggggaagctgaggcattgtgtttgaggcccacgtatctttgtactccttccgtcctgtgatccagaagtctatttatgccagtcttgcttcaacctctctcacaattgcaggggaaaagtctactgaagggagagaacatttcagctaggggatataacttaaggtgagaaataaaagtgagacgaagaaaacatgtttggtgaactggtttgaccagaactcatgtttcaagttggaaatgttcaaataggaggaagataactaaggtaaaaatattaaagactactattaaaaatttggaattcaatagttaaacaccacaattagagatatttttatgacattactgatattaggattgtcatttactgagaaaagtgtgtaaaaatctcccactatgattgataatagaatgtttattttccttgaagttatttcaattattactttatttattttcgagactgtgttattcattgcatacaagttgaggattgtgatatcttcctcgtgaattgacttttgtcatcatataatgactttcttacctggaacaatgcattttgcctttaggattactttgtatgatattaatactttgtcaccagctttcttttgtttaatgtttgccccatagtaaaatattatcttgccttttggaacatcttggaatttttcctcctgcctttctaacctatcttcactgtgtccttctatttcttctttttttcctcctactcctgattacccccaaaacccaggccttgaacataggggtatatctgtgtgtgtacgtagatgcacgtgccaacttttttatctcaaggctttaactgttactctatcattgaaactgcatttcacaccttctctttagtctcaaattcccaactgccactcatcatcttcccttcccttgcctatatctctactctattctctttttctcttgggcttgcagccttggagtcaaccttttttccgctttatgctctatattaagctgtcataaatgccatgacctttgctgaaatgcctaacagattctcagcaataagctcacagggaaagggcaaagccaggagtgcaggacgaggggaggatcagtggcagccatcctgtagattatctactgaaattctttccattcctttgaatttctgctcctttgaagccctggattataataattatcttggaaagtttttcagtccgagatccaaaaattcttaattgggacctcttcagtgaaaatgacattcagtgaaaatccctggcaacattttcctagatgagaaaaagaattaggaatcagatgaagacgtgagaaagccatgacttcacaatgtgtaaagcatgtgctgatagcttgtggaagagtgtcttaggaggtccctgtcccaatgaggataacttcttaatcagaatcttgtttccaagttctccctcaactccaggataaactttaaaaaggaaaacaaaatccttgctagaaaattttccatcatttttctcttttctgtatgagtagcatggatgaaagagttctgtgactgagttgaggtttgcatctaactattgagccatggcaaaaaatattaagcatcactatttgttgtcatataaggaatttagtggggtttgaggttttaaatgttattgtttttctctatagtaatatcccttcaatccccttggttatctttctagagcaatataaaatgacctgacttctgtgagaagtctttagcttttggaaatcctcacctaggtttctttcacctagagaattggtttctgagaaaatcctccttccttttactgaacagtgaactgggagcctttaaatggagtggaggtggaggaagatggaagtgaggcaggtagaatttgtcattctgtccccctgggagaatgaggaaattagcatccagttctctagaacctagagtttcagggatctatttgagtgggaaaaagcattccttgtttttttgtgacctacttaaacattctgtgaaagttgtaatcatttgaggttttctaagaaaagaaaaaaaaaagtctaaatataatcctaaaagggagctaacctaacaacaaagaacacccggttgcagagattatttctctggaaattggcaaaaagagacaaaaatcttccctggcgattactggctatacctgctgctacacctgatttcatgctttttattcctggcagcactattggccttctccaatgtgggcttctccaaacttcacacccaggggcacacaaatcctatttctcccatctggaaagctctgctcacttcttcccaagtccgcttcccacctgcctttgaaatgcagctaaagaccacttcacagagattccctcaatgctagctcttccgctatgcccttcattctttctcttaaacccctagaactcttagaacctgttaacagtgtatgacatcctaagtgctctaattcagggacagcagagaatgcagtccaggctcctggtccagtagtggggatggattgtgctggtccacccgcatgctgccattcagtctgctttatcgtgagcacttcccatttgccagcaggggctaatggtgtaggccaaccatggaagaacgtgaagctcatctcagtttagctgactggatgcagcctgcagcaagcatgtgttgttgtttcatacattcctgtctttgctctgtgtgcacatttgggtttcatcttttcctcctagcggcacacgttcccatagactttgtgcttgcatgtattaaggaacattgcgttgtcaaaaggtaataataagagcagctaaaaattattgagaacacgtgatgttgtaggcactcttttaaacatttttatatgcatttaatccttgcaacaatactgtaaggtagttattatcccattttatggatgaagaaaataaagtactgagaggttatgttactttcccagggccacatggctagtaaattctaaagcccaagctattgaccttgagcctatgctcactccaggctttggagttgtaggagatgtgcaaggcttaatgaacactgagtgaacttatgaggcagttcagtcatctgacatcctcattaaatctgatttgaagaaatgacagagagaaagttgatagagcttagaaatttggttctaggtgagaccttaaaagtcatgtcaccaaggaataagagaccctcaagaggttagataagtcctctgtgcatcatttcctcctgacctgtatctcaacgtcaaagctgtcaacaaaaatgaacagggagcagcacttagtttgtatgatgtattcataatgtttggggtgccaaacagaagtcttatgacatggtatttttgcccggctaggtttttctatactagggcatggccatggttttaatgctttatttattaaagttattagaagataaatatgtgcaatcattgaaacttttcttattttcaaataagaaagggaaacttaaaaaatttagatttagcaactaacttttatttagaactgccatatgatctaacataaagttttcttacaatctgaatttgaaacattcaggattattttactaagatctgaaaaggtaatttgacatactatctataaaagtgtgaattaccctggggattaggaggtgaggttctgtagtaattaggtatgccaaaaataattttttaccctcctccccctcttccttctttcttttctgcatttacatgtattgctcttggtctctcatgtcattctttcaggattttctaatgtaatgaatttctctttctctaccctagagagtaccattatttccattctttcatggaactgtaagtgtgtgcaatttgttgacctcgtggtatttcaaagaactgtaaaatctcaattatcaggaatgcccagggaaaggggcttttaatggaatggatttttctcttaaactgaaggttaatcaggactcttctctcccccccgtttcaaatttattggttgcaattttttttccctaatctgtgagtgtactttctgggctttgctgaaatgggaggttatctgattgactagcaatcataagccctatgtttaagtccacattcttccatttgccagctctatggtttgaggaagttatgacactgagccatttgaaaaatggagatagcaacacttgtcctacctatgtcacctgggctgtttagtgtatcaaattatataaagacaatggacttgctttgtacaagtcttaagttttattttaatgaattatgacaactaccaagttctgagtgcctaggggccaggtgctccatacacattattgttatttccacaataaacctactatatatatagatgtatatagatgagaaaagtaaggcttgggagataagtgacttgcccaagattatgtaaataacagtggaactaaatttctttacagcaaattgataccttgattaatcaaaagtctttattctaagtaccatttcttgtggataaagagagtatagaagattgcctagaagcatactgaccttaggatgcattgttttgcttagggttcttttagttataaggaacagagatgttaggtttcagagggatttcagagaaacccaatgacagaaattgaattatagttgggtgttaaggaagctgtcatgaatcaagcctactcttgcctctcctctttcttctcctctccttccttcttttcgctctctctttgtccacacaggcaaaatcttccttacatatgtggccttcactctcttttgtctattgactggcttcctcataactgtagcttgcatatggttcatcatatggtttgggtctgtgtccccacccaaatctcatgttcaattgtaatcccccatgttggaggaggagcctggtgggacgttccttggatcatggggatggtccttcatgaatggtttagcaccattctcttggtgctgttcttgtgacagtgagtgagttatcgtgagatctcgttgttttaaagtatgtggcacctcccctgtctctctcttcctcctgctccagccatgtgaagtgccttgcttcccttttgccttctgccatgattggaagttccttgagacctccccagaagctcctgtatagcctgcagaaccgtgagccaattaaacctcctttctttataaattacccagtctcaggtatttctctatagcaatgtgagaatggactaatacagaccgtagtagggactctacacctccatatagcatagtatctcttgatctgtccatttagcttttgccctgttgcttactggaaattctctaggtcttgtgattcagattcctgaaggaggattcttactggcccagctcatctattctagtcagatcccaggtcactgactgctacaagctcatggattggctgcttttgcatcaggtgtcctgctttggtgctgcccacttagcaaagctaagggaagactaggaaataaaagcaatgtgacagctacatctatcatcactattaaagaaggctatatatcacgatatatttgtttttgtaaaaatccttaatattttattgttatcttttagttcttattctcttcttttcaacgtagtccctcgtctttcaaaatatttctcagtaattgggttcctgttgactcaaattttatgacacagaaccttgtttataacctcctaacttaccattactaatatcagttctgtagtcatatataccacaattttatatgtttttgaagaaggtagtaggaaaatatgtcatagtttaagttttatactaagcataagtcatgtcatagtagaagtcttttttctattaatagaagatgtcatgtctcaaggttattgttggaatataccgtaattaatttttttaatccttaaaataggagaattgagggtttccgagtagtgtgaatacatgaaaagtgaaaaaaatgggtcatcttctaggaaggcctgcagaacttaaaactgagaacaggccttagacttgctttctttcctctcctggcacttcctgggttttgttttcctccctgctggtaggttttgatgggaaggcattatatttctgtttatctgaatatctattttactcacaaacttttttcttttatcatagctgatatgaagtgaaaacatgtatcacttggctcagcctgaactgctgtgtgataggatgtccctgtatcaaccatgaaccagaagtggaacagggacctaattaatatttatgctgaccttggtggctgttgtaaaataaactaccatacatctaaaacctcaccacactgggttggatagctaaaacttctatactattcatggcttaacttctgagatttatatgcctcttgaagagaaagtactcatcactgctgaaagtttaactttctatttttgttatggcctccattacatttccaaatattcctttacttaattttatccataaacctgaagccttcactttcttagtgaggtactagattctttgtatataaatttgactgtattggaaagcctgggtccatgtgtttttagtccttaactctccagtccttgtagatttccttgtatataaacactttaactgagttatagaacctcttcctctgtgaactggtgtcaggctctggtggtaggtcctcttcctactctacatgctgcctaccctcttgtatggaaaaagattaactgttttcctcacactcagcgcaaaacacttctggtcaccaaaacgtgtgggtttctcccacacaaagcaattctctgacaccagctggatatcctacagttcagttcaattctgtgctaactgaagttggcacagactccacgtgttaagggctcagcccctcaagactgtccccggcttcagatgtcagtcactagtggtagtttcccatgttacccatgacttgtgtcagacttggctgtaaactggagggtcccaaagcccccttctctggtttgatcacttgttagaacagctcacagaatgaggaaggtgctttacttattattagccattgattataagatgatataagtcaggaacattcagaaggaagagatgcacaggtgaaggtatgtgggaaggggtgtgaacttctgtgccctctctgggaccaccactctccaggtacctcctcctgtttggcaacccagttatggaggcttcattacataagcatgattgattaaatcaggccactagtgattttttaaaaaatttaattaacacctaataattgtacatctttatggggtgcaatgtgatattccaatttatgtatacatgtgtaataatcaaatcagggtaattagcatatccatcacttccaacatttacaatttgtttgtgttgggaacattcaaaacctctcttctagctacttgaaaatatataataaattaacgttaactatagtcatcctacagtgctaatagaacgctaaaactttttcctcccatttagctgtgattctgtatctgttaaccaaactctccctcttccctacttccccctacacttcccagcctctagtaactactattctactgtctatttatataggatcaactttttcagctctcacaaatgagtaagaacatgtggtatttttctttctgtgcctggcttgtttcacttaacataacgtcttcccagctcatccatgttgctgtgaatgataagattttgttcttttttatggccgattagtatttcattgtgtacatataccacattttctttatccattcatctgttgatggacactaaggctgattctatattttgtctagtgtgaatagtgctgcaataaacatgggagtgcagatatctcttcaacatactgatttcctttcctttggatatatacccactagtgggattactggatcatatggtagttctatttttagttttttttgaaaaatctccatactgcttcccataatggctgtactaatttacatttcaaccaacagggtataagaattcccttttctccacatcttcaccagcatttgttatttttttgtctttttataataaccattctaactgaggtgagatggtatctcattgtagttttgatttgaatttccctgatggttagcaacgttgagcatttttcacacacttgttggtcatttgtatgtcttcctttaagaaatgtctattcagatcatttgcccattttaaaattgggttatatggtttttttgctgtttgctgtttgagttctttgtgtattctggatcttaatcccttgtcagataaatggtttggaattatcttctcctgttctacaggttatctcttcactctgttgattgttttctttgctgtgcagaagcttcatagtttgatataatcccatttgtctatttttgcttttgttgcctgtgcttttgaggccttatccataaaatctttgcccagaacagtgtcctaaagtggttcccctatgttttcgttgagtagtttcatagtttttatccttacttttacatctttaataaattttgggttgattttatatatgatgagagataggggtctagttttattcttctgagtatgaatatccaattttcccagcaccatttactgaaaagggtgttttttcttcagtggatgttttcagtgcctttgttgaaaatcagttggctataaatacatgaatttatttctggtgccatttgtctatgtgtctttttatgccagtaccctgttgtttggttactatggctttgtagtgtattttgaagtcgggtagtgtgatacttccaccttcattctttttcctcgggattactttcactagttgaggtcttttgtagttccatacacattttaggatttttttttcctacttcagtgaagaatgttaaaggtattttgataggaattgcattgaataaatagattgctttaagtagtatgatcattttaacaatattagtttttccaatccgtaatcttgggatgtctttccatttttttgtgtcttcttcaatttctttcttaagtgttttatagttttatagttttcaacgcagagatatttcaccttcttggttaaatttgttcattttttttatagttattataaatgggattgccttcttgtattagtttgttttcacacggctataaatagctacctgagactgggtaatttataaacaaaagaagtttaactgactcacagttccacatggctagggagacctcaggaatacaatcatggcagaaggtgaaggagaagcaaggcacatcttacatggtggcaggagagagtgtgtaggggaaactgccacttttaaaccattggatctcatgagaactccctcactatcatgaaaatagcatgggggaaaccgcccccatgatccaatcaccccccaaccaggtccctccttcaacatgtggggattacaattcaagatgaaatttgggagaggacacagagccaaaccatatcacttcttgatttctttttcagctagttaattgcagtatagaaacactattgattttggtatgttgattttataacttgcaatttcactgaatttgtttcttttctaagagttttttgatggagtctttcgatgaaggtttttccatatataagaatatgtcctcagcaaacagggaaaattttacttccatctttccaatttggatgccctttattttgttctcttgcctaattgtgctctggctaggactttaagtattatgttgagtaagagtggtgaaagtgggctttgcgtcttattccagttcttagaagaactccccccaaccgccattcaatatgatgttagctgtgggtttgtcatatatggcctctattgtgttgaggtatattatttctgtacataatttattgagagttcttgtcatgaaaagattttgaattgtagcacatgctttttctgtgaatactgagaggattatattagtttttattcttcattctgttgatgtgatgtgtgatgtatattgatttgcatatttgaaccatccttgcatccttgagataaaccccacttgatcatggtgtataattcttttgatgtgctattgaatttcttttgctagtattttgctgtggatttttgcatctatgttcatcaaatatattggtctatagttttctttctttgttgtgttcttttctggttttggtgtgagaataattctggcctcgtagattaggtttggaagaattccactccccacctccattttttggaatagtttgagatgaattggtgttagttcttatttaaaagtttggggagtaacaacagcataatgttagaggtgcctagtattcattccccttacaagaaaaaaccaaggcaatgaatacacagctaagatttgactggagtgtgggaaggagcaccttggaaggcagcaaagaggtggagatgcacctgtggtaaatggaagtccaggagggcagcacgcaggcactcagcctctgaagctctgtctgccccacccagattagatatgtctgaagtcaggagacacttcctgttctggcaaaaatctgagtagaagacccttgccagcttccattgccactgccaatacctacagtccttataacaagagaattccacaatcctttcaagccatgagcccaattgggagaactgtggggattatactaaattagcagtacaaggtgtgcactctccaccccctgcccactccctatgagccaggctgctgcagcatggtgccatcttgagaccagagtcacctctggtgtgcaccctgctctgggagccactagccactgtgcctcacaagcactgggactccatcttcatcccaccaagcccataggtcattgaaccccacaacctcatctgtgcagagcctgggcccaagatcagctatgactcctgcactacagggaaaccaactcctgctgccttacctccagctgaaggaacagtctgattgtctcatccagggtgaacccccccttaagctggcgaaaacactacatgccatccttcaaacaggagaaactttcaagcttccgtgtagctgacatatccctgagtcagtggaatgactataggccatactcagaacctgagaaacaatgtagcagtgccactgccccaagcagacacaccccttgtctgcccaatggccctaatgatagggacaggagatagcgaaatactgggtagaagagggtggttccctggcaaaggccccaccctcaagcctggaaacccatggccctaaatgggaacaggcattcctatttttgcacccaaaagttcccttttggcccaccacactctgcatcctgaacccatataaaccccaaatcccaggctccacgagcagatgaacagaagagcagaagagcagcagagaaggagagaagagaaggagcatctgaacgttgagaggagttcagctgggaatgattggagatgagatcggcgctagatggccaaactccaggggaagatcatcttcccactccatcccctttccagctccccatccatcctgttgagagccacctccaccaatcaataaaaccctcgcattcaccatccttcaagtccgtgtgtgacctgatttttcctggatgctggacaagagctcaggatacagaaagcccttgcaaaaaggcagagtgttcactgagctgtttaacacttaagctgtccatggacagcaaagctaaaagagtgcgctgtaacacatgctcactgggacttcaggagtcgcagacacccacccctagattctattgtggggccggagcccaaaagtgctcacaccagcttctgcacctgcccatctgcatgctccccgtcatgtaaggggtttgagtgccagtaagccatcatccttttacttatttaacatttaatatgtatatggtgttggtgcatgataacatcatggaccagatataatgtttgtctccaaagagcttgtatagctatagggaaataagacttagacactgggcagagggaggtaaaactgacaatgagttgtgggatattacagataggaaagaacataggtgtggtgttttcatttttgtctgcaggttacaaagctatgcataaagaatagtaggaatagtcttctgctcattatattgacaaatgtgatttttaaaaagccaaggtaaattgatgtatttttagaaacatgaaaaatacttacaaaaatacttttaacatttaaaaaaatattgctagcataaagaaagtgggagagtggtccttctggccaaaaatgccatttgacttcttgtcatgcagccactggctacattttttataccttttctgaccctccagtttccacttctgtcactacatttttccatttctaatatcacactgcatgctgatttttgacttttggaactgatggcattttcaccctataaaagtgtcataaagacacattaatattcaaatgatcacttattttgtaaatagggaatttttgcatatattaaaccagtagctttcacttcacttcacataagtcatgtttctttgtggttgtccattttcaaatctgtgccacaagactatgtactgggaaggagaaaatgagaattaccacaaacaaaaaaaaaaagtgatagactctgaatcagagttcactttcttgacctctctagtgagataatagtcttgaaaggcaggcttcgtggaaagagaaatttcttttcattgttttattttttccaaatctattttttaaaacttttctatttagaaataattttagactcaaaggaaagttgcagaaatcagagttcctgcataccctttaacagcttcccccagtgttaacattttacattaccatagtaagagtatgaaaaccaggaaattaacagtgacataaaactgtcaccttatctatgaatctttatccagtttcaccagatttcctattaaagtgtttttcttgtcaaggatccaatccaggctcccacattgcatttggttgtattgtctccttggttttgtccaatattagacccaccttgagtctttcctttctttcttttcttttttttaaatttcatggctaacacacttaaagagaactggtcagttatttatagaatatcccttaatttggaatggtctttcttttaattattacattgaggttgtgccattttggcaagaatgccactgaagcgatgtgcccatcttagctcatcatatcagtgggcacatgatgtcgatatgccttattactggtgatgttagcctgtgtcactcaattaaggtgatgtctgccaggtttctcaattatgaagccactatttttcccttgacaatcactgaatatcttctggggagatacttgaagactatgcaaatatttcacttcttgccatatttttgcacactaatttgagcagccattgattgttcttgcctgcaacatttattactgtgctgttgcctaatggttattttttattttccctacttctaaatttattcattggtaatccattgtaagaagttgtcccttctccctcatttacttatttattcaattatttgtttacattagcatgaactcatgggtcatcatttgatactatcataacttactttgttgctcaaatttaactagctctggtctttgggagatccttcatgttgcttctctgtcttttcaacatgtccccagatttttttgagtacattctcacttggcaacatgagttttcctggattgtcttttatttcccttgccctagctctggaatcaccatttccctggagttaattctgtagccttgatttcttttattcaggaatggtatttacagctaagatctgggcagatatgctattgctataaggggttattgaaacaggaaatcttccctgaccccttcacaggacttgtgaagggggtaattcatttactgagcccacagctctcaatccctcatgggatggggagcatgcaggtgagtgggtacaggggctggcatgagtgcttctgggcactggcaggaacagaacttcgtgtggccctgtagcagcatctgcagggggtacctgtgacccatggagccttagaaggtgtgtgttacagttgtgctcttttagctttgccctctggtgatggcttaagtgtttaacagctcagtgtgacagccctctgtatcctgagctcttgtttggtgtccaggaagaagcaagttgcatgaacgaattgaggatgctaaatgcaggggattttgttgccgatgaaagtggctctcagtataatggagagctggaaaggggatggagtgggaaggtggttttccctggagtacagccatcctgggccaaactcttctctgagatcccaccatcaagccgtccctctgaaatcaagctgcttctcctcaacatcaagctgctttttctcttctttcctttgctgttgccagtggagcctggggtttttatgggtacacgatagggggtggaaaaggcaacattcaagagggaaaacaggaatgcatgttctcactttgggctgaggttccaggcttgagggtggggcttcaacagggaccccaccctcttctacccactattttccctgcctcctgtccatatcagtattgtctctagtcctgctcagtcaacagaagtaggatatatatacatccatccgtaagtatacatattaaaaattatacatttatacctctgattccaacccaacaccactggtttcattctagcctttctgttctttgtaacttcttttgctgatagtgaggaactagctcattatatttacttaagttttgatcctagtatatacacaaactagttttggaataatcaacctacattagcctagaatacagaatttgggttcaatttttttttgtcattagccttacagtattcatgcaaaatactcttttccaaagatatttagattagttctttcttcaccactctcttcactttgattatgttagttatttgtgatatagttaggttcatttgtcactgtttgtcttccatttgaggttcctatcacatcctggtttatttttaattatttatcgtgtgtgtgtgtgtgtgtgtgtgtgtgtgaaccattaccatggttctaagaatcagaactatgaaaaaaaaagtattctcagagaaacatttcttccgcattcggccttgtcctattgttctttccaccctgttctcactcaccccctctaggtaaccaatctcattaacttctggtttatctttcctgtgtttattttgcatttgtacaaatgagcagatatgtgtatattttctttctccttttatacacaaaggttagcactatagataatcttttttactttgcttttttgtaaaaaaataataacagtatatcctggaaatcacagacattttccatattcttttttactgctgcatagtgctccattgtatgaaggtaacttcatttatccaacaactgtcctctgtataataattttggttgcttccaatttttttgcaattacaaacaatgctgcaatgactaaccttggacatattcgtctgtgtgtgtgtatgattgggggtgtatctgcagggtagatttctagaagtgagattgcaggcccaaaaggtaagtgcatgtgtagttttgttaggttttgccaaaattccctccagaaagcttctaccagtttgcattgtgtgaaattatctatttccttatagcctcctgacagaatatatcctcacacttttttattttttctgatataagaagtacaacatggtatcacagtattgttttgattttatttctgtaattataagtgaatttgaacgttctaaccttttaaaaacatttctgttcatgtattttgccgtcttgctatgaggtttttgtcctttgtctcataacactttgatatattttctcccggtttgtccgttgtcatttgactctatttactcttggtatgtaatttaaaaaacatttttgtagtcaaaatttttttttattttattgcttctggattttgaattatagttagaaagcctttctcatatctaggttgaaaagcaatccccccgtgcttttttctaggatttttatggttccgtcccttgttttctatttagattcctaatcctcttggagcacatttttgtttatggtgtaagttacagatctaattttatcttttttccccagtggatgcccaattgtttgagcactatttattattataaagtccatctttgaggccaggcacagtggctcacacctgtaatctcagcattttgggaggccagggtttgaggattgcttgagtccaggagttcaagaccagcctgggcagcatggtgaaaccccgtctctactaaaaatacaaaaattaggtgggcatcatggtgcaggcctgtaatcccagctactcaggaggtggagccacaagaatcgcttgaacctgggaggcagaggttgcagtgagctgaggtggtgccactgcactccagcctgggcgacagagtgaaactctgtctcaaaataaaaaataaaataaaataaaataaataaaataaagtccatctttgtaccagtcatttgagatcccacctttatcacatattacatttccagattaacttgtgtctatttctaagctttctattctattccactggtctatttgtttattcttgtactagcaccacacttttaattatagagaatttatagtatgttttaattcctgatatatgacttatccccaaattgatttttcttttgagtgtgtcctggctactgttatgtgtttgtttttctatatgaactgtaatattagcttgtctaacttcatgaagaagcttgttggtattttctttgagactgtcctaaatatataaattgatttagggagagctgacatatttataatattgagttgcattattcaagaacagaagatgtctttccatttgttcaagtctacctgtctattcttgatacttcatgtctttcaaaaatgcttcttgtctattcttgactctttactcttccatatgcattagaattaacttgtcaagttctgttaaaaacttgttgattgaaa

SEQ ID NO: 280 - DNA, 8305 bp, Homo Sapiens
ctttccacccgagcgcgaggtagacgccggggccacccgcagcacgcagagcttctgggagccggtggcaaggccgaattgggatgcaaaccaaatggacgtgggtgactggcagaaaacgcctcccacaaatgggagggatttcggagggaaccgaaagaaagttgctgcaattgagtgaagtcaccttgatgcagaagtgttttctcttctcattcctgttaggaaaccaagttacagctgaagccagggccttctcctacccgactcccgcggcccattaaaacctacgtgagcttatctgataccttcaagccctgttttgtggccccatctcctcttcagatggcaatgtgcctagctacactacatttcctgcctcccttgcagctagaggtggccaatgagatataaacagatgctgtaagacatgatgtctagatccctagcagtcatcccagaccatgagataactttgagaaggaacaccatgtacaaaggactgtgcagaagagggttggcaggagcctggatctctgatgacttcacccttgactgcccacctcaccaggctgtacaagccactgttactggcagatgaatgcaagttctaaaacatacaactactgacctactgaattttccaaggagcacatttccactggagacatttggtgcctgcagaaaatacttactgaggaatttctatgggaccagcctgaagtagaagccactgaagagaggccctgaagcagcttttcttccttatcccagagaccaacatggttaccccagcccagagtcaccctccttcctctaagctgtcaaaaccctggctgcctttacaatgattctgacaatgaatcccaccctgctggtgatgtctattgctttactgttaaactttttaagggttaaaattcctttttatttttctttttaaattgattaataatagttgtaccaatttggatggtacctgtaatattttgatacctacatacaatgtgtgatgaacaaatcagagtaattgggctagccatcacctcacacatttatctagggctgaaatccctgaaggacaggattgtgtcttacaaattgtgtattctaatctgcatttacatttcagaaattctggactaagtaggcaaaccaacagaaactcttgctatgaagatctggaggtttcctggaggaagtggtgaatagggccttgggactgatgttaaaagccctggaacacaatagggagactcctgaactaggaagaagtcaaaagctctggtagcagcccccacaaattaagaaacctactcagagtaaaagaaacaggccatggtgggtggccggggagcaaggaatatttgtgagtaaccccagatggtggcaatcatttaatgccctccatccctctcagtgtatattaggttatgttttttttttagaaaatggaggaagggttttactatgttgcctaggccagtctcaaactcctaggctcaagcgattcacctgcattggcctcctaaattgctgggattacaggcatgagccactgtgcctggcccaagaagtctgagccagacgttgctgcataggtcagaactctgtgggctatgaatgtaagatattcacgagtcacatctattccattcattggcaaacacttacctgaaaccatacagcaaaagagattctggaaaatgtaccttccagccttagaagaaagtgatggtggtgcccagttgaccccaggcaagccggcccaggaatgcagacattttggactgctcatcttttactactttgtgtagcctttcacagaagaattacacaagaacttgactcttgattccaaggattctggaagaatgccaaccaaactgaagtctacaagcctaaccatgttatgaaaaggctggatgtgacatggtgaatcctccttagatgtgttaactagggttagggtaccagtgacatgcaaggggttggccatttgattaagtagaggaggcatgagtgaaagcagcacacctccaccctgctcaatggccatcatcacctagccaggctgtgagcctccatggagtgggtagctgagaacccacaacccacaatatatcttctttctggccctgttaacatggacctgtctctatgaggtgatggttgatatccagctaagtatggccctcttaatagtaatgtgggtggctttattcatattggcttcatgataaatggtatcactgagctgacttctctatgttttagataaaacaaaaataaaagacaaaaaaaaaaaaaagaaaaaaagcaaaatgacacaggcagtcttgctgccagacacatctgcaatcagaaagcttggaaaattagacttggaaatggcttgaaaaaacctttaaactttttctgaagagcaagtacaggtttgtctctggggtcagttctaattctttgaccagctaattttaagtggctgtatctcgaaaaaagtgacagtgacattttggtactccagctgaacttttagattagtcactgatacaactgcaacttttggcctatttgaaggattttaagggcaggataaataacaaaacccaacagtcttagcctgagtttcccagaaatcagagcctgagacaaaggcttgccttttaagattatctgagaatgtgatcttaggtagcaagagtacagggtaggggagtgatcagggaaggagggaaagctaatgcaacatggattattacgttgtctactactatggacaattgttcatgtggactatgctgtggactaccatatggactaccactatcactatggatacaagtcctgcttggaatttttggggagatttatggaaagtactagagaactgtttgtccaaaggaccaaagatggaaacatttatccattggctccaggtccccattggtcaaggatgacttggttgcatttctaagtaatgtatgctgagcacagagcagattcaagtggttgccctgagctgcagatacctctgggcaggaaatgagagatactcagtgcagacctagagtgagacccgtgatctgattgcaccagcatagagatggtcaaaacctaggtggaagcagtttcttcagttgtaactggagatagaggtgggattgagaggattttaaaaaggggcccaggagttatctaaagcaccaaacagtaagtatacattaactatgttctgggtgttgggcacaagcatgggaggtagagcagtgacatgataaagcctttactcttccccaaatatctatactttctctaatataaaaaatcttaagtatatgaaaaatatcacatttattataaaatgtaaactgcaatgacatctgagagagttatatgttgaaatttaaattcacattgagatataaatgttagatacaggtattttaccccaagtaaggctttactaggggaaggaggaagtgcacaagaattctgggagtctgatgtagttgtgaatcaaaatttccaatccttatatatatttttattatcagccttgctttgcctagtgcctataatcgtgtgagaacttgccctgtagccccccatgagtggcccttttccctagtcatccttctttggctttagccatgaggagcctgatgtgaggagagaactcagcaaatatttaagtaaatatttatggaatgacatgaatgaatacaaagttataaatagaacattatcttattctactcctggactagatgtacgaccaaacaaactagaatagattttgcatagattaaatttcacctttctgacctccccaagcaagtgcttctctgtttttttccagaccaccatgtatattcagtagctgtagcccttattttctgttttagttattcaaagcttgctggaatatgagctcctgaagggcaggggccatttcttattaatctttctgttgtcagtactgagcaaagtctacggtgcctagaaatgtttaattaatgagaatctgaatcaagactataaccatacaacctcaataatgcaattaaaatgaagaatctgtggaataaaatgactgaaaagcataccttgggaatacatatcccagctgagagactataggcaagtcactgaatttctgtgtctcagtttctccaagtgaaaaatgagagaccaatcagggttagaggatatgtgatgtgcatactgtcactctgttttctgtgtcttggttgacatttctaataaatcatgacttttcttcacactgatttcagatataagcttagtagtctcaattcacttcagtcagcttctttgaaattcatcagaaatatttttaaaagcataaatcaaatgatatctttcccctgcttaaaaccctctaagaacttctaattccatcctgatggcaaactagggtcatctaaaaaatctccagctatatgtccttagaaatgctacccaaactatagcaacaagtcaaaatgcatggtggatcctttagtaaagaaaggaaaatcaccaggtgccagaaaaaggaatgaaactgaaaaacatagggaaaagcatatgagcttatgctgtggctaccctggaagaagtgtggaatgagtggtttggtgtattattacaccgggtaattaaggttttggtcaaattagaggataagagatgcagtcttcagtttaaatgaatcagggagttggaactgaaaactctacatgagctaggatgcttgaagggctgacctatagagagggtgctagagaaaaaaattacaactgttaacatgaagaaaaaaggaagtgtttctttgctttggctctgggcaaataatgataataataattattcttgaaaaatttacaactttattctgtgctttatggaaaattagaattcaaatatgttctttcccagttctccatgaaaccaaaactgcagaattaatatacaaattgttcttaagtgaatgttactccttggattcctggcaaaaaaaacacacaattcttgtggaggaacatttccattactcccatgccacaggagctccacagattaagcacaactgaagatgaaaccacaacccaaaattacaaaactcacaaaaaacaaaacaacattagagagccaacagacacaacaatattagataattaatatttctaagtacctgggacatagtaagttttatataacgtttgactgataaataaatattaaaaaatgaacataccaggaatgtaggttaatggagaaattcgtaataaactttaaagtaggaggaattaaaatgattaaagatataaaagcaggaataatttacataaaaaagacactatgataagataataggcaggcttgaagatccatatagaacttctagaaaaaaatgttatttgaaataaaaagctcaataaagagtggtttgaatagagctgagaaaattgagtgcatcacagagaggttaagatatagtaatatgaaaaaggttaagagatgtgaacaatagaattaggaagtgtaatgggaatttcagaagaagagaatagataatgagaaagaggcaatattcaggaataatggtccagtttttcagaattaatcaaagacagaattgaagaagtacatacagtcatgagtaggaaaactataataaatacacattgtaatgaaattatagaacttaagaacaaaaaatagtttggtaaattccctcttttaaaagatagagacctactgaatggataaaaacagaaggacctcattatatgctgcctacaagaagctcgtctcacctgtaaagacacatgtagataaaagtgaaagtatagaaaaagatattttatacaagcagaatccaaaagtgaggaggagtagctatacttataatatcagacaaaacatgttctgtaaaacttcatgttctgtatcagacttcatgttctgtaaaaaaatgaatgacattataaaataataaagagatcaatttagcaagagaatataacaattagaaaatatatgtacccaatactggagcactcaggtaaataaagcaaatatcattagatctaaagggagagataggccataatacatgtaatagttggggatgtcaatatgcctctatcagcattggacagagcatctagactgaaaatcaacaaagaaacatcagatttaaactgcaccatagaccaaatggacataacagacattatagaacgtttcacacaacagctgtagaatatatatgtttttcatcagcatattgaacattctccaagattgaccatatgttaaggcataaaacaagtctcaaaaaattttaaaaattaaaatcatatcaagtattttatctaactacaatggaatgaaacaagaccagtaataagaggaacataacaaaactacacaaataaatggaaattaaacagcatactctgggatgaccaatgtgagaaggaaaaaattaagaataaaattcaaaaatttattgaaccaaatgaaaataaaaacacaacatagcaaaacctatgagacacagcaaaaatagtattaagaggaaagtttatagcaataatgcctacatcaaaaagattttaaataaacaacataatgatgcacctcaaagatccagaaaagcaagaacaaaccaaacccgaaattagaaggagaaaagaaataataatgatcagagcagggctggattgtgtggctcacacctgtaatctcagcactttgggaggaaaaggcaggaggattgcttgagcccaagaatttgagacctgcctgggtaacataataagactccgtatctacagaaaaaataatgaaaacaattagtcagggatggtgcaacacacctgtagtgccagctactagggagacttaggtgggaggatttcttgagcccaggaggtcaaggctgtagtgagctatgatcacaccactgcactccagcataggtgaccgagtgagaccctgtctcaaaaaaaaaaaaaaaaaaaaaaaaaattagaacagatataaacaaaattgagacaaaaattgaaaattgagaaaagatcaataaaacaaaaagctgtttttctgaaaaaagaaacaaaattaacaaactattagctagattaagaaaaaaagaggccgggcgcagtggttcacgccagtaatcccagcaatttgggaggccaaggtgggcggatcacgaggtcaggagatcgagatcatcctggctaatgtggtgaaaccccgtctctactaaaaaatacaaaaaactagccaggtgtcgtggcaggtgcctgtagtcccagctactcaggaggctgaggtaggagaatggcatgaacgtgggaggtggagtttgcagtgagccgagatcacaccactgcacttcagcctgggccacaggtgagactctgtctcaaaaaaaaaaaaaaaaaaaagaaaagaaaagaaaaaaagagagaagacacaaataaataaaatcagaaataaaaagatgttacaatgaaaaccacagaaatacaaaggatcattagaaactactatgaacaactgtacaccaatacattaaaacacctagaggaaatggatatgtttttagatgcatgcaacctaccaagattgaaccaaaaaggaacagaaaactggaatagactgataacaagtgtcaatactgaattagtaacaaaaagccttccaacaaagaaaagtctaagaccagatggcttctctgctgaaaaccgctaaatacttaaagaagacttaatatcaactattctcaaattattctggaaaatttaaagcagagacaattcttcctaattcatcctatgagaccaacataaccttgataccaaaaaccagaccaggacacaacaacagcaacatcaacaaaactacaagccaatatccctgatgaacagaaatgcaaaaattctcaacaaagaattagcaaactgaatcaaacaacacatcaaaaaaaaaaaaaaaaacacacaagaatcaagtggaatttatccaggaatacaaggatggctcagtgtacagaaatcaaaaaccatcatacatcacatgaatagaatgaagaataaaatccatgtgattatctcaatagccacagaaaaattttttgataaaactcaatatcccttcatgataaaaactcttaataagttaggtatagaaggaaaatacctcaacataataaaggccatatatgacaacccaaagctaacattttactgaatgagaacaagacaaggaggccaactct

SEQ ID NO: 281 - DNA, 1755 bp, Homo Sapiens
cttaattcctaccgattactattaccttagtcaactcctgcaaaataggctcatacccaaattatgtaaaaacatctatcgcatatgccttcatcgttagcctcatcccaacaacgtttatatgcacagaccaagaagccattatctcaaactgacattgaatgatgatccagactctcaaactcttactaagcttcaaactagactacttctccacaaaatttatcccagtagtgctattcattacctgatctattgtagaattctcaatatgatatataaattcagaccctaacattaatcagtttttcaagtgcttattttcttcatcacgatattaattctggttactgccaacaacctctttcagctctttatcggatgggaaggtgtaggaatcatgtctttcttactaatcagctgatggtatggcagagcagatgctaatacagcaggcctctaaacagtcctgtacaactgcatcagtgatattggctttattttagctatagcattgttcctgtcctccaacacatgagaattttaacaaacatttattctagaccagatccccatctccttccattaattagccttctcttagcagcagcagaaaagtcagctcaatttggcctccatctctgacttccatctgcaataggaggcccagccccagtctcagccctactccactccagcactacagttgcagcaggagttttcttgcttatccgcttctaccctttaatagaaaataacctatcaatccaaacctttatattatgtctgggggctattactaccttattcacagttatctgtgctctaacacaaaatgatatccaaaaaatcatagcattcttcacctcaagccagctaggccttataatagtcacaattggcattaatcagtcacacctagcattccttcacatctgcacccatgcctttgttaaagctatattatttatatgttcagggttcatcatccatagcctcaatgatgaacaagacatctgaaaaataggagggctattcaagactttgcccctcacttcctcatcctttattattggcagtcttgcacttacaggcatgcctttccttacaagcttttactctaaggcctcatcattgaaactgcaaacacgttcatacaccaacgcctgagccctttctattactcttattgccacttccttgacagctgtccgtgatacccatattattttcttcgctcttataggacaaccttgcttcatgactctggctgctattaatgaaaataaccccttcctaattaactcaattaagcgcctaacagttggcagcatattcgccggattcctcatcaccaaccgtattattcctgcttcatccccaaaaacaaccataccactccacctgaagctcacagccctaggtgtgaccatcttaggcttctcactagcaatggagcttaatcttgaaactaataaccttaaaccaaaatacccattacagacattcaacttctccaacatactaggattttattcatccacaattcaccatacaaacccccactcaggcctatacacaagccaaaatctggcttcacttctactagacctaatatgactagaaaagtctataccaaagaccattacacaacccaaatttcagcctccattaccatatctactcagaacggcctaattaaactctactttctttttttatcccatcccttctaactctgctcctaattatcta

SEQ ID NO: 282 - DNA, 2795 bp, Homo Sapiens
cagtcatggtctggagtcaagaaatgaagagggcaagcaatgtttttggcatcctgactacagttacatgcagtttggggctgctgcaatggcaactcaacggagaggttaggaacaccaactccaggatcaggcaatctttgaatccctgtcactagcagctttgtatattggagcaagttacttaacatctgtctgctggagtttgctggaggttcactccagaccctatttgcctgggtatcaccagtggaggctgcagaacagcaaagattgctgcctattccttcctctggaagcttcttcctagagagtcacctgccagatgccagccagagctccccgaaatgaggtattcagtgacatctttctaaattgtttaaaatgagaagcattgcacactgagagtcaggatccaagtgtctttgactgagccaactcagctctgctattaacttatggtgtgatcgcaggctgtctagaaaaggacaccaacaatcacccatgaagattgcccttcaacctttgggaggaaatgatcgaaatgggagctagagaagattgttgttggaatctcagttcttcagagagctactatcaacagattgagttgacaggaaaaagtcataatccaggccaaagtgagcaaactcccaagagcattcctggtcagcaccgcagcaaatccgtggcaagtgcagagattataagcaatttctccatggctggaattcagttgatctgggactgaacctatttctaatggggtcttgatatattgcccaggctggagtgcaggggctattcacaggcacaatcatagctcactacagtctcaaactcctaatctcaagcagtagctgggactgtaagtatgcaccaacactcccggtttgggtatctccattgattggcaaccagcaccacagtagatgctgatgaaaagaaagttatgaatgtcatgtaaaatgacagtagtattagcaaatgtgcttttaattataagaaaattacaatatgtaaaaaaatttcaattttcccatattatctcttaataataactgccatttgttgagcccattgggtatgttacatatattaacacaacaggatggacattatctatcttatatatattatgtgtatatatacggaaaacaggacacaaattgtctgaggccatggacaattagcttgcagtaaagtaggattctaaattaggtttctctagctccaagacccatgccattttgtttggtcatttgcttctgatgaatcaaatattaattcagccaaagacagctattcaaagctggttgaataacttactatgtgtaattcacttgtgtcctgcctttcttccgaacttttgtacaaaaccttgattattttaataaggcattctatacataaagtttcaaataaaccataagtacctcaagaaaatgtcatataatttagaattgaatcatagcatatttttaatctggaagcaacatatctaaataagccatttttatattataaatacaaacaggtacaaagaagtatagttcactttacaagctgttgtacatgcataataccatattatgctaccaaagaaactattaagttatacatattttttacagctttaactatttttgttgtcaatttcctctaataagattttttctggataaacaaaaatttatctactcaaatgattgtttttcttcaacatcataatgttgcaggcctattgatgtatatttttgtgtactaaatagtttgtggagctcttcttgaagaattatcttcagagctgattaaccagacacaccctccagacatcatagtcacagctgctttgagacagcaacaacctcatccccgcaaatagtatggattcctgtcttattcaataggtctgaattttaaatactcttagcttatttcaagaactaaatctatcctccacaaataaaaatgtgctgccgctcagaatatttaggagaatatgtgatagccaagatacttttggcttatttcaaaaattcatctatctccacaaaggaaaatgtttcaccattcagaatattcaagagaattttcttagaaaagaaatccaagattgtattcattggaataacagacctttcttcaaggtgacttctttcaaaagaacaatatttaggggtatatagaacatcatttttaaaataatttattttgctatatttaccacatttcatgacaccctaaaagattttggctaatgaaatttatacagttcaaatgtgtattcctgaagagacaagactgagggaaaaaaaattatctcaaagtcattctcaaattagacatgaaatgaattattaatttctacatattttaccatcatgcttgtagttttaataaacaaaaatcaaatgcatataggcttcacacactttgtgtaattgcttgtttaacatccccaaattccataaatgcaaaaactagatctgtctggctttccattaagtccccagcacctagcaaggtgcttaacaaatagcagatggatgttggaaggaataaaggaacaaagaaaagaatagaagaagttagtgacttgattctatacagagtggaccttgacacatactgcaagtgaatgttaaactaaaagtataatttctttatcagtgaatatatttccatgaattttaagtattttgctgatgatttattaaatatgtatttcactactttcttttcttttaatcagtcctattccatccccttcaaataataaaaaagtttcaatg

SEQ ID NO: 283 - DNA, 3002 bp, Homo Sapiens
attccagaattttttaaagttcacaacacgagagtggacgaaatgtcggagcttttgctcatatccagaaatgtggcctctgcctcccactcgggccctgcggtgcagacgggttcagggcggcgaggactgagccaggagcgccgagagttccagctgctcccaggctgggttctaattaacgctggacccctgctgagatggagtctcactctgtcgcccaggctggaatgcagtggtgcaatctcggctcactgcgatctctgcgtcctgggttcaagcaattctcctgcctcagcctcccaagtagctgtgactacagagaaacgtgaacaggccaaacaaagcctcacctggctatcccgccaccctggggttgggcctccaaaggcccgggaggtcacctaagacacggtgttctgaacatgcaagcccgacagcatcttctctaccattctgccagagtccagagacctgggaataggtcataccccccactgcattttacaagcttggcatacattaggttctcaataaatactgaattaatgaaaaaattgctgaagtaactgaaaacatccatccaaaccccacaccatctggtagataagtagtctgtggggagtcccatatttttcttaccttagatatttatttggaaatggactgtaggcccaatatggtcaatgaaacttgcagaggaacatttcatgcctttaattagttcttcataactgcagggacctctagagttcctgaaattgaactgggttgtaatactgtcaagaaaaaggaggacctatcttaaatctatttcaagggtaatactattttactatgtaaattttcccctggtcagggacagcctgatcatgcatggtagactcgaagcatgcaaatatttcaacatgcaaaaccgccctaaaaatataaccgaagcttatggagttgtccagggtacagtggtttactggcccctgaatgcgggactccatcaaactgggttccaggctgggaggtctctgaacccaatttctagacagcctgctttggagttcaactgatgggaccttagacaccagccttaccctctgcaagtcttgtgatttggagccagatacttggcctctctgtgctccagggagacaccactgcacctacctgagaggactgaaggagaggatctgtgcaactcactcaggatactggatcttaagccaatgggtggacttacattcgtcacctctgattctgtctcctcctgcgcggtgacttagcaaacacttcttcctctccagctctgcttcttactctccagctctgctgccctgttccagtgctgacgccagacaacagataatttcccaaatgcttgtattagcccttaggagttcatgtgttcctcccccagccaataaagctgttaaatcccaataactgtcaggaatggagccaattgctataaagtacttccagcttcttggcatgaagaaataattagttccagttgccactgtggcatgaaaaaaaaaaaacctcctgcagctagctcggtgtctacccaaacagctgcctagttttgtgcttgaaacctagggccttggtggcagaggcactggagggaatctcctggtctgtcgattgtgaagaccatgagaaaagcatagtttctgggtggagtgcaccgttcctcatggtaccacttttgccttttgtcctaagtggttgtggacatctccaggggctgataccaaggactaggaacagctgagggaggcagaaaggttcagagtacatctctatttacagggaacagaacaccgccttgagagggccatctgtgctccagatgtgagagttcatgtgaatagaatggctgcaattcaaagaatcttcacaggaaaacagggctcagagctcatccacaatggacagacagggagggaaacaggtggaggttagttcaccacttcctcataagaaggtaataaatagtttggtgaaataaaatggtagcactgagtaattgcgggcttctggataggcagtcaggttgatttcatgttgctactgctggacttgagggctggcttggctgtggtggcagacacagcagcagctcaggatgatggtgatggtccatgccagccagaaccaccaatgttcatagtagtagttacaacactgagactgcccatagcagtgtcctgttgtgtcacagatgtagctttgattgttggtacacacacaggcttccttatcctttgggggttcagccctggctgacacagggctgggcagtgcctagaggtgcaagagctccatgccacccaggagtcttccctccatactcctcctgctcctccgacccagcgtgggcacctccctccacccttgctgcacttctcctctaccctcttcttccttcttttgttcttttcctgtaatatgttttgaagtcagattgtgaggccttcagctttgttcttattgctcaagagtcctttagttattcaggatcctttgtggttccatataaattttcaaattgttttttctatttctgtgaagaatgacattgaaattttgataaatattgcattaaacctataaatcgctttgggcagtaaggacattttaagaatattaattcttcctacccatgaacataaactatctttccatgtatttgtgtcatctacaatttttcatcaatgttttatagtgttcagaatacagatctttcacctccttggttaaatgtactcctaagtacaatcctaaatgtgctcctaaacaaaaaaaatacgttttttttgatgctactgtgaatgagattgatttctttatttttgtcatatagtttgttgtgagtgtaaagaaactactgagttttgtacattgattttgaattctgaaattttattgaattcatttatcatttctaatagctttttggtggagtttttagggtttcctatatataatatgtcatcaaacag

SEQ ID NO: 284 - DNA, 3293 bp, Homo Sapiens
gagtgtgagagcgagaacagccccgcaggtcccgaggcgctggctggggacaatgccgcggaaagttcccagtccccagccgcagatctgcagaattgaaatgaaatgttttgagctcttcaagctgactcgtcagaatcctggagccttttaaaaaatgacgaagtgcccaatgtggaaatcatagatttcaaggaaggaacaagaaaattgatgaaacaagttcaaaagaaagaagcttggccaatttgatgtcaatggaaatgcgtgagatttttattcagcattcacacctgagcaatgcttttggtcatgatgtcatactaagaagaaaccacctgagatgagactgttagatgttcagagcaaacaaaaacaaaaacagaccaacaaaaaaaacccaaaacaaaacagaagtttctgaaggacagcagaaatggctttgcaggaccacaacaaccactcccagtcatgatggagagaagtgttcaatacccacagatcctgaacgttgagctgattatactaactagatgggacttagttttgtctaccgtggggtgagcgtatactacctgagggaacaggttctctatggtgaagatggcaacttgctgactcagtctcagaatgcgttaaatccacatattctggcaagtggagttctgcttctccaatatctcttccagactaagtctcgaaaggacagtaattgatccaccctgagtcatatgcccatgtccaaagcaatgagtttgggaaatttcatgacacactcctaattttgtggtaggagacacatcagaaccacacaatgagtcagtcctatttatgaaatagaggttcatctatcagatgaaagggaaaaaagttgtaaaaacaaaacagatgttcactaatggggatctatctgaatttcacctgtaactacaaatgctcacaagtagatttacagttttcctagagtgtcatgaatttaaaaacatatgcatggaatcataaagtaatatcctaatcacctctcacaacctttctctccttaacataaaatgagaatattttagcagcaggagaaggattttcatttatagacctttatcagacactaatgtaggattgagtttgacctgatacagtgttctatctctgagtgttgtcactcagttttatcataaataaaatttattttatatgatatcatatagagaacaaatttacttatttttctcatgtaatcatgtaatcaattgttccaacataatccattgaatagatattgtggcatttccctaattatttataaaggcactgttactagatatgaatatttatatatgaggatatgaatcgtggctctctgatttgttcattatttgcttgtctattcctgtgccagtatcatacaattggtactaatatagtgttctgatattgacaggatgaagtgctccttctaatgatgtagctttaaatttgtcttggttgtgcatttctttttattcttccatagagatttgtggttcagttgtcagctttgaaaatcacttttgggatttgaatttgaattgcatgaaatttgtagactaacttgtagaaaatagacatttttatgatatgaatttacacatccttgtaaccatgggtgtgttatttattttcacttttgaatattattgtgggtatttagtaataaaaataacaatcgacgagttacatggtggttactatgtgacagatgttgtcaaagttccatccatatatcaacttattatatattcttatgggaagagaccgttattatctccattacacaagtaagaaaatcgaggtacaaagagcttaagtaacatgtgctaagtcatataagagtaaagctttatttgaatccatgcagtttgtctccagagcttgaaatccattttattttattttatttttgctttttaaaaaaaatttttttgagacggaatctcgctttgttgcccaggctggagtgcagtggcacaatcgcggctcattgcaacctccacctcctgggttcaagcaattctcctgcctcagcctcccgagtagctgggactacaggtgggcaccaccacgcccagctaattttttgtatttttagtagagaatggggtttcaccatgttagccaggatggtctcgatctcatgacctcatgttccacctgcctcggtctcccaaagtgctgggattacaggcgtgagccactgcatccagcctgaaatatttaccagtatctgatattgcctcactaagaactttgcccaactccttagtgattctaccattggcttagtattttggattttctagtagacaataatatcgtgtgcataaagcaaatacaattattattacaataaaatttttaaactactcatttgtacttgctttcataaagccttagctaattccaacaaaatattgattactgtgggagagagtggtaaatcttattttgtacctaatattaaataaaatgctactaaatataagtgagatgcttgctataagttttagtagttaaacactataaagttatttcttgtctattttcaagaattttttattattttaaatgcatgtgcaatttttttaaaaagtattgttttgcatctaatgttaaataaaatgcttctaagtattagtactaaatatcagtgagaggcttgttgtaagttttagtagttaaacactataaagttatttattttctattttcaagagtttatattattataaatgcatgtacaattaaaaaagtcttatttgctcttcttttctaatgttaaaacatttgtgctttcctgagatgaatgctgtgctctcatgaaagattgcagagtcaaaaagtagcctctggagttaagactttctggttttagagcctcctatggccacttactaattatgggtcttaggagagttactgaaccttcataatgggtaccaatcctagatcctgtcaaaagggatccttctcttggcgatgactttggaagatcctttgcatgacaataaaaaaaaaagtattattagatctaatttattagataacacttgggtgtctctaagtgttatggtggtaaacgttcaacaggctctcaaaaatgcatatatgtatatgtttatatagatacatatacactcaaatgtgtatatatgtatatatacacactaatatgtttatcataaattttattgatataaaggttgtgtaacacaagttacaaataataataaaatattcaatattatttattgtaaatt

SEQ ID NO: 285 - DNA, 2493 bp, Homo Sapiens
agaagagaaactcatgtcagccccagccctggggctacctgacctgatgaagccatttacactgtatgtggcagagtgaaaagatggaagttgggagttttaatccagacggtggggccctggccaagaccagtagcctacctctccaaacagctagatggagtttctaaaggttggcccccatgtttgaggaccttggcagcaactgccctgctagcacaagaagcagataaactaactcttgggcaaaacctgaacataagcaccccccatgctgtggtgactttaatgcataccaaaggacatcattggctaacaaatggtagactaactaagtaccaaagcttgctccgtgaaaatccctgcataaccattgaagtttgcaacaccttgaactccaccaccttactcccagtgtcagagagcccagtcgaacgtaactatgtagaggtgttggacacagtttattctagcaggcctgacctccaagaccatccttggacatcagtagactgggagctgtacatggacaggagcagcttcgtcaacccacaaggagagaggtgtgcaggatatgcagtggtaaccctggatgctgtcactgaagccaaatcattgccccaggatacttcagcccaaaaggtcaaactcattgctttaatttgggccttagagctaagtgaaggtaagactgtaaatatttatactgactctcggtatgccttcttaaccctccaagtgcatggggcattatataaagaaaaaggcccattgaaatctgggggaaaagacataaagtaccagcaagagatcctgcagttagtagaggcagtatggaagccccaaaaggtggcagtcatgcattgcagaggacaccagcgagcttccacctcgattgccttggggaactcccaagctgactcagaggcttgaaaagtagcatccacccccttctgggcatcaatcacagcccccctattccctcaggcacctgaccttgtacctacttattctaaagaagagaaggactttctctaggcagagggaggacaggtgatagaagagggatggatctggttatcggacaggagaatagccataccacaactgctaggagccgcagtcatattggctatgcatgagaccacgcacataggccaagagccacttgaaaagttgttgggccagttcttctacatctcacatctgtaagcctttgccaaaacagtggtgcagcagtgtgtcacctgctagcagcacaatgctaggcaaggtccaactgtcccgcccagcatacaagcttatggagcagccccctttgaagatctccaagtagacttcaccaagatgtccaaatgtggaggtaacaggtatttgctagttctagtgtgtacatactctaggtgggtggaggcctatccaacacgaactgggaaagcttgtgaagtaacctgtgtgcttctccgagatctcaaccctacgtttggactgcccttacgaatcagctcagacaatgggctggtgtttgtagctagttggtacagaagacagcaaaggtgatcgggtatggatcacggattggaacatagcctccttgcagccacggtggagaggaccccagaccatcgtcttgaccactcccacagccataaaggtagaaggaatcccagcctggattcaccacagccatgtaaaacctaaagcatctgagacctgggaggtgagaccaagcttggacaacccatgcaagatgactttgaagaagatgacaagccctgctccagtcacacctggaagctgactggtccgtgcatggctgaagcatgaggaaactcatcgtgggactcattttcctaaaattttggacttgtacagtaaggacttcaactgaccttcctcagactgaggtagggcaaaaagttaaaacagactttctgtttaaaagggacttgtgtgtataatgctacccagtacaagatatgcagcccaagaagtgaccagcttgatgtgtgctataacccattggaactagtttatccctgttggaaaacagagtatgtaactctaggaattgatggaactggactggaagacctgggtagtgaagatgacagtgagaactcccactagtgagtgagattctcaaaggggggaatgagaagtgaggccatttctcttactgtctcctgtctctgaagaggaggaggaagtaaaagttgaaaaacaacaggaatgaagtcattggcaagaccagccggtgccactgatgaccaggcctgaggttaaaagatcaaccccccactctaaccacatgtgctctcaatctatcatgaccctttcatgtggacccccttagagttgtaagcccttaaaagggccaggaactctgtcttcagggagctcggttcttgagacatgagtctgccaaagctcccagctgttgagatgcgagtctgccaaagctcctggccgaataaagccaaatccttcctt

SEQ ID NO: 286 - DNA, 6662 bp, Homo Sapiens
ccagttaggtttaccctttgactctccacttctgtgaatagtccctccatttccagttattttaaagtcagaatatgaaggccgcttagtccatcggggttaagccttcccatcaaatcaaattcttcttccttgcattcttctcttcaagccatttagtgaaacaagcacaaattgttaacttcagattaatatgtttaataagtgaaatctggactatttcaggaaggcaggcaggccagcatgactcttagcatcccactaactcgctgtcgggctcccaggcagcggctcgggcaggcggccttgtggctccgcaacccaacctcttcccctccgggcgcctcccggctccggggtcctgctgcctctgggacctcctcacccccagacgttcttcctctgcttctagagccaccagttcccctcccatgataactcattaaactattaacccattagtccattcatccatgaatgaattaatccattcatgagagcagagccctcagctgttcactatgcacacttgcttgaaaaggtgatcggaaacaaaagacagtgcctccacttgtgaggtgcgtagagatgtgagagacccatggagaattgtcttccaactgtagataattctcatatattcccatgttaacattttagtagctaatcagaattgccaatcaaatccttgacattcttctgatcaatagagtaggtcatcaaaactggaatcccgtgaggtttaaagtaattgttttgtttgtaaaatacatcctgcaaatatttttatttttctgaattgatccttaaaaaaaaaagttattcttgactggtctgaagcatctattgtccattttaagctttacatctggacaactagtttccgagacttcatgtatttaagtgtatttaagggcaatgctttttattttctctgcattagccatccactggctatttatttaacaacaatcccattgcactgaatacattgtccttcatgatgtagcctcagccttcttcaaactcattcacccatgtatgctctgccccagcctaattactggaagctccccaaacatgaccggttcttccatcctccatgccttatgtacactgtttcctctgttggaaagcctgactcgtcaagcaaactcctacttgtccttcaaaactagacttgtgctttacctcccctccttccctatgtcccctaagtggaattattgacctcttcgttcgtgacatttgttcatttctataatagtgtatattatattgcattgtaattatttgtttacataatgatctccccacagttagcgtgtgggcagaaactatgtctctatattcccagtgtgaaacatagtagatgttcaacaaacctttttctttgaatgaaggagtacattagtcagacttcctagttaggagttactgaaacagactcaaatggtctcaggaaaaagtaaaggatttgctaagtagctactgcagacagatcaaaaggctggaaggctatgtttggaaaatgggcaggatgtaaggaaactaaggaggccaatcagcagaaataaacagattttcactatcatcttatatttgtgcatcattcccatgagatcctcaggctggggagggtgttttattgactgagcctgtgtcactcatggacaaactgggataaggttgacctacccccttaagcttgcaaggctgagggatgggggaagacgctacttcccaccaagcttacacacaatgggggaaaagcaattatctgaaaggaaactggaatgtcatcagtaggggaaagaaatgtgtctaactccaaaaaatgaccaatatgtactactaataactgaaactttccaaaaaaaagagactatgatttaaaaatcaatttaacattgaatggtttgattatcagcaaaatcaccatgacatttagcacctttcttttccttgatgaactaagaactcttgcatagatttaataatgtgttatgtaccccctgggtgtctgatttactgacttgagctgaatgattggactcaatacaaataaaaagagcttgcaaacttcgcccatggtttcccagacatcaaggaactaagctcttttgctccctggagaggctaaaaattctaaaatgaagtgccctctgctctggtttctgcttttcagcatttctcttctgttttcacatacttttgctgctttaaaattaaatctaagaaactcattccatatttttcatcatctgcttttgaaagtgaatgttatggatttatggtttgggattctttgatgttagagcagcaactatgcttgcttcacttgtttttgtttcatttttttttttacatttatgaggctttgataatttgatttattaaaatgccacagtcaatgtaggggaactgacaccattcgcattgttggaaagcgtcatgaaacatcaggcgctagttccccatggagcgcttacctctattattatatctccccctcccctttggtcttcaggaaagtttggcattaaacttaagctgcacgcaaagaatattcattcctagaacatttcagtatttttggattggattccatcccccaattttgattttgtatctgccaagatgtacagagtggtacatctaaagctagttatgatacacaagctagctttccttatcaaggaacagaaatattccttcctcttaccctgtaatcattgcatatctggtatattaaaaattgaatttcatatcgtatccctttaaatgtattaacaagtgcaggttggaactttacattatgaatccctaaggatgagtaatgactaaaggacaagactgaccctttctgcaagtggagggtgtttttttcttttccatttctataggaagagacagatgaagagagagggagagaaaacaggacaagtttacccagaatgaaaacctggataagaagattaccataagagcttaaaaccatagaaaaaaatgtcagggttggaaaagtccctagactcttcattcattataattccctctaccagtccactgggtttcaggaaaacaggaacactcatatgctactgtttaagtgagtgagtgagtgtgtgtgtgtgtgtgtgtgtttgtgtgttacaggatattataagaatagaatagggaatcttccaggtatctgaggaatagaaaaaagccaggtcacatgggaaccaggactggaaagtcagaaaccaacaggattctatctctttccatttgtcagggactacacagtctctttcttctcctcaaaattgaccattcagctcacagtggaatatagccttattacagtagtcaatccttatccaaggcttaatttttttgtggttttagttacccacgattaaccatggtctgaaaatattacatacaataagatattttgagagagagagagagagactatatttatacaactttcattacaatatattgttaagtgttctattttattattattattgttaatctcttactgtgactaatttataaattaaacttcatcataggtatgtatgtacaggagaaaacatagtaaatgtaggattcaatactaccggaggtttcgggcatccattgaatgtcatgaaacatttataagaggggactagtgtatattttttcattcaacaagaaaataggcaattagaaaagtcagaaaatacaaaaaatcatggtttaaacatgaagcaaactaatctatgggattattttgaactgatgaagtgtcaagagagagaatccgtttaactgtggtactcggaatattcttagcgtgatgcaagtttgataacaagaattacaacaccttcctaatggattcattcacgtgacctaataataataacaataatgaacacttattgacattttactatgtgtcaggtactgtgctaatgctttatagattatttaatcttcaaacaattatttgagggtaggtattattatctcatttttttcagatgaaaaattgaggcatagagagattgagtaactctaccaagtcacacggctcttcagtggcagagctattctaagccgcatgatttacttctatgatatattgcttctggctaagctatgttatccaatcagcaataaattatttacacaatcattattataaacgcttttttgattttttaaagaattattctataaataaagcatgtgacttgattataataacaagagaatataaacattatcaaccttgatcacataaaaatagtaatataaagttaggggaaagagaggggaacaaaaggaaaagaacactgacttcctcatatttctcagtaaaagatattatttaacattactacatcaaaaagctgtgtttttaaagttataaacatagccaatagaactaaaaataaaaacaggttaacaaaagttggaagggtggttaatatatgtgagtcaaattcgtaattttttaaagcactattcaagaaatccttgaagttgataagcaaagaaacagtataaacatgttatttgaattatgtagatgactaccaggaaaaaaaaactataagcaagtgaaaaccagttacctacaaaaagtgagcctggggtgctgattatggagtgagatttttactctttattttatttctttccatttaagtgattatttccatgtgcacacattactttttataataagaaccatgcccatattattcacttcggtaaatctacatctaggtttccatcccagagaaatgcacatcatatacatgtaagtggcaccaagtgggatgaggggcttcttccaaaggctggaaccacagccccccagggggctctgggtaaacattcctagccccagtggtcttgggttcttttgtacctatctgaatgctattacacgcccacccatcccaaggttcagcccagagatgggagaaaacaaggacacttctgaacttttcactcactcttctcttttacatagtcccaggtgggagttccacttcctcttccggtctgtgtcttaccattctaatcccagggcacaaaaagcctcaaggtttcgccttaagggtggatggggtacatgaaggaaaagtagcttacagaaatgggtacacaattttgggaggtatttgaaaggtattgtctcctgtacatatatagatgcatggaaaatggtctgcaaggatacaggccacttcaaaagcagttggcacctctagggagagcagtgggggaggggaggatgcattcatgtaggacacaggtaattgtgggtttttttggtgctatggacatttatttagtgcttttgtatgttttacccattttaatcatcacaatagccaagtgaggttagtttttatctccacttacaaaaaaattaatagactattctttgaaaagttttaggtttacagaaaaatcgtatgggaagtatagagagttcctatatacttatcctcacgccctcctccccaatttcgcctattattaatatcttgcattagtgtcatacatttgttatattgatgagccaatatgaatacattatcatgaaccaaagttcatggcttacaccaggtttcactcttggtgtacatcctatgggttttgacaaatgcacaatgtcatgcgtccaccatgacagtatcatacagaatagtttcaccaccctaagactccctgcgctccacctgttcatctctccccctaattgatttttttaaaatccctgattatcctgcttgccctgcatgcatttccctcttacccacgaagtgaaacctggtccactgcacctgttccttcagttactgactgctgcctgtgataatagtagcatgagtggtcttcaagcacctcatatcctgccactaccgccacttgtcaggggaaaacccagacaggatgagatccacattcccagctgtccctgtcttccaaggaagagaaaccctaaaccagaagctaaagagtgaaaccagatatcccagggaaggggtgggggacgttaggtccccagtggtctgcgaaagaggtgccaagccagaagccccaaagtgctgggaaagccagcacagagaagcagataatgccaggaaacatctcaggcatggtggaggggcttggggggtactcaaatgacaggactgaagatttgtgaggatttgtgaggcactcaaaaattgcagagcgattatgaacactagggagctctcctgcttcctggaaaaaatcaaagcctgactcccaaggttggcattgggggcatctcttgtggagacagctcagagtgaggttgggagatacttttctaggaagtgtttttcaaatattttttaccgtgacctacggtaagaacatatttcaggttgagcacggtggctcacatacgtaatcccagcactttggaaggctgaggcgggagaatcacttgatcccaggaggttgaggctgcagtaaaccatgttcacaccactgcactccagcctgggagacaaagagagaccccgtctcaaaataataataataataatatatttcatattggcatctagtgcacacatgtggtgcacacacaaatacccacacactttcagcattagctggga

SEQ ID NO: 287 - DNA, 2666 bp, Homo Sapiens
aaaccctcgataagatacaactgcacacccactagattggctaaaattaaaaagaatgaaaactttgacggttggcaagtatatggagcaagaggacctttcatagactgcttgagggagtatagattggcacaatcattctggaaaactgcttgacaatatttactaaagctaaatatacacagactttgtgaccaagcagttccactcttaggtgattgcccagtagaaatctgtacatgtattcactgaaagtcaagttccagaacattcaaagcagtgttctttgtagtagccccaaacttcaaacaatccaaattgtgaataatgctgctaggaacatgagtgtacaaatatctgtttgagtctctgctttcagttctttttctttttcttcttcttcttcttctttttttttttttttttgagacagagtcttgctctgtcatccaggctggagtgctgtgaataatgctgctaggaacatgagtgtacaaatatctgtttgagtctctgctttcagttctttttctttttcttcttcttctttttttttttttttgagacagagtcttgctctgtcatccaggctggagtgcagtggcatgatcttggcttactacaacctctgcctcctgggttcaagcgatttttgtgccttagcctcccgagtagctgggacttcaggactgtgccaccatgctctgctaatttttgtattttttgtagagacagggttttcccatgttggccaggctggtcttgaactgctggcctcaagtgatccgcccaccttgacttctcaaactgctgggatcataggcatgagccaccacgcccccgcctgctttcagttcttttgggtatatacccagaagaactggattgctggatcatatggtaattctgtttaatttttggggaactgccacacttgggtattcttgtattttagaaacttcttggttttaatttcttctgtagatataatctacataaacaactattgggatcctcagtaattcaagaactactttaatgaactgtattatcaaggagagggttgaagcagccattgtcagtgagtgtagaaagtgataacgtgggtgagttgggtgacatactcttttgctctcaagtgacccagtttgggtgatatattatatggcccccctagtaatggagttcatattaggcagatggtcacacttggtaatgaggtcgccttagtgttggtgttcctgtggagctccctgaactcgcaaactttaatcttcctatgatggccaaccttggtggaccaaggtttagaatgaaagaaattgctttggagactacatatctcttttgagatttgacatacttaccaaaatgagtaatgattctgacgttcttccagtgttatttgaaattcaacatgaaacttttcctacatgtttctttgttaaaaatgttgagtaaattttgagacaaaatgtacatttttttcatataaacattgaaaccatcatgttgaggattacatgcattctgtgaagtttgtgtattaacaatccgtgtatgtcttcccaggaaaatgttaactgcagagggtttccaactgtgttggcttgatccggtcctttcccctctggcttgcagaacataacacttcctccctaagtgaggcagcatgaagccccatccagttactactattgtgagtggctcagagttcagcatcacagtttaatgcccagtagtctccttcttaggtctagtgactgtgcaccaaagggttatctgtcctccctttcccctccaactgcatttgtggaagaggaacaggatggagtagggcagaataaccaaaataagctttcctattctgacaaggaaagaatggggagacaagacacagtagtgtcttggctcacctctctcctgagtggaaattggactaagatctctgggcgcgtagatggagtcttttgcccggtagacctcattttagggcgaatgggtagaaaggaaagacccccccccccgcccccgccaccaaatccaagaattgggagagttccattctagcgctcaatattcatgctggaagcttaaattaacccagatggtctgtttggtttatttaaagataaaactagttttgagcctggaggaatagccacgttctctgcaggtgagtctgggaatagagcttgtaatttgcatagttgtttcagtgtacagaccttcaatttctgttacaatccctagttcttgctctcatccactatcccgtttgccagatattggtctggagcttctccagggtttcagagggcagacgctccttcttcctccagagccttcctgaagtacactcttggctgcattttctgttttgtttcatccatcttagctcttcagactattttgtcatccagaaatttgctgaaatctcacatccactggtgatgcctgtcccctgctgtttctaaggccatagtgtccttccttgctgtacttactgacattcatttcattgggatattggggcccaaagcatgggctttatctcctatcttctgcaggaagttccaagttgtgtgttttgctttttgtgtttttttttttttttttttgagacaaagtctcgctctgttgcccaggctagagttcagtggtgt

SEQ ID NO: 288 - DNA, 9172 bp, Homo Sapiens
atccattgcctccggctctcggcggggccgctggcgacccgcaggctccgcagtctgacctcttaggcgccggcccgaggtcgccagatcaaatcgccgataaaagcccggcgcccacgtcagggggctctgacaaccgccccacctgcgcgccccatctcttcaggtccagcgccgcctacccccatttcgccatttttaccggcgcgcccgccccgaggcgcagaagtagggcgaacggtggccgcagctcctttctcccggctcagccgccggccagcagccgcgccggaacctcggcccacgtgacgcgggcgcgcgcctatggaactgacggtggagttcagcgaagaaggtgccgcagagaattcgcaaacaccaaccgtaaccagagcagctgggggcgcggcggcgagagaagctgcgaagcgcatgcgcgcaggacgctgtgggaggggaaaggaggggaggagcgtggagcgatcgcctagttcccgcgttgcggggcgcatacgagacttggcgactcgctgcctcagggttgcgtgcctccggccctagcctgcgcaggcggcctgagcttggggctctgctacgccacccacgcccaccttggcggagggcggggccccacggctctcaaacttgcgcgccaaagacggagccacctggcgtactggtggaaagcgcagacttcagagccacacccgtagttaagtattcggactctgagattccagggtggggcccaggccatccgcgttttcacccagcatcgtgtgattcggcagcaggtggtctgtggcccgcactttgagaaaccctggtgcagaaggttcatggttagtggttctctctggaaggaacagtctaaggtttgtaggacttgcgttccacctaccaaagctaatcgagttagaaggctccaaactgaggtgtcatttctcattacggtggtgagaggacgggaccacacactgtgaagtcttcgttcccacatcccacacttcattcttgccgcctaagttgtcgccgtgggactattgaaagggtatcagcgatattcatctttcctataaatgggatctgctttctacagtttcctgccagatgtgtaaagattgcaagaattgaaggtatttcttcaactgaagacctttacagatactcagatgactgaaatcctcttatcactggctggacatggtggctcacgcctgtaatcccagcactttgggaggctgaggcagattcatcatctgaggtcaggagttcgagaccaccctggccaacatggtgaaaccctgtgtctactaaaaccacaaaaaattagctgggcattgtggcaggcgcttgtaatcccagctattccggaggctgaggcaggagaatcacttgaacccaggaggtggaggttgcagtgagccgagatggtgccattgcactccagcctgggcagcaagagtgaaactccatctcaaaaaagaaaaaaaatcctctattactatataactacttttatgtaccaatttgtagtctcaaaaatataccatcaatttattatatccagtgggggaaatttgtaaatattcaaaataccatttttccctttgccctctcacccaagtttattctgtgcttcaataaatttatggttctatacagatatgttgtcatgtacatctggaactatacttaatcagctatttgttttccaagaacaaggttatgtgctctattgtcaggcacatataatgaagaatgtgtgatttgagatgatttataaaagcttatcatatacatacttttttttgcatttaatttactagcatgtgacacaaccctgttttaaattctgtctccccattacctctattccctgttcaattgcccttccttcctccatcattcatctccttgtgatataacagatacatctaaggtatcattttatcgttctaagcagatattattctattttttcccctccatttgcaatataaagtattcttgatcaaactgacctgggtaattaacctttctgatttactctagctacaagcccataattcaaagtatcttaagccaaaatttagtgtagagttggcaaataaatatcacatatgcagcccttcctccttcccatgctcgtggcagactacgctattttctgccatgtccagacacagctccttgatacagcactctaagccacccttttctagacatctcagtctcactagtacttacaggaaccagctaagctgctagattttataagtattaccaagttttctgccatggttacataattcaagacagcacaattctttattaaccatgtcaagtccaaatgcttatttttaaataaacagaaataagagctattatacttcagggtatcaggaaaatctttcaatagttcaaactgactgctgagtttcaaaatttaagttacatcaggtttatttttcaaagcaacactcagagctaaagctaaacaaatctaacctgtcaactgaaagcattacctccaggtctgtttgcttctgtagtttttgtatcatattcatagtctttttcacagtagcacaaatgcggctcttactctctttctgctcaacagcaactggtttaaagcgggcatacaaagtttgatatcgagactttatcactgacaattcctttaagagtgtaactggatttttctatgtcaggaaaaaagtgaacatgtattaaattatgaaagattaaactttttaagaattaaaatactgtatacatacaacacattctaccatccatttaattgaacactgttgagtatttaattatgcagccacatgacatcagatgggaggtggggaagagagaaaagtataagacctagatcctattctcaaggaatttatagcctaggtacagaaataacccaccaaaaaaattagcaatattaaacagcaaataagggtcaccttagatatataacatttgatggatagttcacaataataaattatacaatatttctaaaatacaattctaaatgctattcagaagaagataaaaggcactattagtatttgttcttaaagaataagaacttgaaactacttataaaaatcttttttttttttttgagatggagtctcactctgttgcccaggctggagtgcagtggcgcaatctcagctcactgcaagcttcacctcccaggttcatgccattctcctgcctcagcctccggagtagctgggactacaggcgcccgccaccacgcccagctaattttttgtatttttagtagagaaggggtttcaccgtgttagcaaggatggtctcaatctcctgaccttgtgatccgcccgcctcaacctcccaaagtgctgggattacaggtgtgagccactgcgcccggccaaaattcgtaaacatactatcatggggataaagtatgtataaatatcaatttacttatatacacacaaaatataaaattcatgccaacccaactgtatttataaactatgctggttttccagatttattttgtaatatacattaccactattccataaaagacatttcaattggaccccttctgccacttggtaattcttttctttaattttttttttaaatagatacaggaatctcactgtgttgcccaggctggtcttaaactcctggcctcaagtgatcctcctgcatcagcctcccaaagtgctagaattacaggtgtgagccactgtatcctgccagatttctttttttatgattaggtaagattcatatattttcaggccccaccaagtgacagcacaattaataaaaagatctataccataactgtaaattttcgcaggatagaaaaaatattctgaaacttccaggtgataggtaagggactggggtaggctgaggaggaaagcacagacaaaggatcaggaatgagaatggcatccatttttcaacagcaacaatagaagctagaaaaccacgaagtaatgatgttaaaattaagagaaaatctccaatctagaatcctatattcaaccaaaccactcatcaaacaaagggttaggccgggcgcagtggctcacgcctgtaatcccagcactttgggaggccgaggcgggcagatcatgaggtcaggaaatcgagaccatcctggctaacacggtgaaaccccgtctctacgaaaaatacaaaaaattagctgggcattgtggcgggcacctgtagtcccagctactcaagaggctgaggcaggagaatcgcttgaacccgggaggcagaggttgctgtgagccgagatcgtgccactgcactccagcctgggcgactgagggagactccgtctcaaaaaaaaaaaaaaaagaaaaagggttaaagggtacaataaagactttttcaaacattcagcatctcaaaaagttaactttctgtgtaatcttcctcaggaagcgtctaaatgatatacttccagatcaaagaaataaaccaccaaagagtgaaacatatgatacaacacaggaataaaacaaagggaagtaccaaaataatggtaaagaaatcccagaaatgccgggcgcagtggctcatgactgtaatctcaacactttgggaagccgagacgggtggatcacctgaggtcaggagttcgagaccagcctggccaacatagcgaaaccccgtctctactaaaaatacaaaaattagccgggcattgtggtgggcgcctgtagtccttgcctcagtaggctgaggcaggagaatcacttgagcctgggaggcagaggtggcagtgagccaagatggcaccattgcattccagcctgggtgacaagagcaaaactccctctcaaaaaaaaaaaaaggtcgggcgcggtggctcacgcctgtaatcccagcactttgggaggccgaggcgggcggattgcctgaactcaggagttcgagaccagcctggccaacatggtgaaacaccgtctctacgaaaatacaaaaaaaaaaaaaaaaaaaaaaaaaaaaattagccaggcgtgtcggcatgcgcctgtagtcccagctactcgggaggctgaggtgggagaattgcttgaacctgggaggcagaggttgtagtgatccaagatcacgccactgcactccagcctaaccacagagtgcgactccatctgaaaaaaaaaaaaaatcccagaaagacagcaattcaagaagcctatagagcaggaggtcagatgggagcaggatagagacaccagaaaggataggatgtttccatgggagaaaataaaacttaaagaacatgtagtgtgtctgacaatattgagaagagttttacagttgttagaaatgtctgaggctgaattagtgaaaagtatatagaaaaactaagcaggctgggccatggtggctcatgcttgtaattctagcactttgggatgccaaggcgggaggatcgcttgaggtcaggagttcagtaccagcctgggcaacatagcgtgaaacctcatctctacaaaaaataattcaaaggctgggtgcagtgactcacgcctgcaagtcccagcactttgggagaccaagaggggcagatcacttgaggtcaggagttccagaacagcatggccaacatggcgaaacctcatctctactaataatacaaaaattagccgggcgtggtagcacacgcctgtagtcccagctactcaggaggctgaggtgggaggatcacttgagcctgggaggcagaggttgcagtgaaccaagatggtaccactgcactccagcctgggcgacagagcaagactccatctcaaaaaataataactattattattttttaaattagccaggtgtgctggcacatgcctatggtgctagctactcgggcggctaagcagggaggatcacttgggcctgggaggcagatactgccgtaagccatggtcacagagtagctgggactacaggtgtgtgccaccacacccagctaatttttgtagttttagtagagatgaggtttcgccatgttggccaggctggtctagaactcctgacctcaggtgatctgcctacctcggcctcccaaagcgctgggattacaggcgtgaaccactgcgcccaacctttaaattattttttgtagagatggggcttccctatgttggccaggctggtctcaaactcctgcactccagcctgggcggcagagcaaaaccttgtctcaaaaaaaaaaaaaaaaaagaaaagaaaagaaaagaaaaactaagcaaatggaaggaaaaaaaagaaaacaattattagctctagaaaaataagttgtgaagaaaggaaagcagacacagtattcaatagggcttatataaaagagttacagaaattgtgaagacaggaataaatatgggtagtaaagtatttaaactttatcttccatagtacaaaattcttttttttttttttttttttttaagagttagaattggctgggtgtgatggctaatgcctgtaatcccagcactttgggaagctgaagcgggtggatcatgaggtcaggagtgtgagaccagcctggccaacacggtgaagccctgaatctactaaaaatacaaaaattagctgggcagggtggcatgtgcctgtaatcccagctactcaggaggctgaggcaggagaatcgcttgaacctgggaggcggaggttgcagtgagccaagatcatgtcactgcactccagcctgggcaacagagcaagactctgtctcaggaaaaaaaaaaaaaaaagttagaatcttactctgtcacctaggctggagtgcagtggtgcaatcatagctcacttgaactactgggctcaagtgatcctcccacctcagcatcccaagtagctgggactacaagtgtgagctactacatcaggcctatagtaggaaattattattaatgataacagctaatgtatagcacttactctggactaaacagttatatatgttaactaattttattttctctcaatctctgaggtacatagtaatattcccattttacagatgaggaaattaaagtacagaaaggttaactgacttggctaaaatcacagtgctaataagaggcagagccaggatgtgaagtataacagttcgtatccaggaaattagtagatgtttcagatcaggaaaaataaagatgcagtacaaggaaaactatttagaaatataaaggaaataccataagacactgagatgagtggtatccttcttgagggtgggagtgtgaagcattattctttgtaattataagctttatatttctgcaactcttcaaatatattcaagaatttgacaaaaataaaagtttaggccggggtggtgactcacatctataatcccaacactttgggaggctgagacaggaggatcacttgagcccaggcaagaccagcctagtaaacatggcaaaaccccatccttactaaaatacaaaaaattagaaccaggtgtggtggcacacacctgtatttccacctacgcaggagactgaggtgggaggatcacctgagcccaggaggtcaaagctgcagtgagccatgatcatgccactgcactccagtctggacaacagagtgagactctgtctggggaaaaaaaaaaaagtttaacattgggagggaaattggtaggagggaagaagtcatcttcctcatgaggtgataataaattatgtaacttaattataaatgatctttaggtaactggaatgtagctcagtagtgaaatacccagagatctgcatgtattaatataactcaggagaatgatgagttccccaaatacagattcatacaggaaaaaataaaagtgacaagaactaatccttgaggatctcacaaaactaggaaaggaaagttggtatataaagcataagaaataaatggccatagagctaaaagagaggacagggtagttgggcagctacccataatacatgtttttatgacattagctcgatcaataagactgacatggcagtgagtaatttaggacaacatgatttgcatttatggcctgtttatgacaggttaggactgtggttaggacttagcaccataccacaaaggaaaaactgttgtgcgcatagcctgttttatttgagtaactggctgttgggaaccactacattcttttttttttttttttgagatggagtttcgctcttgtttcccaggctggagtgcaatggcgggatctcagctcaccgcaactttcgcctcccaggttcaagcaattctcctgcctcagcctctcaagtagctgggattacaggcatgcgccactacgcctggctaattttgtattttttttttttttttttttttagtagagatggggtttctccatgttggtcaggctggtcttgaactcctggccctcaggtgatccacccgccttggcctcccaaagtgctgggattacaggtatgagccaccgcgcccggccaggagcctctacgattcttttattagtgtttgtaaactgtgctgcactttagttaattttgtgcctataatacttcaattcattttagggttttagttatcatgagtggatgataaaaggttacaagaatggctgagcgaggtggctcacgcctgtaatctcagctttgggaggccaagactggtggatcacctgaggtcaggagttcaagaccagcctgaccaacatggtgaaaccccgtctctaataaaaatacaaaaattagccaggatagtagcgggtacctgtaatcccagctactcgggagggtgaggcaggagaatcacttgaacccagtgagccgagatcatgccattgcattccagcctgggcgacagggtgagactccgtctccaaaaaaaaaaaaaaaatgattacaaaaatacataaaaatactctgctaatgatagtgctggtgatgggagaaaagaaaagccaatatatgaacaaaaagctcagttcaattaagtcttttgaaagaaacaaaaggaaatgaattatactactaagcttaaaagaatctatagggaaaatgttcataaaataaaattatgtttctctgccgggcgtggtggctcacgcctgtaatcccagcactttgggaggcagaggagggcggatcacgaggtc

SEQ ID NO: 289 - DNA, 2068 bp, Homo Sapiens
tataagtgagattgctgacacacaaggaggatgagttccacatatgctcaaatacaaaactatccctcataaacagaataacctcatggttgagtcctttggtactgcttaaaatttgggtcactctcagttaccttattttacacaataaaatagcatgagatggagacatcttaatttgaaacattctcagtcatagctggagttggatgaatctagaaatataatttaaattaaaaaaaaattcaggagaaagatacttactttgagataaaaactattagggtcaaaatattgccattgagaacagtgagcaagtgtgtgccagtgtcagatattgtatgcatccaaagacaatggctttcaaggagaaattctgaaggaagtttggcctcctgtcttagtattcagatttaaatcttggcatttaaaaatgttaaattaatgaccgatcaattccaaataaattaccatctttagaggtgacgctaatcaatggaggacatggcatggttggtttgagaaaggcctcatttgacattgaggaagatgggataatgatggcttagtatttgtgatttctactccaggtcattaaaacagcaaacttaatagctctaatttttctaaaactcgacccatgcatgcattaaaataatcagcctaaaagcttgatttgtatttgattagaattaaaagacactatatgtcacaatggtatttgatgacaacccctgaaatgaaaatatcttgacttaaatactgtgctggccattagtagtctcatcaacacacagaataggaagagtagatttgcattctagtgatcatgagtcaagtgaacatagaacttttaagagacaagtcaggttgagagaaatgccatatatgaaacttacgtcctaaaggaaagaagttgagctctaagttaactagtctttggaaatttgtgattctgttcatggcatgtagaacttagagactggtgatatttttgtgtggtctctaaactgttgcccattagccagttcatcctcacctgtcctctaagctaatcacaaatttgcatccagattatataaatgtcaaggtcacagaaaaatatgaacgcagccaaaattagctatgctttctaaaatgtttgttccacccataaaagctttgcttaattatacaaataaagacttttgtttgttcatcataaaaaaaaatctattcaatactctttttctttttcttgctattatttatcctcactcccagatcgactttgcctaaattaactggccactgcaaatcaagataagaaaagcaagattactttcagtacaaaattgtatagacagacactgaattcagtctgcttcttgggtcctttctctggctcaaagttaagatgctcttgtaatgttccatttaggagcttaatgtttttccgataaagtgattataaagtttatatgtttaattaatttgcagctaaataattgtaggccctgctcttctcagtgaaggaggaaaactaacaacaatagagggaagtttttcttttcaaacatgagacaagaaagagaccaaaaagtttattgattctaatttcatcatgttatagctaaggaaactcagcccaaatgagttacatatcttggctcaagtgctaacattagccaatgaaagtgccaggactaaaactcctaattcctaatccattgttctttgtacacagtgtaatttgcaaaacacctttatttgttacttcatttgactctcaaaaatgtctttggaagttacctagtaagaaaactgaaacttaaactcacagatttaaaatatagttcaagttatatttaaaatataagtttaaatcagctggctcctcaattttatctttagcccttacctgtccctggataccaaactcatatatccacctgccctcctgacatatctaattaaatatctactttgtatctcaaacttaacatgccaaaataaaatctcgatctccttatccatcctctgttcttacccagcggaaccatgggctttcaaatcttattagatggta

SEQ ID NO: 290 - DNA, 823 bp, Homo Sapiens
gtaaaggttgaagtcaatagatttggcagtattaggtgtctggttacagggctcctttcaacactggcaaaatgaacattattgccaccaatgatcccttcattgttttcaactacatggtcctcatgttccaagttgattccactatgtcaagttcaatggaatctttaaggataggaatgggacgctcatcatcagtgggaagcccatttctatcttccaggaaacaggtcccaccaacctccaatggggtgatgttggtatgggggcccctggtgtcatcactatcttcaagaagattggggttcacttaaaggtgaagtcacaaaagtcctcatcgctgcttcttctgctgattcccccatgtgtgcaaggagagtgaaccatgagaaacataagcattccctcaagactatcagcaacaacacctgaaccaccaactgtgcagccctcctccccaagaacatccatggaactctcccagcagggaggacctcactgttataaacaatgccatcagtgccactcacagactgtggatggtccttctggcaaaccatggtgcagtggtcatcgtgctgcccagagcagcatcctcaccatcactggcacggccaagactgtcatgaatctgacttgccaccttgagaacattgccaagtacaatgacatcaagaatgtggtgaagcaggtgatgggggcttccgaagagcctcctgagcaacattgaagactagattgtctcccatgactctaatagtgtaacgctgtggatgcagggcctggcttcaccctcaatgaccactttgttaagctttttagt

SEQ ID NO: 291 - DNA, 3784 bp, Homo Sapiens
ctgagagccagccccccgtcccccacagcttaggacctccatcaaggatcctaagaaccttaggacccacctggaggactgtgggtattaggtgtccaagaagaaagctcaaatctgctgacggcaggtaccttgcttgggatttactatccgacaggggtccgaacgcagcccgggaacagaaagaaagcaggttatttacaatctaccggagcctaagggcagaaggcaggtaagggaattcttgggagctgtggggttttgtagactggatcccaaactttgcagtattagccaagcctttgtatgaggtcacaaagggggcggggaacggaacctttggaatggggatcccaagaacaaaaagtctttcaggagttaaaggaaaaacttctggcagccccagccctggggctacccgatctgacaaagccttttccattgaatgcgtcagatagagaaaagatggcagctggacttttaaccgaaactctggggccctggctgaggccggtggcctagttgtctaaacaactagagagggtttctaaaggatggcccctcatgtttgagggccgtggcatcaactgccctgatagtacaagaagcaaataagctgactcttgggcaaaacctgaacataaaggccgcccattttgggttgggtgacagccatcccctcttccccccctgccttaggacccccatcgcgtatcctaagatccttaggactcacctggaggactgtgggtattaggtgtccaagaagaaagctcaaatctgccaacggcaggtaccttacttgggatttactggaggactctgggtattaggtgtccaagaagaaagctcaaatctgccgacggcaggtaccttacttgggatttactatccgacagcggtccaagacaggggtccaaacgcccgggaacagaaagaaagcaggtcatttgcaatctaccggagcctaagggcagaaggcaggtgagggaattcttaggggctgtggggttttgtagactgtgcatcccaaactttgcagtattagccaagtctttgtatgaggtcacaaagggggcggggaccgggaacctttagaatggggatcccaacaacagcaagtctttcatgagttaaaggaaaaacttctggcagccccagccccggggctaccagatctgacaaagccttttccattgaatgcgtcagatagagaaaagatggcagctggaattttaaccgaaactctggggccctggctgaggccggtggcctacgtgtctaaacaaatagaaagggtttctaaaggatggcccccatgtttgaaggccacggcatcaactgccctgctagtaccagaagcaaataagctgactcttgggcaaaacctgaacataaaggctccccattttgtggtggctgagagccagcccctcttccgccccaggctcttaggacccccatcgcagggaggggaggcaccccccacgaggtagggactgagagccagcccctattcttgatttagccaatttaagtatgtaaaacggggggaaaaatgtgatgacagcctagttttaaggcattgatttgattgtgttgtaaaaaatacattcttctttttctttttttgagacggagtcttgctctgtcacccaggctggagtgcagtaagcccatctctgctcactgcaagcttacaccattctcctgcctcagcttccctagtagctgggactacagatgcttgccaccatgcccggctaattttttttgtgtgtgtttttagtagagatggggtttcaccatgttagccaggatggtctcgatctcctgacctcgtgatccacccgcctcggcctcccaaagtgctgggattacaggcgtgagccaccaagcctggccaaaaaatatattctttcagaaagataacatgtttgttctttcattcagtcaatatatatttattagtgttattgctatgccagtgtcttagtccattcgtattgctataaaggaatacctgaggctggggtggtgccatgttggttagaatggtgccatattttctgggatagcaccatgctggctgggatggtgccatgttggctgggatggcacctgcctcagcctcccaaatagctgggattacaggcatctgccaccatgcctggctaattttttgtatttttagtagagaaggggttttgtcatgttggccaggctggtctagaattcctgacctcaggtgatccacccacctcagcctcccaaagtggtgggattacaggcgtgagccaccacacccagcccagatttcttttatcacgctccataggctcaatagcaggaaacgtgtagagattcctcttgggaactggtcaccatatcatttggatgagctacagacagaccttcaatcatcctgtatcttactgttttgctatctctgtacactgcagttatgtggacatgtgtcacctccgccccactatccagaaatgtgggctcctatgtgcagggccagatctgctcccatgtgcatcctcatcacctggcaccaggcctgcccatgctaagcctccataaaattgttggactaaaaggtgacataggatactcaacttctcccagccatatgtcttcatgaaccaaatggcagtgcagaaagggaatgtttgcagtttcagtgggcctttctgagggcactgcagggcacacttctcccaccaggcccttggtggaggtgcagaatggggtctcttcagaagccacttccagagcccctaccaagggtggctcagaaggtctggttttcaatgagtccactagggaagtccatgtgtgactgattcgacctcgatgcttctacttcgccttctttccatctgactgactcagacctaatagtagggttctaggctgctccatgagccaaataaattttctgctcttataaatgactcagtctgtggtcttctgttatagtagcacaaaacagactaagacaccattccagagatatgcaaatattcaactgtaggtctccaaaaatgagatggcaatttcaagttcagctctgacagaagtaacaagaaggtacacacaatgagcagcacacacatctcccaccttctgggcacatgtggcccacatctagccagtcttcctgagccagcgggtcccaaagctgtctttggatcattgcttctccatgacaatttttgccagctcttcactggcctgcagcgttcctttcaagtaaattcctgacctgtgggggacaatctgggcccagcgtgcacccctggtcgcgaggaccacatggccagagaagcagaaaggaggcttcaggcacgagaatttaggttcttcagctgccacaagtgaagagcaccacttgtattttttattactacctgctatggactgaattgtgttcagttcataacacgtagtaataaaaatgtgtaggtcgaagccctaatccccagtatgatggtatttggagttgcagggcggggggctttgggaagtgattaaggataaggtcaagagagtggggtcctcatgatgggattagtggctttataccaagaggaagagagaccagagttctctctctcccttccccgccctccccccacctctttctctttctctctctgcaatgtgaggacatagcaagaaggtgccatctgcaagacaagcagagagcatcctccccagaaaccatgtctgctgcaccttgatcctcaattttccagtaagaaataaatgtctg

SEQ ID NO: 292 - DNA, 3386 bp, Homo Sapiens
gaaggcgggggacccgggacttccaagtgtgttcatctcaaagatctctctttgcataatgtgtgtgtggacctgcctacagatacattgggtggaagccctaggagcctcaagcaagtctgaagattggccctgagaaccactgttctcattatcagcaaggattttatccagagacctctaggaatacattcactaaaatgtgactgtggtcctgtggttgtatgaactctggctcttctcgtgaattacatttcactggagtcaggtgttttctgtaaacatcgttaaaccacgagaccaactgcattgaacattttttgcactacattgttttatttcttgctcgtcttttccttgcagagctggggctggggtgaggtgagtgtcttaggtgaggctggactcttcctccgagaagatctgaaatgcagtgagcacttttgcttgaagacagggactgattttggtagcatcctttggtctcttctagtctgggagtcagagaaagtttgcatcaaaatgtcatcaggccaaaaacaatccattgatacacttggtgacattaattgagaaaaaaacaatatggtctggccatggaggcatggtatccgtaacatcccccaaaggagctaaagaagaaatccacaatttaccatgagcatttctcgtctgaagattgccaagcgattcctccaggacattcctcaagatcaatttctgttcatccaccttgtcctgggagggacatcaatgggtttccatgtcctttggcttctggttgagttcactcagtggagaaccctggcaagaggcaggaaaaggggaggaagcagcctgaccggtttgaatttcaccttctgttcaccttggatgagagcagtaatcatcacgatcccagggaacagccaaaggaagagaaaaggcaaaagatttggacaagactcatgaagactaacagctcttggataattgagagaaggcagctgcgtgaacagttttgatgcaatcatgaaggcagggcccagtgcctgtggcatctgcctttttctggaaccaatccatatttccttgtggttttctaaggtgcagagagggcacattgggaactttgcttggggtctttttcacatcttagagggaaggtccctcaacatctgcattggcggagtgtgatcctcatgtccctctgaatgatctggacttgaggtaaccagccccttccaggaagctgtcccatgagtgaagcctcagcagcagcctctgtcagtccctcccccacagaacctttggcttccatttgaccagccttgacatccagtgtccaaacaccgataaaattgattccactaagcgtgggaaagtcctggagcatcgattgtttcctcctctgcacccccgataccctggcattagcactctcccagaatgtaccttgcttgtttgattggaggaggtcaaagccctgatgaagaatgagtggaattccacaggattggagcagtcttgataaatgacagcaggggatggtgtggggaggggaaaggatcagaggaagtgtggataaatgaatggcttaaaaaataatccacctttgcctcccccttttctaccagtctgtctagtgcttcagggtgaaaaaaaaaaaaaaaagcttgcctttctaaacatttggagtttcagaaatgatctatagagcatgtttagtttttcaagttaaaaatattaaaagaaaaaaaatgtttgagggctttactgctttcccgcaaagagctagagccacccaagcaggattgactgtcattggtttgaggtttctgtttgctttgaggctattttttccttagtgctataaactagatcagtccatttttagctgataaccctttccaatttcgctgtgaaatgaggggctggttgggtggtttttttttatgttctttccagcgttgacttttatggtctttgattccaaggtacctcgtcgactctgaagacgagagatgggtaggttctaactccagatgagccactgcaagatggtaccaggatgagatagagagtctctgtactatcttttatatgttctcaaacccagccagggatcagagtgacaatataacatggggaatcatagagatgtttatggtaattctgctatgagtcaactgagatgtcccttatggagataacttcccatactataggcagttggacaaagatgtaaatgccttgtttacaaatgctacccagatctcctaattaggaccacacatgcggagaacccaacagcttttggacttatcggccaatggtcttcttgggaaggtctctcctagtcatgggaattgtctttttattgttcaagcttttgcatagacctggaagaggcatccattgctgttacccctgagtttataatcatgctgcaagtccagtggggaactttggcacaaagcattgaatgagatgggactgcacttatgtagcctgcatttcttgagaataaagatttctgttcatttagtgcagtggttatcatctgggggaaaaccagtgagtagaggccagggatgccactaaaatccctacactgtgcaggaaagctgtcagccctttgtcccacaagagattaactggttccaaaagtcagtagtgctgtggttgagaaaccctgtttaccacctgtaggttccagagagctcggatggtggtggtcattgtgctaagtttcaaattcagtatttaggtttggtttttagcttataggcaacaaattggctgactatggggtgaaaaggaagcacctcctttatcaagattggcttcaaaagatgtctgcctccccttctggtgggtcctgtgtccattcacagtgtgagaaatggaaaggaggtcactaagagacttgcaatggatgtaataactggatgcagaaactctggatctgaagggaatgttcatgactatttcatccctcctgctgccttggagaaccaaacgcaggagccacccaaggtgaaaaccatccatttcttggagaagtgccacggtggggttgcaagtcccaggatcaagttttcgatgtgtctctttttcccgtaaagtggctgaaatctgaagctgaatctgcaagtgtcatggagtcattgaatctcacagtctcaactgataaaagttattaaaggtcgtctggttcagccttctacttgatgtggaaatcctttctacagtaactctgtgtgggaatcacagttcacttaggggcttagtctcatagtcaaaatgtcttcttcctaagtgggaaattacttccagcttctattcattcagtagttgtttaatactatctctctctctctctatatatatatgtattatatata

SEQ ID NO: 293 - DNA, 1030 bp, Homo Sapiens
ctgttatcagactgtatagaggtgggaaggctaaactgaggaattatgtctgacagaagggaaaaaatgactgtggtggccttctcagaccctgtaggaaaggcctctacctatccagtaaaagtgtctacctagattaataggtattttagttatctgacttggggcacgttgagtaaagctaatttgccagtcctgggtgggagcaaatcctggagcttgatgtgtagggaagggaggggggcctgaataatccctgaggagtagtagaatagcagatggaacactgagaagttatttccttgaggatagatttccacgatggaaaggaaatgagaggttctaagaggcaggctagtggcttgtactacagcatagcctgcctttgctggtgtgtggcgattaggcctggtggaaccgccatcaataaatcaagtgtgatcagggtgaggaacaggaaagaaggaaatatggggaaatggggtgaatgtcaggtggatcagagagatacagtcatgggggtcaggtgtggtatcaggaataatgtgggaggccagattgaaatcctggccaggaacaatggtaattgtgggacttaacaaagagtgagtacagctgaaggagctggggagcagaaagtatatgcatcaggtatgaggaagaaaatagattttggaagttatgagaaatgtagagagtgagttgagcatatttgtgattttgagggcctctgaaagtattaaagcagtggcagccgctgcacgcagacatgagggctaggctaaaacagtaaggtcaagttgtttggacagaaaggctacagggtgccgtcctggctcttgtgtaagaattctgaccgcactaaccatgcctaggaaggaaaggagttgttattttgtaagggcttgaggtttgggagattaatcggacatgatcagcagggagagcacgtgtgtttttatgagaattatgccgagatagggctgtaaagcgtgtcagggttgctgccgaaggagccatgaactgggct

SEQ ID NO: 294 - DNA, 755 bp, Homo Sapiens
acctgtctgctctctggcctgcctcagtggtctacagcagttacacacaggcagtggtatctgtgagcagctctgtggactcaaaggttttctccctgagaggcatgacccaggccagctgattcatcagaatcagatgagacgtctggggtcagagaggcagtaaccggcctgggaatccggacatgaccctgagttttgctctcagccctgccgtgtgctgtgctggaattcaggcctgaaccctgtgacctccctgccctagatcccaaatctgcccaggtttcccatcccgatggggcagagcctggtcctggcagagccactggtatagagccactggtacagatccactgacggtcctcagaacacctctgtgccctaagctgggtcctgatggtcgctgtgggccccactgaacacacatggtcccttgtccgggggagcctgctgcccttgggcagctgtggaaaatgaaggagccctggagggctggctgaggggagactatcttcccttgtgttcaaaggggtccgggcactagggttctccccaggtatttcttgctctgcgtggtcctcttgaggcctcgccctccttttgcctcgagtattcccaggagggacggtccatccagctgttctccaggaccaaggacccactgttcttcctcagtgacccaggaaaatgaagcctcctcctgttgggacggctcagaatggtggactccacagtccctccgcgagagacgtggt

SEQ ID NO: 295 - DNA, 8400 bp, Homo Sapiens
actcactgggatttctgttccagcagcctctccgttctagttgtgtatccactacacacatttttggttggtgtctacaatgcctcggctccatgctgggcactgaggacactgcaatgcaccagaaatgatccctgccctgcaggagctgcaattgcctcttggtgactgtttctgacacactttatgtggaagttggttcaatcaggaaagagacacctctttggacccccatctctcacccagtccacacttcctggtggtgactggtcggctccctagtttcctggtctggcctgagcagccggatcttctcctacgtacctgcttcatttttcctgctgcctgaagagaatcctaccaacttcacttcttggccttataggaaggagccacagtcccaaagaagtctggggagagcaggatgtggcagagaacaatgatcggtgccttgtttcaggaggcaaacgtggcccaatccagggaaatcagcagatggcatgtcatggccatcgcagatctgaggagctggcctttgggtgatttctggtccacatgacaaacattcaaggtgaattagaggagaaaagctacatgaagtgatgtgcaagttgaaaagagaaaagggtgtggtgctatccaggaaccatctaacgaaaaacctcttgcaaggcagattgagaattttaaaacaacactctccgacccaactgccccgtgacatctgttaacacaaaaggcagaactatttccaggaaaagctctcagtgtttgcaaggcatccagcaaaacagaacatggagactgaggacagaaaagagaaagaagcgtagggcaagacccctcctccaaattgcagtcctttaggaatttctggagaggtaacctggggtctccccaagcttcctgcagcccaaccaaccaacccaccaacctggctgatgcatatgtggaatatcggcttcctgttctctgaagggcaaaaaggacactgaagtatagcctacaggctctgcggcccaaagctcattaagaagataatagatttaggccagccgcagtggctcacgcctgtaatcctagcattttaggaggcctaggtgggtggattgcctgagctcaggagttcgagatcagcctgggcaacatggtgaaacctcgtctctactgaaatacaaaaaattagccaggcctgatggtgtacgcctgtagttctagctactcggggggctgaggcaggagaattgcttgaactggggagacggaggtttcagtgagctgagactgcatcactgcactccagcctgggtgacagagcaagactctgtctcaaaaaaaaaaaaaaaaaaaagaagaagaagataatagatttagaagacacacaaataattgtttaaaagaatggccctaatgtgctgcagtctgaggtggaaggttagtaaggtctggacttcctcggaatatgactgagttttcagatcacgtgagacgtcttcatggaagacattgaggtagttaccacatcttctggatgtcccacagccaacagcatatcaatttgggctccttcagacattaaaagcaggaattggattagtgtagctgccggaggtttcccactgtctccactcccagtttccacgtgcatttcctctggtgctcatcaagtgtacagtgctgctgtggtgagaatttgtcaaatgagtctccagtctcagaaggtctatgtaaatggggtttcaagtcatcacagggactgaatttagtctcaagtaccataaagaaaatacttttaaagctcttctaaaaataaagctcctctgaagagatgtttggcctgtggctaatgtgtttggaaacatgttttctgtaaaactcaaccttattcatctacttgcaaatccagaaagacaactttcactacacacatcagggcttgtcccaaattttccctactcacagtggaagatgccggggtgtgaaccattggcttaaggtgcctctgcctccctttccccaaaacagtttaggaagggagggtttgggtctagtgtccagcctgggctcagctttggatgctggcaacctggacctaggcacaccagggaggctgctttctttgcccttgtcttgccacttcccatctcccatgtcataggaggagcttggaaggagctgaaggccgtcaccttcctacaaagcagagagatcctctctccaagaacggcttttgctgccctctgggtcctgctatttccatggctcctgaagaatcagcctctgatatttcaattgccccttcatcagaactgtcaaacctggtgaatctcttctctttttctctggctcactctctctaaaacacgcatcttaaacaagttttaaaatccctgaagaatggcagaaatacaaagaactcaattccaaataatattgtcatgttctgctgcatagttgaggtaatcaccgttaagtaagtgcaggtatgggtgactctctaagacaaggatgaaagtacagtggacaggtgagcccatggcccaggactcaggcactcacagcctcccacgtttcttctctatttcacaattgctgatccaaggcgggaggggtgccattcatgtgtggcattcacatgagagaggtgggcattgtgggtcctcagtgcagggcctgttgtgtcctcaatgaacccaggattgagtcccacagtggacagactttgccaacttttataaatctctctcaagacactctcctccaatattgcaccttgaactgatgtaatttcttgtagcgaaaaaattaaaatctatcctttttgaccttcatatgcaacatgcatatcaagagagttgtcttagcagcagcaattttatattgggagatttgagcatggactggctgttgggagagctttatgaggcattccatgatgtcttggctttaattttgcttttattttgatgtgacaagatgtgttggactgagatgcctttgggctctagccctggaatttacaaaaagagaatactgcagggttatggtgggggtgaggctggaagatgttacccactcacaaagcttcagcacagcaacatatgttagaagaataaactaacattggaacagtaaatacacacatacacacacacacacacacacatacacacacacacacacagagtgggagagagtgagagagagtgcaaagccagtgttaaatcctggacatccctgcagggtcctcatgcctgcctttttctcttagtcttgtgggggtggggaaactctttggtattctcctttctcacttgtaggaatataaggaggaaaggaaccagaagtaaagtgtctgggcctctctcagccatgcttttcatttccacttattatctaaagtaattcattactacttctgtgctctcttttcatcttttccttgagcctcccctgagctcccttgaaggtggcaggtgacaggctggcttgaccagaacaaagacagttatccctggctgccgcctgtttcccaatgggtgcctgccctgtcttgttacacttcctctgtgtgtctaatttacactgcaagccctctgggcagtggctttttttttcttttttaaaaaattatctgctcttctctgcttacgactgaagtttaacttctgcaccccaactcctcctcattcttaagaaaatgccaacagaaaaatattaaaatgattgctgctgtatgtaaagacagaagggtaaaaccgaggcactggaggctttgggtgggtattgatggaggtctgggagcagctggtgattgacagggagaagagctgaattagttaaggaagggtctcctgggttttgctgggagtggtggccagacacagacaaggacaaggaagaaggccaggacctctgattgcttttctcagaacagaaaagatattattatttgaacctagaggctgggcagtttcctgtcatagaaaaactgactggcctcatggccagagaaaggtaccaactactttctttggtatttatggttctcgtatccaacgtaggaagttagggctagacaacatctggaagtatctggtagaagtatctatttatttaaatcatccatccattcatctatccatccattcatccactgatccatccatccacaatgattaactgcagtgaaagagaagacatttttagaagataaatgtggtcaaatgtcctaaagttttattcgcttgcatgcaagtaaccgtgatgtgtctggaggactggagggctggaaatgaaaggagaaaagcaattatctgggcccatggatttgggaagcagatatggggatcctctcactgctgacagagccccagtaaagcatctggaagggttttaaacagaatgagggtgtaacaatgacagacgtattcttcctccttcaaaatccacaacaaaataaacaaccaccaccaaaaaaaaaaaaaaaaaaaaaaaaaaaataggagaggtcaattcaggaaactttcctagaaaagtacatgaggtagaagagaaaggatagggaggagaccaagcattctaggttgcaaggaagacctaggggatgcctgagggtggggatgaagggactgacaaacatgttccatgggccatctatgggtagggcactcggtcgtgagagtagtgatggcacctgaggcagggctacaggaatagatgaggtagggagccctgtcagggtgcagtaagcatcccatggagaaggcacgcactgtgggcctggagcttactggggaggtggaacaagcagggaagcagtccttggtgcaagcaaggatgcacattccacatcaggctgcccgcccacgaggagggcctacacttgtggctctgaatccatgtggaggcggaaacggtctggttaagatagtgacaatgtgctttgtgtttgtgcctgaagggccagggaccacgctgtggcacaatgaaggcattgagagtcagcagtccccaagactaggtgtcctaacaagatgccaagacccagagagacaagagctgagcccttgccatgaaggtgccgagagctgtggtctcagcccttggaaatatcatcaaaagaagctgttccgagcaaaatgcattccatgtgttggccttgcccatgtgtttcttgtcaatgaggccgatcttcctgggttcagaagggtttctgtttgaaattttatgagccttggctgggaagcagaacttatccctgagtttgtgggagttaatggccttttctggcggcacaactctgggggcctcagggaattcccaaatgccaggaaagaagaaacccatagcccgtatttcaactgaaaattatgctttatttataggcagccatggagaaaagactccccagaacacttctccagcgtcacctcagtgtggtgtgtctgggctcacaggcccttccttggggtgacccttacagctcatgccagcactctgtggaaaagatatgcctcactccccagtgccaaataaagacatcagcctacatccagagcagaaacagcatttgttcctgagtcttccatttttgccatttaaatagagaagtcaaactattccttgatacactcttgtccccctaatttacttcaaccaacacgtatggggcacagactgggaactggtcattttattgggcatcattatgagcacaaagggacagatatgagatgggcaatccagaaggtcttggttcaagccatttccttccattgtctatcaagttctgtcaccgggacaaatcatttcccctccctggacctctgcctcctcatttgtcaaatgaggagcttggaccaatgaatatgaattctgaagaaattcagtgtaagaggaagagtcttaaaatactagtcctaaaaggttaattgaaggagattcatggaagtgatgcaaatattggtgttttgtatgagtgacacttaactgcttcttgtctatggcaaatgatattcctggggtagctaagaaagaccctttcgctgcctggcgtggccctctgtgaaccctgctagcctgacatgtcatatcagagctccctgcagaggagttgctgttcacagcaatcatctgggccaggctcttgacctgtacccctgtcagtgctttgctgtcttggcctgacccttggccttagctgttctctgccctttggacttggggttgctattttctcttcccatcttgattctcagttttccctcaaggtcttggctgagacccacccatggactcacctttcttttttcaaactacctcagataggatttgagtgccctgtttgatcccttgtgactcaatttctgttgctggacaaagaaaaaagaaaggcaagggaattggaaactttacagtataatactctgctcagcagtaagtattgcaccagaattttagtcaaaaggagtatgtataaaataaaccatgttagatcgagctaaaatatgactcactgagaattccaactctaggtcttagatttttcctttgaggttacacatgaacaagcctaattccttctcatatgatagatcttcacatatttaagtataatgatcgagcccccagccttcggtgaccaccccctctcctgccaagtcagttcttctctaggcaaaacaagtcaatttctctagcattcctcagatattttggttttgaatccttttgccgacgtgacggctcttcctaatccagttcaactgatttctgttcctcttcctttgaggtgcctgcagcttcatgcaacactctagacaggctccagtcaacccagggaactgaaatcttttgccttaaattgatgcttcccaaagtgtgttccattcatccaagcccctgtgacatgctctggaggtcaagggtaggtggtcacttagtttcacagtcaaatatgtttgggaaatcctgcagactaatatccctcttggagatttcagaatctgtgttagagtactaaaggatctgagtagtcctgtttacctttacttcatctaatttttcccgaattattcgaccactgagccgtttgttaaagtattactcattaacctccctagtgtgccatgaagctttgggtggcactgttcaacttccatttaagccatctgaaatcatttatttttttcctctttccctccctttctccgttcttttcttccttcttctatcacactattattacatattgattttagtgtcaatcaaacctcctacatatttttcaaacctgttgctgataaatcatatgtaaagtccttcacccttcttccctttatttgggcagctgttatttgatattcatcacttatgtattaagcatgcctttatttaagcccttaataaaaatgaaacttcataaatatttgttgaataagtacaggactgaggcctataccctttggacatggtaattcaattagctattaattatcctaatcacactaatattcagcccatgtttctctatgcttgtccgtgaggctatcttgaaatgcttgtcaaatgctttgctgcaatcagattcactatgaagttagatttcataatctaccagtctagagccatcttgttgaagcaggagatgaaattaatatggtaggactttgtacttcaggttcctgcgcaggagtttagaaacacaggtgagccttgatgggagggtaggatttaaaaaatggaggggatcataaaaaggattgtgggctggttggggtaagcatgagtaacggactacaggcaagtgtaaacatgttgggaatggttaggataaatttaacaatatttatccagtgttcactattgtgaggttttatgcagggagctggcagcaagggggttggttgagatggataaatagctaataattaactttataagtaccacttaaaagataaaatgtgatgagtgttacataaaaggaaggagtaaagtaacatagaacatttgttctgcagagtcagggaaggcttcacaatacaggtggcccctgagcagctatgaagattgggcagggctctgccagagaatgatagagggcttcaggattcaaaactttgatgatggaacagatctgtgaatggaggtgtcaatggattaacatgacttccagattcatgacctctttcttggacctgggcaaagccttgtggcattttagatggagctgggtgactggcactatgaccttgggctctgcctgaacctcacgtggatcatctataacataaaggtagtagtatgacagtgggggtgaggattgcataaacagtggaagtaaatctcccacatatcaggggtgcttactgaacctccttcctctcatctctcccagcc

SEQ ID NO: 296 - DNA, 8300 bp, Homo Sapiens
actcactgggatttctgttccagcagcctctccgttctagttgtgtatccactacacacatttttggttggtgtctacaatgcctcggctccatgctgggcactgaggacactgcaatgcaccagaaatgatccctgccctgcaggagctgcaattgcctcttggtgactgtttctgacacactttatgtggaagttggttcaatcaggaaagagacacctctttggacccccatctctcacccagtccacacttcctggtggtgactggtcggctccctagtttcctggtctggcctgagcagccggatcttctcctacgtacctgcttcatttttcctgctgcctgaagagatttcaggaggcaaacgtggcccaatccagggaaatcagcagatggcatgtcatggccatcgcagatctgaggagctggcctttgggtgatttctggtccacatgacaaacattcaaggtgaattagaggagaaaagctacatgaagtgatgtgcaagttgaaaagagaaaagggtgtggtgctatccaggaaccatctaacgaaaaacctcttgcaaggcagattgagaattttaaaacaacactctccgacccaactgccccgtgacatctgttaacacaaaaggcagaactatttccaggaaaagctctcagtgtttgcaaggcatccagcaaaacagaacatggagactgaggacagaaaagagaaagaagcgtagggcaagacccctcctccaaattgcagtcctttaggaatttctggagaggtaacctggggtctccccaagcttcctgcagcccaaccaaccaacccaccaacctggctgatgcatatgtggaatatcggcttcctgttctctgaagggcaaaaaggacactgaagtatagcctacaggctctgcggcccaaagctcattaagaagataatagatttaggccagccgcagtggctcacgcctgtaatcctagcattttaggaggcctaggtgggtggattgcctgagctcaggagttcgagatcagcctgggcaacatggtgaaacctcgtctctactgaaatacaaaaaattagccaggcctgatggtgtacgcctgtagttctagctactcggggggctgaggcaggagaattgcttgaactggggagacggaggtttcagtgagctgagactgcatcactgcactccagcctgggtgacagagcaagactctgtctcaaaaaaaaaaaaaaaaaaaagaagaagaagataatagatttagaagacacacaaataattgtttaaaagaatggccctaatgtgctgcagtctgaggtggaaggttagtaaggtctggacttcctcggaatatgactgagttttcagatcacgtgagacgtcttcatggaagacattgaggtagttaccacatcttctggatgtcccacagccaacagcatatcaatttgggctccttcagacattaaaagcaggaattggattagtgtagctgccggaggtttcccactgtctccactcccagtttccacgtgcatttcctctggtgctcatcaagtgtacagtgctgctgtggtgagaatttgtcaaatgagtctccagtctcagaaggtctatgtaaatggggtttcaagtcatcacagggactgaatttagtctcaagtaccataaagaaaatacttttaaagctcttctaaaaataaagctcctctgaagagatgtttggcctgtggctaatgtgtttggaaacatgttttctgtaaaactcaaccttattcatctacttgcaaatccagaaagacaactttcactacacacatcagggcttgtcccaaattttccctactcacagtggaagatgccggggtgtgaaccattggcttaaggtgcctctgcctccctttccccaaaacagtttaggaagggagggtttgggtctagtgtccagcctgggctcagctttggatgctggcaacctggacctaggcacaccagggaggctgctttctttgcccttgtcttgccacttcccatctcccatgtcataggaggagcttggaaggagctgaaggccgtcaccttcctacaaagcagagagatcctctctccaagaacggcttttgctgccctctgggtcctgctatttccatggctcctgaagaatcagcctctgatatttcaattgccccttcatcagaactgtcaaacctggtgaatctcttctctttttctctggctcactctctctaaaacacgcatcttaaacaagttttaaaatccctgaagaatggcagaaatacaaagaactcaattccaaataatattgtcatgttctgctgcatagttgaggtaatcaccgttaagtaagtgcaggtatgggtgactctctaagacaaggatgaaagtacagtggacaggtgagcccatggcccaggactcaggcactcacagcctcccacgtttcttctctatttcacaattgctgatccaaggcgggaggggtgccattcatgtgtggcattcacatgagagaggtgggcattgtgggtcctcagtgcagggcctgttgtgtcctcaatgaacccaggattgagtcccacagtggacagactttgccaacttttataaatctctctcaagacactctcctccaatattgcaccttgaactgatgtaatttcttgtagcgaaaaaattaaaatctatcctttttgaccttcatatgcaacatgcatatcaagagagttgtcttagcagcagcaattttatattgggagatttgagcatggactggctgttgggagagctttatgaggcattccatgatgtcttggctttaattttgcttttattttgatgtgacaagatgtgttggactgagatgcctttgggctctagccctggaatttacaaaaagagaatactgcagggttatggtgggggtgaggctggaagatgttacccactcacaaagcttcagcacagcaacatatgttagaagaataaactaacattggaacagtaaatacacacatacacacacacacacacacacatacacacacacacacacagagtgggagagagtgagagagagtgcaaagccagtgttaaatcctggacatccctgcagggtcctcatgcctgcctttttctcttagtcttgtgggggtggggaaactctttggtattctcctttctcacttgtaggaatataaggaggaaaggaaccagaagtaaagtgtctgggcctctctcagccatgcttttcatttccacttattatctaaagtaattcattactacttctgtgctctcttttcatcttttccttgagcctcccctgagctcccttgaaggtggcaggtgacaggctggcttgaccagaacaaagacagttatccctggctgccgcctgtttcccaatgggtgcctgccctgtcttgttacacttcctctgtgtgtctaatttacactgcaagccctctgggcagtggctttttttttcttttttaaaaaattatctgctcttctctgcttacgactgaagtttaacttctgcaccccaactcctcctcattcttaagaaaatgccaacagaaaaatattaaaatgattgctgctgtatgtaaagacagaagggtaaaaccgaggcactggaggctttgggtgggtattgatggaggtctgggagcagctggtgattgacagggagaagagctgaattagttaaggaagggtctcctgggttttgctgggagtggtggccagacacagacaaggacaaggaagaaggccaggacctctgattgcttttctcagaacagaaaagatattattatttgaacctagaggctgggcagtttcctgtcatagaaaaactgactggcctcatggccagagaaaggtaccaactactttctttggtatttatggttctcgtatccaacgtaggaagttagggctagacaacatctggaagtatctggtagaagtatctatttatttaaatcatccatccattcatctatccatccattcatccactgatccatccatccacaatgattaactgcagtgaaagagaagacatttttagaagataaatgtggtcaaatgtcctaaagttttattcgcttgcatgcaagtaaccgtgatgtgtctggaggactggagggctggaaatgaaaggagaaaagcaattatctgggcccatggatttgggaagcagatatggggatcctctcactgctgacagagccccagtaaagcatctggaagggttttaaacagaatgagggtgtaacaatgacagacgtattcttcctccttcaaaatccacaacaaaataaacaaccaccaccaaaaaaaaaaaaaaaaaaaaaaaaaaaataggagaggtcaattcaggaaactttcctagaaaagtacatgaggtagaagagaaaggatagggaggagaccaagcattctaggttgcaaggaagacctaggggatgcctgagggtggggatgaagggactgacaaacatgttccatgggccatctatgggtagggcactcggtcgtgagagtagtgatggcacctgaggcagggctacaggaatagatgaggtagggagccctgtcagggtgcagtaagcatcccatggagaaggcacgcactgtgggcctggagcttactggggaggtggaacaagcagggaagcagtccttggtgcaagcaaggatgcacattccacatcaggctgcccgcccacgaggagggcctacacttgtggctctgaatccatgtggaggcggaaacggtctggttaagatagtgacaatgtgctttgtgtttgtgcctgaagggccagggaccacgctgtggcacaatgaaggcattgagagtcagcagtccccaagactaggtgtcctaacaagatgccaagacccagagagacaagagctgagcccttgccatgaaggtgccgagagctgtggtctcagcccttggaaatatcatcaaaagaagctgttccgagcaaaatgcattccatgtgttggccttgcccatgtgtttcttgtcaatgaggccgatcttcctgggttcagaagggtttctgtttgaaattttatgagccttggctgggaagcagaacttatccctgagtttgtgggagttaatggccttttctggcggcacaactctgggggcctcagggaattcccaaatgccaggaaagaagaaacccatagcccgtatttcaactgaaaattatgctttatttataggcagccatggagaaaagactccccagaacacttctccagcgtcacctcagtgtggtgtgtctgggctcacaggcccttccttggggtgacccttacagctcatgccagcactctgtggaaaagatatgcctcactccccagtgccaaataaagacatcagcctacatccagagcagaaacagcatttgttcctgagtcttccatttttgccatttaaatagagaagtcaaactattccttgatacactcttgtccccctaatttacttcaaccaacacgtatggggcacagactgggaactggtcattttattgggcatcattatgagcacaaagggacagatatgagatgggcaatccagaaggtcttggttcaagccatttccttccattgtctatcaagttctgtcaccgggacaaatcatttcccctccctggacctctgcctcctcatttgtcaaatgaggagcttggaccaatgaatatgaattctgaagaaattcagtgtaagaggaagagtcttaaaatactagtcctaaaaggttaattgaaggagattcatggaagtgatgcaaatattggtgttttgtatgagtgacacttaactgcttcttgtctatggcaaatgatattcctggggtagctaagaaagaccctttcgctgcctggcgtggccctctgtgaaccctgctagcctgacatgtcatatcagagctccctgcagaggagttgctgttcacagcaatcatctgggccaggctcttgacctgtacccctgtcagtgctttgctgtcttggcctgacccttggccttagctgttctctgccctttggacttggggttgctattttctcttcccatcttgattctcagttttccctcaaggtcttggctgagacccacccatggactcacctttcttttttcaaactacctcagataggatttgagtgccctgtttgatcccttgtgactcaatttctgttgctggacaaagaaaaaagaaaggcaagggaattggaaactttacagtataatactctgctcagcagtaagtattgcaccagaattttagtcaaaaggagtatgtataaaataaaccatgttagatcgagctaaaatatgactcactgagaattccaactctaggtcttagatttttcctttgaggttacacatgaacaagcctaattccttctcatatgatagatcttcacatatttaagtataatgatcgagcccccagccttcggtgaccaccccctctcctgccaagtcagttcttctctaggcaaaacaagtcaatttctctagcattcctcagatattttggttttgaatccttttgccgacgtgacggctcttcctaatccagttcaactgatttctgttcctcttcctttgaggtgcctgcagcttcatgcaacactctagacaggctccagtcaacccagggaactgaaatcttttgccttaaattgatgcttcccaaagtgtgttccattcatccaagcccctgtgacatgctctggaggtcaagggtaggtggtcacttagtttcacagtcaaatatgtttgggaaatcctgcagactaatatccctcttggagatttcagaatctgtgttagagtactaaaggatctgagtagtcctgtttacctttacttcatctaatttttcccgaattattcgaccactgagccgtttgttaaagtattactcattaacctccctagtgtgccatgaagctttgggtggcactgttcaacttccatttaagccatctgaaatcatttatttttttcctctttccctccctttctccgttcttttcttccttcttctatcacactattattacatattgattttagtgtcaatcaaacctcctacatatttttcaaacctgttgctgataaatcatatgtaaagtccttcacccttcttccctttatttgggcagctgttatttgatattcatcacttatgtattaagcatgcctttatttaagcccttaataaaaatgaaacttcataaatatttgttgaataagtacaggactgaggcctataccctttggacatggtaattcaattagctattaattatcctaatcacactaatattcagcccatgtttctctatgcttgtccgtgaggctatcttgaaatgcttgtcaaatgctttgctgcaatcagattcactatgaagttagatttcataatctaccagtctagagccatcttgttgaagcaggagatgaaattaatatggtaggactttgtacttcaggttcctgcgcaggagtttagaaacacaggtgagccttgatgggagggtaggatttaaaaaatggaggggatcataaaaaggattgtgggctggttggggtaagcatgagtaacggactacaggcaagtgtaaacatgttgggaatggttaggataaatttaacaatatttatccagtgttcactattgtgaggttttatgcagggagctggcagcaagggggttggttgagatggataaatagctaataattaactttataagtaccacttaaaagataaaatgtgatgagtgttacataaaaggaaggagtaaagtaacatagaacatttgttctgcagagtcagggaaggcttcacaatacaggtggcccctgagcagctatgaagattgggcagggctctgccagagaatgatagagggcttcaggattcaaaactttgatgatggaacagatctgtgaatggaggtgtcaatggattaacatgacttccagattcatgacctctttcttggacctgggcaaagccttgtggcattttagatggagctgggtgactggcactatgaccttgggctctgcctgaacctcacgtggatcatctataacataaaggtagtagtatgacagtgggggtgaggattgcataaacagtggaagtaaatctcccacatatcaggggtgcttactgaacctccttcctctcatctctcccagcc

SEQ ID NO: 297 - DNA, 734 bp, Homo Sapiens
tatttccttaagataaatttctcaaagaagaataacatttatctagatggatatttaccaaattccacctcactccctcagaatttgatgcctctttcccaggtccttatgaacattctcaatgacagtgtttaaaagtgttggttttcccttttcttcatcaacactaggtattgccatttgttagcataaagagtataatctttgccattctgatatatagaaaaacagttacatatcactttaatttgtatttcttcaacagctagtagagcaaagtcttttattacatgtttctggtcatttgtaattgcttctggcaacaaacaaacaaaaaaccttaagcaattttttaaaagcccatgacattttattttaaaggtccattttaaagcaaaaaagtaaaattgaatcattgccataatcagattacttttaattaaagcatttcacacctagagccctcttgggaaggtatgaagtttttacttcaactaataatccattcttctgtaacctaaatggttcctatttgaacaatgaaacatgcattattcctttaggacacatgatcagtagcctcgggataaaaacaaaaccagaaatattcagtgtttggatagataaaatggcaacaacatttcttcctctgattatatctgcttcatctgcatgcagttttgcattgggcaatagatcttgtgtttcaatactgattggtatgaattccaaaa

SEQ ID NO: 298 - DNA, 1524 bp, Homo Sapiens
ggagttacactgtttgtgatatggtacatgacctggtcaatcttaggctctgaagctctccctggtggaaatttatttggattgttaattattttttatagtgccattattgggggaaaaaatttacaactcattagaatacctttagtgccgccatttccacctcttcttgggatgttactggctggttttacaattaggaatgttccattcatcaatgaacatgtccatgttcctaacgcatggtcttcaattttaagaagcattgcccttaacattattctaatacgagctgggcttggactcgatccacaggcttggaggcatttgaaggtggtttgtttcagattggctgtaggtccatgccttatggaggcaagtgcagctgctgttttttcccacttcattatgaaatttccctggcaatgggcaattctattaggttttgttttaggtgctgtctctcctgttgttgttgtcctttacatgatggtgttgcaagaaaatggatatggtgttgaggaagacattccaacctactaatggctgctagcagtatggatgacattctggctatcactggattcaatacatgcttgagcatagtcttcttctcgggtggtaagcttaataacgccatagcctctataaggaacgtatgtattagtcggctggcaggaattgttttgggattttttgtttgatattttccaagtgaagaccaaaaaaacttacattgaagagaggattccttgttttgactacgtgtgtttctgctgtcttaggcagccaacgtattggtttacatggatctggaggattatgcacattagtgttgagtttcattgcagggacaaaatggtcccaagaaaagatgaaagtccaaaagattattacaaatgtatgggatatttttcaaccacttctttttggtttagttggagcagaagtatctgtttcatcgcttgaatcaaatattgttgcatatctgttgccactctgagtttggcattatgtgttcgaattttaaccacatatctattgatgtgctttgctggttttagttttaaggagaaaatatttattgctttagcatggatgcccaaagctacagtacaggctgtgttaggtcctctggctctagaaacagcaagagtctctgcaccccacttggaaccatatgcgaaggatgtgatgtcagtagcatttttagccatctcgatcacagctccaaatggagctctacttatgggcattctggggcctaaaatgcttacacgccattatgatccaagcaaaataaaactgcaattgtcaacattagaacatcattaaaaagtttacctgtcatcatctgcctgcttcttttaatgaattatttcacatgacagaagaattttaaagtagaaatatgtagggactgtacagaaaatccaggatttagtaaacatgtgatttcagtacagggcttttcttggactttttactccaaagttaatttaataaaaataatattaaatggaa

SEQ ID NO: 299 - DNA, 12631 bp, Homo Sapiens
gctgtgttctcatttcacccaagacctttggctagatcagaacataaaaaattcatttcaaaaagtgatactgagaagatatgagaaatctagacatgagaatttacaaataagaaaaggctgtaaaagtttgaatgcatctaagttgcaggaaggaggttataatggacttaaccaatgtttgtcggttactcagagcaaaatacttcaatgtaatacatgtgtgaaagtctttaggaaattttcaaattcaaatagacttaggagaagacatactggagagaaacctttcaaatgtaaagaatgtggccaattctttcacaggttctcacacctaagacaacatgagataattcatactgaagagaaaccctaccaacatgaagaatgtggcaaagattttaagcagtcttcaggtcttactatacatgagagaattcatactaaagagagaccctacaagtgtgaagaatgtgacaaagcctttaaacaatcttcaaaactgaataaacataagaaaatttatactggagatacaacctacaaatgtgaagaatgtggcaaagccttttcctattcctcaaccgttactcaacataacatagttcatactgaagacaaaccctacaaatgtgaagactgtggcaaagctttgaagtagtcttcaaacctgactatgcgtaagattattcatatgggagagaaaccctacaaatgtgatgaatgtggcaaagcctttagaatatcctcaaaactgaaagaacataaaagaattcatacttgagagaaaccctataaatatgaagaatgtggcaaagctttttactgttcctcaggccttactcaacataacatagttcatactggagacaaaccctacaaatataaagattgtggcaaaatttttaagtggttttcagaccttactatacatcagagaattcatagtggagagaaaccctagaaatgtgaagaatgtggcaaagcctttaaacaatcctcaaaactgaatgaacatatgagaactcatactggagagaaatcctacaaatgcgaagaatgtagcaaagcttttaagcaaccttcaggccttactctacataagagaattcatactggagagaacccttacaaattcgaagaatgtggtaaagccttttattggttgttaagctttactaaacataattgataggggagagaaaccctacaaatgtcaagaatgtggcaaagcttttaagtggtcttcaaaccttactatacacaagagaattcatacgggagagaaaccctgcaaatgtgaagaatgtggcaaagcttgtaagcagtctttgggccttactatacaaaagagaattcataatgaagagaaaccctacaaatgtgaagaatgtgataaagccttttactggtccttaagctttactaaacgtaagatagttcatactggagagaagcactacaaatgtcaagaatacgtcaaagcttttaagcgtcttcaaaccttactatacataagagaattcatactggagagaaaccctacaattgtgaaaaatgtggcaaagccttttactgttcctcacaccttattcaacataacatagttcatactgaagagaaacactacaaatgtcaagaatgtggcaaagcttttaagaagtctttagaccttaatgtacataagataattcatagtggagagaaaccctacagatatgaagaatgtggcagtctttaaacaatcctcaaacctgaatgaacgtaagataactcatagtggagaggaatcctacaaatgtgaagaatgtggcaaaggctttaaacaatcctcaaacctgaatgaacataagataactcatagtggagaggaatcttacaaatgtgaagaatgtggcaaaggcttttactgttcctcaagccttactaagcataagatagttcatactgaagagaaaccatacaaatgtgaagaatgtggcaaagcttttaagtggtcctctgaacttactatacatcagagaattcatactgaagagaaaccctgtaaatgtgaagaatgtatcagagtctttaaacactcctcaaaaccgaatgaacataagagaaatcatactggagagaaaccctacaaatgtgaagcatgcggcaaagctttttaagcagtcttcaggccttactatacataagagaattcatactggagaggaatccagaaatgtgaagaatgttgcaaaaccttttactggtctttaagctttactaaacataagagagttcatattggagagataccctacaaatgtcaagaatgtggcaaaactttttcttgttcctcaagtttactcaacataagagagttcatactgaagagaaatcccacaaatgtaaagaatgtgggaaagcctttaaccagtccttaagccttactaaacttatgagaattcatactggaaaaaaatcatacaaattggaagactgtggcaaaatcttttaagtattgctcaaatatatccagccataattcatactaaagattatgcctatgaacctaaggaagtttggcaaagcttatgaatacacctcaaactttcctaagccttggagaaatatcagtgagaaacctcagaaaactgaacaatgtggcaagccctttaaatggttgtcacatcttactgtaggtaaaataattgatagtggagaaaatctctacaaacaaagaatgtgtcaaaacttctaacatgctcatactttatggcacataaaagcgtttatacttgaaaaattatacagagtgtggaaaagccatttctatctgctcacatcatagtcaacatcaggaagttcatacttaataaaattattataaatgtaattactgttcaaagaccttggaaaatataaacccttaaaataaaaaagagtattctggagacaaacattacaaatataaagagggttgtaatacctttacttgccctatataatgtacagattttacactagaagaaaactctaaaggaattactcaaacttgtttggcatcagagaatttatgttgaaggaaaccgtacaaatgtaataagtgtggaaaaacatttgttcagaaactacagcttacaaaacaccacacagtttataataaaaaatatttttgcagatggaatacatatgtaaaaatatttagtcaaaattaagtctttgtaaactttagaaaattcacggtagggagaactaaggcactggcacttaagacgttacactaaatcagaatgttctgtaaagaaagtaatccaaagctaaaactgttggataatttatttgtatataagtttaagaggagtggaaggttattttttggagagttaaaattacattcaaggtatacgtttttccttgaaaaaagtgtaagttttttgaaaagcaagtaggtaattcaactgtaaaattgcttcatgctgttccttttttcctgttgtttgtgtaaaagcatgtcatcaatttctgttgcatcagaaatctgagagattcctttcttattaggtaggcatcattcattaatttttccatggaagagtaaggatattaaaatgtaagatgataatgaaaatctgattggagaggctctttatggctgacttttaacattgttcatgtgatgcatgagttatgtgtttagagtaatattctgcattatagtgagaggaaaactttgagttttagtagtaaattgttttaccaattgtacttttatgtaataaaatgtagggaattttaaaattcttttataagactgtgataacttaacttttaaattaaacgaaatggttttaaactttttaagacgtgcatttagtaaagtgttatgtcaccaactttaacgtatcccactgtattaaagatgtagataaaagatggtaacatagtagaatgacctctctagcaatctcttttgcctgtggcattaaactgaaaagtttaacagtattgtttcaatgggtaaaatgtacatttgtttaactttttaaatttttgtaggaacataatattgtttacctatttatggcatatatagaatattttcatacaggcatacaatttgtaatcacatcagagtaaatgaggtattcattacctaatgcattttttttgtattacagacaatccatttaaacatttttagttatctaaaaatgtacaagtaaattattacttgctacagaggttttttatcgtcttgataataattacatagtagtataataaatctcacatttctaagtcctgaatgaatatttttaaaaatttgtcatatatattttgaacaagtggactctctgcctgtaaactcatgcagactgttagtttttacttacatgatgctaaatatacaaatatattactcttaagataaacattaggtgtaagaaaattgtggggcaagtaattgtgtgtgagagtacctattttcagaagacaagcaatattggaacaaaatatcactttaataaagtggacaaatcatttactagaaaaccagaaacctcagtgattttgaataatatctgtattctctgcattttatttaattaattactgtgaagtcttatggactgtgtttccgaatctttccatgcaaattctttctttcatttgcctggtactcatggtagactgattttttttttcatattttttgtgtttataatttattaagtattcattatgtgagttgctcagatattctaagaatttttataaaatttagtaatgcatgcaaaataatttttcaatgttatttcacaatgagtgtattaacttatatttcttttgttgctttcttttttcttttttttttttttgagatggtgtcttgctctgtcacccaggctagagtgcaatggtgggatctcagctcactacaccctccacctgctgggttcaagcaattctctagcctcagcctcctaagtagctgggactacaggcatgtgccaccatgcccagctaatgtttttgtatttttagtagagactgtgtttcactatactggccagagtggccttgaactcctgacctcgtggtccacacacctcatcctcccaaggtgctgggattacaggcgtgagccactgcatctgaccaacttatatttcatttagttagaacatcccattttgttattttaattggagaaacctgtgtaagctaagtttccttattgttccttttactctttataattgacataggtgaatttattcattcagccaatttgtttaagtaaatactggggaggcttcataagtcacaaagatattttgatatgtaaatgtagcaaacacaatgcttgctgtaatagaggcaccattattggccataaatatttctgctggagttagtttgtagctccaagtaaagataaagaaatatgcgtggtgaagaaataaaatcgattctgtatgtggagaggacgttgttcttatgctgcaaaactgactctttctgaatttaaagagacattcttcttattttctgattatctttagttttgtttttgtgtctacttatgtttatcccaactgtgtatgcatcacagcccttctttttcttctttgtgttatggctacatttttattgctgtttgttttgtgccatgtcatttcacacagtactttgtaggttctgatgagaagtttgtcaatgtaactttcagatccgttaattgagataaaaggcatccggtgttcacaggtgagaggaataaatcagtcagaatttcttgtctttgtaaaaccaaacttttattaaattttaacacagtctgtgtgtggtggctcacgcctgtaatcccagcactttgggaggctgaggtgggagaatcactaagtcaagagattgagaccttcctggccaatatggtgaaaccccatctctactaaaaatacaaaaattagctgggcatggtggcatgcacctgttgacctagccattcaggaggctgaggcaggagaatcgcttgaacccaggaggcagaggttgcagtgagctgagatcgcaccactgcattccagcctgatgacagagcgagacttcatctcaaaaaaaaacaaaattaacacaatgtgtggaaaatataaaattagttagaagatatgtcttagaaattaaacttttagaagagttaatggtaagtggagaatgttaaattttttattacatacttacagctcaacttaagttttcattcagaatcttttattttggtgtgaatgttaaatattcaaaaataatagaatgacacctgtggatttcacatgtgaagtaatctttttcatattaacattaaaatcttgaggaatttctcacacttgtataatgtacttttttattgggtgcagtttacaatttagaggtttcattctttgtcacctaactagtcaactccttggtcattttatctggaaaaattttaaggatcatgtcatcttttgagttaaaaaatttcttcagtgatctgggatgcaaacttatttactctcttcagagtggtttaatcatgtgaaccacagcaacacctgccctttttgtgtcttccctatcattaccaccagcaccagaaactccaggtgtcccaagctcaaagtaaaaggcctaaggtacgttggcttctcccatattctgtgctgggtcccaaaaacatggtggtaaatattagagttcatatggtcatgactgactaggtgaaaaaacagcacaaaaactatgtatctttcatactattcagacaggtttatgacaaaaacacagagtcagaatttgaacctttgtcatttttaatagtttttataaatatatttttaaattcactgataaaatatgtatttattttgtaaaatagtattttgaagtaaatatacattgtcaatgcctaattttaggtaattgtcaagtgctttgcctcacatagttactttttggtgcgaagacaacatttactgtcttagcattttttcagaaacacaatacatgcattataatctcttgaacttatttttcttatccaactgtaattatgtaatcaatatatgttttgtagaatccacatgtgagtgaaatcatgagatattaacctttctgtgccttatttcaacaactatagtgtcctttaggcttatctttgtgattaaaaataagattttttgtttaaaatatagtattccattgtatatatacaccatagtgtgtgtatttcctcattggacgatggacacatacgttgattctatattttggcttctgtaaagtgtgctgcaacaaacagaattgcagatgtctgttcatcaatctagtttcatttgttttgtgatagatatccagtagttcaattacatgttagattttaattgttttgcaaaatttctatttttcataatggctgtttttatttacattgacacaaacagtgtgaaagctttcctctttctcttttttcaagtttaccaacaattttttttaaacattctaacaggagtgagtttatatcttagagttgttttggtttgcctttccttgatgataattgactgagccatattcatctatctgccaagctataagtatgtctttctttgaaaattatttatatagatcttttgcttatttttaatggttatttgttttttgttttatagtcctttgagtttcttatgtatttttgatattaactgcttttcacatgtataatttgcaaatattttcttccatttttcagttatgtcattctgctgattgtatctgttggtgtgcagcagcttcttaattttaagaaatctggtttgtctatttccccctaaaattttgaggttaaacccaagagtcactgcccagaccaatgttatggggcattcattctatatttcctcatcttagttttagattttcaggtctcacatttaagtatctaatttgagttaatttttatatatggtgtgagatgaaggtctgattttattattttgcatgtggatatatattttctcaacatcgtttataaaagactttttttttaaattgtcatctttatttacaatcagttgtctgtaaatacatgaatttatttctggtctttctcttttgctctattggcctatgtgtccatttttatgcaagtaacactctgttttgattactgtagctttgttggacatttaaaagtcagagtgattccttcagccttttatttttcattttttgcttgattttcttagctattcaaggtcttttgtggggcaatatacattttagattttttaaaaacacttctatggagaatttaactggattttaatagaagttttattatatctgtatatcagtttgtgtaatgcagttatttaacaatattaatcgtgcccatttatgaattagaaatatctttttgtttgaatattatttattttctaaattcttttttttttagattataatgtaccgatcgttcacctttttggttacattcatttctaagtatagttactgctgcaattattgtagataggattgttttttggttttattttcagatactttattgttagtatatagaaatattacggaatttttttatgttgattttggatcctgcaagtttaataaatttgtatattctaataattttttgtgaggtcctaggtttttctatacttaagattatatcatctgcaaggaaactataatttatcttcttcattttatttaagattgctttgattttattgaatattttttctgtcttggtcattttgtattatgttcagtaagatcgaagaaattgggccaggcgtggcggctcacacctgtaatcccagcactgtgggaggcggaggtggggggatcacgaggtcaggagatcaagaccattctggctaacaaggtgaaaccccgtctctactaaaaatacaaaaattaggcaggcgtggtggcacgcacctgtagtcccagctactcaggaggctgaggcagaagaatggtgtgaaactgggaggcagagcttgcagtgagccaagattgcaccactgcactccagcctaggcaacagagcaagactccatctcaaaaaaaaaaaaaaaaaaaaagattggagaaattggacatccttgtcttgttctagctcttagagaaaaggcttacagtttttccttatttagtatgttgttaggtgtgcattgttgttaatgacattaccttgaattgcatttattttataactagttcaagagatttattatgaggagatattgaattttgttacactttcattatgcatctatttgaatgttacagttgtgacagccaatcccacaaaaatacaaaagatgcttgcagactactataaatatctgtgtgcacaccaactagaaaatctagaggaaatgaataaactcttagaaacatacaacctcccaagattgaatcaggaataaacagaagtcttcaagaaaccaaaaatgtgtaagtaaattgaattggtgataaaaaaaatctaccaattataaaaagtactaaaccagatgcattcatagcatgattttatcacatatacaaaaatgagttggctgtaattctacagaaattattccaaaaaatcaaagtgggactccatcctaattaattctatcatataatatcactgtcatcttgatatattaacctagtaaagacacaacaaaaaaaattacaggccaatgtccctgatgaatacagacccaaaaattattcatgaaatgcttgcaaactgagtcaggaaatcaaagttatttcactgcaactatgtggacattattctgtgaatgcaggaatgttttaacgtgcaatctataaatgcgattcaacatataaaaataattaaaaaacaaaaccacattatctcaatagatgtggaaatagcaattaataaaatgtaatatctatttatgaaaaaaattctcaaaaaactaggcattgaaggaacatacctcaaaataataacagccatataagacaaatcctcagccaacatcatactgaacaggtgaaagattaatgcatctttcctaaaaattgaaataagaaaagaatgtgcactttcaccactcctattcaacatagttctgaaggttttagccagaacaatcaggcaagataaagaaagaaaaacactcaaataagaaaagaggaagtcaacttatctgtctttactgatgatataactgtctacctacttcaaagactcctccaaaagactcttaagcctaataaaagacttctgcaaaatctcagggcaacaacaacaaaaagcaaaacaacattcaaaaatgaggaacatttctatacaccagtaacacttaaacagagcaaaattaagaacacaatctagtttacaatagccagaaacaaaaaataaaatagtgatccattaaacaaaggaggttaaatatctctactagaagaactacaaaccactactgaaagaaatcagacacagtgcaagtaagtggaatagtatttcatgctaatggattagaattattaaaaagttcatactgcccaaaacaatcaacagtttatttctatttctatcactctaccaatgccatttttaaataaaattagtcaaaaaactattctaaaatttatatgaaaacaaaaaagctcaaatagccaaggctatactaaacaaaaagaataaacctggtgacattatgttaccaaacttcaaactttaccacaagctacggtaaccaatataatatggatgcagatacacacacacacacacacacacacacacacacacacacacacacacacccttacggaacagaagagagcactgaaatgaagctgaactcttaaaattaattgatttttgacagcatcaacaaaaacaaatggaaagaactccctacccaaaaaaaggtgctggaaaaactggttagtcatatgcagaagaggaaatcgcaacacctacttctcatgatacagaaaattaaatcaagatacattaaagacttatctgtaagtgttcaacctataaaagtcctagaagaacacctagaaaattctctccttggcgttggtctctgtaaagaattaatgactacatcctcaaaagtgaaagcaacaaaaataaaaattaaaaattgtgacctgtacagcaagagaaactattaacaaaataaacagacaacgtacagtatgggctaaaatacgtgtaaactgcatacaataaataactaatatatacattttataaggaatttaagaaaaaatgttgacaaaaatgtgaacatatacttttaaaagaaagacaaaaaaagcagccaacaaacatatgaaaaattgatcaacatttctaatgattagagagatgtaaatccaaaccacaatgtgataccatctcaccccagtctaaatggctattattaaaaagtaaaaaaaaaaaagttaaaattatgtagaaaagagaaccctgatatactcttagtgggaatgcaagttagttcacctcctgtagaatgcattttggggatttctcaaaggactaaaactaaagttaccatttgacccagcagcttcagtactgggcatatacctcaatacaatacaaataaattattctaccaaaaatacacctgcactcgtatgtttattgcagcactagtcacaatagtaaagacatggaatgaaaccatgtgctcataaatcttaagatggattttaaaaattaggtaattacacaccatccaatactatgcagccactgaagaagaatcatgtaatactctttgcagcaacatggatgcagctcaaggtcatgatcctaagcaaattaacacagaacagaaaaccaaatactacattttctcacttataagtggaagctaaacattgggtacacatggaagcaaagatgagaaaaataaacactaaggattcgaaaatggagggagaaggggtacaagggttaaaaagtacttgtcatgtataatgtacactacttgggcaatgggattattaattgcctaaacctcaacgtcatgcagtatacctatgttacaaatctgcacgtgtatccttgaatccaaaatacaaataataaaatactttgtgatataatgccatgttagatttctccagttttggttaatggttggaattaagggtggaagacatagaattttgtcccctttagacataggggtgaatgtttctataacaggtctcctgacatcctataagctattttctctgaaagctctcggccttagttttgagtgtgcagctaaaataaatgactgtacatcaagcttgtccaactcatggcctacgctccatgtggcccaatatggctttcagtgcagccctaaacaaatcagaaactttctaaaagcattatgagttttttgtgattttttaaatcatcattggtgtattttatgtatggctcaagacaactcttctagtgtgtcccagggaagccaaaagattggacaccccagctctacatctttatttttcatctatttacagtgcactaggtgatagtgtttatttattactctactcctttgggaaaaaaagatggtca

SEQ ID NO: 300 - DNA, 3483 bp, Homo Sapiens
cagaggctagagctcaggctcaagcaggccaagaaggagttaacctccaaggagaatgcgggcttctcccagactggaggtctgtgcccagttttgctggtgccaactccgggaagaagtcctgggatctgtagtttgtgccaccacccacccctggcctgcctgtttatcaacacggtcttgtagactacagttcccagaaacctgcagaggctaggctttgggggaaggggtggggaaggaggctccgtggcggccagagggagagggagagggaggaggtggggagagaaaacccaattcacccccttcgtttttaattctttctcctggtgtgtctgctccaccgcccgagctaatcccccaaatccggtctcctaagccgcagctgcttcccttcgcagtgatgaatggctcagggagggaagatctctggtgagtgttcccccagcctggcgtagggcatgccccagttcactttcgcctgcttctgtggtctccacggcttctgcaaaatgaagaggaagaaggaggaagttcacagagagcgggagacggcggtgtgatcagaaccagggcccctccatcaagcccccagcaggtcccaggcctgatggtgcctgcttctggctggggcttggagcaggaagccgtgtgtgtatcttaagtcttgatttagccagtgctcttctcagcctgactctcacccgagggcatcagcctcctgtgtgcctctcatcctcctcatgcccacacccattagcttccaattctcagacctccttggagagaggccccagccacacaagggggaaccccaggacctgccgcatgccttccagagactgagaagccccagggaggccaaggagtgaaacttctttcctgccctgagagcttcgggggactcttctcagggtaaccgcatgaggcatgtgccgccttgggctaggagagctgttgctaaatgggaaactggctgctctagcagagaacttccagcagccctgaccctggagaaggcctccagggcggaagtgtgagactctcctgggattccaggacctggggcaagaatccttttccagccccctgccagcatcctcctgggccaggtggggccaggcctgaggtggccagcccagtgaggaggaaggcagaggtggccagtggctccgtggctccctctgttcttgctctccagaaagcagtgtttcctccagccccggccctgacccacccgtgttcatgatgcctgtgcctccttgccagcatcacagatgtggggaggcctgttccccaggccctgactcccctcctcagggactgtcttgccgtggccagactgagggacccctttcctggactgagccgtgccctcccttgattctcctgtctcccctgcctttttcttctctcctcagaagccatagaggggactgcgttcatatgtggtgccttcagtggaaactcttagggtggggggacctctaggaccttcctcgactttttccctcatcccccacccccgccaaccttccagcttcagcctctgcccttacccccagcccatttccaggaggtaggaagcaaaagaaaaaagcatttccttccctctttccttcttccttccttcctctctcccttcattttggtataacttagccttttgtctttaatcctggagttctccggggctagaagacaggcagagacgaatgccagcagcagagatgcttcaggcagattctgtaagcctgttctccctcatcagggagcagctcagccaaggagcaaagtcagaccccctctagctccccagggacagaatagcccttctgacaggtaaacaggtgacctgggtagagagggcaaggccccaagataggagagtcagggctcccctttccttggaatgtgggcctctctgggcaactagggagggcaaaagtcttcctcggctggttcgcccaaaacctgggagaagcaagggcacattctatgctggcagcctctgcctgcccagctcatgcccacactcaggggcctttcctgggctttgggcagattgggtgggattcaggttgtctttatgaggcttgagcacagcttgagttcctcctcccatcctccaaccccttcctttgcccctacctcctagcccccaccttctacaatctgttatttccttttatatccaaagaattataaacagaagtccttccctcaagggaacagcaagattcagcaataaaggccagtggggtcacaaaggacagaagaaaaactccctggttctttgtcctcttggatagtagaggccttgggtgaggcaaagagatgggcagaaaaagttaccttgatacagaggccagagagcctcctggagggcatgtgtttccctagcggtcacctgcgaggctgcaatcctagaaaagtcacttctgtggcagaggatgaaattgtatccccggagactcagagatattgggtgttatgtcctgaccacacaggctcaccaggaggaaaggttaggaaagtggagaaagtacgtcctggggagcgggtggccgaggagagctttccccttgtgcgcctctcaggccttggcagggattgcagctgcaggggtttggcagtgagcccatccagagagcttcctcccccgggagaactcccttggctccagagggatactagatatcttgagccctggctttgggaacatgggtggggtcccaaggtcaaagtgttctgagtggaggtccagttgtcctctgcctccaagccggcagccccttcttcacccagggctgaggttggggccagcactgcagctggaattgtctgagcaggaggtagcagcttctagccaggcacaccccaaccccacattctattgtccctcagtttccttctcaggaaaatggggactttgctccttttagcatctcaggaagcagtctggacacctgtgccctcctctaggcccttggatgagcccagggaatagggaaaggccaaagcagccccagcattcgcagaccctgcgccctgggcctctgacttcgggccaggcttctgctccttctagggttggcctggctgccctgccttcccatcctctctccatggttctctcccagagactccaccttgaggtgggggccctgagctcttggggtgagggaggggcacatgggtagatgattctgtggaggagatcaggcctcttgttcttgctgcgtggcactgattcctccttgcagatgggtgagggggccagttttccccatctgtaaagcgaggacttcccatggccattttccctcttgggcttcaggctgctgaatggaagatcaagaagtgtgaagggtgcttggggtccttgtgacttgagtgttgcctaggaccctggcccacaggacccaaggggcttcttgtctcaggttgaaacctttttatcagaatgtcatttccttc

SEQ ID NO: 301 - DNA, 6111 bp, Homo Sapiens
agtgaagaagggaatgagggacggaaagagagagacagcgaagagaggagaaaggtgagtgcattctggaaatcaccggcagctccgctccgcagaaaggccttggcctgtgccatctgagggtgaagttacgtggttatcaaattccccttccctggagcccctggcaagaagttgatgccagaaacagacggagggggtgcgaggagggagggaatcagaccttttgtttctctttttccccctaggacctggtctcatgcttctccccctcatctctcccagggcacccctccgacccccgctgcgaggggtttcccgcgggaggtggacgaagcgtgggccaggacaggcgcctggcactggggtttcagagccgcgagtaggccctgaaggccgggagggaccgccagtccccactggaagccgcttccgtgcagcccgggacagcatctctgaggttggggtgcatcttaacatcattgtccacaaactgtcctgtgctgtcattttccctgtgtctgaacaaacttggtagttacacccgtgacttgattgggtgacctcaacctttgatgtttcagtcaatgaaccattcaggcatcattgagatcattttcatcttgcttattttcctgaacatctttctgtgaaaatcaaacaagtccaaggatcaaactcccaggtgtcaacagcttggaagggttccacacacttttaagaaattttctggccaggcacggtggctcatgccaggaatctcaacactttgggaggctgaggtgggcagatagcttgacgccagaaattcaagaccagcctgggcaacatggcaaaagcctgtctctgtggaaaatacaaaaattagccaggcgtggtggtgtgcgcctgtaatcccagctactcaggaggctgaggcaggagaatcgctggaacctgggaggcagagcctgcagtgagctgagatcgcgccaccgtactccagaccgagcgacagagcaagactcggtctcaagaaaagaaaaaaaaaaaatgcaactgaaggaaacctagtgtgcagaaatgttttgaagaaaacttcaaaaaaaaattctattagtcttaaagatatgagaagatattacatccattaaagaagaataatttaccataaaaaattcaaacaatgaaaagggctcttaaaaatttaaaacatggctgggcacagtggctcacacctgtaatcccagcacttcgggaggccgaggcaggcagatgacctcaggtcaggaatttgagaccaggctggccaacagggtgagaccccatctctactaaaaatacaaaaaattagctgggcatggtggtgtgagcctgtaatctcagctacttgggaggctgaggcaggagaattgcttgaacccagtaggcggaggttgcagtgagccgagaaaagaaaaagaaaaaagaaatttgtgagagctgagcataagccacactaaatgcacacacaggaaatattaatacgtattagttatgttttgagggcatatgttcacaaatacaaaacctctggggaggctgaggcgggtggatcatgaggtctggagttcaagactagcctggccaacacagtgaaaccccctctctactaaaaatacaaaaattagctgggcgtggtggcaggtacctgtagtcccagctactcgggaggctgaggtgggagaattgcttgaactcgggaggcagaggttacagtgagccaagattgtgccaccacgctccagcctgggtgacagagcaagactctgccttttctttctcaaaaatccctggagtctgcctttgcttcagaaattagtttatccagctatacttgatggaaaacccagtgtttcagtagcagaaagagctttgtggtgtaagccattctagaataagtagacaggctaggggtctcttccgtgggatgccagttagctgtgtcccaaagacagacctcaaagactccatcccagggacacaatgcctctcccgaagctaggactctggaatcaggacacaggttgctctctctggacatatttctctaagtaaacaagttgctcttccttagagtagctgttgtgttgctgtattcccatcacattcccaggggtgtgaaatagtagactctccagtctactagagatggggccattttctcagcaacacttgcttgttatatcctgttaaaaaatcttaacgtagaaaaatgggcaaaacataaatgtataactccatgaacaactgcaaagtgaaaacatatatagtcaatatacatattttaaaaaataaaacattgtgggcgggcacggtggctcacatctgtaatcccagcactttgggaggccgaggcaggcggatcacctaaggtcggaagttcgagaccagcctgcccaacatggagaaaccctaactctactaaaaatacaaaattagccggcatggtggcacatgcctgtaatcccagctactcgggaggctgaggcaggagaatcgcttgaacccgggaggcagaggttgcggtgagcgaagatcacaccattgcactccagcctgggaaacaagagcgaaactccatctcaaaaaaaaacattgccaacacaccaaaagccccaaacagtatctgctatcattgctatcattacttaaacactgtggtataatttttccaattattgaattttgattttttagtatattcacaagattttgcagccgtcactataatttagagtatttttgtcctctgtcaaagaacccccccatacccattcgctgccacttcatactccccacattctgtccccaccctaaagacctactttttgtctccatagatttaccttttctggacactttatataaatgcaatgagtcttttgtgactagcttctttaacagcataatgcttcaaggttcatccatgttatcgaaagtatggatatgtcatatctttttattgccaaataacagtccattgtgtggctgtaccaatattttatgtattcattcctcagctgagagacatttggctggttttcactttctcgctattaacaataatgcagctctgaacatttgtgtacaataaaaataaatagcatcctacaattaatatggaaacagcagaaatttatttctcataattctggaggctgagaagttccatatcaaggatctgatagattcaatgtctggtgaggaaatgcttcataaatggttcataaatggtgctttcttgctgtgtcttcatggtggaaggggtaaggtcttcctggggcctcatttgtttacgtatgtattcatttatatttttggagacccagcctgcatctggtttccccttcttccttgaatgtaaaccctagaaagctgggctttcttttgagagcttgggagatttttgtctcaactcaaagagactagaggatgacccatctattttttcattagttttaaactcagcttttttacttcctgtagagtttcagaatttggcaaaagtctcaaggctcaagctggttgtctgaagcctttcaaacccccagttttatcaccacatatgagaggtcccagcaccaaccgcaccagccacaggactcctcttctcggtggtacaaccagcagcttccaggcccagccacatatccagagcttggggatcaggtatagagagccaatcccctgggaacccatgcattagtcccagggggcctctcctccaagcgcctacattctggaaaagcctcaagtttctacagtcatgatacctgggaaactcagtgctcccttttggatttttcttagcccttcaacacctatgtaaatctgcatgaaatttccactgtttgaatagagtgtcattccctgctgagccctaactgatacgctgtgtttccagtgtccctcatccactagactcagtggtgtcaggaatggtgtggtattttgttataaatttaactccttagatggacacacagagagcctcgataaatatttttaatccatcaatgcaaggagtgtggttgtcagaagtcagctaaaagtccaagtttaaatctaagctccgccgttcacagcttgggtgacctcagcttcttttttggaaatgaagttcatattttccgagcactttttctgtgccaggtgcttccaaatgtatctcgtttaatcctcacaacatacctcagaggaagacatcatttttacaagtaaggaaatagaggctcagagagatgaagtggttgacccgggctgtctatcttgtaaatggtgggctgtgattcccacacgactggagtttctggagtcagaggctgcctggagtcaggggctgcctgactccagaaaccattttctgtgcatttcatgtagctccacctcaattgccttcctttcctcatctgcagactgattaaataaaatgtataatttggatgaaatttgataaataattctgaatgcattcttttttagaataaattatctgcagttcagtactttattcttactaataaattccaagcaacactcctactcacgggcctggcccttcccatgcattttcttttcttgctttttttttttttttttgagatggagtctcgctctgtcacccatactgaagtgcagtggggccatctcggctcactgcaagctctgcctcccaggttcaaacaattctcctgcctcagcctcccgtgtagctgggattacagggatgtactaccatgtccggctaatttttgtatttttattagagacagggtttcaccatgttggccaggctggtctcgaactcctgacctcaagtgatctgtgcacctcagcctcccaaagtgctgggattacaggcatgagccaccgcgcccagcccccatacgttttctcgctggccatgctgtgcaccgtctactaagttgccatggctgcctggccatctgacttgtcaccctctcatccctgacctgaccccagtgtgtctgcttttgcagggccaaggggtcagattcttctgcagaggacagccctgtgaggtccaggttacggactcctgctcaagcacatgtaggatgccagcctgatggtgtctgggtccttcagtagtattcatggcagcctgctgaactctgccttccaagatccagtttatattttagggccccaatgtaaatgttgcaaagtctttcccatttcccctgcctcagaacagcagcatggaaagcctagaatggaaaaagagaatgagcccaaacccagcagctcaggccaggaggcatgcctgttccacatcactccacgtggctttgtgtttgttgcctccacatctgttccaacccagctaggctggtgcagaaggagcccagggggtcctgcttatcactgaattcctttactgatgcattgttttaaagagaaaaaatccccatgaaaggtccaccacaggaactggggacctctcaatgatcccaataggtaaggaagactcatttgcagtgagctccaggggacctttctacaactcacagtgaccagtgggaataggacacacaaggtgatgccaagcctggcacaacagctgagtaccttgactcgtcccaaatcccagagtaaatgtagggcacctgaggcagctgccaagggacagatgtccttcagagcagttctggacaaggccctcatttatttctctctgtcacctgcccctctctctctttaaaaacctaggcattttgtcttcttttcctcatttttgtcctacacaggaacatgagagccacctggtggaaggttttattagcatggaggacgagggagagtttggcagcttggcagagctgcaggttgtggagaagcagctgagacaacagccctgagagaggagatctgtgcttccctggagcacagggcaggttgacacatcagctgcggaacagtatctggaccagaagcctttgctcactgtgagagacaggccgggtcacttacttgctcaccgcacatgggggctgagtggtggctgttacagatccatggaggccagtggttgaggctctgaaggggacatggctgtcgctgtgggag

SEQ ID NO: 302 - DNA, 4912 bp, Homo Sapiens
tagttttattaattctcgctggcccccatctgtgctttcgactggattcagaactcagtttatcttccaggctccctgtctttgggtcttgatcaccacagaggggaaggggagaatccagagataaaatgtgagactgaaactgttttaaagaagcatacaagaaagaagcacacactttattagggagatgttgatgagatgcttacaacccgcccgccaccccccagccccagctaggccatctggcaggtaccgcccgtgcgccaggcatcgttttcaaattgcaagaccgaaatccaatcaaccgaaataatttcttaggaagataagcttgcaacacgtgcaataatgaaaaaatttaactagcattaaaaatattcaggaatgtcgagcaattaccacctggccgcagtcacaggacagaagacggaataaatgggcacgcaccaaaggtttatattaaagtgtaagtttcagcccctcagtatatttaagggaggctgctctgcagaggaaacctctgccttctcggcgagggagtttccgagctaccttaactggggcgcaacgcagccttccgccaccagaggcagcgggcgtctgcggcctgtcaaaaactggcgcttttttcctcccctttccgtggagagactatcaactccatctgtcacaaaaattaaggctaaatctcctctccagaagcagagggagccggggctccgacgcgctcagcgtcgggctgtctgcctctccctagaggccaagtgaatttgaaatggcaaaagtcacagccggaggcccagcactaggagattcctccggctgcgggaaatcttcctgtacctgctgaagctgctgcgttcctcagaggcgcttggtctgccgtgggaagctgcacctctgcagtccccaaaaccaaaatcaaaccttaaaagagccagactgaggtaaggcggaccgtcttgctctgatttgagtattggtagacaaacagcaatataaatcgatactaaaaaaatccagaaaggctgcaacttcatggcacatcaaaacaaccatatccctggctctctgtctctttttttttctctattatttggagttgtcctctcagtccggcctggaggacttggacaactcagacaccttctctgtgtctgggatccctccacagaagccagtcaccacgtaagacatctggaccaccttcagactcgcatgctgtgaggaagcccatgcttactatgtgtagaggatacatggagaaggaaagagatgcctggccagctccctgctgtttcagccatgtgagtgaagaaggcaccagacttgtgagtggagacactaacttggatgtccagcccagctgaaccttcaggcagaggtgctgagcagctaattggaggggatagtatgagcctccaaagattagggaagaaaattgcagttgaagaaaacttgctttggttcaatgcaaaaataatgggatgaatggcatgctgaaatatcatatgacttacgaaaatgatgaatgtgattcccaaactcaataagaggagaaatgatgacaagaagcaaaggccgtctacagccctcacgttaggtttattgaatctacatatgtggaacccatgaatgggagtcggagaagggggcaactgtatacgcaaaaagctatcataattgccaaaatagtgataacaatgttgaaacactactgggattactactgttaatgactaccagtgatcaagcacctcccctgccccagtgtttgcctgccttgtttgaagacacgaaaaaatgtacacaaaatgatttagaactgttgaacttttcagaaaataatttaaaatcatctacctcataactaaaggtgaaggaaatgaagtagaaggatgttacataccttgttcaaagtgacatagctgagtctgcttggactgtggttcaagccatgcagcctaactctagaacccatgctttgctacctgactttccagacgtaggaggcaaataccataatcagctccttgtttagaggtgtaggaattgaggcccagaaaaaataagtaacttgtccaaaatatgtagtgaaattggtacttgaacttttgtctgtctttcaactacactaccacctctaaatgctcaaattcagatcattttagatttaaggactagaaatagccttggagatcatgttattaaataattactcattttacagataatctgtaatcactaaaatcatttacctaaagcagtcaggaacaggttctatacagcaaagcaacttaacatacaaaggaaaattattgtttgaaatattatttctattttttttttttttgagatggagtttcgcttttgtcacccaggctagagtgcagtgatacgatctcagctcactgcaacctccgcctcccaggttcaagcgatactcctgcctcagcctcccgagcagctgggattacaggtgcccaccaccatgcccagctaatttttgtatttttggtagagagggactttgaccatgttggccaggctggcctcgaactcctgacctcaggtgatccacctgcctcagcctcctaaagggctgcgattataggcatgagtcatcacacccggctgaaatattacttctatttaatatttaagaaaacaaaatgaggaattcaattcttgatggcaacacagctcttgctagtaacttaaatgcctcattgtttctctgcaacaagaggaaaacttgggaaaggattctgtaggcactgagaccatcataaggaattgcaggacccagagattttcatgaaagtgaaattgctcataggaaatcaaagcaaatggccttaagagtggcatccagtggaccgtcctctgaaaagtgacccacaattctgcatgaatctttccaggacactgaattggagccagctgatgtaaggagcttaccttggttgccaccttctggtctctgtttgaggaacaactgcatgtgattaagggtaacagatacagaatttgtgttaagcccaggatgtaatttgttgaatgagtagcaattgacttgaaaattggatggatggggattgtgtttctttactctctctctcttttctttctccctctcaatacggctagattaaatcatctttagtctagtcaaatcagtgcttgctgttgttaagaaggatattcttgaggtatagtacttcagggatgctaattgggatttgagcaagatgaaatttctacccaggtgtgtgcatcgtatactggagatggcaaaaactggttccaaatgagggtgtgtttgtgttcctaggcatgttcctataggggccaaaaagatgcaaaatcttcttttctaaagcttttggtgttctcaagcttgtctacacaatggaatcacctggagaatttggaaaaccaaaaatactgataccactgatcctacccaacagattctattttaattggtatggagtatggcctcagcactgatattttttaaagtttctgaggcgatcctaatgtgcagcaaagcaccgtcaagccccctctctctgaggaggcaccagctgcaagcatgttttacaccaatatgtttgctgaatataaacatcccagtgcaaactcttgcaccccagaactctgggctgcttgtggacagtctttggcaaagtctgaatttataaactgataatacatataattccataggctccatatggttcgtgttatcctggggggaactatacacatttgccttgccccaggatggaaagataaataacagatgtggataatttttatcatacttgtactgaacaataataaaaaaattagaaatgaaggagcagagagagaagtaaaactcatgaaaacaaagctcaaatcaattattctacgttatatctttgcatttttaagaatccaaatacacagtagtactccatagaaaaacctgtcatacagttctccatttctaagggagactatctctagagtgatgagacataatattaaaattgtatgttaataaagttaatcaatttgttattagtgataaaaagtaaaatctacatagagcttactgtgtaccagacactgttctaagcactatacaagtattaacttatttaaccctcattataatcctgagacaaatcctattattatccttattttacagatgaagaaactgagaccccaagaatttaagtaatttgttcaaggcaacacactgctatgtggtagaactacaaattgagcccaaataatccagcttcagatactatgcaaaggtatcctaggtgtgggggtgataacctggtgacaatcccttctcagaaggaaaacaggtcccatctacagaggtgaagcagagtgtggaactgaaaaactcaatggaagaatggctattaagatttaggacggctgggaaataataaagtaataataataatactaggtattgacgtgtgctacatgccaggccttgggtgacatttggattgattcccattttctttacttttcagcagtggggtctttcacctttcaagctctgcctgagaagtcaacatggtggcatttggctaggttcttttaggcaaccaattgttttaacatgatttgttgaaaagcctattctctctttcattgaactataatgctagctctgtcataaatcaaattttcatttgatttatgatatgaaaattatatgcatttgattgatatgcattttttctccaatgatactcaactgtcttaattatataattttgtagtaattcttggtatctaattaggcaaatacccactcccaaccctgtttcttttgtttttaaatccaggggtgttttggatattctcgttcatttgtgcttccacc

SEQ ID NO: 303 - DNA, 6397 bp, Homo Sapiens
ggagcgtccgggacgcggcgggactcgagtgtttcggaaaaggagcgtctccccaggcggtggttgtcttcactagcgatggggtaaaaggaggacgcaatacctggttcaacttgagcaggtacattttgaccatattccaggtgtcatgtgaagatttaagcctctttccaacccccactccccccgaatctactgcatcctttttggagtcttcattcttaggcacattttgtcaagacttaaaacctaccaaagaaaagatacactgaggtcagatccaatcccactgggggccagcgagtgaaatgcgacggtttccttttataatctctgtttttcataatgatgacattaaaaatcttgaggtttcccagtagatatttaagctgaaagcaacattgtgcttgtcttcagagaccaagactttctggctcttgtcttggaatatttcgcaaagtcataggcaaaacacacacaaacaaacagaaccaaaacacagcagaccactcacgggggaccgaaccaggcagttagcccagcatccccctgctgcgggaggagggagcttggatactcctctctggagaatcctgctctggaaatccccacaccccaaaatgcaatgtagaggggcagtgagtcagcacctcaccccaaatgaatggccgttctgctcagcaggctcaacgcttagatccccagatccagtttctctttgctttctgtaattggaagaatggaataggattgctgctagaaatctttgaggtcactggtttgaaagtgggattatgagcatgaatttttgttgttgttgtttgtttgttttcagacggagtctcgctatgttgcccaggctggggtgcagtggcgtgatctctgctcactgcaagctccgcctcccgggttcacgccattctcctgcctcagcctcccgagtagctgggaccacaggcgcccgccaccacgcccggctgattttttttatttttagtagagacggggtttcaccgtgttagccaggatgatctcaatctcctgacctcgtgatccgcccgcctgggcctcccaaagtgctgggattacaggtgtgagccaccgcgcctggccgagcatgttaatttaagcaaatgaatgtccctgggaatgatcttcaaggagaattaaagtgggatagagaagtcatctatctgcacctgtgtctgaaccagaatgacgaggcacttccatgtcagctagttactggagcaggcggagtaaggagtacccctgggcttctgccccgaaaccaccacggctacttcaaaacaatattacattaattttcctgcttgttcttgagaagcactggtttgaaaaattggatggggtgatacatgttttaatcagtatttacaaggctccttaatcacttcatcagacaattcattgagcacctactatgtgccaggcagtgtaattcattgagcacctgctgtgtgccaggcagtgtctgaggcacttctagctattatttcctaagggttccagcagcccatggataaacttcaaagagtgtaagctcctaaaaattgttcgtattttctgcacatttttgtagttttggagaagagagttaatggagttcttgccattctcagaattatttgatccctttaggaatgagcatctctagcctctgcctgttcatctgggacaatctgcacctgggcgtggacctgctgcttcagatcagtaggtatcagaatgaactcagttggatggggcagttcaggacccctggcctccttttagtctggaccccactctcattcctcatattctcaattcactctttctactgagttactatcctagtaatgacaatgcctcctatcatctagagacttggtttgatacaatgcattcacatacaactgctcgttttgatttctataactggggaatacagaaagcaaatatgcggtgcaatggaggatgtctccattaccccagataactccaaaattcttcacctagttaccagtgcaggaaattcgttcgaaggcagaaatggaaaatgaataagaaacaatttggatgtgttccaaaaatggagagttgtcaggcactatatcatacaacctgaaatatcaatggtgaagtagacagttcacctccacagggggcaggaggttggacccagggcaatggatgttttatatggatggttaaccggtctgtggccatgaggtggaaagctgtgtacacctgtgaagccatcatcacaatcaagttagggaacatatccatcacccaaaaaagtgttctcatgccctttggtaattcctccctcctaaatgtccccaccctaccccacatcccagtttctatgcaaaaaccgctgaccaactttctatcactatagatttgtttgtattttctagacttttatataaaaagaattatactgtatgtacacttttttgtctgtttttttcacttaacatatttattttcagaatcatctatcttgttgcaggtgtattcctttttattgctcagtagtattccactgtatggatataacacaatttgtttatcattcacctgttgagggacattatacttgcttctaaatttttactatcacaaataaagctgctgtaggcattcatgtgtgtgtccatcgtgtggacattgtgtgcacacgtgcttccatttctcttggggaaatatctaggagcagagtgtctggatcccatagtaggtatttgtttaactttttaaactgtttttcaaagtggttatactgtttttcattttcaccatcaatgcatgagggtcccagttgctccacatccccacccatactttctgtggtcactttaaaaatttttagccgccccgtccgggagggaggtgggggggtcagccccccgcccggccagccgccccgtccgggaggtgaggggcacctctgcccggccgcccctactgggaagtgaggaggccctctgcccgaccaccaccccgtctgggaggtgtacccaacagctcattgagaacgggccatgatgacaatggcggttttggggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgcttgttaagagtcatcaccactccctaatctcaagtatccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaataaaaataaaaaaagaaaccctacactccactgaaaaaaaaaattttactcactctaatatgtatataatggtatttcattgtagtttaaatttgcatttttcaaataactagtgatgttgaacaaattttattgtacttattgccatccagatatcttctttggtgaaatgtctgtttcagttttactttctttcttttcctttacttggtgatatggtttggctgtgtccccaccgaaatctcatcttgacttcccacatgttatgggaaggacctggtgagaggtaattgaatcatgggggcaagtctttcccatgctgttgtcatgatagtgaataagtcttacaagatctgatggttttaaaaagaggaattcccctgcacaagctctctgtctttgctttctgccatctgtgtaagacgtgacttgctcctccttaccttctgccatgattgtgaggcttccccagccacgtggaactgtgagtccagttaaacctctttcctttgtaaactgcccagtctcaggtatgtctttatcggcagcgtgaaaattgactaatacacttgggatgtttggttttccaattgttgagctgtttgttgagttttaagagttctataactattctagaagcaagtccattatcagatgtgtggtttgcaaatatttatttccagtctgcggcttgtcttttcattctattaaatgtgtctttagccaggcatggtagtgggtgcctgtagcttcagctacttgagaggctgaggcaggaggatttcttgagcccaggagtttaagcctggtctgcacaatagagcaagactctgtctccaagataaaaagaaattaaagtgtctttcaaagatcagaattcttaattttgaagtgcagcttattttctttaatggattctgcttttggtgtcacatttgcctaactcaaggtcacaaagattttattacagaagttctgtagatttcagttttacatttaagatggtgatccattttgaatgagtttttataaatgctgaagtatgaaacaaagtgtgtatctgtacgtatgtgcctagggaaatgcaatcatcccagcactgttaaaaagactattctttctccactgacttgcctttgcacctttgtcaataaccaattgataatatatgtgcaaatctatttgtagactctgttctgtcccatttatttgtttgtctctttttaaagttaataccacactgtcttgactatagtagattcataacaagaattgaagtcaggtaatgtaaatactcaggtagtgtaaatactcaaacgttcttctttctcaaagtgtgcagttgtttggttattctgttttctttgcatctacatatgaatattagaatcagctggtcattctttacaaaaagcctgccaagattttaattgagattgcattaaatctataggtcaatttttaggcaatgaacagtttgacagtattgaggcttctgatatgtgaacgcggtatatctttcatttatttaagtcttcttaaattatctccacagtctttcatagtattcaatgtacaggcctgatatatatgttattagatttgtttctaaatatttcactttctttgtcctattgtaaatggcattatttatttatttatttattgagacaagatctcactctgtcactgaggctgcagtgcagtgacgcaatctcagcccactgcaacctctgccccccagactcaagtgatcctgccacgtagctgggactacaggcatgcgccaccatgcctggctaattttttgtattttttgtagagatgggcttttgccgtgttgttcaggctggtcttgaattcctggcctcaagcaacccaccccccttagcttcccaaactgctgggatgacaagtgtgagccactacatctggcctttggcattgtttttcatttcaatctctaattgtttaaacatttgatttttgtgtatttatcttgtatcacacaactttgcttaattcaattattctgatttttttgtagcttcagtagaatttttcttacatagataatcatgctgtttgtaaatatagacacttttacttcctcctttcaaatctgggtgctatttaattcttttctgtctgattgcactgcctaataacctcccatgcaatgttgactagaaatggagacagtgtgtacccttgtgttgttcctgatcctatgtgaaaataatccagtctttcaccattaaatataatgttagctgtaggcttttcatagattctctttatcaggttgaggaagttctcttctatttctagcttcctgcaaattatgttttaaaaattaggaatgtgtattaaatattatcaaagttttcttctgcatctattctattgagatgatcatatgggtttttttattcattaatatgtgaattatcttgattgatttttgaatgttaaatcaatcttgtgtccctgaaataatcctaaccccacttggtcatgatatatcatagttttaaattattgatgaattcaatttgcaaaaacatgttaagaatatttacattgatgtttatgagggtactgatctgttgttttctttctttgtctggtttgatatctaagaaatgttggcctcatagaattgttaagtgtttcttccgctttaattttatggaagtgtttgtgtagaattggtcttatttcttccttagatgattggcaaaaatcacaatgatgccatcaggacctatagttttctttgtggggaggtttttacctataaatgtaatttctttaatatatattctttaaggctgggtacggtggctcacgcctgtaatcc

SEQ ID NO: 304 - DNA, 2420 bp, Homo Sapiens
tacttctgctttccttgggtttgtttgtctttcatttcaagtgatttcttaatttcctttaacagtttttaaactgtggaattattttctcagtatagtccaagctacatctaataagctctagcatgtaactttttcttttttgttcttttctaaatattgtgtcactgctgatttggtttttctcttttatccatgagatgactgttttaagttcccaggaagcgagtcttcttgttccaatttattcctgaatttttattttgactgtcattacactgtagttaggagatgtgacctctactgtctccagcatttagaatgtattgcggatccagggacacagcaagtcaggtgggctctgtcgcaaggatggttacaacatagactacttccatgtcagtcttccattatttgcatactcgagaccctgatgtgttggctaatttgccaagaaacccccgcagcagactgcgtccgcagggcagggctgagtagcaggggcagcacctctcacaggggcagggccgcttgcccagccttgaggaagggggacccagacattgcctttctcaatactgagcccctaaacaggatttctggtctggggtctgggactaggctatctggacagtcaaactcttcccactgcgccatcagccccactaggaaagaaagaggagaaattagggctttgctttaaagagttcaacggtcagaatatgtcccccgcaaacggacatgctggaatcctcatccccaagtgagggcggggcctcacattaggaggtgatgaggtcacagaggcagaaacctcacgaacgggatcaggctcatcaaagaggcctgagagacgacacctaccagctggaaggcggttccgcaccagacaccgaagctgctgggccttcgacctcggacctccgtcttccagaactgtgagccacacattcctgatgctcctaagccacgccgtgtacggtattttgttacggtagcccaaatggaccaagataggagctaaaggtgcttgtgagattccacgcatcatactagaggtgtgagcactgcacctaagggtgcctcggatcatccctgagatgcaggcactgcaccaggaggtgtcttggatcattcctgaggtgtgagcacatcatcagaagacccttttgtccatggggtcccattctcaccttctggatacacatcactctcggggccgccattctacctgcctcatctgtgcgcggcagtctggacctagaagctctgtcccctctgctgcccagtggagtcgagtgcctggcacccaacacccagacagggtggccaccaacctggttgaggggactgtccccaagatgatcacagaacatcaggcagggctcctgagccagcgccccccccaagcctgcctcgctcccagtacggccggaagagtagctgaggccaacccctgaagcagccaaggcgtcctctatgcccagaagtgccagggatcgggggctgcccagttccagacagggtcatcacactccgaccttcagaggggccccccgcctgccagctccagacagggccatcacactcccgatccacagagggcccccccacgcctcccagctcctgacggaagcgcctgtccagcttcaccgacctccatgccgctgcctggggtcttgctcgaacgcaagagaacacgggtctcgttgagggctcctctgccccgcatctcctgctcctggacacccaggcctgccctcaccactgctgctggacaccgggcaggggtcctggccactcttctggaaggccagtctgacgttgcaggcgcagccacttcactgtttgtccttcacggtatgccagactccctcctccctgcaagagcctctcccagggcccagtcctcccccgagaggtgctgatgagagtggagtatggaaccatctgccagccaaccccaggtggcctctcgggggtgccctgccccacagggccatgcacggtgtggccctccccggtgctgtcacgtctgaatgtggccctgcagacttgcccccactgggctggagcacatcccctggaatctgatcccaggagctccgggagcagctcgcacacagctccatggatgcccctcacagtgggagagacaggaaaggccagctccgagtctcacacctcactcttcaagctgggaaaatgatgctgttaccttgggaggtgagaccctccagatgggaacctcgacgctgggagctggtgtgttcccggaattcgggggaatatttcattccctgcgtatggtgtctggactttcagatccctcctcccaggcacccaggcatcatttcacaaccccatgctcagcaagccccagagaaaactcctcaataaactacgagtgttaatacccg

SEQ ID NO: 305 - DNA, 2029 bp, Homo Sapiens
aggtgggattgaacagcagcctcttttagtgggctttctttacaaaacccaacgactctacctctctgcttgctaagcatgtgaacttatcatctaatggggaatgcaagactcactctccagtaaacctagaaaacttagataaccttgcttctcatctaatgagacagatatattcttctctccagaagacaggtgtaacatggattccatgccactgggcaactgttcaactgccctgaagaaacggtgtacgtatcacaagtatcacaaagggctgctgggtccactgagtgattgttttgcattaggtgagactgtttcgaagccatgatgtttcacaagtctctgattctatatgtgctgtttgctttggagtgaaattacttcctcatgcttagcaccaccattgcctgattcctgtctgcctggaatgattatctccatcttcaatttgcaagtgaagaaactgagctatagggccatggcactaacaggttctctggaaagcagtggctaagatggagtcagaaatagaaaagcttattgtggattaattcctggggtgtgatggctcatacttgtagtcccagcactttgggaggctggggctggggctttgcttgagcccaagagtttgagaacagcctgggcaacactgggagaccctatctttacaaaatatacaaaaatttagctggttgtgatagcacacacctgtagtcccagctacttgggaggctgagaagaaggatcgtttgagcctgggagctcaaggctgcagtgagccatgatcatgccactgcactccagcctgagtgacagaatatcaggagccatcagaccaccatgcagacttgacaaggtctctgcacagtcccagaagaaacaaagcaaagactgcccactagaggagtccccttttgaaggaaatgcctggacccttttttctctaccatgcttagtcattggcaagggctgccctaagagcagcatgacttcagcttataagtgtggatgaactgtacgcctaatagctagaggccatcagctatccacactcttctcaactgagtagcaactccattcttgaaagggaacctgagaaacctatctctatgtctgccacaggtggtaaacttttccactgtcatgaatagtagcaagtggcaggaacaggatttgaatccaggtgatatgattccagctccagtgttctcatccactgcttactccagttgtgtctagcatagagatgccggagagaaattacaggggtgttgtctccatgtcttctgtgaagagcactctcttagcctaatgcctcctcagggacctcgaactttgatctctgaactgcgtcctcccagggcccagagggaagatcaatcactcaggcatctcccaggacaccaggtcaagtggcagaagttcatcctctgggattctttgtcctctgtaacatcgattgtcaacttggcaaagccagcttgacaataccagagtctttgtgtacaatccatagacagcactgggaagagcaaaccatgagaggccagcactaaaccctcagggtagctaaagaggaagcatggtaagacctcattctgcagcagaaaaaaacaaacaatctgctctacatgtacccagcatcatgtgaacatgaaccagttgagtatcgcctgggcctctgtttgctcatctgtaaatgggctggttgccccttcttgcaatggacaagcctgcatccgcagagttcgagtcctgtgtcttgtgtccttgccacatcctcctctgggagcactccgcaaaagctgttattgttagcccccttctctcaacctccccaatcattgcacactcatagacaaaggacaatctgatctttatgtgaccaagataaaatttgatgggagatcagcaagacataaaggaaggttcttaaatgacatatttatcccaacattgttctgggaagaaaagtatccattgtaaaaactaaacatgtctgattaaatgataaatgcag

SEQ ID NO: 306 - DNA, 4113 bp, Homo Sapiens
gaaggctatagccggagccacgaaaaagttcggaaacaaattgcttggtctttgaggaatcgccacactgccttccacatggaaaggacacaaatggttgaactgatttacactcccaccaactgtgtataagtgtgcctttttctccacaaccagcgtgaagactagaagaaaaagaatggaagaaagaagtgaaagagaaacaaatagggaaggggatccctcggatgactgggaaggaaaggaaaaccagaaaaagcagtcaggatgaatgcctgacaaaaaactctgctgcagtgacactttgacatgaagcagattcaaactttctatgactgaacaggacattttccatttattgctcctttgatacccaagctcctcaatgggggtattcttcaatgagacacttttaccagtgaccatattcttgcttgttggtttcttttttttttaaagtatgttgctgctgtacttttaagaaagttgtgttttatcttagtactttgatattcataaatggtataaagcataattttaccacatagctttaatggaatactttttacaaacaaaataaaacttgaccttcttccaccctatctccacatcggaactaattttactacattttatttttcaaaaactattaattcagtcaatgaatattgactttggactacattgggtcattttcaatggattgctctggtacagctttactttgtcatgtcctttgttcttgctctttcttgtctacctaccagttaaaatatgaaactcatgaagcatttagctccctggatagtgattcctgtatcagggtgaatcatgcaaactttcatattgtctaaactataattcagaaatataatgtggcttaaatgggaacttggggctaatgtttaacaagtgtgcaccatactttatcagttctctaagatttattttctacaaacaaaattttttatgtaacgggctacctttaagtggtaatcctaaaggccctttctgacttgttcattaactttttcaagtcttcaggccactgagttatctggtgcacagagtaataccaaatcatgtctgagaaaggttccatgattcccaaagtgcctgattttccacgtcttcctgtaagaagtagtaatagatatgctaaatgactggggaaataagaattaagcctacggctactttaaactttcctatggaaagattttaatgagtttccaagtagactgttcagctgagacaattttatataatgtggtatatatgatttaaaaatctacatccaaaaaacacataaaagacataccctactttagctatgtgtcactatactcagctatgtatgcataatataatatacatatatacatacacacatgtagtttagacacaccctactttagttatgtgatagtatatatgtttatgacttagaaaccctactttagctaggtgttagtttttttctctgactctaaaattatgtgttttgtttgtttgtttgtttttggagacagagtctcactctgacctctgtcgcccaggctggagtgaagtggtgtgatctcagctcactgcaacctctgctcccggggttcaagcaattcttctgcctccgacttctgagtagctgggattataggggtgtaccacaatgtctggctaattttagtatttttagtagagatggggtttcaccatgttggccaggttggtctcgtactcctgacctcaagtgatccacctgcctcggcctcccaaattgctaggattacaggcgtgagccactgcgcccagccaattctgttttgactatgaagtaatacgacttaaaatatgaattacggaagccatgcttctgagtcatgcagtgaccttcctccacccatccccacgccagtgcctcccactgttatttttgtgcatttggcataaccagttttctttaatgaaagagatttcctttccaagataggagtgcaagctccagactaaaattatgaaaatgcaaatgagtagtgcttcctttatccaagttgctttcttcaggtatatgttgtatgtgtgctgttgtttgctggtagctaaaagtccattctttcagcaggattgtcttctgtctctaagggaacaagaatgaccattaagtaaaaaacatgtatgaaattatgcgggtgagaatctttaccccactttttgttctttttgatggtagaaaaacctttgtcttgcaaaggcaaaactagtaaaaactttctgccttcggcttaaacattaaatgaaaatatatctatttaaacaatgttttaggctgggtgcggtggctcacgcctgtaatcccaacactttgggaggccaaggcaggcggatcacaaagtgaggagttcaagaccagcctggcttatatggtgaaaccccgcatctcctaaaaatacaaaaattagctgagcatagtagtcggcgcctgtaatcctagctactcaggaggctgaggcaggaaaattgagccgagatcatgccactgcactccaacctgagtgacagagtgaggctccatctcaaaaaaaaaaaaaattgttttgccctgaatgggtagaccggtgggtttgagttcagctttgggaaaaggtaggatggttttcctctaagcatgaagtaggcagaatgtgcctgttttgtcctttcatgagagcaatttgatctagaggaagtacgaggctttaaactccgggtctacagaattaaaggagggtaaaagaaggacagcaggacctgacactgggcttcttattgttcctgtcacaatttaaatcatttgttcacagttggtcacaagacctcagtctattccgtgctgcaagtgtattctttcaaaaaacaggaagcaacacttaagtaattgcagatttacagtgactaccaggctgatcccagctctttgtcatggctttcctgtttgggtctgaaggaagtggcggagaaaggagagagagggtgggggaagaaactgttagaaggacgggttagcctgagcctggctttgccttagtgaaagagtgatgaaaacactttaaacagttgccgacaggccggtagaaaatatttgacatctcacctacatcaacaagcaagagttaaaggttaaatcacacacaactcaagtgctgggaaaaaaggataggtttaggtcatcaactttctttgttctaggaccgccctatgtcaacaaggagacatattcccactccctggttggagacaccaggacaatagagactgatccacatttgctctgggtggtaaatccccttttaagcatttgtagcttgcctctagtctagccttcttcatcgttttttacctgcttccaaatacctatgtatttagggcaatgtggttggtggcctttcttctttcttcaaccagtttcttgagatcccaagcatgaagcttagtgtaggaggagaactaggaagtgaaaagtgtttgcatccatttcctgtgttggttccaaattcagtgagcatccaacctaaatcctttggatggtggtagggccagggaaaggtgctttacattgctggttctcacacactctaggtttaatgatagaaggacctttctggagaggcatttagtgcttttcacaaggactataacaaaaggtggggcagatttcttcactggttcaaggaagatttgaattgaaatttgggaagaaaggaaaatatgcccaggggagcaatgcaacactgttgtggtggatgccaacaggtgtgttatagaatgaaaaagaaacagcatagaaaagtacattttatcatttggtgggccaaggtccattttgagaatctggtgagagccatgattatctgcctacaccaaagtttgtatccatgcttaggaggatcagaaattttgatgatttttttttttttttaagaattcctagaagttcagctgggctcagtgtttcacgcctgtaatcccagcacttttggaaggccgaggagggtggatcacctgaggtcaggagtctgagaccagcgtggccaacatggaatacctgcatccacaaaatattaattgaagtcccac

SEQ ID NO: 307 - DNA, 8461 bp, Homo Sapiens
acacctctcttccggctggagcagcctgaccaagtcccacttgctgttctgccagggagcctgattttggcactggtgtatttccagaaccaaggctcaggaccctatgggattgcacaggtcgcagcccaagcgcagtacttgcgcacaggtcccagccccttccctctctgggacttgtcttctggcccctcactcctgcgatgagcttttctttcagctggtgaaaggccgcagacttcgaacctctgggcctttgtccaggacgttccctcagcgctcagtgcccttcctggtggcctcctacatcttcagatcccggctgagctctgcttaaatccgggaccgggtagtcactggggcagccacttggctggggcgaggccacctcgctttgggtcttgtcgcgcccaggccagcgccagcccaggcttgccatggactggctcctgggcgttagatgaatgaatcgactcaacccgggccgccacgttgtgttcagaacaccgacagtcgctcccaggcaaccagcacctgctgcgccccgtttccagcgacctccccaaccgcgtggactcgcatccacgtgcccggcggggccgcagcagaaaggctcggaccccccaggacgatcggccggtgggggccggtggggccgcagactcggggggcggggggcgccaggcttccgggtcctgcccccgccccgtggggaacagcaggacggcgccgaggccgtttcgctttcctccgcgcccatttgccgggaggggaccccgtgctccgacctgaagcttctctggaagacctggtgctggtccgctctcccgggacctcattttccttatgtggacaacgggggcggggtcacagcagcccctcgggcttatagccgggttgttctttccttaaatctcctccctctgccaaaataaaaaaccccacagggcaaggcgcggtggctcacgcctgtaatcccagcactttgggaggccgaggcaggtggatcacctgaggtcaggagttcgagaccagccttaccaatttggtgaaaccccgtctctactaaaaatacaaaaattagctggacgtggtggccggcgcctgtaatcccagctactcggtaggctgagataggagaattgcttggacccgggaggctaaggtcagtgagccgagatcgtgccactgcactccagcctgggcgacagagggagactccgtctcaaaaaaaagaaaaaaaaaaaaaaacccacagcgtcccggaggggcctgaggagttgtgaggggccgcctccgcctccagcatctggcatctggaggaggaggctgaggctgaggtgagggtgagggtgggtgacccgcacctgtccaggcccaggttgcctgctcccagcttgggctgggcagtggggcagggccatgatcccgccagtgctgtggttagccctacacctggcctggctgaggacagcgaacctggcaggtccaacctgggccctcccagcctaggatctccaaggcctcgtctcagtcaccatcagctgctctagggtgcagtggggcccaaggaggattgggcctgatctctgccccccagagcccatggacccaggactgggcccaccaggcgtgtcgcaggcatagggtcagtggcttctcaacagctgctggccccggcgcccctcaccaccccacctccactggtcagaaccaccacactgccagagactgggtttccctgcagttctgaccagtggggatggggtgaggtggaagggacattgcttggccgggcacggtggctcacacctgtaatcccagcactttgggaggccaaggcaggtggatcacttgaggtcaggggctcaagatcagcctggccaacatggtaaaaccccatctctactaaaaatgcaaaaattagccaggcatggtggtttgcacctgtaatcccagctactcgggaggctgaggcaggagaattgctcaaacccaggaggcggaggttgcaatgagccaagattatgccattgcactctagcctgggtgacagagcgagactgtctccaaaacaacaacaaaaaaggcagaggagtggggagtctggatggctccgctggtccagcccacccctcaggggacagactggttgacttgacgggttcactgagagtgctaggaccggccccaggtgtagtgccctccctgcggtgtcctgaggtaaagcctgccactctgagcctgctttctcttgccaggagacaggaccttgtccgctgcagctgggacatggtgtggataaaacctgtcagacagtgggcgtcctcctgccctgaagcctcccctctccctggtagccttcaggccccccagattctggtctctcggcctgctgtctcctttttccttggtaccttggcacctgaactcgcttggagtgtctaaggagctgcctgtgacaccatggggacctctattggtcccagcatcccctgcccagccgtggggggcatcggtgtcagccctgccaaggatcagtcagccaatcaacaaaccgcagggatcacccagctcatggatgtgggtgccgggaggcagggagggccacacaatgaagagatgtgtgtggtcctccatgctcagagatcctcatgcccctctcccagggatgggagttcccctccccatcaggggtagccctagggcccccagccccactctcactagggccagcctctctgtgaacccctggactcacatcacgtgtgcggggcccagctttgaggtggaagaccaaaccttggcattgcttctgtggaagctcaggaaatgcccacgatatggcctgaccaccccattcacacgaggatggagggagcaccctggtcacctgggggttgtggttagagtgccctccagccgagcctgcagcccagaccgagctagactggaaggggtagaagggcattcaggtagggacacagcctgggcaaaggggccctgacctttggcagctgcgggaagatgagcccacctgaaagggaggctgcattgagtgcagtcaggacctgggctgtagggctcagcctctagacagcaggagcacagaagggcgtggcggggtctcctgcccggccataataaacaggcccaagacttgttcacacaggtcccaggaatatgctgggtttgccttacgtataatttgtgattcatacctctcagtcttccagaaagatgcagtctacagaaattcagaaacaatcaatttgtaagaatagacatagataattttgaacaaccaagattagtgggagataggcatttacccaattctaggacattaatgattagtaatcaggcatcagacatagctgtggtcagccatggtggctcacacctgaaataccagcactttgggaggccaagacagaaggctcccttgagttcaggagttctagaccagcctgggcaacagagtgaaaccctgtgtctacaaaaaataaaaataaaataaaataaacaaattagcctgtggtcccagctacctaccagggagcctgaggtggaaggatcgcttacgcccgaggtcgaggctgcagtgagcagtgattgcaccactgcactccagcctgagtgacagagtgaggccccgtattaaaaaaaaaccccaaaaacttagctatgagtttcctggcagtcgaggcatgaagggaatgagaatggactatggaacttcactgtgtgatcacagcggagtatatcaggcagccaggaggccctcacttatatacccaagcctcaggcagcaggcatgttctgtggcggcctctggaaacaggccatcagggccgggaggacagagatggctgtgagctgggcctgcaccctcagggccctgcctgttgagtggctccagggtgtcttgccctctctgggcctctgggccaaggctaacccaactctctgggtcacaggggctcaagacctcagtggcaggtcatgaggaaggctgccctgccagcctcaccctggctccccacccactgcctgcttctttttttttttttttttttttgagatggagtctcgctctgtcacccagtctggagtgcagtggcgcgatctcggctcactgcaagctccgcctcctgggttcacgccattctcctgcctcagcctcctgagtagctgggactacaggcgcccgccaccacgctgggctagtttttttttttttgtatttttagtagagacggggtttcagcatgttagccaggatagtctcgatctcctgacctcgtgatccgcccgcctcggcctcccaaagtgctgggattacaggcgtgagccaccgtacccagccctgcctgcttcttaagtggcccaggaggacagggagtgagcttgtctctccccactgcagggtcctgagggctggggactgtgctgacactggtctctcccctgcctaggcatatcctgttcctagtgcttggaacacccttcccaccctcacatgcctggcaaattgttcttcacctctaggttcacatgtcgcctccttcagctttaaattcctacacgaggccaggcgcagtggctcacgcctgtaatcccagcactttgggaggctgagacgagcagatcacgaggtcaagagatcgagaccatcctggccaacatggtgaaaccccctctctactaaaaacacaaaaagttagctgagcatggtgtcatgtgcctgtaatccagctactcaggaggctgaggcaggagaatcgcttgaacccgggaggtggaggttgcagtgagccaagattgagccactgcacttcagcctgagagacagagtgagactccgtctcaaaaataaaataaaataaattcctacacgaaggctggggctggctccgagtgagcgggcctggggtatttgtgggataatgtaacttgggagtgtctaagtaggaaaaaactttaggttcttcagtcccattgtgcatggggaaacagaggccctgtgctggtaagtaatggggcagaagccagggtggctgcctcagttggagggaaagcggcaccaagattcacaggacagctctggggtcctggtcgcagtccctgccgtgccgccttctcactcagtgaccctgagcaagctgcttgccacgagatgtcggctccgtggcagtggatagcttcagccgtgggaagtccttggcaatcccctggctcgcggctggtgctcagctgggttcgctctgactagcactgcaccttggtcaccacctcgactgccacacaccctcccccagtggagacagagccaggggtctctcagcttccccaaccctggctccccattgtccagcctcagggatttggagactgggacaaactagccatgcgggggaaaggtgttccagaggagggaacacagtgagccaacaagaggatgggatggggcagggcctgttccaggaacaggctggggtcactctcccttctccagagtccaaggcacatgggtggtgggagaagagataggagaggctggcgaaaaccagcccgcaaggccctaaatgcctgactaagaagcttcagtctttcactgaagttttggagctaggttgggtgcagtcagatagcttgggggctgggccggagcatctggtggagagtgagacaccggtgtgagctgcagccctcgctgtgggtcccagcacccaggactgcacccagcccaggactgcagcaagcaggcacaggatgcgtggctgactgaggcctgtactccgactggagtcacctaggagattggctgagatgacctccagaagggccttgccccaggccggaccccaaggggaagctggctctatgtctttggacgagttaggaactcattgggggtggctgcggttttatttggggattcagctgtgccctgcacaccagctgctgagcaatgtctccaggaagccacagctgccctctgggaggcagggggccaggtgcagtagaggagatgccccagcggctcatgcaggagctcactcagacgccagaaccccagccaaggaggcaccccagacccaggcccaccagggccagtgtccccactccacgacaggggcactgcagccggggtggacacccagccttgctgctcactagtcacgtggtctgggcaagtctcttcctcttccctgagtgaggtgaggcaggatgggctaggatatgtggtggtaacaaacaactccagtctctttttttataatttcctacagacttttttttgttcttgttgaggcagagtatcgctcaattgctaaggctggagcacagtggtgctatctcagctcactgcaacccccactccccaggttcaagttattctcttgcctcagcctcccaagtagctgggattacaggcgtgcaccaccaaacctggctaatttttgtacttttagtagagatggggtttcatcatattggccaggctggtctcgaactcctgacctcaagtgatccacccgcctcggcctcccaaagtgttgggattacaggcatgagccaccgcacccggccaacctgtagattttttgagataaaacagctttattgagatctaattcacatatcacacaattcattttaaagcgtgcagctctctgtggtggatggtatattcgcagagttgtgcaaccatcaccacaatcaattttagaacattttcgaggccgggcgcggtggctcacgcctgtaatcctagcactttgggaggccaaggcgggcagatcacctgaagtcaggagtttgagaccagcctgggcaacatggtgaaacccccctctactaaaaatacaaaaattagctgggcatggtggagggcgcctgtaatcccagctactctggaggctgaggcaggagaatcgcttgaacccaggaggcagaggttgcagtgagccgagattgcaccacggcactccagcctgggcgacagagtgagactctgtctcagaaaaaaaaaaaaaaaaaaaagaacattttaatcaccctccaaacacaccatgtacccattagtaaccactctccatttacctgctctgcccagcccctggcaaccactcacacactttccatctctatgggtttgcgtgttctggacatttcatataaatgaaaccatatgacgtcgccttttgtgactgacttctttcacttagcaaaactttttaaaaatagcttttattggctgggtgcagttgtttgtgcctgtaatcccagcactttgggaggccgaggcgggccgatcacgaggtcaggagatccagaacatcctggccaacatgatgaaaccccgtctctactaaaagtacaaaaattatccgggcgtggtggtgcatgcctgtaatcccagctactcaggaggctgaggaaggagaattgcttgaaccagggagttggaggttgcagtgagccaagagcccaccactgcactccagcctagagacagagcgagactccgtctcaaagaaaaagaaagctggctgggcgcggtggttcacgcctgtaatcccagcactttggtaggccgaggcgggtggatcacaaggtcaggagatcaagaccatcctggctaacatggtgaaaccccgtctctaccaaaatacaaaaaattatccaggcgtggtggcgggtgcctgtagtcccagctatttgggaggctgaggcgggagaatagtgtgaacccgggaggcggagtttgtagtgagcccagattgcaccagcctggggacagagtgagactccgtctcaaaaaaaaaagaaagctttttttttcagagctgcctgaggttcacggccaaattaagcagaaggtacagagagttcccatgtacctctgcccccacacatgcacagcctccctcacaatcaacatcccccgctggagccgcacatttgttacaactgaggaacctacagggccacatcatcaccggaagtccagggtttccatgagggttccctcttcctgccggatgcttcacgcgttcgggcgaatgtataatgacttgtctccaccattagggttttatgcagaatagtttttgttttgttttgttttgtttttgagacggagtctcgctctgtcgcccaggctggagtgcagtggcacaatcatggctcactgcaacctccgcctcctgggttcaagcgatcctcctgcctcagcctcctgagtagctgggactacaggggtgcgcccccacatctggctaatttttgtatttttagcagagatggggtttcgccatgttggccaggctggtctcaaactcctgagctcaagtgatccacccgcctcggcctcccaaagtgctgggattacaggcataagccaccgcacctggcctagagttatttctctatttgactactaaaggacatc

SEQ ID NO: 308 - DNA, 4132 bp, Homo Sapiens
atgctccccagctgggccggctgcggacgcgggaagggaggtggtggcgactgacggaactgggtgaagcttctgcagatggcctcccctctctgcgactggttccttatcgaggcaatggagatgtggactgcggtgactgatcaagcctcacatatctactgaatcaggaagcccgaaggcctgaggcctcccgagtggccccatgggagcgtcgtgcatttttctgggcccgatgacgatgctggcctggcgggggacttggctgacccggcctccgcacaggtggactagttcacagagcttggccactggggggctgctggcaggcgagacaaacatcgctggctggtcggcaaagagggttccgcggtacggccctgcagacaagtggcactcgcttcggcacagctgtggggcagacagagatagaattacagagcataataaataccgagcctcagcagctttcatgtgccttgcaggagacagtggcagcaggggcaaatgattcttcctggatggtgactttaacaaagacttcttctggggggcaccgatctccacctggccatgtcttcaagcccaaggagaagtcccaggatgggtctgagctaatcacggtgatcgcaatacaaatgactgcgctaagcatggcacagctggcctcaatcctggccaatgcaacgtgagaatcaattgctggtgggattctgggggagtttttctcactgttataaacagatgcaaagcagaaatacttctctttgctggacactgtcatgtctaatgtgacgcctggatcactgaagcccccagaggccacgggacacgctgaaaatggcccagtgggaaggcggaaagccttgggtcctgaaaaacacttctaagtcactgacggaccaaactgaaatcatcctttattttgttcttttcatgtcagaaaaaaagacccctaaattctttaagtgacttttttgttaagtttttgtttctagaagcccaaaatatcctaataataataattttaaataatccacctatttttggaaatagcttgttcatcattgagattatgaataatagatcagttctcacccctgccttccccaccatttaccagagttaacaactgtgaaaaattctctgtgtatttttaaaaatcctgtaaaatgcacacacaacacacacacacatttatgataatgcttgttcttaaccaaaaactgagatctaatctctatctcactatatggataagcagtaaataaacctttttgtaatgcagtagaaaaggaaatcaacctctcgaatgtttaggatgtgacttcagtagctagtttctttgtgctgtgacactgccttcagaattctgatcttggccaattttcctatccagcaaataaagcaccatttcccccacactggtacattttaaaaagttagctgtgaattctaagctgcaaatattagatgcagcaggcggtgttctcattgtatcaccactggctctcgccaaggagcctgtgtgttacctggagatcaaggcgaaaagcctcaaacgcacaaattctgaagtcaacttgctgtttattattttcatggatttttcaatacccttggtaatcgcaatttacagcaatgtgctctaaactctaacttcagctgggcaaagtggctaacacctgtaatcccagcactttgggaggctgaggtagttggattgcttaagcccaggagtttgagaccagcctgggcaacataggcagaccccatctagatagatagaaagatagatagatagatagatagatagatagatagatagatagattagatagatagatagatagatggatgatagacagacagacagacagacatagataagcaagcccggcatggtgtcacatgcctatagtttccgctacttgggaggctgaggtgggaggatcacttgagcccaggaagttgaggctgcagtgaactgtgattgtgacccttcactccagcgtgggtgacagagcgagaccctgtctcaaaacaatacaactccccacccccaacaaaaaccaatgattctaatttcattgcaaacctttacacacacacacacatgcacacaccccagaaacaggagtgcgtgcaggacatgtggaggggacagacgtaagttggggaacgatggctcggtggcatcgtgttgttttatttttgttgttacctcagtgaaaacctcagatataaccaggctcatctatttatatattgacccagaagtttctagctaaaaaatgttaaaagataattttttaaaaatcataacttttgggaagctgaggcagaagaatggtgtgaacctgggaggaggagcttgcagtgagccgagattgcgccactgtactccagcctgggcgacagaacgagattccacctcaaaaaaaacaaaaaaaaaaacaaaaaaaacaccccccccccaccaaaaaacccataactttcatacaggtataaaataaacaacagtgtattcattttacttaactcaaatgctataactggttcaaaggacaatccgaagaacacatttaatgattaggaatactgatataaacttgctaatggacaaaaaatattggctttcctacaaggtaggaagcattccctctaccagacagaattcatttcctgcccacagacaagcgcgtttgcattgccagcagctatttacaacttatgaagctgtaaaacagctcccaagcaatgaaggctgcaagcagataaggtggcaggccgtgagcaggcctcaaatggagttttacagtgaagcacaaatgttcccctacagaacccaagatgtctctttaaaagaaatcatgaaagaagaggggattaagtggagcttatggactgctccagggttaagtggcctccaaaataaacaacaggactgctcagtagtcagagtgaattttgggtggggtttgaaagagttccagctttcctctgctaatggtgacataaaatgttcatttcatacccatgcatatacactgatgtatacatgtagttgaggaggcagtggcagaagccagaaggctttctctgccatgagctcctcctaggagccctgggttgcagagggtgaggactgctaggaaagtccgtcagttaaggccgaagggacattagctttgccttaaaccacattggctgtgcttgcctttgtgtcttcacctgatttaatgggttttagctcacactctccgaatctatttacctccaagtcagttaaggcagactgtactgttgacaaagctaagcagaacagaatttccccatggcttctagcttcaaggaatcccagctatttatccatcaccaagaaatgaagccccatgggtggctgacggttcatttactccagcccagggtgttggatttcaattagtgcattcgcttttccctctaggcagagctcaccctttaaagtcgctccttggcctgctaactgtcttaagatgcactttcccatctcaacaatgatacaggacgtgtcttacagggctgtagttctcattcacagcattcttcctctgagtggtccaggaaatactcgcaggccttacagtcaagtcaccttagatttaaagtacggaatacgcgaaaccttcctaactggtaaagcgctcagtaatgcaagctctgggtgcaactcagtggttcttagtatagtcagagttatgcgatcatcagcacaatctactcacaccctcctcgaggtattaaataaatatttcagaatccacaatgcagccaatctcatcaataactttactgaatcctgtagcccagcactcaggggttctctaaaaccctgccccgccttcccctccaattgcggtgcccactgtctcttttaaatagactctgtcctcatcaagcctgttctctgtcccccaaatatgccgtatcattccttaatgcatgcattttttccccagttccctacaatcttataattagtggttacgctaatctatatgtgtgtttaaactcatagaattgtatacaaaaaagtcaactgtactgtgtacacacatttaaaagataaaatgtgttcttttaacgctta

SEQ ID NO: 309 - DNA, 3185 bp, Homo Sapiens
gagaccccatttcaaaaaaaaaaagtgccaaatgtgtcccttcaattccagtcagcacttttggaaacacgcgtaaaattgttgccaatgtgcattctgtgtgtttgggagtcattgtgcaaaatgcgtgggcagcaagcactcttttgtgaaccaagttctatgaaccaccaagtattctttctctaggctgaattccaaggctctgttcagagagtacaggtttctgaaggaagggatttgatctatgtatgcggctttcttcttaaaatgccaggaagaaggttgcttaacaaatgcttttgacattcctgacaagtaatctccaggcttgacttcaggggtgagttacacctctccctccccacgcctttttgagagtattgccaacaagcagcagcaaaactgatgttcttcaactccaccctttggtgcatcactgaaatggcaaaaaggtaggaggtgcagaggagaacttcaggccacggaggcaagaagtcagtcattgattcctggcatgattgtgatagtcgtgtttggaaatccaacccataaaatgagccaccggtttcacagcgcacaccttagagatctcagaaacatgccctaggcttgcttgagtcacaatagctgggttcaaatctccactcctgttgtctaaagaacgaactgtctaggctagtctcagccttggtttacaggtatctctccgcagggtttttttgggagaactatatttgaaataatgtgtgtgaaagtttctgagatatagtaagtaataatacttgtggggattctaaggcttacttgcagtgatttaagtgtatatggggaatatttttattgtattgcattggcatgaataaagacatttgagatttggatgtttacgtcttaaaaagccagtggtatttaatatttgcaggaagaaaatgttgtatttaccctataatataggaaacttggcccatttttctaatgatatagaaaaagctcaattaggcttaaatatgacctagcaccaccccaagcctacagcacttgtattctctttaataaaaattgcgtaaattatagctttctcttgatttgcacagtacgggctcaattctaccccctttcccctaagtagagttgtttcttactatttttcaggttaaccaactaatgtcagacatatgtttcttcaccaaacactgcattaggggacgtttattttacatttgttcccttttgcaaatatttgcagttagttgcagaactgagctattttatgaagtacagaaaatatgtccagggaaaacataaggtttcaaaagtagcttttgagaaggagaaaggaagaaaagtctaattacagtgaagataggtactgatttgtgctaagagaatgtataaatcacgtccactacactcgtggttttaatgcattctgtgcatctgaattaaacaggagctagtgtttgaaattatgtctaaagctttcttcagtgatttgagaatataaaaagtagtgtttcttttctttcaaaagacatccctctcgcagtgtgccttctattcttgacttgtcttgctataaaagaaaaagctctcacagtcttttcaaatctaaatagtctgtacattaaaacagtttcttttttcatttaggaaactgaatcatagctatacagttacaaacataatatgaaaacctaaacaccttttatctaaaatgaaccctcagcaaattagcaagaggtaaggtttaggtatgagggacatttttttttttttttttttttttttttgagatggagtcttgctttgttgcccaggctggagggcagtggagtgatctcggctcactgcaacctccgcctcccaagttcaagcgattctcctgtctcagcccccctagtagctgggattacaggcacccgccaccatgcccggctaatttttatatttttagtagagacgggatttcaccatgttggccaggctggtcttgaactcctgacctcaggtgatccacctgccttggcctcccaaagtgctgggattacaggcatgagccactgcgcccggcctaaaggacatttcggtatacatttaaagtgaatgttttatacaatgagtcaaaagatgccctgacctacaataaatttaattcttttgttgataattccaggcaacttaaacatattcaaagcaaacatgggatggttaggacccaaaacagcatttgtttagaaagatgaggtcctatctgggattccttttgccaagggaagatgccactggaaatgagactactaatgccccaagaagtgactgatcctataatggaaaagggaaaaaagaaaaagagaactgcttccttcttcaagggacaaccacatcaaagcacaaatgcactcctgcgtaggtgtgtgagatgaaggtaccatctcagccactgtagaaactgctggcctcccttgaaagaacacaggccacattccagggcaaccatttctgtttaaactagtttttaaatgttaaaatgttatatgcatatgatgacaatataaatggtagcaaaatataggtgttaagaataaaagcttctgtcctcattagtcttctagtccctctctctgatttattggacatcattccagaaatttttttcctttaagacggagcctcactctgttgtccaggctggagggcagtggcgcaatctcagctcactgcaagctccacctcccgggttcatgccattctcctgcctcagcctcctgagtagctgggactacaggcgcccgccacaacaccctgctaattttgtttttgtatttttagtagagacggggtttcaccgtgttagccaggatggtttcgatctcctaacctcatgatctgcctccccttggcctcccaaagtgctgggattacaagcgtgagccaccacgcccagcctggaaattaatgtgtagacaagtacacagaaaatgcacatggctttttatacaaataggatccaccctttttaaaacaaatggtgggctgagtgcagtagctcatgcctataatcccaacacttggggaggcagaggcgagaggattgcttgagaccaggaggagttcgagaccagcctgggcaaaacacagtgagaccccgcctctaaaaagaaatttaaaaaactaaaatgaaa

SEQ ID NO: 310 - DNA, 9479 bp, Homo Sapiens
gtaaacagggtatactgttgcagattccgtggagtgcagctttaaatagatttggtttggaaatgggacagagaacacaccgcagtcagtggatcaacgttgagagcagagaaaaacaatgattacactcattaagtgggtacctgttgacacatttactgtcaagtctaattatttattgaaactgttattctttcttcattactgccactgataccaattattgccacaggattattttaaatttctacagcatgctcccagactatttacttctccacctcccaaaggttacttgagaggtttctatcattccctctctaccattccccacctccaaaatataacgaaaagagaaagagagaaaattcctctttcttgagagtaatttttgtaacctttcagggcttgcttaaaactcctcttgatagtttcaagatgggtttctgtggggacaggggatacagttaattacttttcaaagcttattctattaatatttaacaattggcatcggagggaaggttagtgtgataactgcagtttctaaatgaacaagttagatctctgcctcacagagctgtcaaaaactatgatagtaggtatctacagtacattcttttctgatatatttatccgtaaaaataaaacattagaaataagtttttgcagggttattttgtggactagaaaagaaataaaaggtggacaggagccattcttacattttttgctactaccttttttaaaaacaatgttctctttttctgtgttagtttgctgagaatgatggcttccaaacaccgcatgttctcactcagaagtgggagttgaacgagaacacatggacacagggaggggaacatcacacatcggggcccgttgatgggtggagggcaaggcaaggacaaatacctaatgcatgcggtgcttaaaacctggatgatgggtggatagggtgcagcaaccaccatggcacatgtatacctacgtaaaaatcctgcatgttctgcacatgtatccaagaacttaaagtaaaataataagtaaataaataaataaaaaacttcctgggtaaactagcttatattccacttgaaaaataaataaataataataaaaataaaaacaatgttctttttttgtaggaatgagaagaaaatctaaataacttaagtggctgttatgtctggtttaattacagaaatttcatagtccatacataacctaccttgtctgcacgtgttcttattatatatatatgatattagctttgaaaatcatgtaaacctgacaccttaatttcctctcaattctaaattttctaagtcctacaaatttggggcaataccaaccaattttattcttctcaaaggtctgtgcaactgaagtcatggttgcagttcgaggtcatagatataacataccaaaggaattaacaaaatattcagcagaatacatgtgtatagtactctaaataatgatatcaaatcttctacaaagttactattctacatattgactacttcacctctttttggttaagttacattacataaaacacagtagagctcattagaaggtacagattcagcaggttgactttaggagaaaaatcgcatctggtaaattttacaactatgatgcttcctttaaatgttttttctccattggcctccattttcttggcaaactcaagacaaatgtattcttctgccaaggattggtgtcattcccaacagtcccccaggagagtggcattcagatacaatggatgcaaggtttcaaaagactaactcaattttctgtgttcttaggatttttctgttgtggctttggattctagctttttgagatgattttgtttggcagctaagagagagtgactgacccagccataaatatttggccccttcagagccaggtaacactggcagtatagtgtagtcaaaaatgcgctcaatcaagggttaggaaaccaggtaaaaagccctcctgccacatactagttgaggatacaataaaataatggttaagcacattctactccattgcattttatggacacttaaatacatacacattaaatctgaatcgtctgtgtggcccagatttttggttttggtattaaaccttaagggctatgaattaaaagggaaaaaaataaatcaaaaaaacaaaaataaaaagagaggtcagctcactgtcttggccatttttcagttcttttcctcataaagtactttgtatttcttctattctttgtatttcttctaaaatcaacattactggctcagatgcctattagtatttcataaacaagaagacacgcctcctctcttacctcagatagctggctcctggaatggatggttgacacaaggttcagccaactgcaatgctagtgtttacaaatgaaataagtaaaaattacttccagacaccaaacccatatttattcattaatagtcataacctcttatatctacataatggtttcttgttttacaaaacattttcacattcattgcaccccacaggaacccgatgaagaagcaggaagagatgattctactggcttcataggtgaggaaacagaagctcaaagagggacagaaaggatgagaaaggaactaacaccatcctcatgattaactttacagaaaccatataaaatgaatattattgtccacattttacagaagtagaaactgaagttcacaaaaggaaagtaatttgcccaagattacacagtttagtatctggcagggcatgaatttggagccaaagtttgtgcctgctagtccagtaatccttcctttctacttcagtttttcctaggttattaggctagggaaagacaaagacaaacagcaactcattgtcttaattcacaaggcttggtggagagagaaaataaaataaaaccagctatttgattgaaatgaggaaatgggaaaagtacataggatttcgagccagtcagatttcctttaatcaatggccttaggcaagttatttaaactccatgagtgtcaatttcttcatatgtatgtgaagattatgatatatactccatagccaaagttgcccttagttaaactttttaaataagatttctctccattattccatatatatggttatagagagcagtgataacatttcttcccataaatccacatttatatgatcaaaagataacattataagcacattaggcaagagaatatctctttgacttatgtttcctagttttaaaacaccgaaatattaatctatgtcactctcacatgacctcatctaacaagagacagcccaaaaacttttaagattttaaaatcaaaagtttccttgacccctaaaaagcaaaacagatactgctttagttgaaagacctgctgatgaatcgcacatcattttcaactttgtgcccataatcatgccctaggttcagagagttggagtttccaccagactctaagaacaaagcaaatttgttttaatagaatggatggatttattgagaaatataagacttctaggaagttttgataaaatgtcccgtttacataaaggactcaaaacaggttaagaaaagaacatggatcctgcaactatacccctgaacttaaaataaaagtttcaaaaaaaaaaaaaaaaaaaagagcatgattgatcagatgccctgcaagaaacttgtcatctaccaccaaatgaaaacattaatcatcttttaacatcatgctttattttatagcttgaaaaatcacaatgaccattatgtctcaaaccattccctttataactccaatgagaccttattacccaaattttacaaatacaaaaaccaaacttcaaagatcacatggttaacatggagcagataaaaatgtaacactgtatcttgataccaaaatcagtaagcaccctcctactacatgacgtagcctcccaattgctatttgaagagggtaactaaacaacttcaggaaagggaaaccgagtgtatagcacagaaaattcaattgtcgaagcactaacacacacttagttctaagttctgctttattagcaagtgaaaggagaaagagtagacttcacatctgtggtctaaccagaaggtgacacattactaagctaaggcaaaaggagtgtttgatgcagtgttaccataaacactttctcagatctcaccaggaaagtttcaagatgcaacatccctgggcaaagtgtcgaagcacaagccatatacgcaagtctgtaccagtgaagttttgtgaagagtgtgatacagtttgactgtgtccacaccgaaaatgtcatcttgaattgtaaaccccatgagtcaagggtgataccaggtagaagtaatccgatcatgggggcaatttcccccatgctgttctcatgatagtgagtgagtctcacgagatctgatagttttataagcatctggcatttctcctgctggcagtcactctttcctgccgccctgtgaagaaggtgcctgttcctcctttgcctttcaccatgattataagtttcctgaggcctccccagcaatgtggaactgtgagtcaattaaacctctttctttataaattacgtggtctctggcagttctttatagcagcgtgagaatggactaatacaaatccttcaccaatcagtctcattttaagcaataggaaagctgaagtctttctagctaagaagttcaccagccctcttcacgtggattgagtggcatgtgtcctgagtagctcctgagtgtttcataatgcaatggagttttccataattccatacagacatctgggacaactgacaaatcccactctagccttttggtaatgaagccagttatccttggctgcctctgtgtattttataactaactgctgacccagaacctgacatgtctgcatcctttgtcaaaccatccatcctctctcccctcaaaaatatgctcaccctcagaagcaattttacagaagcaactatattttggagaaaaacaggatggagtaaatgaaggtaagataataaagagagagaagcaagaaaataacagggggtaaagaaaaagcagaagaaaatggaatgacatggaaatgaaaagtgcagagatcagctgcaatgggtttttcacaaaccatggtgtcctttgaattttccaccacacctcacaacaaaatgtaaccatccctaagatgattatcttagtattatgaacaaaaattctaagtgttattgaaccagtgtaaagctaactcaaaatacttgatattttgtaagtgctttagtacctcaataagcaatataagagtatcttataaaaactcccactaagtcaataaactggtacctctttcaccctggtgtccaagatattcattccgaatagggggaatcatattgaaaagaataatgaaatggggatggaggaactgggttctggttttagtgctgtaattatcaaatcttttgattagaagttgcataaaatacacattctgtgtttctcttttcacagttatcccaaaaccactgcgaaaaggccaataataatttggtcattttcataagtttcatgtggcaacagaggtagtagtaaaaggattacttaacctaacatttattaaaataaaacaatgttttaaacatagaagtctgtccccagaagcaactgaaatgttaaatcaggccaaaggaattagatgacaaatatggactgccctgcattccagtcatcaaataccacatacaatttaaagtgcactctcatgccaccctaagatacttatcaagaatacaaggtattccatagcttatgatttggttgtctcattaaagtaatgtttgccaggatttaattgcttccctctctgattttaatttccacacctgtcagcatctatcagaggcactgaaatcttctgacatctggttgattgtgttgaaattaatcagattttttaaaagtaaattgctttggcctaaaggtaatgctcaacttcttaatgttatatttataagggctctatcaatggaatgtataatctagaaataaaatgagagactttaggaattctgagcagaaatataagtagcttacaaatctccagcactggacttttaaagataagtactttaagagtgacatcagtagcatggccaaccagaggcccctagctctcgtctctttcacaaagacagccacaacaacaatcaacaactaaactttaacaaaaataactgggccaggcacgatggttcgtgcctgtagtcccggcactctgggaggccaaggtgagtggatctgttgagctctggagtttgagagcagcctgggcaacatagggaaaccccattgctatatagaaaaaaacaaaaagatgaactaaaaacagaagaagaaaaaataataactaaggcagtgtaccagactgcatcagagaagtaacagaaaccctggatagcaagaaactcagaatgaccacatagagaatagaaacaaaacacctggtctttaccacccatcacccacttgggatctgctggaaacagggaggaacttctctctagggtagaatggtacacaaaaggatcccagcaagccccatcaacaccttgaacagctacagacctcacccatggagtctcatgtagtcctcacaggagccaagtcccagctgagggacctgcctgaagtccacatagccgtgcttccccaagaaaaagagcaaccagtgtgacctgccctctgtggcctgcgcagctactgcgctatgccgtcttggaaatggagctttggctggagtgtctcttgctctgggagtgcatagctatgacactccatcactaaggctaagctaccgttgaaccacccgaacccagtggcccgacatccccaagccgagctgccagcaactgttccactcttccccatgggcccaggtgaaggtagagtcacttaatctacctttcaccctccccttcaggccagtgctgaagcagtaccctgcctcctgggaaaacagtacattggccactcagagcggtcacgcaccccagtacttaatctgaagtagcacccttcatcccagggaaatggtacctgggctgcctagaaaagtcatgtcccccaggcctgagctgaagtggcatattgtcccttggtgaattggtgccatcgctcagctgagcagctgtaaatcccaaagctgagctgatgtgataacccacatccttggaaaactgagcagtggctgggctgatctgagacactccagcctaaagggaaaacaactctaatacgctgtttccctggagctggtctacctgcttagtgtcagagctgctaagatacccctctccctgtggcatacagccaccactgtgctgtactctgcccccactcagggcacaagtaacagctgtatgttgccattctggggtactgctaccgcatgtggtcttacagagtctaaggtactgctgagtcccaacatccaggggtcaagaatcactactacatggtgcctcatcccctgagatccaagttgccactgaaccctactggctcatgttgccaaatcagggcatatcctgctctctgggtccaaacttccctgcactccttctttcctggagttgagccactcacagctgggactgagtttgtagagtaatgtctcagagtcacaaatcctggctctgtgggaagcctacatccaaccctagcacagagagtgaacctgtaacccaagacccaggtgtcacaataggttggcaagatcctgggcataagactctagtcccacagccacttcaagcacctgcacctagaactcagcaccactgcacttgcttgtaggtcatgtgatatctgacatgaagagcagtccccttggctaaatctccccattatgaaaaaaataagaataggaggacctcaaaagcccttgacactgaggacattaataatctatgccaccaccaccactgccacaaatttctacaacttaagctactgaggtgcccacagttattgctgacattgaacgtagctttagaagctgcatggagaccctatcactgcatctattcagaaacaaagtcatcacacccctcccaactgtaacaccaaccctaattgcaagcggaagtctttttttatgaaaaccactccagaaagtttgtatagaagaggtaattgttccaccggatgcaaagacatcaactcactgacacaagaaatatgaaaaagcaataaaatatgacaccaccaaaggaatgtagctctttagtttcagactccagtaaaaaagaaatcaataaaatgccagaaaaggaattcaaaataatgatcttaaggaacctcagtgagatacaagaaaatacagatagacaattttactaaatcaagaaaataattcacaatatgaagaagaaattcaacaaagatagacataataaaaaagaataaatctcaaaaataaagaatttcatgaatgcattcttaccctcataccaaaaccagacaaggacaaacatgtaaaaagaaaattataggccaggatctctgatgaacatagatgcaaaaatcctcaacaaaatactagcaaactgaatccaccaatacatttaaaggagcatttactatgatcaagtggtatttatccgagggatacaaggatagtttaacacaggtaaaccaataaacgtgatacattacctcaacaaaacaaagtacaaaaaccatgattatctcattagatgcagaaaaagcacttcataaagttcaacattccttcatgatataatatctcaagtcaggtataaaagaaacataccttacctcagcataataaacacttcacatgataaacccacagtcatcaacatactggacacgttcaaattgaaaggtttcttttaagctctggaacaagacaaagatgctcacttttaccacttttattcaagatagttcttgaacaggcgtatacaccaatgggacagaacagagaacccaaaaataaatccacgtatttacagccaactgattttcaacaaaggaaacaagaagaatctctttaataaatggtgctgggaaaactggacatccatatacagaaaatggagccaccatgagatatcatctaacccaagttagaatagctattatcagagacaaaaaaaataagaaacgctggcaaagatgcaaagaaaagggaattcatacactgttggtgggaatgtaagttagtacagccattatagaaaatagtatagaggttcttcaaaacactaaaattagaaatattggctgggcatggtggctcaggcctataatcccagcactttgggaggccaaggtgggcggatcacgaggtcaagagaaggagaccatcctggccaatatgatgaaaccccgtctgtactaaaaacacaaaaattagccgggcgtg

SEQ ID NO: 311 - DNA, 2003 bp, Homo Sapiens
atccgcgagagaggcgcgcgcccgccaccgctgggggctccagccgcccgccgacccgggcctggcagaggggacgcggcgcccaagccgctcctccggatggcgacagagacggcctgacgcgcccgcagcctgggccccccacggggaggacggccgggccaggtacaacttgagctctcatctacataactgaaggctgcacccagggctgtaaagagtgaaaatgcattgccgaagcatgagcacctcctgcagttctcagtagacatttgggaagcgagtgaaccgccctgtatggagtgtttggaggaggtcggagggtgtcgggcctgagccaggggctgccctgggcctgtgtcgggtggcgcatgccagaggaatgagatgggaagggcatgcacgcggggtcttggcagccctggagctggcctagatgcagcagctttctgataaagcgaaattgttccatcggcttgccatgctttgcttagccatccgcacttcactgttgggcgaaagaagattttaaagaacacccttagcagatgtcagagtttgggatttggggtccatgatacccaaataagattccacttgaagaaagtaacacgaattgctttcaacacatcaatcaacaaagagcattgatggatgaagaggacattgataaatgggatgtctttttgctgaaactctaacttacagtaaaggggggaaactcacagaagcccagtggaagcttctggagccaggagctacactgactctctccgcagagggtgtggaggggtaggcggcagtcagcccccagcccagagtggagggcacctgggcacatgtgtgatcagagcccacatggagggaggccagggtccagcttcccttcactctgggaacatgggaggccctgtccccaggccatggcacacagagggaggagcaggagctctggcagcctcagaggtgtgtgccaggccgcagcctattggaaattcctcaggagtgcatggcctggggtcccccagcctgcgggaggcagagggggcgaggccaggtcccccggcctgtgggaggcagagggggcgaggccacgtccaccagtccgaagcctgtcctgcccagcttgctgtgtgactctggcctcggggggaacattatctgaaatgtacatagtggaatccaggcagtgttcaccccttccctctgtgccctccgtggtcttctgtgacctgggatttgttggtcattggcagaaacagaagatgcattattattactgtaaaaggtaaagttgtcccctaactggctcaactgtccgaagacccccctgctttttctgcttttccttgtgactcagcctggtctttcttcttccagggtggcatcccactgactcctacgcagccccaccctggttccctcactcccaggttcctggtccctcagggtcctagggctgagtcctccatagcccccacacacagcccagagctgggactgacccacggcataggacaaactcctccaggcctctgagagaactcctgggctttcatctacatgattcagaaagaatcttttttctctttcaaatgttaatgtttttaatttccttttttttttcatttttcattataactgctaagatttttctaattggcatgccaactgcttgcagacttgacctgtttcttgcaaaaaaagaaaatcgcttaatcattaaatacaattattacttcattcttctatctcttcagtctaccaaactattatatactcttgatgattgtcattttcgtcaaaagaaaactgtatccagaatcccataacacttacaaattaagtgtcttaatttttcaagttcttttggggcttgccatatgagtgtattattcttgcatattgcacattcattttctattatttttaatacataattctacaaaataagcattcttcatgatatatatttgtttgagaatttcttaataaaagatggg

SEQ ID NO: 312 - DNA, 6403 bp, Homo Sapiens
ggcagaagggacgtccccaaatgacactcggaggccgcctccctgggctccggtgctcggtgccgggaggagcggcacggctttctaccccgcctcaggtgcgccagcacgttttctgggcagcatctgtgtgttaggcgaccggagaggtgggttccttatagggaataagaaaactgaaactgacttccaactgcaggcagaaggaagcagtggtcattgctggaggttaaaactgttctgaccgggcgcagtggctcacgcctgtattcccagcactttgggaggctgaggcgagcagatcacgaagtcaggagatcaagaccatcctggccaacaaggtgaaaccccggctctactaaaaatacaaaaattagctgggcgtggtggcgcgcgccggaagtcccagctacttgggaggatgaggcagaagaatcgcttgaacccgggaggcggaggttgcggtgagccgagatcgcgccattgcactccagcctggcgactcagcgatactccgtccccctctccccgccccaagaaaaatctgttcagtggggagcgacaaggaaggagctttcagcccgactggggtcgcagggaagaattcaagatggcgtgtttaggagctctagctccttgacaaattagtaaaatgttagtcttaggagaagaacgaaaaggctctcctaggctaagaaacagcatacacagtgagaaacctcagaagaaataaaattcaaggaagatagcaacaacgaaaacatcagaaggaacactaaagtagtcaaatcagcctagcagaaacaaagtacgttaaccaatggaaaactgacggagagaaataaactgtttttgcacagctaaatggaaatgacttttgaattatctgctttggaagattatccatgacactgttctgccctgctctgctctaacaacatttgtaagtcactcaacagttaataataaaagtcagttttgaatattgcaggttttagacacagaacaaatgtaatgtgacactgtaggaagaatgaattctccttagtcccaaattccttttttttttcttagattcgggaataagtaaagatacaagatcctcttaaccagtatcagtataattgttccctttagatttattgctgtcaccccaatgctcttctttctttctagaggaaaggaaaagaaggaggtaataggaaaagtaatgggttgtcctgatgttactgtgtctaggatgtcattgccactggtctcctcagatcaatcattctgcctaataaacagaaaaataacatgggcagcctcacatgcaagcctttacacacactgctaaagagacctcgcttcctctgagaagtgaggatgtgagaatgaaggattgattttacagaactggatgacaggttaaattgggcatctggaggtttatattcccatctccactcaccaagtttcatcctccatttatgaccaaggataggtataacatctgatcttgatggttactgtttcaaaaaacaatctgatcttttttataaagttaaacatttacttaatcatgcagcatactaattcccactcctgggtatttatccgagtgacataaaaacaagttcacacaaaacctgtaaacacatatatgtctttattcatataatagaaaaaacacaaaccctaaaatggaaaaaacataatgtccttcacctggtgatatggtttggttctgtgtccccacccaaatctcatctcaaattgtaatacccacgtgttgaaggaaggacctataaccttcacgtgtcaagggagggaagtgattggatgatgggggcggtttcccccatgctgttcttgtgatggtgcatgaattctcaccagagatgatggttttaaaagtgtttggcagttcttccttcattcacacacactcactgtctctcccctgtgccacataagatgagcttgcttcccttctaccataactgtaagtttctgaagtcctccccagccatgcagaactataagtaaattaaacctcttttctttataaattacctagtctcaggtatgtctttatagcagtgtgaaaataggctaatacatctggtgaatcaataattaaaatgtagcatagctataaatggaatactactcagtaataaaagaataactcgatacatacaataatattgatgaatctcaaatgcattatgggaagtaaaagaagccaggctccacttatgtgacattctggaaaaaggaagactatacggtcagaaaacagatcagtgtttgccaggacttgggggtggggggtggggagtgattgactacaaaagggcatgaagaaattttgaaggggaggtatggaacaggtctgtatcttgactgcagtggagttattgatacttaccaaactgtacaataaaaagtaaatttttattgtatgaaaattatgcctaaattaaaaactattaataaaatcagcattagcaaaatatatgagtttatacacaagagactactcaaccattgggtaaactaattatttttaaacaaataccattgattttaatctttttatagtttttatacaggcagagaaataatagtgattctgctcacctaaaggaagatagacccaattcaaaggtacagaattttccccaaatagtatcataatttttcctttcagattccaaaggatttgcatgtaaattctatcatgtgatcctcagaaccaccctatgagggtaagcagaacagatgatccatgatattccattttataaatgaggtgcaggttaaatatttagccagtatttcttgataagtatagtccatttatttcaacaaaccttgattgagggccccaatacttgttgagcttttgctgagccacccctgctctagaggagcacatgctctggaaatctctaaggaaactactacaactctaaatagatatggtgtatagtgatactgtgactaaatattcactgcaaatttcctctaaaattatagatatacattactggaataattagtatctcaacatcttcattaactatgaatctactatgtatatatcatcaccatgtgagtattaatttggtacaaataggctgccaactctaaaattatttgatgtagggcaagtacttttatctttttagccataaattttctcatctgtaaaatgagaggagtaggcatgtgatcattaaatcctgggttacggtaggaggcatcaatatgaaatgtttagcttaatatagatacagatgggtaaatatagaaatacttaaaaatgcatgtggattcatgtttaatacattagtatacacacatatatttccaagttctgtcctccgaaggcctagaagcaatgacaagcagaagcaaggagcacacccagcatccagttttttgtttctaatactgttctccaacaaagggaaccagagcccttgagaaaaatgcctaattctaggactggggcaggggatatacaagatgagtctgaaacatcttatagtgccagaaaataaacaagtgctttaaaaagacacaaaaaactgatggtatatcaaagtgacataggagccaactaaaagagctcccaatagctaaagctagaataattcaaaaaataagtaattcagcattggatttaacccaaattataaaataagatccatgagttcatactgatacaagtaaatgattgaagaaacaaataattgggagataattctcatattgaaaaattccaaaaaatttatgtactctaccctcgagaagatggaacataattctccaccccataagcatgagtcaagcctagtaaatgtttttcaaagagcgcagtatggaaaggaggaagaacactacctcaaccagctgatcaaggctaacatctctagtatgtcattagtggcatgtaaccttgatatgatatgatgagaatagcatttgatctttgatctgtttcctccccgaaactcattgccccagcctaatcatgaagaaatatcagacaatctcaaattaagtacaaaataaccagtactcttcagaactatcaaggccaccaaaaacaaggaaagtataagaaactgtcacagtctagaagagcctggtgatgactaaatgtaatgtgatatcctggatgggatcccaggacagaaaaagaacattaggttaaactaaatcaaacttgagtatgaaacttctttttttttaagtgcctaagtcctgaatgacaacaaaagactgaagaactgacaacgattagaggacactaaggagacttaacaactaaatgcaaaatgggaccctgaatctgatcctggaacacaaaaactaaattagtagaaaagtggtaaaataggtggtcgcgcgcccgaccgccgcagtcccagtcgagccgcgacccttccggctgcccccaccccacctcgccgccatgtgcctccgccgcccagcgctgttcccgggcgtggcgctgcttctcgccgcggcccgcctcgcggctgcctccgacgtgctaggactcagggacgacaacttggagagtcgcatctccgacacgggctctgcgggcctcatgctcgtcgagttcttcgccccctggctgattgcactgccaacactaacacctgtaataaatatggagtcagtggatatccaaccctgaatatgtttagagatggtgaagaagcaggtgcttatgatggacctaggactgctgatggaattgtcagccacctgaagaagcaggcaggcccagcttcagtgcctctcaggactgaggaagaatttaagaaattcattagtgataaagatgcctctatagtaggttttttcgatgattcattcagtgaagctcactccgagttcctaaaagcagccagcaacttgagggataactaccgatttgcacatacgaatgttgagtctctggtgaacgagtatgatgataacggagatggtatcatcttatttcgtccttcacatctcactaacaagttggaggacaagactgtggcatatacagtgcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaatgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggatttctcgcgtgatgggaatgctctggagaggttcctgcaggattactttgatggcaatctgaagagatacctgaagtctgaacctatcccagagagcaatgatgggcctgtgaagctcagcaaagacctgaatatcgtcatagccaagatggatgccacagccaatgatgtgccttctccatatgaagtcagagttttcctaccatatacttctctccagccaacaagaagctaaatccaaagaaatatgaaggtggccatgaattaagtgattttattagctatctacaacgagaagctacaaacccccctgtaattcaagaagaaaaacccaagaagaagaaggcacaggaggatctctaaagcagtaggcaaacaccactttgtaaaaggactcttccaccagagatgggaaaaccactggggaggactaggacccatatgggaattattacgtctcagggccgagaggacagaatggatataatctgaatcctgttaaattttctctaagccatttcttagctgcactgttatggaaataccaggaccagtttatgtttgtggttttgggaaaaattattggtgttgggggaaatgttgtgggagtcgggttgagttgggggtattttctaatttttttgtgcatttggaacagtgacaataaataagacccctttaaactgtaaaaaaaaaaaaaataggaatgcggtccatggtttacttaatcgtataatatcagtgttcattttcttattttgataattgtcataatgttgtgtgaaatattctctttagggagcctgggaaagaatatataagaactctactatttttgtaacttttgtggaggactgcaatcatttctaaataaatagtcttaaaaataactaaagtaataaaaataataaagtacatgaggaagtccagtgtcatgttgtatagtcagaagattcttcaaatgagagaatttgcacccagggaaatag

SEQ ID NO: 313 - DNA, 1137 bp, Homo Sapiens
atgattaatatacataaaatacacccactaattaaaattataaattattcatttattgatctccccacaccatccaacatctctacatgatgaaattttggctcacttcttggtgcctgcttaattctccagaccatcacaggattatttctggccatacactacacaccggacaccttaactgctttctcttcagttgcccatatcaaccgagttgtaaactacggcagaatagtccactattttcacgctaacggtgcttcaatattcttcatctgcctcttcctgcacgttggccaaggtttatattatgggtcacttatgtccctagaaacctgaaatactggtattatcctcctactcaacaactatagcaacagcgtttataggctacatactcccatgaggccaaatatcattctgaggcgctacagtaattacaaatctattatcagccattccatatattggaacggatcttgttcaatgaatctgaggtgggttctcagttgataaagccactattgcatgacttttcaccttccattttatcctacccttcatcattatagccgtagcaattctccaccttttattcttgcatgaaacaggatccagtaacccttcaggaatttcatcagattccaacaaaatcaccttccacccttactatacaaccaaagatatcctaggtctaatatttctcctcctccttctaataactctagtattattttgacctgacttcccgagcaatccagacaattacactttagccaaccccctcagtatcctaccccacattaagccagaatgatattttttgtttgcatacacaatcttacgatccatccctaataaactagaaggtgtactggcccttctattctctattctattctagcagttattcttgtactacatacgttcaaacaacaaagcataatattctgcccattaagtcaatgcctgttctgaattttagtggcggacttgcttacagtcacatgaatcagatgatagccagttgaacatccttttgttaccatcggacagccagcatctattatgtaattctccattttccttgcccttataccactcactgccctaattgaaaataagctacttaaatga

SEQ ID NO: 314 - DNA, 3105 bp, Homo Sapiens
cagacggttaccagggcggctttgggtgaggacattgaaaaaggtcagactccctgggagcagcgccctggactccattctcatcacagaccagtggttcccaattgaagtcagttttgctcctcagggcacacttaacaacatctggagacatttttaattgtcctgaccgagaggacaatgctactggcatctagtggacagaggccagggatactgctgaacatcccgcagtgcacaggacgcctgcaacacagattatccagccccaaacgtcaatagtgccggagttatggaaccctaatgaagacaattcttgaaggcatagactgaatcttatttatctttgtttccctcatgtctcacaagcagagtatgagttcagcaaataggagttgaacagaaatcaggaggaggtgctgattgacaggaaaaaagaaagatttagtttagagctgagaattcagctggacagccataggggctctggcatggagactggaagtcagaagagaatttgcagcaagacatttagagccatttatccagccatcataattttattgagtaactattttgtgtgaggcactgtactggatgctttggcaacagagataagcaaggcaacccctgtgaataaggcactcctggtctacacacagtgggagaaacatagaaattcatctcttctgagcggagcctgtgggaacccagaggatggacacccagcgtggtctgaggaatcatgggccaaaacaggaggcatcaggagagatctcttgggtaaagaagagtgagggctggaaggatattccaggcagtgggaacaacttacataaagtgagaatattgcaaatgcctagcgggtctgtagtgagagggtcatgaggcggaggagtgaggtgcgtagcaaggaatagcaggtggggccagagcagtaaaattaaccattgttctatttgaagaagggtaggacgcatttttaggttttttggctatttctccttttggtaatagcatctattttcttttaaaggactcacttgtacgtgtacacatttctcaggagtcctgtcaaccactgggaagaaagaggctggacttctgcattgaacccaggaacggggtttcacagcaatggaaacctggggttaaatatcaatggaaccttacatgacttgaagaatctttaatacaagctaggttttgaccccaaattagacatttggcagcctctcattacagtctatcttgcaaacctcagtgtggcaaggaatcagattcacccacactccctagtctaaaggattgtcctctgatccttccaggtggattaagccctttctaatctgtcatggacagagcaatgtacctgcctttgtttgttttccttaattctttcaagtgcctttgggtaataaatggttgcgtactcaggtttttagtccaaattttttttcttcaactctaggtaattgctttacttgccagaataggttaccatagcaatattttctgagcaataggtgaactgaattgtactattgaggaagcccaggagaaaaatactaataacaacctgagaaagtctaatcactttatggagcctcagggctgtgaagagggggataagacggactccctgggtgattaggaagtgctgctgccagctcacacaggacgcaatgtgagaagccacccatggtccccaaattcccccatctcctgatatccaagtcccccatccaagctgcttaaatgacaaaagacaaatgtaaactggggaaacatttgaaatgcatatcaaaaaggggtatttcacaaagctctccaacaggaggcctaggaagatggtaacagcgataccagaataatgtttggatcttccagagtgcccatgtgaaaacagagcaaccaaactgaaaagccatggacaacaaaagtcggtgacaaagtgtcaccttgaatcctgaaatacaaatgagttcaactgtcaaatggctcaggaaacagcgaaatctccaatggaccgtacaggcaaacacaagaaacttgaaaaagaaaaacagagaaaacaagaaaatcctccatgacaagatcatctgggagctgaaaagcaatttggatgtagtgcttcataacacaaaacataagctcctttaaagcagtgcaagtcccattaagtctttgtgatatttttgcatttcttcacacatgatttaaaattcacctatttccaaaaagatgtacaatgaaaaaagaagacaataaacaataaaaatagagataatttataaaagtacaacaaaggaagggaaagatatatgcaattaataattaaatatgagccacagtgagatacaaggaacactgactgagatggctataatttaaaaagaaaagaaaaaatggaaaataacaaatgttgcaagaatgtgaagaaattgtaacccttatacactgctgggggagtgtaacatggcacagccacagtggaaaacagttcaccagttcatcaataagttaaacatagaattatcatatgacgcaacaattccactccaaaggaaatgaaaacagggactccaccagatacttgtatgtctatgtctttgcagccttatttacaataaccaaaagatgtaaacagcccaaatgtccatcaacagatgaatccagaaataaaatgaggtttatatattccaacggaagatgaaaagggatgaaattctgacacatgctacaagatggatgaaccttgaaaacactttgctaagtgaaaatagccagacacaagaagacaaatactatacaattttacttaaagtatctagaataggcaaaactaatagaaaaataaagttaattagaggttaccaggggttgggagaagggaaaatgaggagttatggcttcatggttagacagtttttgtttgaggtgataaaaaaaagtttgggaatagtagtggtggttgcatatgttgtgaaggtaattaatgctgctgaattgtacactttaaaatgtttaaaatgataaattttatgtttataaaatgtaatatgtatatatgtgtgtatatatatacatatatatatatgtaaa

SEQ ID NO: 315 - DNA, 14733 bp, Homo Sapiens
agagctacagcggtctccgggtggcgaagtgcggagacggggttttggagacggtggatggaggagggggagggaaagctgccaactttggataccaaccccgtacacccaccgaaggggatgtcccactttttccagcgctgggagcaaaaagataacagtgagcgaggttgaaaaaaacagggtcttgcttcgttgcccagcctggtctcaaactcttggcttcaagcaatcctcctgcctcagcctcccaaagtgctgtgattataggcgtgagccaccgtgcccccccccttcttctgtgtttaggcttatatgctgttctctaatttctaccactgatgtttatttttattcatatttcttatttattactatatgtatttatataaattttcccctaagctctcccttaaccaatgtactatatagtgcttttatagttgtcatttttacagtctgattttcttagcattgatatcctttttttttttacatttttatttttatttcaacagttttgagggaacaggtgatgtttggttgcatggaaaagttctttagtggtgatctctgaggttttggtgcacccatcacctgagcagtgtatactgtatccaatgtgtatgtagtcttttatccctcactccctcgcccacccttccccgccgccagtccccaaagtccattatataattcttaggagtttgcatcctcatagcttagctcctgcttaatagtgagaacatgccatgttttgttttccattcctgagttgcttcacttagaatgatggtctccagctccatccaggttgctgcaaatgccattattttgttcctttttgtggttgagttagtagtattcccatatatattcccatatatatatatatatatatatatatatatatatatatatatatatatgtagtattcccatatgtatatatatgtatatacaccacattttctttatccactcgttggtcgatgggcatttaggctggttctgtattttggcaactgtgagctgtgctgctataaacgtgtgtgcaagtgtctttttcatataatgacttcttttcctttgagtagatacccagtagtgggattattggatcaaatggtagttctactattagttctttaaggaatctacatactgttttccatagtggttgtactggtttacattcccaccagcagtgtaaaagtgttcccctttcaccacatccatgccaacatctgtttttttttattttttaattatggccattcttgcaggagtaaggtggtatctcattgtggttttgattggcatttccctgataattaatgatgttgagcattttttcatttctttattggcaatttatatatatatatatatatatttgttgttgttgttttgttttggtttttgagacggagtcttgctctgttgcgcaggctggagtgcaatgactcgatcttggctgactgcaccctctgcctccctggttgaagcaattttcctgcctcagcctcctgagtagctgggactgcaggcgtgcaccaccacccccagctaatttttgtatttttagtagagatggggtttcaccatgttagccaggctagtcttgaactcctggcctcagacaatgctcgcctcggcctcccaaagtgctgggattataggcgtgagccactgtgtccggtgaatttgtatattttcttttaagaattgtctattcatgtcctttgcccactttttgatgggataatttatttttttcttgctgatttgtttgagttatttgtagattctggatattagccctttgttggatacgtagtttgtgaagatttttctcccactcaatggattgtctgtttactctgctgattatttcttttgctgtgcagaagctttttaatttaattaggtcccatctatttacctttgtttttgttgtatttgcttttggattattggtcatgaactctttgcctaagccagtgtgtacaagaatttttcctatgttatcgtctagaatttttagtttcaggtctcagatttaagtctttgatccattgtgagttgatttttgtatcaggcacagatggggatccagtttccttcttctacatgtggcttgcgaatcatcccagcaccatttgttgaatagggtgtcctttccccactttatgtttttgtatgctttgtcaaagatcagttggctgtaaatatttggctttatttctgggttctctattatgttgcactgatctacatgcctacttttataccagtaccatgctgttttggtaactatagccttgtggtatagtttgaattcagagggtgtgttgcctccagatttgttctttttgcttagtcttgctttggctatctggggtctttttttgtttcatatgaattttaggatttttttttcaagttctttgaagaatgatgatggtatttgaatgcaaattgcattgaatttatagattgcttttgtcagtattgtcattttcacaatattgattctgaagcagcatcattgtctggggtaatacccaaggcttgttgtctcacaccaagggaatcgaggatgtggacacacacatgaagtgaggtttaatagcacaagaaagagaaaggagaacagctccctctcttgaagggggggagggagagagagggagagagacagacagacagacagacatgggggcagctccctaatgggaattctagcccacgggggagtgcaccagattttatagacaggcttgaggaggcagtgtctgatttacatagggcccacagattggttggaccgggtgtgatgtttacatagtgtgcgaggaagctggctgccctaccctaatcttattatgcaaataggctttccacttggtcagtaccatgttgtctgctccctactgcacacacggttggaaaagaaaagggaagatggagccaccattttgaacatgcctagtcccaggtggccttttcctattggcacaactgctggcattcacccatgcaagcttccagcttgcttgtacatgtgtgcagctccattttacaggctgctctttgttagaaacaagatgatttgggggctgcttttcattaaaaggaaaaccttactgagaacttcctcaccctcactatctgcctaaataatttctctttaactcctatatcaaaattccggcccgggcgctgtggcatatgcctgtaatcccagcactttggaaggctgaggcgagcagatcacttgaggtcaggagttcaagactagcctggccaacatggcaaaaccctagctctactaaaaatacaaaaattagccaggtgtagtggcatgtgcctgtagtcccagctacttgagaggctgaggcaggaaaattgcttgaacccaggaagcagaggttgcagtgagctgagattgtgccattgcactccagcctgggtgacggagtaagacgcctcaaaaaattaattaattaattaaataaataaaataaaattcttcccatccatgagtgtgggatgtgtttccatttgtttgtgtcatctattatttctttcagcagtgttttgtagttttccttgtagagatctttcacctccttggttaggtgtatttctaagtattttattttattttttttgcagatgctgtaaaagaggttgagttcttgatttgattctcagcttggtcattgttgatgtaaagcagtgctactgatttgtgtacattgattgtgtatcctgtcagatctaggagctttttggatgagtctttagggttttctaggtatactgtcatatcatcagcgaacagcaacagtttgactttctctttactgatttaaatgccctttatttctttctcgtctgattgctctggctaggacttccagtactatgttgcatagaagcggtgaaagtgggcatccttatcttgttccactttgctgtgggaatgctttcaacttttccccattcagtgtaatgttggctgtgggtttgtcatagatggcttttattaccttgaggtatgtcccatctataatgattttgctgagggttctaatcataaatggaggctggattttgtcaggtgctttttctgcatctattgagataataatgatttttgtttttaatactgtttgtatgatgtatcacattttattgacttgcatatggtaaactatccctgcatccctgatatgaaacccaacttgattgtggtggattatctttctgatatgctgttggatttggttagctagtattttgttgaggatttttgcatctgtgttcaccagggatattggtctgtagttttctttttttgttatatcctttccaggttttggtataagggtgatactagcttcatagaatgattcagggaggattccctctttctctattttttggaatagtttcaataggattggtaccagctcttctttgaatgtctgatagaattcagctgtgaatccacatggtcctggactttttttccattggcaatttttaaattactgttttaatctcactacttgttactggtctgttcagaatttctgtttcttttttatttaatccaggagggctgtatatgcaggaatgtatccacctcttctagattttctagtttgtgtgtgtaaagatgttcatagtagccttgaatgatcttttgtatttctgtggtattagttgtaatacttcctgtttcatttctaattgaacttatgtggatcttctgtcttcttggttaatctcactaactgtctatctcttttgaaagaaccagctttttgtttcatttatcttttatatttatttgtttcaatcttatttaatttggctctgatctttgttatttcttttcttctgctgggtttgagtttggtttgttcttgtttctgtagttatttgaggtgtgaccttagatttctatttgtactctttcacactttttgatgtaggcattcaatgctatgaactttctcctcttagcacgacttttgctgtgtcccagagtttttgataagttgcatcactattatcattcaaataattttttaatttccatcttgatttcactgttgacccacagaccattcaggagcagattatttaatttccacgtatttgtatagttttaagggttccttttggagttaatttccaattttatttcactgtggtctgtgagggtactaatataatttcaattttcttaaatttattgaaacttgtcctgtggcctatcatatggtctctcttggacaatgttctatgtaccgatgaaaagaatatatattctgaagttgttggatagaatgttctgtaaatatctgttaaatcttatttgttctagggtatagtttaagtccattgtttctttgttgactttctgtcttcatgacctgtctagtgttatcagtggagtattgaagtcccccactattattgtgttgctgtctgtctcatttcttaggtctagtcgtaattgttttatgaatttgggagctccaatgttaggtgcatatatatttaggattatgatattttcctgttggactaatcattttatcattacataatgtccctctttgtcttctttttaactgttgttgctttaaaatcttgtttgtctgatatgagaatagctactcctgcttgtttttggtttccatttgcatggaatgtctttttccacccctttaccttaagtttatgtgattccttatgtgttggatgagtctcttgaagatagcagatacttggttggtgaatttttatccattctaccattctgtatcttttaagtggggcatttaggctatttacattcaacattagtactgagaggtgaggtactgtttattcatcatgctagatgaatagaatagggccaatggggttatgttccagaggggattatggctgtctctgttgccagggaagtgggagaaaaccagtagtgataggcctcacccagctcccacgcagttgacggggccagtctcatttctactgtggccctgctaacagcaccaactttatctccaggcaaccttcaggcaagagtcagacctagccccaggctgtaagtttccccactgagaaagcaaatatggctttcaagccatgcctcaccccacctgcccacactctccaccataactcctgctctcctatctgcagcagttttcgtttgcccctggattctgctcaagagagttcatgcccagtcaaaattattacagagttcatttagaagtttctttcaccctgtgacccctcccgaattctaccagctactttccctgagggcccctatgagatatagtcggggttgtcttccctgggcttgaactggagaatggcagtgcctacttggctcttcccactgctgcttctacttttatatttcacgctaaatctgtttcagctctaggtacggttaaatccctcttccataatctggatttttggattccccagtggggatgtgtgtccagatgcaggttttctacctctcacactttgggaactcacagtttttcaccagtcttgaagaattggcagcggcctgccacttctttcaaaggatctgtgatttcttttggtcttcctggttcacttctgcagtggttcctggagcaagtgtccatggtgtgagtcttcacacgctgttctgtccatccaagggggagctgcacatcagccctgtctcctatctgccatcttccttggtcttcctgatatcctttgtgacccaaaagtagtgtgagttagctatttaaaattaatagactaagtttagagcagttttgttaccagaaagtggtcccgatctagaccccaagagagggttcttggatctcttgcaagaaataattcaggatgagtccatagatagaagtgaaagcaagtttattaagaaagtagagaaataaaagaatgactactccatagacagatcagccgcaagggctgctggttgcccattttaatgtttatttcttgattatacactaaacaaggggtggattattcttgcctcccctttttacaccatatagggcaacttcctgacgttgccatgacatttataaactgtcatggtgctggtgggagtatagcagtgaggacaaccagaagtcactcttgtcaccatcttggtattggtgggttttagccggcttctttactgcaacccgttttatcagcaaggtctttatgatctgtatcttgtgctgacctcctatcttatcctgtgacttagaatccctaaccgtctgggaatgcagcccagtgggtctcagcctcgtttcacccagcctatatacaagatggaatctctttggtttaaacacttctgacagttttactgtataaaaaattgagcagatagtacagagagttcccatatactctctctttccccatttaaagattcctctattattgtcttgcagtagcttggtacttttactacaattgatgaaccagtagtgatacattattattaaatgaagtccatagtttacattaggatttacttttagtgttgtatagtttcgacaaatatataatgccatttatctgcccttacggtctaatacagaatagtttcactgtcctaaaaattccttgtgctccacctttttatctctccctctgtcctcacaaccactgatcttttttactgtttatatagtttgcctttttcagaatgtaatataattagaatcatacagtatggacccatttcagaccagcttttttccctaagtaatatgcatctgagtttcctccatgtattttcatggcttgatagctcatttgtttttattgctgaataaaactgtctagatataacatagtttatccatccaagcaagaccttgtctctaagaaaaagaaactgctctaaaaagtaaaacctattaatttttaaaaaggtaagaaccatcaggaatggtggctcatgtctgtaatcccagcactttggaggaccgaggcaagaggattgcttgagcccaggagtgcaagaccagccttggcaacatagcaagaccttttctctacaaataatataaataattagcctgatgtggtggtgtgcacctttggtcctggctacctaggaggctgaggctggagaatcacttgaatccagaaggcggaggttgcagtgagccaagatcatgccactgcactccagcctggctgacagaatgagaccccatctccaaaaaaaatacaaaaataaaaataaggcccaactatatgctatctacaggaaatgcactttaaatataaagacacaaatgagttaatgagttaaaaataaaatattggaaaaatgtataccatgccaacactaatcaaaagaaagctgagtgactacattaatatcaaaatagatttcagagcaaagaatattaccaaggataattaacattatgtcataatgatacaggggtcaattcatcaggaatttgtgacaagcctaaatctttatatatctaatagcagaacttcaaaaaacttgaagcaaaaactgataaaactgaagggagaattagaccaaaaaaagagttaagaataacgtgcatagcatgctattttttatgcaaaaatactaatgtatgcttgaatttataggctacctatgaaagcattatgtaagaaactgataatacttgttgcctccaggaaggggagtttgatggctagtgtacagagagagaagggaatctattcccatgtatgtatattacctattaaaaataaccatcctggccaacatggtgaaatctcgtctctactaaaagtacaaaaattagctgggtgtggtggcaggtgcctgtaatcccagctactcaggaggctgaggcaggagaatcgcttgaacctgggagacaaagattgcagtgagccgagatcacaccattgcactccagcctgggcgacacagcaagactctgtctcaaaaaaaaaaaaaaaaaaaatagaatgtttgccaggcacagtggcttatgcctgtaatcccagctctttgggaggccaagacaggagtatcacttgtatccaggagcttgagaccagcctgggcaacatagcaagaccccatctctacaaaaaataaaaaattagttgcccacagtggcatgtgcctgaagccccagctactcagtaggctaagatgggaggatcacatgaacctaaatcgaggctgcagtgagtcatgatcatgccactgcactcagtctgcgtaacagagtgagatcctatctcaaaaaataataataataataggccaggtgtggtggctcacacctgtaatctcaatgctttgggatgccaaggcagaaggattgcttgagctggacaacatggtgaaaccctcatctccacaaaaaatacaaaaattagccaggcttggtggtgcatacttgtggttccagctactcaggaggctgaggtgggaggattgcttgcacccaggaggtcaaggctgcagtgtgccaagaacataccactgcactccagcctgggtttcagagcaagaccctgtctccaaaagcataaataaaaatagaatttttttttttttgagacaaagtctcgctctgttgcccaggttggagtgcagtgacacgatctcagctcactgcaagctctgcctcctgggttcacaccattctcttgcctcagcctcccgaatagctgggattacaggcacccgccaccatgcccagctaattttttgtgtttttaatggagacgaggtttcaccgtgttagccaggatggtctcaatctcctgacctcgtgatccacccacctcggcctcccaaagtcctgggattacaggcgtgagccgccgtgcctggcaaaaaatagaatttttacagataaataagaaccgaggagtagagaaaagttgtataaataactctttcaaaaaacttttgttggcttcctttccaatttgggcctggcaggatggctcctgcaaagaagggtggcaaaaagaaaaagggcagttctgccatcaatgaggtggtgacccgagaatacaccatcagcattcacaaacacatccatggagtggacttcaagaagtgtgcccctcggccgagcgtggtggcttatgcctgtaatcccaacactttgggaggccaaggcaggcggatcacaaggtcaggatttcaagaccagcctggccaacatggtgaaaacccatctctactaaaaatacaaaaattagccgggcgtggtgctgggcgcctgtcatcccagctactcgggaggctgaagcaggagaatcgcttgaaccccggaggtggaggttgcagtgagctgagatagtgccactgcactccagcctaggtgacagaccaagactccatctcagaaaaaaagaagcatgcccctcaagcactcaaagagatccagaaatttgccgtgaaggagatgggaactccagatgtgcgcgttgataccaggctcaacaaagctgtctgggccaaaggaataagtataagtaatgtcccataccgtatccatgtgcagtttccaggaacgtaatgaagatgaagattcaccaaatgagctctatactttggttacctatgtacacattaccactttcaaaaatctacagtcagtatggatgagaactaactgctgatcatcaaacacatcaaataaagttataaaattgcaaaaaataccacaaacttttgttgcatagaacaaagaaatgtgatggttgttggaggagcctgtcaggtcaagaaatagtgtttttaagatgagggataacagaatgtgtagaattatgggaataaagtaatgaggagagtaaccatgatgatgaagagacagaggggacatctgagacagcaaagtatttaataggtagaggtggtacctggtgaccaaatagtgacctttgctaaaaggaacacctactctctggtaaccaggggaagaaagagtccatgggtacaaatgcagatgaggatatactatgtggaaaatgagggagttcctttctgatggcttctgtctcaacgaggtcattagcttgtcaaaaaatagatgaggtaaggccgggcacggtggctcacacctgtaatcccagcactttgggaggctgaggcgggcggatcacgaggtcagaagattgagaccatcctggctaacacatggtgaaaccctgtctctactaaaaatacaaaaaaattagccgggcttggtggccttccaccacatgatgatgcggaaagaaggccctcaccagatgttagtgccttgatcttggacttctgagctctgaaactgtgagccaataaatttctgtttgttataaatgaatcattcttagatattctgttatagcagcacaaacaaactaagacaacaacctacagaatgaaagtatttacaaattatatatctgattaggatctactccgtagaatatagaaagaactcttacaactcaacaacaaaaagacaaaccccccaattttaaaatgggcaaaggacttgaacagacattttccaaagagggtgtacaaatgaccaagaagcacatgaaaagatgttcagtatctttagtcattagggaaaggcaaatcaaaaccacaatgagcctgggtgaggtggctcatacctgtaattccagcacttagggaggctgaggcaggtggatcacttgaggtcaggagttcgagaacagcctggccaacatggtgaaaccctatctctactaaaaatacaaaaattagcggggtttgatggtgcatgcctgtattcccagctactcaggaggctgaggcaggagaatcacttcaacctgagaaatggaggttgcagtgagccgagatcacacctctgtactccagccttggcaacagagcgagcctctgtctcaaaaaaagaaaaacaaaacaaaacaaaaaaaccacagtgagataccacttcatatccattaggatggctagaattttttttatataacaagtgttagcaaggacatggagaaattgaaactcttgtacattgctggtgggaatgtaaaatggtgcagccactgtggaaagcagtgtgatggttcctcaaaaagttaagcatagaattaccatataaccccaagtcccactgctaggtatatactaaaatatttgaaaatgggtatttatttatttatttattaaatgaggcaggatcttgctctgttgcccaggctggggttcagtgttatgatcatagttcactgcagccttgaacttctgggctcaggccgtcctcccgcctaagcctcttgagtagctgggactacaggcacatgccactatgtcttgctaattttttaaattgtttagagtgggtgtttgtgtggcgggggtctcactatgttgctcaagcttgtctctaactcctaatctcaagcagtcctcctgacatggacttccaaagtgctgggattacaggtttgagccactgtgccggcctgaaaataggtatttaaacaaatacttatatgtgcatgttcatagcagcactatttacaatggccaaaaatgtacaaacaactcaaatatccatcagcaaataaatgcataaaccaaatatggcatatacatacctacttccccccaatggctcctcctatccctcagtagatttgatgttctctcatttgtgacttcagagtatattccacagcttaagctttagtacccaacttgtttgtggccagaagaggtcagtgtccctcttctaacctctgagctgcttcccatgtagtgattgtatctcgttcattaatacatccctagtacatggcacatactaaacactaaaaatacttattgaacaaattaatttattttgtcctatttcagatcccatatagaattatatattgcacatcatttatatgtcaaatgcttatattgtacttttctgtttttgttctttcatttttgcctctcttgctcatcagattataaagtatcccaggacagtgctctgtaaccagcccatagtagctactgctattttaccagctactgtatctttccttctttgatttccagcacctgacagtgaaaagagcaatttgaagaaaaacaaaatttatcttcaatgtgaaaagcaatttataaaaatccgaatacttgccaggagcaacttgacaaaaaagacaaaggtggtagaagaaatgtaaccagcccacaattccaatgttgataacagatgagctccctttcaaggtgactgacatttacacaagtacacagagcaagaagaaggtctgagtgaactgccaagcattttaacttctcctgagaccaagtacatcaacagttctcttggaaaagaacaactgatttgggagtctagcagactgccagctgcaagacattcatccagcatcaggaacacaatgggccttcatttgcctgcctttctgagggcaccaatcaaaagtaacagctgccacctttttctatgagacttgattataattttctatggccaagggtttgctgtgacacttccacatcattcttcagtatgtagtccagagattagctacagattcaagaaacacagactgtaaactattatatacagacatatctcaaaataagcatacccattagtgccagctgccctgaaagactgaatgaccccagctattttccaaatgttttttcagaaagccatgaacacacctttctgggatcctatctatttcaaagacaggcaaagctctgtggttcagttccaccacccagtaccaagcccacagtatgcagaccatacgccttacacatggccttttctctttatgtaattgctgtaccatattcagcagatctagactgactcaaagcatgttccctcaagaagctccacagaaaaaaaggtttctgtgatcaaaaatcatttgggaaatgctgcaaaccctatctgcctcttagagcttaaccatgcatgtcggggcataatataaaccttttccagtctgggccacagagtgagaccccacctctaaaataataaatcaataaactcttgagaagtacacagaaaagaaacttctgtaactttttaggtcttaattacaagcaattgtagcttaatctaaacttgctcttcactttatttctatgctcttgaaaactagtgacataagccttatgaattttttgtttgtttgtttcttctttttttaagagagagacagggtctcattctgttgctcaggttggagtgcagaggcacaatcatagctcaccgtaaccttgaattcctagtctcaagtaatcctcccatctcagcctccctaataactaggactacaggcacataccaccacatctggctagtgtgtgtgtgtgtgtgtgtgtgtgtgtgtacaggggtctcattatgttccccaggctggtcttgaactcctgggcttaagcgatcctcccaccgcagcctcccaaaactttgggattacaggcatgagccactacacctggctggattattctttctttaaaaaaatttttttggccgggcgccgtgactgtaatcccggcactttgaggggccgaggcgggcgaatcacgaggtcaggagatagagaccatcctggctaacacggtgaaaccccgtctct

SEQ ID NO: 316 - DNA, 1984 bp, Homo Sapiens
gcctcgagacacaacaacaagttgtttgtcccacatcatgctggggtggctgggaggggatagggtgagacagggagcagccactccactgaagaccaggccatgcagaggggatgagaagggcagcgttacctcccgagaggctactccaaggagagcggctcggggtcactgtttcccccttttcaggctggcccgcttcactatctgcgcccccttcctgccctctatcaggtccggctgtaggccactccctctcagctccacctgcagacagcagcagagacagaaagcaggacagatcgcaaagacgggcagaacacaggcagaagatcgaaaggaggccacacggaggtggcagacacactgcccaccagggagaagagagactggagagagagctcataaagagcactttgcagtatagaaaagcccttcgacaggcagcatcacccagaatgtgacttgcttgaaaccccagagccagttggtgacagaaacaggacgatccgggtgcaatcccatggtggctcacgcctgctatcccagcactttgggaggccaaggccggaggaccacttgagcccaggagttcaagaccaatttgggcaacatagcgagcccccatctctacaaaaatttttttaaaatagccaggcatggtggtgtgtgcctgtagtaccagctactcagaaggctgaggcaggaggatcacttgagcccaggaatttacagtaagcccaggttacagtgagccatgagcatgccactgcactccagcctggactaaacagcaagacttcatctctaaaaacaaaagaaaaaagagaagagaagagagagaaagaagaaagaaacaaagaaagaaacaggatgagcgcagcctcccgagacccaaagctgagtgtttaatgtcactgtcacaatgcactgggcaccagagggcaggttctggtgggcgcacacacactctggctcccagggtggaacatgatccctgggggcctcctggtccttttcctccggcgtctcccaactctgggtccggagctccccacagcagcgtcccctcagccccggcctccggcgcccacaccaccagccctgccggcctcctgccaggcggttaccttcaggaagacccgccgccggaccaccctggtggagatggtctcctcgtcgtcactgaggccctcgctctcccccagctccttgtccagctcctggtggatgtgctttagcacaaagcacagggaccccctgacaatgtgcatcacgttctgacagctgaccaggaagaagctcagcagcaccagcgtgaccaacagctgggtgacgaaagtccacatcctcgcctcctcaccagcccggtcctctggcagccagggccccggccaccacggggggcctgcctctcattctccactgggactcctgagtcccccagggaccccttgcattccccctccctatctctctggtttgctctcttggtctctcactgtttctctctctgtgggcaggacaccgaatggccctctcggctgaagcagcccggcccaagtgcccttctgcccagcagccaggctctgccctgagtggcccgggtgacatcacgctcctataattttacctccccaaaccagctgccggagctgtccaaccgggctagaaggaagccggcaggtgcccatgtcctgagcactgaaagcacaagtgaaagtcactgtgtgagtgacacccgctgctgcctaaccccgccctgcccagagacctggaagtgggggctcggcctctcacctatcctgcccatccccatgggaactagaaagagttctgcccagggaaagtttcttactttcagaaaataatacagtccgagaaagcagctacttgtgtgtctccttgggctgctactgcggtgatccaaatgctgttccccggcatggtagggatgagaccagctaataccctgggtacttag

SEQ ID NO: 317 - DNA, 3931 bp, Homo Sapiens
atgtcaaactgatgagcatccatcgtatttgtagacacccctcaaaggagagttgtacagcctattccactgacatcctgaccaaggcatctccatcatgcctaggtggagttggcctttttccttacattctgtcttcactggagaccaggcaggtgaaatcagctgggtgtgaagtggccttcagccatgtcctctcctggggaatccatccccctccttccactctttccttgtaattggaattggaccacctggtgcccacggctctctggggtgaagctccctcttggtgtgtcctgttcttcagtgacatttatttttgctttcctcatgtcccctcttgcagtgctcatcctgttgttacagtagctatttgtagcctatgcaccagcctgtgtgttcttggggccaaggactgtgtcctatgctccttcctgtcccctgtattgcatattgtaccatgaacctagtagtgagtgtcccatgcatgtttgctgaatgagggagtgaatgtctgacagacgtttcatggcttgcatccagcctgcccctaaatgtttccctaatttctaatgctgacactagacaccccactgaaggactagggtgtctaactattccatgctaagtatgggcaaaagaggacagtttgaccaagatgctcttttacccttgtgtatccaagttccctctgatcattaaatgagcagagacttcacacagaaggtgttgctactgctgcagatggaggtcagaattaaggtactgctactgttgatctcagacctttgaaagccagacccaagcttggggtcttggggatggggatgctaggggatgggatggccagatacaccagagtggctgggaatgaaagagtgtcccggaaaacctgcttcctcggagccgatcctgtgtgagcagaagaaatctatccacagaggggtgagatcgcagagcaagtgggttacctaaaaatagcagtgctggtttcccacagttagagatgggtcctctgccattcatctcaattgctttgtgcaagtttgcttatttattgagagcgagagaaaaggatcaaaccattcatccaaagatggaaatctgcaacctcttctacaatgatcagccagacagatgagctgagtgagaagtccctgaaatctcagaggcctagggctggccaggagagtgggatgggcatgcttaggagagtggggtgggcatggttaggagctgcccccagcttgccctgccttcgtagcagagttgatggtgggctgaaccttacccccaacatggggacttttgcaggggaggcagacctgtgtgtacatgtgagggtacatagacatacatgaacgtctagctctctgagggaagagatgagatgcataaatcacctaacccagcacaaagtacacacaataggtgcttagtaaatgttaattagggagtcaagtaggtagaagttgaggtcagggcaggaggaggcagggatagaggaacataatgtgaagtagccagagtatttttgacaaaaaggtgtggattttggagtcaggaaagcctaggttcaaatcccagttccaccacttgttaacatggtaacctcaggccagttacttaacctctcagagtatcagagtcttcacctatacattttgagaatggcatgacatctcatggtgttactaggattattaagtaaaataatatatttagagtacctgtaccagcccggggttcgataaattacagctgtttttctttttattatcatttattgtgaatatcatggacaatgaggttcctcagtttattaacagttagaatcttactttaaaaaaagaacccaaattaggctgggcatggtggctcatgcctgtaatcccagcagtttgggaggccaaggcgggtggattgcttgaggccaggagttcgagaccagcctgggcaacatagcaagatcccatctctaaaaaaaaaaaacaaaagaacccaagttggaaatacttgcaagtcatgtatctaatctgataaggggttaatatccagaatatatagagaactcataaaactcaacaataacaaaacaagccattcaattaaaaaatgggcaaaagacttgaataggcatttctccaaaggagatataaatggccaataaacacatgaaaaggtgttcaacaacactaatcattagggaaatgcaaatcaaaactacaatgagataccacctcatacctatcggtattaggatggctactatcactgtcaatggggatgtaaatgatacagtcactctggaaaacagtatggcaattcctcaaaaaattaaaaatataattaccatatgatccacaattctacttctgggtatgtacccaaaataattgaaagcagggtctcaaagagatctttgtacacccatgttcattcttcacaatagccaaaatggggaagcaactcacccattgtccattgtacattgatagatgaatggatatgcaaaatatagtgtatacatatatatacatatacacacacacaatggaatattattcagcctttaaaaatgaaattctaacatacattacaatatggataaacctcaaggatgttatttttggtgaaataagcaagtcacaaaaagacaaatattgtatgattccatttatatgaagtacttagagtagtcaaactcattgagcagaaaagagaatgatgatccagggaatgtggggagaggaaaatggggcgtttttgtttagtgagtacagagtttcagttttgcaaaatgaaaagcattatgaagatggatggtggtgatgtttgtacaatattgtgaatgtacttaataccactgatgtgtaatttaaaaaggattaagatggtaaactttgcatgcattttatcacaacaaaaaaaattggaaaagcactaaaatcaaagataccaattttcccccaatcgatccatagatttaatgcaatcccaatgaaaacatcagtaggcttttaaaaaactgaaattgacaaatgtattctaaaatttatattgaaatgcaaagacctcataatagccaaaacaattttgaaaaaatgcaaagttggaagatttatactaccagacttcaagagatactataaagctacagcaataaagtattggcataaggataggcatattaatgaatggaacagaatggagagtttaaatgtagatccatagacatgtatggtcaattgattttcgaccaagctactgaggttttccacgaggaaaggttagtcttttcaacaaatgatgctgaaaaagttggatatccatttggaagaaaccccaaaaacccaaaaaaacaaaaagccttaattcttcttacttatcacaacacacagaattcaactcaaaatggatcataggccttgggacaagtaatattatgtgtcaacttgactgggtcacaggtgcccatacatttggtgaaacatcattctgggtgtttctgtgagggtgtttttggatggaattaacatttaacttggtaggctggataaagctgagtgctctccctaatgtgggtgggcctcgtctaatcagttgaaggcctgactagaacgaaaaggctgacattcctttgagtaagagaggattcctcctgcctgatggcatttgagctgggctgtcaactttttcctgcccttggacttgaactaaaacactggctcttcctgagtcttgagcctgccagctttgcactggaactataccatcagctttcctgattctcaggcctttagagttgtccagaactatactgtcagctctcccggctctccagcttgccgactcactctgcagatcttgtgacttgtcagcctccatcatcatgtgagccaattcattataataaatatcttttcat

SEQ ID NO: 318 - DNA, 3616 bp, Homo Sapiens
agtagtaggcgcatgcgtggttgcgatcatggctggcggtaacttcgcgtttctgttacccatttttaaaacgcatcttcaggtgttccttccttctcatggaaggaacattaattaaattcagagggactgggttttagtcctaactcttattcctactggctgtgtaaccgtggacaaattatttaacttctcagaatcaggttgttcaaacctgaggttgaactgcaaaaaggttacgaagtgacactcagtagggcccgaatccatgttttctttgatcccaatcttttttaaaaaaatttcttttaattacttgccaacattttagaatttggaaatctcacatgaaattctggacttttgaagctgaggaattccattgcaacaatcaaggagactaaataggaaatgacacttctgtttggccatcttgccctcattggtttagaatggcagtggttctcaaccctggctgcacattagaatcactttaggagaggtaaaaccatactcacgctggagacctactcctagaaattctaaagagtttggggctgggaactggccattgatctgcctttgaagtttcccaagtgattcccaacctctgatgtaataaatttctggctgctgtcgtatttgagatttgacccccccaggtctaagacttaattgatttttaaggctgtaagacatttctaagactttgacttttaagactttcctgcctcattctgaagagaaaaggccacatgaggacaccatgagaaggcagctgtctacaagccaggaagagagtcctcaccagaaaccagctctgctggcaccttgaacttggacttcacgcctccagaacagtgagaaaataaatttctgctgtttcagccgcccagcctgtggtattctgttatggcagcccaagctgactaatacactacctaatagtgaatgagaagaattaaatcagaaaatataaatgcattaataaacataccatgtattgggcacctccctgtgccaggcacttcaccatcatctctagtcctccaaaacacatgctgtttgcaccacatcatgctgccaggcacatagttggcttgttgatttgtgtgtgtgtgtgtgacaagatctcattctgtcgcccaggctgaagtgcattggcatgatcatactcattgaaacctccaactcctgggctcaacagatcctccttcctcagcctcttgagcagctatgacaatgggcatgcaccaccacatctggctaattttttttaaatgtttttgtagagacagggtctcactgtgttacccaggctagtctcaaactcctgaccttaagcaatcccccgacctcagcctcccaaagtgctgggattataggagtgagccaccacacccggccggcttgttgaatttgggatatgaatatcatagtcttattaacaccatgtttataagccataattgtctttatgaatgtattcattttggaaaagtaagtactaaggatgttcagctttctgtgctatggattattatgtgtggagaaacaagaaaatgagtcacagtcctcacttaaatattttaccatctagttagagatgaagacaagtatattaatgttactggcccatatgactatctttggaaaaacaatcatataaagtcaagattcagcacagggacccagggtccaaaagatttgcatttgactcccagctctataacttagccgtgtgatcacagtcaaattgcttaacctctcccttttctcatctgcaaaacagggaaataatagcacccacctccatcatttattatacacaaagagataatatgcctgaaatatatctagctaaataaagacctaatcaaatgtaagctgtgactattaccgtttgttgtttgcttcctgctttttactattgcaatttctaagatcagcctttttcaaaagatttttctttcatcttaaggctacctgggaactgactgtacctactacatacaccgtaacatgtatgtactatatacagccataatggggcaaggaaagaaaatggaatgtgtaatataagaataatggcatatagtcctcaaagactgtgttttatattttgtctccattagatattaacacagtgctatgtaatggaggaaacccaagaaatattttttgccttgaagaaaagaacacaaactcagaagtcacatggatctaagataagacttgcaaagatttaaattcaattctgccatttacttcatatgaggaccttgagaaccagttgatagcatatcagaaaagctaattaatttgccatggttaccaggaaaacagggcctagtctccaaagtacagccaaatagaggagccaaataaaaaagagggaaatttttgtcatgcatcttgtttttctgaaatgttatgttttaaaatatatcaatattcaaaacaccatgtgctttattgagttttaactcttaattttgtcctcttttttctgctagggtgtttttgagcagacaaacaatttcttattgccaggatacagcctggaactcttaagcacaccaggcaagcatatgtatgaaataaaatttctacaaagaagagattcgtcaaaaagcatcactgggacaccaaccaagtgtaaggctctgtgaggaaaagggaatttcagaaaactgtcatacccagccactgccagtgaggatatggtaatcttctttggggacagagtgcacattcccctgataagtctagaaagcataggattagggcccagtgtcgggcagacaatacatattacaggaatttaggagagaggcaagtcacaaaaggctgaagagttcagggaaaacctcacagaggtgagccagggatgatttctgatggctggagaagaggaaaagaagaaatgtcacaaagtgcaccattatcagaaaaaagacagagagtcaaacactttaggtggaacagaaagctccagtcaggaaataatgagatcgaattataaaaagaaccaaaatgtcaagctaagaaatttggaactgatccagagagtagctggaaagctgctgaatattttaaagggaaaaaaattacaaagtgaaagcagttttggatttgattttttcagttttctttattttgctgaaaggaaataagttcacatagtctaaattgaaaaagtacaataaatagtgaaaggtctccctcccacttcggtcccctgctgcctatttttctccctggaggcaaaccaatgttagcagcttcttatatattcttccagagataactatgcccatggaaataaagacgcacataaatttttccctcctcctttgtaaatgagatgcgtagacacttatttaccttgcatttttcactccaaaatctaacttacagattattttgcatgaatacataaaaaaggtcctcgttcacttttttaaattatgctatgaaaattcaacattcactcttttttaaatagatgcattggtacaaaagaatatacaggcgaaattgtctctaactcttctgcaacttgctgcgctgttctccctggaggcggtgtctagtttcttatatatccctccag

SEQ ID NO: 319 - DNA, 1111 bp, Homo Sapiens
tttgttactctttcttattctaattgtgtattcttatttactgacgtgtctccagctttcaaggcagagtctcacccattaggtcttctatatacaattaaatttacctagaaagtatttccttcttatttaaaactttttaaaagtaaattcatgtatacatatgtaaccaacctgcatgtcgtgcacatgtaccctaaaacttaaagtataataataataaaatttttaaaaaagaaagataacaaccaaaaaacaacaaaaaagtaaattccaaaatttctatatcacattacaaattcacatgccacccacgaagaatacatttgcaaaataaatgatgtcttgagacgaaatgagttttcaatgaagattttagagactctttatttttatttttattttttagacagagtctcactctgtcaccctggctgtagtgcagtggcgtgatctcggctcaccacaacctctgccttttatttattttttatgtatgtatttatttatttttttgagacaaagtctcactctgttgcccaggctggagtgcagtggcatgatctcggctcactgcaacctctgcctcccaggttcaagctagtctcctgcctcagcctcctgagtagctgggactacaggcgcccaccaccacgcctggctaatttttgtatttttagtagagacgggtttcaccacattggtcaggctggtcttgaacttctgacctctggtgatgtgcccgcctcagcctcccaaaatgctgggatgacaggtgtgagtcaccgcacctggcctctttgcttttcttaagtgactccatgggggacccatgcagccagcagcatctcggctttttctccctggaaggtgtctgcaggaaaccagcatcccagttaacttcagacgcgagagtgttgattatacactcaaggccccacattagggaagtttgtgagtcacagccccacactgggtctcccagggatcaacaagatccacaaaccagcatggttaggacaagtggttttacagtccttttttttttttttttttgtgagatggagtcttgctctgtcgcccaggctggagtgcagtggcgcgatctcgg

SEQ ID NO: 320 - DNA, 2309 bp, Homo Sapiens
ataaaataaaataaaataaaaaagaatatgaagagggggccaggcacagtggctcacgcctgtaatcccaacactttgggagcccaagtgggcagataacgagatcaggggttcaagaccagcctgaccaacatggtgaaaccctgtctctactaaaaatacaaaaattagccgggagtggtggcacgtgcctattgtcccagctactcaggaggctgaggcaagagaatcgcttgaaccctggaggcggaggttgcagtgagctgagattgcgccactgcactccagcctgggtgacagagcaagactccacctcaaaaaaaaaaaaaaaaaaaaatatgaagagggtggaagatttcgtatgttaacactctggaaagtcatcactcccagattctttccatggaggctctctcgaaagcagaatgacccccattctagaagcagaaggtgaatatggcaaaggcctgtggaggagctagtgtgaaaggaactgacatgaggacagctaccaactggagtgagaaagtcaggtctcagctacaagagcactagctgggcaagcgagaccggtagggccttcatcagaaatgccacctattttgacattttgagtccaaaaatgttcctatgtactacactgaagtgtgtccctgaaggtggccccagaaatggcccagatgaagtcctgggaaggccgtggaggtcatcctcttttgtttccttcttcaacttggtccaattaccttgctctccattgaatttcaaattagaccttgtgtcttcacacctcaagcctttaccctaagccttctctttgcctggaatgacctctttcctctcacatcattcaatttccatcccacctttgaaataaagcctacctttcttgctattgtgattactttagcttgcagtgacttctcctggctctaatatctgaatcttgtattcaataatcattctttagtaggttttccttagaaagcccactggacaaaagtcagattcatattaaactacagactaaagagcaggaagagcccctagagatcccctagccctactatttctgtttaggtgagcaggcaaaaatgtagaaggaagtagtgatttccttaaagttacaagagagtcaaaagcagagaatgcataaatccatgtctactgactctcaatctggaatgtcttccatgcatttttttaaatttcttttatgcctaagtagtttaacttgagatgaaaatgcaataagaatcacatttccacagaagtgataagaaattgatcagggctcctttctgatgtttcagcatgctatgagtctcacggaaggtccctgtttttgcacctcagggtgaatcatggatttctgaatgggcaggaggaaactgaggctaagtgaggctacctctggaatcactggaagtcctcccaggagggaagagaaagagacctatgacatcaaccttgagctttccttctttgttccttttatggccttcctcactttatgtgagttctgggatatgaaagtgctcaggggtagggaaagctgtaaatccccagggccttgcactataaacttcatttcctccctttattgcagttaactgcccatgaactctattaatattttgcaaattgagatccctaaaacacatgttactgttaattttaacctcatgctaactaggatgtggtcaaattttcacaacaaattccaaggatattttgatatgccttggaaaaatgcatttaaaggtgcctcgggggtatatactttttctaagtctacacattttctttcaattcttgctgtttaggaacaggcagaagtaaactgtcttatgtgaggaggagcaataatacaaagtgattcagttatgatacgggagtgacagaagcctctaacagaccaagagggacagtcaaggaacatcaactttctgaacttaccatagtaaaaatctgatgtcaacaaaactgttacacacttttgcgtacaggatcaatttacttagaaacacttcaccgttctataaacacaattcttcccttaggcaaaagccatgggttttataaatttaatgagacaaaaatgaatttttcccacctccaggataccaaatacattatcacagaatagtatcacaagtgtgacctctaaatctgatgagccagaagtaagaaactccttccttccttctttacttccttcctccctccctcctttccttccttcctcccctccttccttcctccctccctgtctccctccctccctcctttcctttcgttccttcctt

SEQ ID NO: 321 - DNA, 2426 bp, Homo Sapiens
atgcctttggagatggggcccaaaatgagcaaatttgcctttaggtatcagagaagttccatatcagataatgattctggctgtgcactggaggagtactccgaggtcccctgggccttagaccagagcaaatctagctctcttttgcttgcttatcagaggaaaatgtccttatattaacatccctggaaagaaacatctgattaaagggcttgtataccagttgctacaacatgataatgacatatagtattgtcagtctttgaaagaagatgagaataaagaattccaagtgttcagtgcttagcagcagaaagaagcacttggaagaggcatgattaaacttttgtctagagcaggaatgcacgctatgtgtgagcaatgtgggttgaagatcaactgaggtaaaattgcagtgtttgcctctcgagtgggccctggagtgtactggtactcattctgttttgtctgtttcacgtgtaaagagctgctggtcaacctcgtctatttttatcaggatgaaaaaattcactgtggcaggcaccatgctgaattgctcaaaccctgatgctcagcatgtgctgagataattttgttgatgtttgcacagaaactgagagtcaccattggcacatgaaacacttctgctgccttgagcgcaaaatggtccccagaggacaaggtatgttatgaaggatagccacccattctgctgtggtggttttgagcctgtctatgcagagtgctgtgaaatctgtgggaacatattagtgtcgaccatgtgcagatgacctatgatgggaagttctggcgtgctgcagaagcatgcttttctcgtgtctagcataaatcctttttgttggatgtctcttctttaccaaagtcagatttattactcaaaaatatgccacctcgggccaggcaatacatccatgcttctaattcttccaattatccatttcagtgagcttgatcaagaaacaccagaaaaagtatctgaatgagcaaaagcagttggtcagcagatcagtgtagacagtctctcctcttgttccctgctctgaactacaagttttctggccttttgggcgatgctgatgacactctttctcagaaattgtatattctgagtctctccaggcaaggaacatttttatcaatgcggaattttggaaagacagagtacagcattaaaccccagaagaccctgaaggactgggtgggcatgaagattatatgacatagctcctcctcaaatttggtgataaaagcctcttcagcagcagcccaatgagatggatatttgagccaatcagcactggatatctgatagcataaaataagaactagctaaagcaaaacaaccagaaccttgcaaataaaaattactgacctgatatggactgggcacaagatgaacagtgtttctgctcatggcaaccacacaggccctgtaagcagtagaaggctctagaaattgaatctggaccatggggcttcagggtaggctaatgatcaaacacaggggtatgaaaatcccctggggtttttgtcagacttgaaaccagagaaacgtgctcaggattctatggattctttggctttgtccaacatcacagtagcttcagcggatggatgaagcaagctgaggtcatccttatattctctgcaaactctgaaaaaaacggaggcagaagattatgagaaaatcagcagtatggaaactttgaactctgctgcatggaagtgcagaggccttaaagagtctaagttcagatttttgtctagaaaaaaaacatcatgcctcatgaaaaactagtacatctgccagtactcagacaatccaagtctcaatctagaccacagaaggtcagaggatgtcactgacaatggaaactgcaacatcaagatcaggcagcgtccaatgagtgacaagacctgggtgtaccattttgaagagaagggatccagatctcatcaccatttccacagaagtagaaagccccactctgacaatatcctgaatattgttatagaaagagaatattctcccaaggacaggctgcagctttacatccccaataactacagtaatttatgtggaataaaagggctcaggacatccaagcgtacatccagaatgccgatctctatagagagcatgcccgttcacttccctccattcctatgtccccgggagtgaagaagtttctgggattcctggtgtttctccttctcgtcctcctcttccgactcagaacaaaaggattattttcttgaacaatcaatccctcagccccacgccacagagatacgcctactatacagatgacctttctagtccaactccctgcccgtcagtttggttagaggaccactaaattcaagaagaaaagtggacacacatgcaaaaactattatttctt

SEQ ID NO: 322 - DNA, 2572 bp, Homo Sapiens
gatttatagtcctttgggtatatacccagtaatgggatggctgggtcaaatggtatttccagttctagatccctgaggaatcgccacactgacttccacaatggttgaactagtttgcagtcccaccaacagtgtaaaagtgttcctatttctccacaccctctccagcacctgttgtttcctgactttttaatgattgccattctaactggtgtgagatggtatctcattgtggttttgatttgcatttctctgatggccagtgatgatgagccttttttcatgtgttttttggctgcataaatgtcttcttttgagaagtgtctgttcatgttcttcgcccactttttgatggggtttttttcttgtaaatttgtttgagttcattgtagattctggatattagccctttgtcagatgagtaggttgcaaaaattttctcccattctgtaggttgcctgttcactctgatggcggtttcttttgctgtgcagaagctctttagtttaattagatcccattggtcaattttgtcttctgttgccattgcttttggcgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccattcattaaatagggaatcctttccccattgcttgtttttctcaggtttgtcaaagatcagatagttgtagatatgaggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgtgggctcttttttgattccatatgaactttaaagtagtttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttggccagggcaattaggcaggagaaggaaataaagggtattcaattaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatatacaaaaatcacaagcattctgaaaagttttttcttattttggatgccttgttaaaaggcaagtaccccagcaggtgtcagtggagactgtgaccgctgaatagcaatggtgatggggtgaggctggatctggccagaagagggctgaggggcatggagaagactcggggagcacagggaagatgtgggaggtggggaggatgggagggaggacagggagaggacaggaaggactggctctgctcattctccttcgcacttctgtggagcagctgctctgggcccagataatgatctctcgagggcaggacttgtggttttatttgcgtcatgagcctttaggaagtttggggtcgtgcatgtagagctgaacgtggggacaccgagaacgtgcaccctgcatcccgactgctgagttcacttctctgcaaagcacaaatcgctgtcccatcctgggtcacactcctgggagccaaacctgggtgggattctgtctctaccccacatcagctgtaagatttggggcagggcgcagaaccccctgagcacgtgggaaactgatcaccacgtgggggatgtttgttagagagattcagtgggtgatgtgggggcagaaggaggcccctagagcagagtatggcatctgttctgaatgccgatatggcgttggggggacagcaccctggcggcctgcagcaccctctgtgaacagggaaggctggaaggaaggggtgggtccccctgacaggtaggggctgctggatggtcccactttgcccgcccggtctcttcctacactatggttctcactgatgttccctgggcagacaactcaggatgagcctctgtgagtgctggacttgtgttccatccagctcctccccaagagaggggcaggggctggtgccccaaagcaccagcaccccacatggactggcacattttgaaagatataacacaaagaacttccattataatcgctgcccaggcgaccattctcaacgcgtacattatttgttaaagtaatttttaaagcctcaaagtcatgagtcc

SEQ ID NO: 323 - DNA, 2740 bp, Homo Sapiens
atagtacttggatgttttagaaggttttccaagtattacataattcctagatgttcacccttattacactccaactattaaaaaggtcaaaattcagcctattttttttcattattttagattcctgtggttgggatattttaacattgatgagaaaaataattgaggttgatatttttacaaaatcatgcggtaataagtcttgatttcatgattcaaaagaatcaataaagcctaaaaataatagattactttaagctgctatgtaagatatatatggaataaattaaaaacctttgtgaattcaggtttattatttttaacctaaaacattctctttggttcattcatcccctcatgtcatgggggctcattggttttccttctttgtcatatttaagtatgatttttcaacaaaacttctagaagtcagcttattatgtcaccattcatgcaaagtgctcatgcctctgattggtccattcactgacgtgacaatttcaggtcctatgtttaaaaagaaggggctggccgggcacgatggctcacgcctataatcccagcactttgggaggccgagaggggcggttcacgaggtcaggagattgagaccatcctggttagcagagtgaaaccccgtctctactaaaaatacaaataaaaattagccgggcgtggtggcgggcgcctgtagtcccagctacttgggaggctgaggcaggagaatggcatgaacccgggaggcagagcttgcagtgagccgagattgcgccactgcactccagcctgggcgacagagcgagactctgtctcaaaaaaaaaaaggaggggggctaaatatccagtgagatgcactgaggaaaggaagcattttgctgaagacagcagcagcaacaaacaatggtctgtttgttgcaaacaagatgtagcttgatttctggtctgacatatgccatatacagatattagaaacgactgtttgaaggccacactggtcatctacaaagtaatgtttaccaattgacgacagggatttaactagattaaaaagatcaaagtgtggtttttctctgctttttaaaatttcactcggaatttgtagctgggccaattcaacacattttacttttcagtggaattgatttttctaatgtttcagaattttaacatatcaagaagaaaacaacgttctcaaagtctggcctctttagcatgatgtaaacctatagaaatgctttgaaatgtgctggtgtaagataagagttatcttgtatgatttaatcatatgcagtgttgtctcagttacgttcagggaaatgtttctgtgtcattcagagatgcttgatgaattaacacctcccaccctgagtgaggggttgacttgttgggagatgatttgggcttcactgggatctgtgacaggtgggggctgggctgggtgtcacaaagagaatagtggtagaaatcgggcgaaggaagaaagaagttactggtaaaaatcattacaccataaagcaccaaggaaataactgagttaaaataggtgaagtttcttttttcccccctgtaacaggagagttttccttatgataattattctgagacttggtcactttgtttttgaatgtggagctgctgaactcattcagaagccatttgctgcctatcaggactttctgaagaagttcttttgcctctgcctaccctctggcaccctcccatggaggcacaggggacccagagctaaagcattaccaggccatctccaaaacaccccgtgtgtgtgtgtgtgtgtgtgtgtgtgtgtgtgtgtgtgtgtgtgcactttgcagcccccgaggtggagaggcagtgtctggatcactgtgaatgcattgccccattggtcagttggggacactgttacaaatccactgaagtcctggtaaaactgtcaagagtaacaggcctcttctgttctaccctgctcacttccacggtgagttaccagcctgggcaacacagcaagaccccatctctacaaaaaaaatttttttaagtaattaaccgtttaaattttttcctaaagatttaacatgatttttccctcctatgtaaagtttactggagagacttgaattacttaaattcatgttaatatgatttttttttaatccaggtcacattttaacaaagtttattatgaaacaaatgaaatttgaactctaaaatggtactccttggcttcctcaagtcacaatgaactttatattttctttgtccttaaggactaagatagttgttttatttcagccgaatcacagagataaccactcctgcaggcccccacagctggcccaaaggggctgtctttctgacctggctgtgttagcactgattgagaaacgcaggctcccaaatattgcctttattaaaaacacaaactacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctc

SEQ ID NO: 324 - DNA, 12261 bp, Homo Sapiens
acaggcatttttttcttgtcattattccccacataataccatggaaaacttattatccagtatttacattgtattaggtattataaataatctagagacaatttaaaatacacaggaggatgtaactaggctatgtgcaaatactatgccattttatataagggacttgagcatccatagagtttgctatttgcaggggtttcttgatatcagtccaccatggataccaagggatggctgtacttttgttttaaaacattccatgctatccactgtattctgtattttctaaagaaaagctctaattctcagaacaacagaacaactctcaaaagaggttctcttaccctgtgttaccaacttggaagtttagttttaggatttttttttaaattattagccaaaaggccaataagacaaaaatgtgtgtgatccaagatatttatataattcaaagcctgtacttgatccaacaaaccctattgacagtatcattctgcttcattcagtctctgacagtaactgttgcttgaaactgatgtgatgaaatggaggaatagggtaaggatgtcttatcgcatgttctgaatcatctcaaaatttattcacaaatatgctataataaaaactctgatataaaacttgactaaaactttttatttttatatatgtgctatcctataccaatgaccctccctctcagtatacacatacacatatcactaacaccgataaatgaaaacataacagatatcaaaaatttactgaatgttactatagggttagaccttagcttctttatgtatggaaaagcagattcttgtctgtaaatgaaaaaaatccaacgttaattaatatcataaccccaaaatttctgcctgccataaaaagatagttaagtaaacatatctgttcaaaagttatggtaggacttaccaagtcacaatatttggttttcctctcctttcaggtatctggagaattacttttctctgttcctttgagtgtaagagtaaaagtatgggcatatgactaatcctggtccctaaaatctgggtagaagttgtatgtggcatttttcaggaaatacttttagttaccagtaccagtttagttcaattctccatttttttcttctgcctctgcaaaccctaaagcctcatagtaggatggtaatatcacaagatggcgactactctcttcctttagaagtctgagcatctataatgagcagagttcttctggtgacatgtggaatgagccagaaatacgagttcatatatgaaatttttatgtgcaatatgtaatataatttcaaagagatatatagcttgcaacagtccagtgtgggctgtgaacatatacctttggtactgtatatttatactcctctgcctgagtaatcctgcattacaacaaaatggttatagctttatactgtccaattctgctcctcattcaaccacgttcaagtctacagaatacactaaaaaaatctctaggggatttttctgttcaaacaatatttttactcctaaatggaaccagatggaataagatgtctcgaatactgacccatatcaatctaaaaaattaaaatacaaaaaaaaaacaaaaggcagagttgatccagcatgtatttattgatccagagataacttcagattactagaacatgaaagggagacctgaagagagcacattttgtctgtgtgaatttattcccatttgtgttcaatttctactctagtatttttccatgataacgtactgtgagtcatctttttataaccaagaaaatatttcttgcttttagcagcttaaggaaaaaaagcagtttagaaattattccaaactccacatctttgaagaaacaacttttttgttgccttagacattattttatcattgggaactccacaaaaactcatagctctggatattggacagatgtttggtgggagaattaagtttagagtacaaaagatgatttgtgcataaaattagtttttattgtttataaaatacatgcatatttatgtaatcatttatacctttcatcagttacttttccaatgtcacatatttacaactttaagcaacattatttaattgtgatgatataagacaactttcactttccttatcaaattaagcatgatgacagtgtatttctctcaaaatgtcataacaaattactgcattatttgtaatatgtaagtactgcatatttgtaagttcttacaaatctaatatatttaattgctttcatacatatgtgaactttttgtcattaaaatggttaaaactccagagaagtaaaaatattacccaaaaatgatagtaaagtaacatgagctgtggtcgagacatttaaagggagttaagtgaacatgcacaaatcaaagatgggatataataactatctctaaagtacagataatcaaaccattaaaataattctttgtacattttatgtttactcttacaatggtcagagctgtttcacattcaaccttttaaatgatttcttaaagctagatgactgtgttgaagaaaaaaatctagattcaaatccagttgcagtctactgtattcacttctttaaatgatgtcaacacaagtaatataacctcattattatgcagaagaaagtcatcccaagatcaaagaatgagagctgatacaaattatgattaacatgcgatagctgtttaagtgttcagtgacttcagttcattttatgtgatcattcatttaattatcctctgttgtctgcttccataggtgacgaattccagttatgaaatgcagtctctatggagttgccaattcttctgttttgttactgtcttttgggctcaagtcattaaaattgtgtaattctatgcctttaaaagtatgaagatatttttatttatataaattaagttatacaaaaactggacaagttgataattatttactatctctttgtcaagtttaattttatttttctcatgtctcaagctatttctctttttcttttctaaggctttgttaaaattagaagctgggaaaaataattttcagttggcctttggaagtatataatgtgaaaaatttatcttcttaattgaattgcacacttatgatatgtgtgcttttctgtttctacatttcattttaaaagttaaaagaaatgtaaccttaatagagtagtttcaagtatatctacatataaggattatctgtgctttttcaaaattcgagacagagtcttgctctattgcccaggctggagtgcagtggcactattataacacactgcaggcttgaactcctgggcccaggtgatcctctggccccagctttccaaagtgctgggattacaggcgtgagccaccatgcctcattctagttgtacatttttgctttattttatttttatacaatttcctcgaccatagtctgggaaactgattcagaaggtctagggtagagtcagattatttgaaattatttttaagaagatctccaggtgattttgatcacctcccagatttgaaacaactctaacacacagagatgaaacagagggaaaaacttacatacccacaaaccagaagggttcagtaattaatatggatcatttacattgcagtttattgatttgattattgcatttctcaataaataaaaagtcatgccaatgaggtaactatgagcagaacaaatgaattgtggggtgcatgtataatggaatacactattccatcaatattgaatgaactagatggaaactgaatggatctcaccaatatatttagcaaacagaaaaaaaattgcagaaacatatatatagtgtgatacgtgtaaacagaagttgaagggcaaaatataccatatattacttaagtatatatcaatgaacacacaggaattttaaaaataccaaattcaatatagtctttacctctggtggagagaagaggagagatactcaagatcaaccttggtaatgttgatttctttttttagtggtgagggtaaaatttttttgttttaataggagccttactaccatttgtatctgaaatatttcataagaaataaagtttgttggttatggaaatagcctgattttcattttcatacatgcagaggagagtaaagggagcaggcgttttatgtatcttcaatacaataagtttaaaatgtcagaaatctgttgactcgtttttgaaagaattgagaaaataaaaggtagaaagtagtgaagaaagtttctctaagattgccttaaatgccttgaattgtctctcatctcatggatgccatgagggaggtttactcatttaaaatagtaagtgaggcatgcaaaataaaggaaaaagttctgtatctatgttctttattagtttccaatgtcatcatttactttgttaaattaattcacgttactttagtctaaaaaccactaatgaaaaaatccatttggattcatagattaggcatgtgacaggtaagatttgaacttacatgtaccatgcttcccttccatcctcaatattttttttaaaaagcacacaaatgcatgagagtggttgcagattactttctgaaaggaaggaagcttttgttcttcattttgattttagaggagttatttaaaagcccagttatactctttacttgcaaacatttttggctatttgtgaaagttcacctccaaggaaatctaatcagccagacaagttattgtttcattttagcctgaaaaaaaaaatcacacatatataaaattacacacacacacacacttttattttaaagataggaggtctaaagaatataaaatatggcaatgtgtttctaatgtgtttgaaatgatcatagcaaatagtgaattgccactaaattatcaacaaattatttgcatttgacttttgcgtcagtttctaattatcatataacttgaaacataaacattggttaatactcttttgcagacatatatgatcttttaatggaatttaatcatttaattatactactcatgtaatatttttaattcattaaaaatattgctataaaaatactatgttttataaatgaatggtaagatttgaagaaacaagtttgaatgttatcacttttttcatggttaaaaaaggagactgtttttttcttttataatatacccagaagcccaattgccaaggtagttttatgtacttttccacagatgaagacacttacacattaatctacactctaaaacatggtaggtgcctcaaatgctaaagaaacatccagtttaactgtgaggctgacgcctcagatgtaccagaggattttgtcatttaaatacgaaaattcatagatctttttatatttatagcagcattgtcagagcttatcaaaaatgagctgacttacaaactatcaatggatttaacagtatgatctaatattcataacatcagagacagtataagttgagagacagattttatctttttattgttaaagatgtgttttttaacttttcctagtagattttgtcttttcatctcataactgctctaacgaaaggatcatgccaccaattttagtatattccattattcatgtaaaatcacagccagttcaatatccagagaagaaactagttaggaaagtttaatattacccatgttcttctctatgagattcatattaaagttttaattttgattttgatctttgcccaaaacattgtttattgtacataacagtctgcttgtgtataattaaaaagttgttaaaggtgttaaataaagataattgagatgagaatgtaaatcccttgcgaaaaatattcctctattccaaaaacactgtaagaaatatatattttagcataattcattgactatattcctatactaaattactagggtcagaatttctagaacaaagagttatccaatttaaattgttaccaaatttaaacatagaagattaaaattagtggagccagctacacagttgggtgtgttccaggatccttatattcgtgtgtattttttgtttttatagaaagaaatattttaagttacttttcatttttattgaaaaatatacacacaactaaatttaaatgttataattgcacatctggctatatttttggaaacttaacatcatgtaaccagcaccacccacatatcaaggttaacaccatcctgatttctaacagtgaaagttagtttctctggttttgttctaatgtaaatagcgacatagagtttacgttgtgtctggcctcttttactcactgttatatttgtaatatttatgcatgtgtaaattgtttattctcattaccatgtgatactcaattgagtgattctggcacattttttctatattggaatattggatggaaatttgggtagttatcagtttaggctattttgaagagtgctactatgaatattctactcatctttgggtgaaatatgctttcatttccattcagcatttacatgggaaaggtattgatggattacagagtctgtatgtgttcagctttagtgcatgctggcaaaaggttttctaaaggcgttttagtgatttacagcgtcatctacaatgtataagtgtttcaattgctccatatcctagttctgtttctgttttattttgttttcaggttagacattttgctaaatatgtagtggtacccgattgtgatttcaatttacattttcttgatgaccaataaagctgagcatctcttcaaatgtgcattggtcatttggttatcacctagtttaaagaatttgttcgtattctatggagttgtccttttcttagcggttcatagaagtcctcaatatattcaaaatatgagtcacacattgggaagttatatcacaaatattttctcccacttgtattatattttcagactcctaatgatatcttatttagataggtcacaaaaacatgaaacataaaagtaaaaatcagtaaactggagttaatttaaattaactacttttcaaaaacagtcttaatatcacagaaaagcaagccacagattgggagggggaaaatatttgctgtacatatatccaataaaagaattgtttttggaatatgtaaagtactacaaactcaaaaataagcaaatgactgaaaaacaatgacaagagtttggtgaagacactttacaaaagacatcttaatatggggcatataatgaataacaagatgctcaacatcattagttttcaaagaagtgaaaactaaaccaaaatgagataccaacatacaccaataagaatgactaaaattagaaagactgataatacgaagtgatggcaaaaaatgcacagcaactttgcattcatatattgttactatgaatgcgaagtactataggcacattagaaaacagtgtggaatttcttataaatttagacgtacatttactacctgagccaccagtctcactcctagatatttacacaaaggaaatgaaaaattatacccacacaaaaacttgcccataaatattcatggaaattacattcacaattgccaaagactgcaaaaaacccaaggtttctctttttctcttttaaaaagtttgagtaaacatctgggaataaaagtatgattttggttctcctccatatctcaggcattttcttcccgttcttttgagaacagcctatctcaaactgtttagacacaatacttatgagaggtttaatctttcctacagaggttttgaacttttctctatggctcccacattgtgttaaagattggcaaatattttgaaaaggtgactagccatgtgtttggggaaagtaccattcccccggcggagcttggttttctaaataatgagagactgtgagaaatttcaagttcacttattagaagccctctacattctgtgtgactcaggtttcagaaaatgtattgtcttagctcatttgtgttactatcaaggaataccagagactgggcatttgcaaagaaaacaggttgatttggctcacagttctacaggatgtacaagaagaatggtgccagcatctgcttctggtgggcaattaagctacctccactcaaggcagaaggcaaagtggagctagaatgtgctaaaatcacatggttagagagaaagtaagagagtaagaggggagatgtcaggcttttttccacaaccagcttgccagggaactcttgcaggaactaatagaatgagaattcattcagttccctccccacagggaagttattaatctatttatgagggatctgctcccatgaccctgtcacctcccattagccaccacttccaacactgaggatcacatttcaacatgaggttttgcagggacaaacatccaaagcacgcatgttgtgaaaaaatcagccttgtttggagatctaattttttttacattgtgcccaatagaccacagaatcgctagtttctcttcctcaagccacattcttcttcaagggaaaacctgatttttattcccaagattggaaatctgcaaacgatcctagggagggaaatgactggaatttccattatttaattctctctgttttcacagatctcttatgctttaaacaacgtaaattttacaattaatctgtcttgtatatcgtcgtgatgggaatattgtttgcagcaacctactattgcttttttagcattagaagtttcttctatatatttttatgtcaatgtttagatttctaagaaaaactttgatatattctccaagttaaaatacacatatttttaaagtttcaacaaacttttaagtttataatctgagaaacagtcctaaatttcaaaaataaatatctgaattatttaacataaaaattaatctgatttttaatattgatttgtccttttgaaatttgtcattggatttatatttttaaatacttacacaaatggtcactgtgttattttcttagctacaagttgaatcacagcattcccctttgggaaacctttgtttctttcttttaaagaatagaatttcaattccttttatggtggtcaataatttccataaacttgtcttaactacttttatagtagctacatctcctactgcatctatccattaatctgagtcactgattattcaaacatattctctaggtatccctatatactctcaaatctatgcgattttaccactgtaatcttctaagtagaacacaacaatcaacctttctgcccatctaaatcttactatttttccaagggctaactcacatagcccctcctccattgaggattactctaatgagaagtatactcatcttcctttaaatcctaatcattgttcatttctcttatcacttagtttttcctaccccctttttttatactcgctggtctctagatctttcccatatagtaggaaactccttgaggaggagccataccttaatcatgtgtatatttcttatatacctgcatgaaaggtactaaaatatttgttgaatatatgtgactattgtttttattacataaatatggttcattggtagaaaacagcactaatattttatagttaggatccattaccttaaaatagacattttatctagttgacgtcctagcaaattacctaatctttaagtacttaaaatgtatattttaaattactaaatcttgctttattttccctttaagagcaaactactagctacaatcttttctgaaagcttttcctactgtatcttttggaatagagtaaccttttgcacaaatcccagctcagcacttggataatttgaatgacgatttctctatttcaatatatgaaatcagaggagtttaaggtgaaaattcactaagtatatataggcattcctcaacttgcaaaatattttcatgaacaccttaattttataaatgatgtgttgcaagcttttattcagactacttaaatataaaacacttattgctcagactgggcgtcaatattgttctctaaggggggaaatagcagcagtttttgattgcaagaaaattatagtctttcctgtactgtaaatatcaaagacatcataaggcaggtagaaagttgtaaaatttctctttcagtagttggacaataaagagaaaaataaatatcatcatggactttaatgtgcacagaaaataaaatgttcaataaaaaatattaattatttctagtttcatgctttcttgtttacacaggtaatatatttcaaaatattttatttacctttaaaatgaaaatactaaaaaatgtatgagaaaagaatagagtaaagtcaagatgctttagcttggtggttcacagtagggagattaaagtaatcccaatattttcttgatttcttaaggtttaacaagtcatattctttgacagtaaatgttactagaaataagtaatcccaactggctgagggatatgagaaaaaagtatcagctctatttgagatataaaatgagaatgctagtaataataaatctctctctttatttctctctctctctctttcttagaaaaggtgtctccttattgactagaatggtaaatttatgttcctaaaaatggccttggtggcagcctaataccaacttgcatttgaagaatgttagaattgaggtacataaagtgaagtgatttgtccatggttataaaacatattatcagaataaggattagaagctgcttctaaacaagattgggacccaaatcttctgttaacagttctatataccaactcactttctttgatttttcatctgattagatcaattggaacttctttgtgtgtaaaacattttcaaacttaacagaagtcaaaaaacatggttttgatttagtttaaactttccaattaattttaattattctttttcatactcaaaatttctagagcctgcaaagctgactacctccatgcataaaccaaaaattgaggtttcttacatttttagtaaatatcttcattttatggagcatgctaattgacaaaaaatttggtcatttggaagtagtacaaggttgctcttggctgctctcatttgtaggaattcctgatctgagtgctgtattctataaatgatttctggaatttggcttagatgcttagttcagtctgcatgttcagctacattttctcctctctactcatctgctgctcatgcctccctacaactaactacctatagaaacaaagcctatgtctccagccttctgtgacaccaatagctaccactaggtcctcctatttcaggcatattccaggatgatcctgcctcttctctcatttcagatatcctgccttgtctatcttcatgcctatcaagctgacagaaatggaccgttcctttcttgtctacagagagggaaaagaatttcagtatacaccactctcaccagtctccaacaacacagctctttgtggcatttggggctgccctcaataggaagcatgtcattctacatacagagaatggttggtttacacaagacttcctgctgctgccatcaccaacagagattcctaatgtagacatctaacacattctgatcttgcagtaagcttagcaaagatatttctggtaaaaatgtattcagcagcagaatgacttcagcagttcatttatcacttgatatgcctgttttgcagttgtgtggtcccaggaatgcttgcttactatgatattttataatagtttcccaagattttttttcctggactctgaaaaattgctatgaaaaccaatagtgtatcttttttccttgggggataaggtttggaagaagtagtagaaatggggtagaagcaattcaggttgggcatatttaaccactcataagaaacttagtcaatattaatggaggcataattgccagatcaattgaaataattatccctccatattctgcactgggaagactacatttatagacagtttagaaacactggagtcagatttatcacaattacaatcccaactctgtggcttagacctaacctcataatgacacatggttgttaacctctactttatgactatctaacatttaattacagtatatttatatatatatactgtatatatacacacaaatatatagaacacacatatatagaaatatatactgtatgtatatatatttttacatatactgtgtgtatatgtgatatattataatcatatatatgattatgatatatatatcatatattata

SEQ ID NO: 325 - DNA, 5374 bp, Homo Sapiens
gagtgttccggagagcacgtgttagggaaggaggaggctgcgggctaacctgccgggagggagggataaactggtaaacacctcttgggttccaagagaaggaagaggacacatactgctcttcagatccgtatactgatccccactacaaccagtgaaccggaacattgaatctggatagggggccctggtgactaagatggcacgctctaaagatctagggcactctcttggccctgttttgcatcctatgcaggctgtgtgtacacagcaaggatatttcctggagggaattcatgaaacagcactacctaagtccaagccaagaattcagaaaatacaaatgcaacgtcctcatgagggaaaaagaagctctgaaagacaagagctcttgggtgttcatctatacctcatggtacaaatggagcatatatgcgtcaatgacaactgaaatgaccgctacagaaatgtatgtatataggcccagaatgccctgaaagaactcagttgtcaccaggagaattcaaaaaaaagcaacacattgtctgggtgcagtggccataactatattcccaacacttgaggccaggagtcaagaccagcctgggcaacatagccagaccccatctatacaaaaaaataaaataaaattacctgacataatgatgcacatgtgtagtcctaactagtggggaggccgaggcaggggaattgcttgaaccctggagattgaggttgctgtgagccatgatcacaccactacactccatcccaggaagcagagcaagaccctgtctctttttttttttttttttttttttgagacggaatttcgctcttgtcgcccaggctggagtgcaatggcacaatctgggctcactgcaacctccacctcctgggttcaagcgattctcctgtctcagcctcccgagtagctgggattacagacacccaccaccacgcctgggtaatttttgtatttttagtagagacggggtttcaccatgttggccaagctgatcttgagctcctgatctcaggtgacaccttggctttccaaagtgctgggattataggtgtgagccactgcacccagccaaccctgtctctttaaaaaaaaaaaaaaaaaaaaaactacccagagagcagaagtttcaactacattgaattccactaacgcggatgagtaggttgatagcacagaggacctgaagatgatgagcctgtcaactactagaaggtctacccacatccccaaattttgctacagtattctgtgcttgccaagcagtggccccgtctacatcattcgcccctgccactctctcctttgcatttatgtatcaatgttttcaaactacttagagttatgtatcacatggtctcttgataccatacctttgcctgtgttgtttctctgcctggaatacacttctgtcctatttacctaatttactcctactttttttccccaagattcagcttatatgccatctcttcttgactaacccaagactttttctgataacaattctccttatatctacccaagctgaatgatcttcccttcctttaaataaattatattatatcaaaaagaatttttctttagagaaatcaaagatgatctaaatacatggagggatcaggcatgatggctcacacctataatcccagcactttgggaggaggaggcaggaggatcgcttgagcccacgagttcaaggccagcctaggcaacataatgacacccatctttatttaaaaaaaaattttttaaataaaaaataggccgggtgcagtggctcatacctgtaactcccgcactttgggaagccaagacaggcaaatcacctgaggtcaggagttcaagaccagcgtggccaacatggtgaaaccccatctctactaaaaatacaaaaattagcttggtgtggtggtgcacacctgtaatcccagctacatgagaagctgaggcaggagaaatgcttgaacagaaaagacacagaaaaagatgttcatagcagcattctttgtaaaagccccaaactgtaaataatccaaataaccatcaaaaatagaatattatggcatgttcatgcagtgtaataccatgcagtaatacatacgaatgaaccaaagctctttgcaaaacctgaatgaatctcacaaaaataatgttgaataaaataaatcagaaatgttacaatttcattgatataagcttcaaaaaccagcaaagtgacactctgttgttacggatgcatgtttagggagcaaaactaagaaaagcaaatgaggttaccttaaggggtagcagttactttatgggggaggaaggagtatccattagaaagtagcacaaggggaatctctggagtgctgacagtgatctattttttgacctgggtgttggttacagggtgttcatttattatcatttacttggctgtacattttttttttttttagacagagtctcgctctgtcacacaggctggagtacagtggtgtgatctcggctcactgcaacctccacctcctgggttcaagtgattctcctgcctcagcctcctgagtagctgggattacagatgcccgccaccacgcccagctaattttttgtattttagtagggatggggtttcgccatgttggccaggctggtctcgaactgctgaccttgagtgattgacccaccttggcctccaaaagtgctgggattacaggcgtgagccactgctcccagccttagctgtacatttttgttttgcataattttctatatgtgtgctaaatttcactatgagaaacgatttttggctgggcacagtggctcacatctgtaatcccagcactttagaaggcgaggtgggtagatcacctgaggtcaggagttcgagaccagcctgaccaacatggtaaaaccccatctctactaaaaatacaaaaattagctgggcgtggtggcaggcacctgtaatcctagctactggggaggctgaggcaggagaatcgcttgaacccaggaggcggaggttgcagtgagctgagatcgcaccactgcactccaacctgggcaacagagcgagactctggctaaaaaaaaaaaaaaaaaaatctttttacggtggctcatgcttgtaaatttagcactttgggagtctgaggcggctggattgcttgatttcaggagttggagaccagcctgggcaacatggcgaaaccccgtctctaccaaaaacaccgaaaattagcccggcatggtggtgaacgcctgtagacccagctactggggatgctgacatgggaggatcacttgagcctgggaggtgaactgaggttgtgtcactgtactccatcctgggtaacagagtgagactgtctcaaaaaaaaaaaaaaagataaaaataatgttttgtatgaaaggagagaacgtcagcactcctcttgacaaggatggaagaggctctcagacctgacaacatgcatgaagttaaggcattgccacctacttcatggcatctaaacatgttgttgtggtggttgttttttaaagacagagcctacttgatacctatatacatatagaaacattaactcaaggtgagttgtaaacctaaatgcaagaactaaagctctaaaattcagaagaaaacatatgagtgccaggtgcggtggctcacgcctgtaatcccagcactgtgggaggccgaggccggcggatcaccagcgcaagagatcgagaccatcctggctaacatggtgaaaccccgtctctactaaaaatacaaaaaattagccgggcgtggtggcgggcgcctgtagtcccagctactcgggaggctgaggcaggagaatggcgtcaacccgggaggcggagcttgcagtgagccgagattgcgccactgcattccagcctgggaaacagagcaagactccgtctcaaaaaaaaaaaaaaaaaaaaaaaaaggagtgaatctttgtgaccttggattaagcagtggtttcttagatataaaagcacaaacagtgaagaaaaaaagataaattgaatttaactcattttattttaattcaatggataaattggacttaaaccaatttaacacttttgtgtttcaaaggacgccatcaagaaaggcaacccatggaattggagaagatatttgcaaattatatatttgataagggactagtgtctggaatatatataaaactcttacaactcaacaataaaaggacaattaaccccatttttaaaagggcaaaggggaaacaaggggctgaaaatgagctcaaatttatttttttcagacagggtatttctctgtcatccaaggctggagtacagtagcacgatcatggctcaccacagcctcaacctcccaggctgaagtgatcctcccacctcagcctcccaagtagctggaactacaggcgtgcgccactatatctggaactcctgggctcaagcaatcctcctgcttcagcctcccaaagtgctgaaggattacaggtgtgagccactgcgcctggttttaaacgtatgaaagaagatgagtaaataacagtaaagccctgggttgtgaagatgtaataatacaaaaagcagagagaaggcaggatgtttgactcctgactgttccatcaaggactgtagtctggaaaataaatattttgaaggtgaaaaattaaagctcatattaggataaaagactatcagagagcactgagttgtcttaaattaagtcaagcctcctaaccccaataaaacacatcatagtgccaaataaagttaaaaatccagccaggcgtggtggctcacgcctgtaatcctagtactttgggaggcccaggtgggtggatctctttcagctcaggagttcaagaccagcctgggcaacacggtgaaattccatctctacaaaaaataccaaaatgagctgggtgtggtggctcatgcctgtggttccagctgctcaggaggctgaggctggagggttgcttgaaatgggtggcagaggttgcagtgagctgagatcacgtcactgcaccccagcctgggcaacagagtgagaccttgtctgaaaaacaaataaataaatatataaatatataaataaaataaagttaaaaatctgaaaaaataaaacgggtaaattatttcaatcaatatttctctaaggaatatatacaaatggccaatatgcacataaaaatattctcaacatcatcagtcatcaaagaaatgcaaatcaaaccagtgatgtgatactacttctcagccactaagatggctaatattaaaaagacagataggccgggcacagcggctcatgcctgtaatcccagcactttgggaggccgaggc

SEQ ID NO: 326 - DNA, 931 bp, Homo Sapiens
atggatgacgaaaatgcaacattgctgacagagtttgttctcacaggacttacatatcaatcagagtggaaaatacccctgttcctggcattcttggtaatatatctcatcaccatcatggcaaatcttggtctgattgctgtcatctggaaagactcacaccttcacattccaatgtacttattccttgggagtttagcctttgtggatgcttggttatcatcctcagtgacccctaagatgctgatcagctttttagctaagagtatgattatttctgtctctgaatgcaagatacaatttttttcctttggaatcagtggaaccacagaatgttttctcttggcaacaatggcatatgatcgctatgtagccatatgcaaacctttactttatccagtcattatgaccaatggactgtgtatctggctattagtcttgtcatttataggtggctttcttcatgccttaattcatgaaggtattttattcagattaaccttctgtaattccaacataatacatcacttttactgtgacattatcccattgttaaagatttcctgtactgacccttctattaattttttaatgctttttattttgtctggttcaatacaggtattcactattttgactgttcttgtctcttatacatttgtcctctttacaatcttaaaaaaaaaagtctgccaaagacataaggaaagccttttccacctgtggagcccatctcttatctgtttctttatactatggcccccttctcttcatgtatgtgcaccctgcatctccacaagcagatgatcaagatatggtggagtctctattttacactgtcataattcctttcttaaatcccattatctacagcctgagaaataagcaagtcatagattcactgacaaaaacattaaaaggaaatgtttag

SEQ ID NO: 327 - DNA, 4063 bp, Homo Sapiens
gaggagcccagggacatatttcacagctaagtcaactgcttttcttcaaattcagatttaatccttgagtgaaatgagtcactggctcatccagttaagatcatcacccactttcctaacaaaacttctcttcaaagaaggactcgctcatccatcaggtggacctccacaggaacaaatcatatccatgtcaggcggcaccaaacctaaatctgcttctgcctcagcagacaggacatgagattagtgccaccatcaaggacttgaaagatgcaggggtgatgattcccaacccattcctgttcaactctcccatttggcctgtgcggaagacagatggatcttggagaacgacagtgaattatcataagcttaaccaagtggtgactccaattgcagctgctgtagcagatatggtttcattgcttgagaaatgtgtacctggtatgcagccattgacttggcaaatgcctttttctccatacctgtccataaggcccaccagaagcaatttgccttcagctggcaaggccagcaatatacctttacagtcctacctcagaggtatagcaactctccagctctgtgtcataatcttattcggagagaccttgactgctttttgcttctgcaaagtatcacactggtccattacattgatgacattatgctgattggatccagtgagcaagaagtagcaagtacactggacttgttggtgagacatttgtatgccagaggatgggaaataaatccgactaaaattaaggaaacttccacctcagtaaaatttttaggggtacagtggtgtggggcctgtcaagatattccttctaaggtgaaggataagttgctgcatttggccactcctacaaccaagaaagaggcacaatgcctactgggccgatttggattttggaggcaacatggtccttatttgggtgcattactgtggcccatttatcaagtgacctctaaggctgccagttttgagtggggtccagaacaggagaaggctctgcaacaggtccaggctgctgtgcaagctgctctgctacttgggccacatgacccagcagatccaatggtgcttgaggtgtcagtagcagatagggatgctgtttggagcctttggcaggcccccataggtgaatcatggcagaggccgctaggattttagagcaaggccctgtcatcttctgcagataactattcttcttttgagagacagctcttagactgttactgaactttggtggaaactgagcatttgactatgggtcatcaagtcaccatgtgacctgaactgcctatcaggaactgggtgctttctgacccacctagccataaggtgggtcatgcacagcagaattccatcatcaaatggaagtgatatatacgtgattgggctcgagcaggtcctgaaggcataagtaagttacatgaagaagtggctcaaatgcccatggtgtctacttctgccaccctgcctgctccccccacagggtgcactgatggcctcatggggagttccctataattggttgacagaggaaaagaagacctggttcagagatgattctgcatgatattcaggaaccatgcaaaagtggacagctatagcactacagcccttttctaggacatccctgaagggcagcagtgaagggaaatcttcccagttggcagaactttgagcagtgaacctggttgtgcacttagcatggaaggagaaatggccaggtgtgcgattatatactgattcatgggctgtagccaatggtttggctggatggtcagggacttggaagaagcatgattggaaaattggtgacaaatttggggaagaggtatgtggatggacctctgagtggccaaaaactgtgaagatatttgtatcccacgtgagtgctcaccaacggatgacctcagcacaggagattttaataatctggtggatagaatggcctgttatgtggacaccactcagcctctttccccacccacccctgtcgtcgcccagtgggcccattaacaaagtggccatggtggtagggatggaggttatgcatgggctcagcaacatgtacttccactcaccaaggctgatctggctacggccactgctgagcgcccaatttgccggcagcagagactaacaccgaacccttgatatagcaccattactcatggtgattagttacctggtggcaggttgaatatattcaacctcttccatcatggaaagggaagaggtttgtcctcactggaatagacaattactctggatatagatttgcctatcctgcacacaatgcttctgccaagactaccatctgtggactcacggaatgctttatccactgtcgtggtattccacacagcattgcctgaccaaggcactcactttatggctaaagaagtgtagcagtagacttatgcttatggagttcactggccttatgttccccatcatcctgaagcagctggattgataagagtggtggaatggccttttgaagtcacaattacaacaccagtgaggtgacaatactttgcagggctgggacaaagttatccagaaggccgtgtatgctctaaatcagcatccaatatatggtactgtttctcccatagccaggattcgtgggtccaggattcaagggatggaagtggaagtggaaatggcaccactcaccatcacccctagtgatccactagaaaatttttgctcctgttcccacgacattatgttctgctggcctaaaggtcttagttccagaggaaggaaggctgccaccaggagacacaacaacgattccattaaactggaagttaagattgccaccaggatactttgggcttctcctcctgtctttaagtcaacaggctaagaagggagttacagtgttggctgggatgattgacccagactatcaagatgaagtcagtctactactccataactgcggcaaggaagagtatgcaggtaatacaggaaattcattagggcatctcttagtattaccatgccctgtgattaaggtcaatgggaaactacaacaggcaggactacaaatggcccagacccctcagaaatgaaggtttggatcactccaccaggaaaaaaaaccacaacctgctgagctgcttgctgaaggcaaagggaatacagaatgggtagaagaaggtagtcatcaatatcagctacgaccacgtgaccagctgcagaaatggggactgtaattgtcatgagaatttcctccttcttttgctaaaatcatgtttgtgcatgtatacacttgtactaagaaaatatcttcattttatttcctttttctctatgatgtgacataagatttattgacttcatagcagcatttaagtattgttaactttatataatagtatttgggttggggattggtgcctttctggttgtatgaaggatagttgtattatgttaggtgtaattatgacattattgtctttaagattatgtatgacctcaggaggtgtgtatgggttcaagttgacaggggttggagttgtgattgttaatgctctgtgtcaacttgattggattgaaggatacaaagtactgatcttgggtgtgttggtgagggtgttgccaagagatattaacatttgagtcagtgggctggggaaggcagatccacccttaatctggtgggcacaatctaatcagctgccagcgaatataaagcaggcagaaaaatgtgaaaaggagagatgggcctagcttccagcctacctctttctcccatgctggatacttcctgcccttgaatattggactctaaggtcttcgctttcaggacttggattggctctccttgctcctcagcttacagatggcctattgtggtaccttgtgatcatatacgtttatacttaataaattcccctttatatatatatatctatgtatatcctattagttctttccctctagagaacgctaatacaccatccttgattaaatcccttcaccctctctccatctttgtaaaaattctcctcattaaattattgttcagtg

SEQ ID NO: 328 - DNA, 3988 bp, Homo Sapiens
gagtcactggctcatccagttaagatcatcacccactttcctaacaaaacttctcttcaaagaaggactcgctcatccatcaggtggacctccacaggaacaaatcatatccatgtcaggcggcaccaaacctaaatctgcttctgcctcagcagacaggacatgagattagtgccaccatcaaggacttgaaagatgcaggggtgatgattcccaacccattcctgttcaactctcccatttggcctgtgcggaagacagatggatcttggagaacgacagtgaattatcataagcttaaccaagtggtgactccaattgcagctgctgtagcagatatggtttcattgcttgagaaatgtgtacctggtatgcagccattgacttggcaaatgcctttttctccatacctgtccataaggcccaccagaagcaatttgccttcagctggcaaggccagcaatatacctttacagtcctacctcagaggtatagcaactctccagctctgtgtcataatcttattcggagagaccttgactgctttttgcttctgcaaagtatcacactggtccattacattgatgacattatgctgattggatccagtgagcaagaagtagcaagtacactggacttgttggtgagacatttgtatgccagaggatgggaaataaatccgactaaaattaaggaaacttccacctcagtaaaatttttaggggtacagtggtgtggggcctgtcaagatattccttctaaggtgaaggataagttgctgcatttggccactcctacaaccaagaaagaggcacaatgcctactgggccgatttggattttggaggcaacatggtccttatttgggtgcattactgtggcccatttatcaagtgacctctaaggctgccagttttgagtggggtccagaacaggagaaggctctgcaacaggtccaggctgctgtgcaagctgctctgctacttgggccacatgacccagcagatccaatggtgcttgaggtgtcagtagcagatagggatgctgtttggagcctttggcaggcccccataggtgaatcatggcagaggccgctaggattttagagcaaggccctgtcatcttctgcagataactattcttcttttgagagacagctcttagactgttactgaactttggtggaaactgagcatttgactatgggtcatcaagtcaccatgtgacctgaactgcctatcaggaactgggtgctttctgacccacctagccataaggtgggtcatgcacagcagaattccatcatcaaatggaagtgatatatacgtgattgggctcgagcaggtcctgaaggcataagtaagttacatgaagaagtggctcaaatgcccatggtgtctacttctgccaccctgcctgctccccccacagggtgcactgatggcctcatggggagttccctataattggttgacagaggaaaagaagacctggttcagagatgattctgcatgatattcaggaaccatgcaaaagtggacagctatagcactacagcccttttctaggacatccctgaagggcagcagtgaagggaaatcttcccagttggcagaactttgagcagtgaacctggttgtgcacttagcatggaaggagaaatggccaggtgtgcgattatatactgattcatgggctgtagccaatggtttggctggatggtcagggacttggaagaagcatgattggaaaattggtgacaaatttggggaagaggtatgtggatggacctctgagtggccaaaaactgtgaagatatttgtatcccacgtgagtgctcaccaacggatgacctcagcacaggagattttaataatctggtggatagaatggcctgttatgtggacaccactcagcctctttccccacccacccctgtcgtcgcccagtgggcccattaacaaagtggccatggtggtagggatggaggttatgcatgggctcagcaacatgtacttccactcaccaaggctgatctggctacggccactgctgagcgcccaatttgccggcagcagagactaacaccgaacccttgatatagcaccattactcatggtgattagttacctggtggcaggttgaatatattcaacctcttccatcatggaaagggaagaggtttgtcctcactggaatagacaattactctggatatagatttgcctatcctgcacacaatgcttctgccaagactaccatctgtggactcacggaatgctttatccactgtcgtggtattccacacagcattgcctgaccaaggcactcactttatggctaaagaagtgtagcagtagacttatgcttatggagttcactggccttatgttccccatcatcctgaagcagctggattgataagagtggtggaatggccttttgaagtcacaattacaacaccagtgaggtgacaatactttgcagggctgggacaaagttatccagaaggccgtgtatgctctaaatcagcatccaatatatggtactgtttctcccatagccaggattcgtgggtccaggattcaagggatggaagtggaagtggaaatggcaccactcaccatcacccctagtgatccactagaaaatttttgctcctgttcccacgacattatgttctgctggcctaaaggtcttagttccagaggaaggaaggctgccaccaggagacacaacaacgattccattaaactggaagttaagattgccaccaggatactttgggcttctcctcctgtctttaagtcaacaggctaagaagggagttacagtgttggctgggatgattgacccagactatcaagatgaagtcagtctactactccataactgcggcaaggaagagtatgcaggtaatacaggaaattcattagggcatctcttagtattaccatgccctgtgattaaggtcaatgggaaactacaacaggcaggactacaaatggcccagacccctcagaaatgaaggtttggatcactccaccaggaaaaaaaaccacaacctgctgagctgcttgctgaaggcaaagggaatacagaatgggtagaagaaggtagtcatcaatatcagctacgaccacgtgaccagctgcagaaatggggactgtaattgtcatgagaatttcctccttcttttgctaaaatcatgtttgtgcatgtatacacttgtactaagaaaatatcttcattttatttcctttttctctatgatgtgacataagatttattgacttcatagcagcatttaagtattgttaactttatataatagtatttgggttggggattggtgcctttctggttgtatgaaggatagttgtattatgttaggtgtaattatgacattattgtctttaagattatgtatgacctcaggaggtgtgtatgggttcaagttgacaggggttggagttgtgattgttaatgctctgtgtcaacttgattggattgaaggatacaaagtactgatcttgggtgtgttggtgagggtgttgccaagagatattaacatttgagtcagtgggctggggaaggcagatccacccttaatctggtgggcacaatctaatcagctgccagcgaatataaagcaggcagaaaaatgtgaaaaggagagatgggcctagcttccagcctacctctttctcccatgctggatacttcctgcccttgaatattggactctaaggtcttcgctttcaggacttggattggctctccttgctcctcagcttacagatggcctattgtggtaccttgtgatcatatacgtttatacttaataaattcccctttatatatatatatctatgtatatcctattagttctttccctctagagaacgctaatacaccatccttgattaaatcccttcaccctctctccatctttgtaaaaattctcctcattaaattattgttcagtg

SEQ ID NO: 329 - DNA, 1428 bp, Homo Sapiens
tttccctgtcctccttcccacatcgatttaaaaaattagatgcaaatgcaaaatccttaaattatagatttatgataaatttaaattctggtagaatcaaggttttataacatttaaagtgtctgacactaagtgtatataatcttttaagaaacgtcttcttaacagcgcatggtattctgtgactgttcgtgtaccatgaatattcttattgggttctagagttagttactgactcttgaagatgggcatctaatggtcctcctgtggaagtggagagcagctctccactgtttgataacatttaaagccaagggtgaaccactcaagaaacatttggtggttataatatttttttgttgttgttaagtaccatcaataaaactgaaaaatctcttaagtacctgactcctgcagtgatacaactgcagtgataaaacttttagctttttacatcaggggtattaggtattttctcacagaaatagccttttgaggtgaaattcacataacatacaattaaccattgtaaaatgaacaattcagtggcgtgtaagagtatgtttacaatgttgagcaaccatcacctctgtctagttgcaaaatgttttcatcactccaaaagaaactcctttattcatcatagcccaaagttggaagtattttcttgattgggctcttgattacatggatgcatctgagtcattgaattgaagcctaagatgtgcttaatttcactgtgtgtaagtttcacctcagttaacaagagagaacagaacaaaccaaaaatcttaattcttttgaaaaaaagactttctggctgctttattaaagaagccaggggaacaaggttaaaaggaaatcagttagcagtgaccaaggcaagagatgatggtggcttggctgaagatggtgacagtggaggtggtaaggtgatcagattctggatatattttgaaggttgagctaatttggtcagctgatgggcataatggatgtgagggaaagaaagttggaaaggatgatgtgaagatttttaatgggatggaataggtgtttaatgaacagccatttaacaacatcagggtaatttcatcttgtgtatcattctctacaacagggttatactctaggacagtagatacccttagtactctactgtcctagagtataaccctgttgtaaagaatgatacacaagacaaacttaccctgatgttgttaaatatatgttagatgaccagttgctttgatttctttgctcaataaacattggattacagctggtttgctgtgtggcatgcctacatggagggaacacactgagccaatgatttcatcatctgggtccctttggtttatatcagtttccaacatgacttgtttgtggggcttgtgggaggggcacatacatcggccccaggattct

SEQ ID NO: 330 - DNA, 2225 bp, Homo Sapiens
gattctcacagctactccatctgtgaaagctcctgggagaggggtaaggcggcctccaaagaccacttggaattgcctcacccagaagatcagaaccctactttctgggcagatacatgggatcctctataatctggttcactagaccaatctcactgatcaccattcagtgagagttgcaaagatacggagaaatggaattaaagctatcaaaataagaaaattcctgatcaaaagttttcaactacttatctacaggaaaagttattttatgtgtagtaaactaaattcatttacaatgtctttgtgagttattaatcatccgccagtgggaggcaggcaacaggagaaacaggctgtgtatctgagagtgggaccccttaagagtgcaaaggagaaggggagaggagagaaggtgacaatatgttgcagtttcattattacaatttacaacagcctacacatgtttaatcctgattttcttctctttgaggcactcacagtgcaagtgaagaattaaatcccgtctttatttaaaatgttgatattttgttaatcatagatttttgtgcattgtttgatatctatgtacttgtaataggttgtgatacacataatttgcaactatgtacaaataaactgtggtatcttactaattgaaacagaagcagtagttgaaatttataaaaagttttgtaggtatacagtaacggaactaatttattttgggtgtgtttttgtatgatgaatacaaaagtatactacatagtattttaaaagtgtttgagcctttgactgttttatgaattaacctaagtaacagtaccaaactttttgtaaatgagtcctcaaagttttggttatattttatttaaaattagttgaaaattgtaaatcaaaatattttcaatggagtactcctacatttttaacttctgaagcttttggcaagttgcaatttctcaatacaaatctggcaaacaaaaaagacattgaaattcatttctataaaagccagagacaaactgcatgaaataaaaactgaaagctcctatggggtgcacaatttaatttggaaattcttgattggctcttaggaatattttgattagaggaaagaatcttttgatggatttcttgttttttagtaaattgttaatattctctatcaaaataaagtataaaattgagaaaatttcatttctcacaattatagtgattaaatttggcaaaacactaaaatgaaacaacctgtcaactaagacaacttagttttgtcttcttagttttatctcttaaatctaaccttctgtacctctgtgctgcattctggttaatttttttggatcttccagttcactgactctcttcagcaagtctaatctgctattagattcgtccactgagttttatattttaactgttattattgttcatttttagaattttgattgcatatttttaaaaatgtctagtcattctttataatttttactcactcctcatattgtcagacttctttttatttcattatacataataaacataatttatatttagtgtctctgttaactctaatagcttaagtctctgggtttgcttctgcaggttctcactcatggtgacctcttccattatctgttttatgctcactgcatactgcttattttctttggaactttatctttgaggatttgttgatgccttgttgaaggtgggttccttcagagacgatatacaattgtttttgccagaaacctgagaatacttccagactgggaccactgcaaactggatttcagagtgaggtttgttttagaccaaccaacttaaatgaatttggtctgcatccccatgtgaggatactttttctgctacgaactctcagaagagattttttttgttttctgtcgacagcaccaaggttggagatgggcaagtttcctgcagctgttggcaggctaggcattcgtttctagttctcttttacactgaggatatagctttttggtttccaactttaagggaaggtggcctattagacaacccaccttgggcaggtcctaggctttgtttcttgtccccatactctgtgagtcaaggtcaaggtcaaaagcccttaagacaaaagccagcttcactgctgtcagtatgtagaattcctgccattatttaaattttgacttgagcattttttacttcttgcaagacaatgaatgatttaa

SEQ ID NO: 331 - DNA, 4449 bp, Homo Sapiens
gctctggtgctggcggacctcgggtcgcgcagtcagctgctctaagatggcgaaactcaccttcaggacatgctcccttgggctaggagatcaggtgggctccgggtgatgcgcaagtccacccctctagctgcagttccgcctttttctctacaaccaagcaaacattttggcaggcacgtgtgagtgacgaccttgaaaccaatctgatttatttttctgaaaagtaagttattgacaaatgtcaatttttaatatcaacttatttaggatgtatctccaaacctatccttacacacagtatgtctcagcaaggcagctataagccctggtgagctaatgagtcttccatcaggaaagtaaaatggtcaaatattgttctaggaaaaacattctattgattttcttcagaatctctagcaaagcacttgatcaggtactcagaaaacattaccaaattgaagtggcaccacgtatgcattaaaggatttgggaaggaatctcgattcagcatacaaggcttacgtttcctgatgggcttttctttaagtaaaatcaacaaatggtgttcagcacctattgctgattagtgctgtggggtgacaccaagcagtatgtgaaatgacctctagtcttaaggagtgctcatcgtggttggggacataaactaacatactttaaatactaggcaacaagtgaaacatattgtaaggagtaagggttgtaatgtttctgtcccccgccccccccaagttcataggttgaaattaatcccagcgtgatggtctttggaggtggggcctttgggaagtgaataaatcatgagggtggagcctcatgaatgggaatagtgccataacgaggccagagagctctcttgcccactttccaccgtgtgaggatacagtgagaagatggcctgcaacccagaagagaggcctcaccagaacctaaccatgctggtgcctgatctgagacctcagcgcctccagagctatgagaaatgaatttctaaacccagtctatggtactttgctgtagcagtctgaacagtctaagacagggatgaaaaagcttcaaggagcaagtttgtgaactgagcctggaaggaggagtaggatctgacaaagggttagaagaggaaggactccaagcagaaggagcaaacctaggaaagagactgagggaaaaattcaggagaccaaactctcatgcgcaggaggttcatgctgaggggagcaggaagcagagctggactggggaggccttgaaggcaggcagagcaaggagccccaccaggtgactgctcattggcctcccagatggattcgatggtatcgctcagatgatggaacaaaaaagaaaaagagaaaacacaaatgtgacatgtgaaaaataggaatgaaagagaaagataaaagagaaggaaaatcttcccaggtctagaagatacattctcgtatcgaaagggcccagcaggtgcccagcacaacaaacctaggaagaccaacaccaaggcacatcgccacagcattcagaacaccaaggataaagaaaagatcttcagagtttcctgaaggaaaaatgaaaaggtcacatttaaaggactggaaatcagaatggcatggaaattctccacagaatcccaggaagctggaatacaatagggcattaacttcaaaattctgaagaaaataattctaacatagaattcaactctcactatattagctgtttgtgggtaggatgtagatattttcagatatccttatctcagaaagctactggaggatattcttctccaaaattaagaaattagccaagaaagaggataatatttgggacctaaaaaacaggaagtcccagcttaggagagaggagaagggaagtactaggacagaagctaggacttatacagtaggggatagaggcctctaggagagatgtttccagaaggaagtgaatcacatggaatgcctgttatggatgaatatcttaaaagggatcttcagaatttgatgatgataagtaatagctagataggaaagtgaataaggaaataaatgaggccattattgaatctagtgaaaacaatatgcaaaaaaggatatagcatatgtcttggctgtgaataaatatgtaattataacaagataattgctgaatgggagtttaacccaaaggggtgttataattatttttgaaaaaagggaggtgaccttacgtgtgtttacataaatgtgcatgtgtctaggaagtgagggtgggagagttaaatccttgtcttctagagttaggaagtccatagactatacgcacaattgaaaagtaaggacagaacattaaatatgtgttcttagaaaatatgagcataaggccgggcacattggctcatgcctgtaatgccagcactttggggggccaaggtaagaggactctgtgagcccaggagttggagaccagcctgggcaacatagtgagacctcatctctacaaaacatttttaaaaattggccaggcatggtggcatgcacctgtagtcccagctacttaggaggctgaggtgggaggatcatatgagccccagagtttcagtctgcagtgagctgggattgtgccaccacactccagcctgggtgacagagtaggacgctgtctcacacacaaaaaaaggaaaagaaagtagagtaaattctctcatatacaaaagaaatatataagagataaatgtaagagaaggaattgggagtgggagtgtgtggtgtgggcaactactatttttgttaacaaatctagaaataccatttgaattttaagattataaatatttgatataaggaaaaatttttaagttttaaaaagttattcactaatacaagtggtagtaagtggcacgactgtcactcaaattccaatctgtctaaatcttgaagctttaaaaaattgttatgactacagtacactacagcaaagggaaggaaaagtcaaatattacttcaaggtctctttcctgggagactacaagaaaagttgcatgcagaaatcagtgtaacaagagcaagaagagttacgtaggattatccacatcctgcttcacctcctgcttcatagctcaggcaagcacttccctgtgctctgctgtgcacagccagtttatcagtgtgggaaaaaatctataaataggatggaggtttacataaaagagaaacataggaaaagaaaggggaataaaaaagaaactgtagagcgaatttgggggttaatgcagaggaaaaagctaaagtgagagacatcacatcagctgtgagagagaaacccagaaaatgaatggcaggggcatctgggacaggtttctcttggtaacaagttgaccctttaaatagactgcaagatgtatttgcagtttttatttggatgctgaatgaaatttcttttgagtataacaaccacatgagctcaagattttatttgggcaatgatatggtttggctgtgtccccacccaaatctcatcttgaactgtagttcctataatctccacatgtcatgggaaggacctggtgggaggtaattgaatcatgggggcggttacctccatgctgttctcttgatagtgattgagttctcatgagacctgatggttttataaggggcttttcccctgcgtcactccacatttctccttgctgctgccaggtgaagaaggacttgtttgcttccccttccaacacgattgtaagtttcctgaggcctccctaaccatgctgaactgtgagtcaattaaacctctttcctttataaatcacccagtctcaggtatgtctttattagcagtgtgagaatggactaatacagcaaattggtaccaggtagtgaggtgctgttgtaaagatacccaaaaatgtggaagtgactttggaatggggtaacaggcagaggttggaacagttgggagggctcagtagaagataggaaaatgtgggaaagtttgaaacctcctagagacttggagggctcagaagataggaacaggtgggaaagtttagagcttcttagagacttgttgaatggctttgaccaaaatgctgttagtgatatggacaatgaagtccaggctgagatggtcttagatggagatgaggaagttgttgggaactggagtaaaggtcactcttgctatgctttagcaaagagaatggcaacattttgcccttgccttagagatctgtggaactttgcacttgagagagatgatttagggtatctggtggaagaaatttctagacagcaaagcattcaagaggaagcagagcataaaagtttgaaaaatttgcaggctggcaatgcaatagattaaaaaaacccattttctgggggagaaattcaagttggcaacaaatttgcataagcaatgagaagaagaatgttaatcactaaaacagtggggaaa

SEQ ID NO: 332 - DNA, 1279 bp, Homo Sapiens
aaatgtcaattgactcctctcactcatagttgtacaaattacagggcttttttttaattgtcataaaacatatacattattcatctattcagtttcatctgaagagaatccaacaaagaagaaattttattttccaataaaatattaaagctgctttaccccacaagagacagagcagaaattccatccatgatctatgtaagtacaaaactttttgcctatcagagcatgtgtgaatttaattttatgaaaatgtagacctgttttttcctgttatgcttcatagtacttgtgtatgaatatgtaacaatttcaatgtttttattagtttgtgaagccttggtaccatgatgacaacaagaacatcctgtgcttttcctagcaaatattgacttagaaggacactgttgatatttgtgctgcatccttaatggaaagcacgtacatattacaagatttgtttccctctaatgtaaatacagtggagcagaaaattcaagtggtgattatacacacgtcattacctttgcctctgggttatggattgaactagaacccaggttaaggtcatcatgacccccccccaccccgccccttatcgggcacttctatcactaatgaaaagagggtgtgccaagctcaacacacacacacatctttctaattaacagaatcccgctctgattcataaaagtcctatctaaaagggagggagaaatgatgttagcattgatacagaggtacatgtcagctcagtgcacaaacataggtaaattatgtaaggataaatctttctcttttccaggagacagttcaccactctccctctgtaaaaggattgtgggagacacataggtagtaaggagaaacctccatctatctcccaacgaacctctgtgtccccatgttccacccaactctccatgattgaataattaagcccttaagtagttaccatatgtccttaaatagttacaatcaacctcaaatgaaaacactcagcaaaaaaaagatgtgggatcaatgctcttggtccaaagataaaagatacattatgaaaaacataggaatgactttataaacaaaacagaactttctcaacaatcttattaaccaatactctttcatcgtaagtgatcacggttatttggcgtcagaagcaaaatatggagagatctttctgcagacaagtggagacaaggcacaataaagggagagttaggtgtgtaaagaaagtgatgaaatggacatactttagtgtttaattcataaggaagaa

SEQ ID NO: 333 - DNA, 8517 bp, Homo Sapiens
ctttccggccggactgccgcgcctgtggccggaagagccagctagaccagagagtctgtacctgcaaccctggcggcgtccgagcccaaggcggagtctgggagacaaagaagtcctcgccgccggccgctggaggattctgccagtagtgaagtcagggatgggcccgagagagcttggaaagaggacaaggaagggaaggagtaggagtagaaaagcatgactttggctggagatggggtctcgttatgttgaccaggctggtcttgaacacctgacctgaagtgatcctcttgcctcagcctcccatagtgctgcgatcacaggtgtaagtcactgagtttggccattattccatttctgtacacaaaaacctttctcattctgtgctataactagttagcatttaattgggtggatgtggtataactagtgccttgttgatattgatgcatatttacatggttttgctgttataaacaatggtcccttgctattataaatcacactgctataagtaaccttgcatctaaattacttcaaatgtgtaactatatgggtaggataatttctagaagtggaattgtgaaccaaagttttaggtgcatttgtaattttgatttataaccaatcttttcactgatctacttctctgcctctacctccacctctctacctctctacctctctacctctacctctacccacggtctccctctctttccatggtctccctctcatgtggagccgaagctggactgtactgctgccatctcggctcactgcaacctccctgcctgattctcctgcctcagcctgccgagtgcctgcgattgcaggcacgcgctgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcgctacaacctacacctcccagccgcctgccttggcctcccaaagtgccgagattgcagcctctgcccagccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagtgcctcttcccagccgccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccgccccgtctgagaagtgaggagccaccccatctgggaagtgaggagcatctccgcccggcagccaccccgtccgggagggaggtggggggtcagccccccgcccggccagccgccccgtccgggagggaggtgggggggtcagccccctgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctctgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactgttgtcccatgaccctgccaaatccccctctgtgagaaacacccaagaattagcaataaaaaaataaattaaaaaataaaaaaataaaaaaataaaaaaaactcattaagctctaaaaaaaaaaaaaaaaaagaaagaaaaaaagaaagtagtgaccaattcctgaaaattggcaaaaaaaaaaaaaaggcaagagtaaggcatttatcttgtctttccagtatgaactctagttcaaaataactgatgagaggaaggttttgtttgttttttgagactgagtctcactctgtcgcccaggctggagtgcagtggcgcgatctcggctcactgcaacctctgcctcccaggttcaagcaattcttgtgcctcagcctcctgagtagctgggattacaggcgcccgccaccactcccggctaatttttgtatttttttagtagagacggggtttcaccatgttggcgaggctggtcttgaactcctgacctcaggtgatccgcacacctaagcctcccaacgtgctgggattacgggtgtgagccattgcccagcccgggatttttttttttttttatagattaacagctagtaattgtgcaaagaatgatagaaaaaaatcactattttgcatgtcccagtgaaataattcaggcaacaatcaccagtggatgaaatccctaaagagcttttaggaagctttaaaatgcctggacccactcatcactgaacatgaaaccaccagtcattgtttgcctcctgatgtgaggcaatataaagcacacagaaccacttattaaacattcttgcccaaaaaattgaataggaatacaggacttaggggccaggcgtggtggctcacacctgtaatcccagcactttgggaggccaaggagggcggataatctgaggtcaggagttcaagaccagcctggccaatgtggtgaaaccctgtctctactaaaaatacaaaagaaaattagctggatgtggtgacgcacacctgtagtcccagctactcgggaggctaaggcaggagaatcacttgaacctgggaggcagaggttgcagtgagctgaaatcgtgccattgcactccagcctgggcaacagagcaagactccatctcaaataaaaaaaaaagaaatacaggacatagggaatgagtgaaatgacaacataagaaagcaaacagtcaaatctagaatgcagaacatttcatatgacaatcaacatggcttctgtaagccaatgtcaatgtaaaaaggggataggagactgctcttttttttttttttttgtttgtttgtttgtttgtttgtttgagacagagtctcactctgtcgcccaggctggagtgcagtggcaagatctctgctcactgcaaggtccacctcccgggttcacgccattctcctgcctcagcctcccgagtagctgggactacaggcgcccgccaccacgcctggctaattttttgtatttttagtagagatggggttccactgtgttagccaggatggtctccatctcctgacctcgtgaactgcccgcctcggcctcccaaagtgctgggattaggcgtgagccaccgcgcccggctgaggagactgctttttaaaaaatgtaaccaaatgtaatgtgtggatttgtttggatcttgagtcaaactaagtcatttttcagccaaggaaatttgattatggattgaatactaagaaagtatgatttaataagtgatattatggtaaatttccatatttcttaagagacattgaagttaaaggagtgaaatgatataatgcttggatttgatttaaagtaacttcatcaaggaaaaacaagaaggctgagtgctgtggctcacgcctgtaatcccaacaccttgggacgctgaggcgggcggatcacctgaggtcgggagttcaagaccagcctgaccaacatggagaaacccccatctctactaaaaatacaaaattagctgggtatggtggcacatgcccataatcccagctactcgagaggctgaggcaggggaatcgcttgaatccaggaggcggaggttgcagtgagccaagattgcaccattgcactccagcctgggcaacaagagcgaaactctgtctcaaaaaaaaaaaaaaaaaaaagaaaaaagaaaaacaacaaaaagagaaagtaaatgtggcaaatttgataactgttgcatctggtcatggagattctttgtatagttctacttttacgctgcttaaaaatgtttgataaaaccaacatggcatatgtatacctatgtaacaaacctgcacattgcgcacatgtactgtagaacttaaagtataaaaaaaaaatttgataaaatggttgggtgcagtggctcacgcctgtaatcccagcactttgggaggccaaggcaggtggattgcttgaggtcaagagttcaagaccagcctgacccacatggtgaaaccccgtctctactaaaaatacaaaaattagctaagtgtggtggcaggcacctgtgatcccagctacttgggaggctgaggcaggagaattgcttgaacccagaaggcagaggttgcagtgagccgagatagtgccattgcactccagcctgggagacgagtgactctttctcaaaaaaaaaaaaattcaataacacacatatatacccaatagataactcttcattttaagctaaccagtggttggactcacagtctggccccaacttacctttgcagtttgatcactcaacaataagactcagttctagcctcactatactatgtgacacttttacattggccactcactttaaggcctattctttgtgttcaagctgtttcttctttttttttcttccctaactgggcaattacttatctttcaaggactaggttagatgtgacttgtaagttttcaccaatcttttgttcatactactactgggttacctcatactgtagatactatcttcttatgccatggtaagcgttccttaagggaatatagcacaaaagttaagggcacagtttctagatccagactgcctgaggtcacatcctggtttagctactgactagctgtgttacctagggcaagtaacttcatctctctgtctgccttgggtaagtaacttaacctttctgtgtctgagctgtgttgccttgggcaagcaacttaacctttctatgcttccattatctcatctgtaaaatcgcatttacttcatagagttgtattattatttttatttttagagatggagcctcgctttgttgcccaggctggagtgcaatggtgccatctcagctcactgcaatctccatctcctgggttcaagcgattcttctgcctcagcctctggagtagctgggattacaggcatgcgccaccacgcccagctaatttttgtatttagtgtagagacagggtttcatcatgttggccaggctggtcttgaactcttgacctgaggtgatctgcctgcctcggcctcccaaatgagccactgcgcccagccttcatagagttgtattaatcttcctaaatgggtaagaaagggttcagaacagtttctgacacacagttaaatattcaacaaatgctaatttataaggttaggactctctttttgagacagggtctcactctgtcacccaggctggagtgcagcggcacaatcatggcttactgcagcctctacctcctggactcaagcaatcctctggcttcagcctcctgagtagctggaacaacagatgagcacaaccatgcccagctaatttttattttttgtagagaccggattgccatgttgcccaggctggtctcaaacctctgggctcaaacaatcctcctgccttagcctcccaaaatgctgagattacaggaatgagtcactgcactcagcccaggactatttgttttcatattcctcctcacacccagtttagtgtctggcatgtagatgctcagtgaatgattgatttgggtagttttggttctttatacgggtcttcaggttagtcccaatgtactggcatggagctagttacttgagcaggtcttcacaaaggtctgagtagcaggtgataaaaggggttgtgaagtctggactcctaacttaagtggtggagatgctaaaagagaaacaaaggcagcagagttgctgagggtagggagtatggcatttattaaccctgtgtttcccccgtcactggtcactgctcttgactcgtagaacaacaggtacagaactgcaagggatcatccccagctccgtgatcaccagatccacaagctctgggggagtcacatcatagactagattcaacaaccgtagggatgcgtggttctgccagttagccagcgcaacatgttctccccgcttacattgcagatcatcagggtcatctgcaatggaaggcgtacccattatgttctttcagaaaagaagttctagtttatccgcccctctccctccctctcaagtcttcacaggtagctggaggcttctcttttgcctccttacctagctcattagagacaaaggcatcagtctgcacacgctcacagaacttgtatgtttcacagcaaaccagcactggtacattatgggctcgagccaccagggctaactgtgctgtccctacccgtgacatcacagacccgttggccaagagtgcatgagctcccaatagcaccttggaaacctgtttcacaggagaagaggaagaaaaaaatgtcattgttgtatcaatgcaaaataaggtcccctacttacaggacagcaacattaagacaagtaataaatctcaacacctgtgaaaagaagggaaagaaacaaaaacagacaacaagtaataaatcttttttttttttttctttgagatgaagttctgctcttgttgcccaggctggagtgcaatggcgcgatctcggctcaccacaacctctgcctcctgggttcaagtgattctcctgcctcagcctcccgagtagctgggattacaggcatgcaccaccactcccagctgatttgttgtatttttatatttttagtagagacggggtttctccacgttggtcaggctggtctcgaactcccaacctcaggtgatctgcccgcctcagccacccaaagtgccaggataacaggcgtgagccactgagtccggcaattaataaatcctttttttttttttttttgagatggagtctcgctctgtcgcccaggctggagtgcagtggcatgatctcggctcactgcaagctctgcctcctgggttcacgccattctcctgactcagcctccagattagctgggactacaggcgcccaccaccacgcccggctaattttttgtatttttagtagagacggggtttcactgtgttagccaggatgattgtgaactcctgacctcgtgaactgccctcctcggcctcccaaagtgctggaattacaggcttgagccactgtgcccggcctaataaatcttaatgatggcttttcttctgtgaaaacacctgaccactgacccaccaaatctcccacaggaaaagtaaactttgaagttacttttgtcttgttccctcttcctggttgctagtttaatgtaatgtttttgcaatagctagactgctgtaatatactgtcagtgtttttccaattaaatagaaacagagctatataattattttttttgacacagggtttcattctgtcacccaggctggagtgcagtggtgcaatgacagctcactgtagcctcaacctcctgggctcaagcagtcctctcacctcagcctcctaagtagctggaactacatgcgcatgccaccatgcccgggtgtgtgtgtgtgtgtgtgtgttcaagcagtcctctcacctcagcctcctaagtagctgtgtgtgtgtgtgtgtgtgtgcgtgcgcgcgcgcacgcactcaagcagtcctctcacctcagcctaagtagctggaactacatgcgcatgccaccatgcccggggtgggggtggggtggggtgtgtgtgtgtgtgtgtgtgtgtgtgtgtgtgtgtgtgtgtgtgtacagggtctcattatgttgagcaggctggtcttgaactcctgggctcaagtgatcctcctgccttagtgctgagattgcaggcattgagccatggcaccaagccagggctatataattctaatatttttaaataattgtggctgggcacagtggctcatgcctatgatcccagtactttgggaggccgagacagggggaactgcttgagcccaggagttccagcctgggcaatgtagcgatatcccatctctacaagaaaaataaaaaactagctgggcatggtggcacacaccagtagtcccagctactcagaggcggaggtgg

SEQ ID NO: 334 - DNA, 755 bp, Homo Sapiens
acctatctgctctctggcctgcgtcagtggtctacagcagttacacacaggcagtggtatctgtgagcagctctgtggactcaaaggttttctccctgagaggcatgacccaggccagctgattcatcagaatcagatgagacgtctggggtcagagaggcagtaaccggcctgggaatccggacatgaccctgagttttgctctcagccctgccgtgtgctgtgctggaattcaggcctgaaccctgtgacctccctgccctagatcccaaatctgcccaggtttcccatcccgatggggcagagcctggtcctggcagagccactggtatagagccactggtacagatccactgacggtcctcagaacacctctgtgccctaagctgggtcctgatggtcgctgtgggccccactgaacacacatggtcccttgtccgggggagcctgctgcccttgggcagctgtggaaaatgaaggagccctggagggctggctgaggggagactatcttcccttgtgttcaaaggggtccgggcactagggttctccccaggtatttcttgctctgcgtggtcctcttgaggccttgccctccttttgcctcgagtattcccaggagggacggtccatccagctgttctccaggaccaaggacccactgttcttcctcagtgacccaggaaaatgaagcctcctcctgttgggacggctcagaatggtggactccacagtccctccgcgagagacgtggt

SEQ ID NO: 335 - DNA, 2317 bp, Homo Sapiens
cctaattaggagtcactgaaaacagctgtgcttttgtaaagccctgcaaactgaagctagacaacttaaacttcagaagaaaataacagcaacctatttacacgcataagccactttcatacctgcctactgatgtatggacttcagaataacgtggcctatgtatattttccaggattgttcttttgtttgttgtttttcacccttcctccccctattttctcttcacaagacatgggagttcacagccttctaaaaattagctttcctaataacttgggacttacctgtctaggaataaaccatcctagcatgagcgatcagatgaaatctgggaccaaagactcatttttcttctaaaatgctttctccaaaaaaaaattttttttaaaaaaaagaaaaggaaaattcaagctaggaactacttaagacaaacttgcctcccattctattcaaagtcatccctctgctcattgagataaatgtgtatctgactgcctccttaggaaaggtaaatcagaaactcaaaagaatgcaaccatttgtctcccacctacccgtgacctggaagcccccttcccgcttcaagttgtcccgcctttccgaacccaaccagtgttcattttacatatattgattgatgtcttatatgtccctaaaacgcataaaaccaagctgtgctctgaccaccttgggcacatgttgtcaggacctcctgaggctgtgtcactgcgtgcgcatcctcaaccttggcaaaataaactttctaaattaactgatacctgtctcaaatttttggggttcacaaggtttagttataaatgcttcttatggagcatgattttcttacaagcgaggcaggagaatcggatctggaggcagggaacctagggctgtttcacgctgacttcctagaactaaattgaaagtaaaaccctaacttcccacaccaagtaacaaaagaaccagaggcttctccctttccaaacccccaccttttctgtgtggcagatgggaaattgaaagtacctctgattggttgcaaaaagcaaaattacgctaagaagtaagttatcccttaaaaaaaattattctttctgcaaccaatcagatcttcccataggagtgtaactatgtaacttcaccatctgattgcacgccacgtcttcgtttgcatataagggcaactttgtaacttcactttagcctttcattggttgcttttcacagccaattgtgggtcaccacttcatttacatgagatgagtaccaagtggccaataggagacttcaatggggtattagggcccctgagctgctgctccacaccccaaacacaggagtgtcctttcattttcagtaaatccctgcttttggcggggcatggtggctcatgcctgtaatcccagcacttcgggaggccaaggcaggtggatcacctgaggtcagcagtttgagaccagcctgaccaacatgatgaaaccctgtctctaataaaaataaagaattagccaggcttggtggcgcatgcctgtaatcatcccagctacttggaaggctgaggcatgagaatcacttgaacccaggaggcggaggttgcagtgagccgagatcgtgtcactgcactcccgcatgggcaacagagcaagactccatctcaaaacaacaacaacaacaaacaccttcaaggtctggcgtggcggctcacaccagtaatcccagcactttgggaggcggaggcaggcgtttcacctgaggtcgggagttcgagagcagcctgaccaacatggagaaaccctgtctctactaaaagtacaatattagctgggcatggtggcgcatgcctgtaatcccagccactcgggaggctgagtgaggcaggagaattgtttgaaccagggaggtggaggttgcagtgagccgagatcgcgccattgcactccagcctaggcaacaagggcgaaacctcatcctaaaaaaacaaaaacaaacaaacaccttcgggctttgtgagtgctggtctcagaaaagcactcagtcttcctccaagggctaacttacttcttcaggagttgggtgcctttgagaaatttcccaaaccactacagaggaacaacttctcccttcgttcaccactctaccaagcacttggcttttgtaccttattgcaattatttatcttctaatcttctagagcctagagaattagactgtaatgtgccttaaatgcagaggtttctcttactcttctctggagcaatgcagacgtttgttggttgaaggatcaaactccaaagtccctcccagccttggaact

SEQ ID NO: 336 - DNA, 3210 bp, Homo Sapiens
agtggcagctcgctgggggacccaaacgctgtgctcgccgggcacatggagcgacagcctagaccgagctgccgcttcgatcactgccccctgcacccgccgtggccatcccggagccccggtggaagcaacgccgcgggcaagtaccgagcctctcggggtctcccttccctggggaacgaggcgtgtggggggagggacagaaccaagaaagaatttttccccctacggtgaatttgggggaggtaaaataaaaataaaataaaataaaaataaaccataaaaataaaaggaagccaggcacttagaggagggttcaaaggaggtggggcagtattagcatgtaaaaggatgtgcccgcctactctccccagtcacacaagattgtcatgcgagctgaagggggctgaaattattccctctgaagaagaagaagaagaagaaaacatactgcagctcccgatttgaaacatcatatttgaaaacaaggtggggccttcatcatatgcaaccttcatattttagggcctgcctctttctattccttgacataaaccggactcttcatgctaatcaggctggaagtgtatcataaggatgctgaagctaaaaacaatgtccaaggccaaataactgacaagaagaaggccaaggcatctagaaaccatgtcttctgattcacagttgatcatatttttctatcacctttgataaggcataaaatattattttgatgagtaaataaaaagactttggacacctgctgtttgtctaatttatggtttccttctcttttctctagttgatatgactatattaagccaagaaaaaagttagatttgacaaacggattttaacaattttatgcacagaatattttttaaagttatttttacgagtctacagttttacaagtttaatgacatgttcagagggactagaaaatttacaaataacatgatttataaaatccatgatttcccaggaatatttttgccaccacatgggggtgtagtgttcttaatatgtactttgcaggaattctgagcatctcagctgagcaagcctggggagcagcagggagaactggattttatgtgcaagtttgtcttatctgcaccaagcatgaggccaggaataggagtcgatcttaattcatcctccaagtgtctcaaatataaaattggctttgtgatattaatttgtttaaattgttcaatctcaggaaaaacttcacagtatgtatgagttacccacatacagcagcaatttcaacaaaagcagccatattagtatgtgccatgctatattctccagtccaagaaggttattagaaaattgtttaattgaggccaggcgccatgactcacgcctgtattcctagcactttgaggccgaggcgggcggatcacgaggtcaggagatcaagaccatcctggctaacactgtgaaaccccgtctctactaaaaaaatacgaaaaactagccgggtgtggtggcgggcgcctgtagtcccagctacgcaggaggctgaggcaggagaatggcgtgaagggcgcttgcagtgagcggagatgcaccactgcactccaccctgggagacagagtgagactccgtctaaaaaataattgcttaattgagaaaaagttgcttttgtcgctggaattactgtgagataattgaccgtgatgggagctgtgtcccccagatgaaagcaaatcatgggagccagggtcaatcatattaatgtctgcagtgaaaagaggtgttgtgatcatcataagacataaccataaaatacttaaagtcttaaatggccaaagcctttaaactacattataatgattacagatccaataaagtttaattaaaacaaaactactacattgaacatccataatgattagaaaggtttctaattggggacaaatttggtattgagaacacatcaaaagaatttcccacgttctttgttacatctgtttgtgctggttttctgcttctgcatctgtacagggcacatttctaaaaaactgaccagtttaaaaattactttttaagtttataatgctcattttaggtaagtcattaactctttccataatttaggtgatcatttaatgttttagggattgggaagcacagcttacttttagttaaaaaaaaaaagcaaaaaaaaaaaagcatgagctttggaatcaggcagcctggggattctaggctagaattctaggtttctcatgtactaattgtgcaatttaactgcataatctctctgtgtccatagggtcctcaaagaaaataataggaaattatggataggaaataggaataataggaaagatggaattccaaagataatgtaataaagggaggtatgataggttaggggaattaacaaggaataatgaagcactccggaacccagcagcagcagcagcagcagcagcagcagcaagaaacctttactatccctaaggattagggcaagagagaagaaatagggagttacagtctgatgagaagaggagccttggaagaagtgttgactgacaggagctacggttatggagtgaccaaccccagtcactactatggcagaaaataaataccctggtatttttcttctcttctcttctgatctcttgcaggaatcaccctttggccaaacccaattagacaaccagaaacaagtcagcaaaaaaaaaaaaaaaaactctgggtggtgcagtcaatagtggtaagccctctaggcactgaaaaaaggccagagatgagcagaggaattgttctgtgttaggggggatgaaagtagaaaaaagcaatttacgctctttgtttctttttcctcatcttttcttttctttctttcttttatgaggcagagcctagctgtgtcaccaggctggagtacagaggcgcgatctcggctcactgcaacctccacctcccgggttcaagcgattctcctccctcagccacctaagtagctgggacaacaggcacgtaccaccacacctggctaattttttgtatttttggtagagacgggtttcacagtgttagccaggattgcctcaatctcctgaccctcgtgatctgcccgcctcggcctcccaaagttctgtgtttactggcataagccacagcgcccggccctttttccttgtttctaagtggagatatgaatcaactcttgtccaacaaaa

SEQ ID NO: 337 - DNA, 1806 bp, Homo Sapiens
ctaccgcggtcgctgttggtggcgccgccgggcctgcgactaggtggcatccttcagacactataggccgtctctgcacacgtgatgcggggctcggtcacgttgccccctggaagcttgaggatgcgccaggtttgactctgcagggcgtacgcgctttagggatggaaggaagaggaacgcggcaggaaggcgagccccaaggtggagaatcgcctgggcgcgcaggctgcggcggcttcgcacagccgccctgggcgctgcacgggtccgcgcgcaccctgctgcgcacccactcgcggccagctccctacagaggagtggagtgactgctcgactaccacccctcttttagtgtgagcgtctggagtcctgaccgccccagccagcccagctacgatgaactgtctaagaggatgtggcaagacccagaagtatgggtgaccttatgtcagaggaagtggctttcttattgcagcaaaaattcccgtaccaatgtcagtgctaggatggagtttcactgtgtcacccaggctggagtgcagtggcacgatctcagctcaatgcaacctctgtctcctgggttcaagcaaatctcctgcctcagcctcttgagtagcctgagtagctgggactaaagtatgaaagttttcaagacgcctacaagtggaaaatgcactcctcccagccaaatcaagcttcgccagattccttacagctgtgtgcagtgaaatgactaatgaaagagccctctgctgctggtggaactttcacatatggcactgttatgccactcagcaggacccgaccctggtatttacatattggatgtcaccccaaaagcccctgaccagggggtttccgggatgtaataagaatgccactctgggctttggaaggtgcaccgtatgcacacccatactatagggcaggggttagcatttcagacccctgttcctcccttgacaagcaagtgcttttctccagggaagacgttcaggttcattcatagatccattggtgccgtgggcagctcagtaacaatagctctgctgcctaccagctgctggtggaggtgttgagaatacctaatgaggaagtcagggcccctgcgtgcttcagcagagctggatgcctggcatggcaatcaatggacacaaacctttggataatttccgtccttggcggtgtgttctatagcataggtatgaagtgggtgctctgggagctcagaagaggggctcttctcttaacttatgggtggccagggaaggcttcctggagctcaaatgactgagtggagtcttcaacattaaaaaaaaaaaaaagaaaaaaaaagtgcttccctcccacccccagttaaaaaggtaatacacctcattgaaataatttaaactttacagaaatgtgttcctttaaagttcagagagtaaagaggaagtaataaagctgaaatagtagaatttctaattaactggagcctgtagctttcttcctgaaaagggagtggtgtgtgtgcatgtgtgagtgtgtgtaggtgaatctgtaaaggatggagtagtactaaaaagagggaggtgaagacggaggtgagatctcatctttgtgccctgaacctctttgttataatgtcaggcaatgagagaaatcagtactcaccctctatgggactctggctttttcaaacttggttttctaggttttggtcttggttattgatggcttgtaacttcagagtctcattgctggccacgcttccacgtggtttattaagatgttttcctaaacaaaattgatctctcccta

SEQ ID NO: 338 - DNA, 10095 bp, Homo Sapiens
ggtgtgcgcccccggcgctggagcagccgcgtttcggggacccgggcaggcgtggggggctgcgctgagctccaggcctcctgcaggtagggatgctttgctgacagattcgggcgtcctcccctgaacgaatgtcctggcggggcgtgcccagccaccatccagcttcagaggcaatggccgggcgtcgtgagaaggggagggagaaggaagcggaagagagagagttggaaagactagaggaagaggtggccacgtcttttgccatcccagctttaaactgcagtgtttaaggcctcgtctgccctgctaaggtcaccgaactttttactttatgtgaaaagtgcttcccaagggaggcacagggactccggttctgaaaccgattaatggtcttagagcccccagtaagccgttaccaaagtgtccgggtcacagttgcagaggaagtgagaagcgtgttcgacctcatttgaaacggcttcacagagggtaaacctcaagttgattttgtaaaaaggaaagcctgtggtttggccgagaagaataaataatatattctagatccacgtgtagtgacttggtttgggaaaaaagaatccacagggagaggaacagcgcagagggttctgtggtctatcgcccaggctggcttgcagagaacggaattcaatctagttagtttaagcagaaagggatttgcggcaggatattaagtggtttacagactctttgggaagactgaaggatcagattccagactgatcttttaagaacacgacccaaagccaccctgaagaactaaagaatctaatgcccctcctcgaattcagcagacaccagtggcgtagggaaacggtggccacagctgctagccccagaaccatgccacctgcccgggtcggaaaccaccatgacaggcaattgatatagtcaagaaactcccccaagccgaaagctactgctagtgctgccaactctaaaaccgtgacacccctggcataacccacaccagcaaataggttccctgggcagtgctttttaatactccacaaagccagtaagtagacactgagacctctcctcccgctttcagagcgaaaccaggtaccttcacaatggtgcttgtcagcagaatattagaaacatgccttcctaatctcgcactaattctcctgaatagtggaatctaaatcaccgtagaaccctagatgcaagggagttggggaaatatagtaaaaactccagcgtcccagctcctacaatacatgaaggcatgctaggatgatgtcagcatggttgctggtgactcaatccgcagttcccatcacagtcctccacctggttactcaactcccatgcactcctctcttctcatacgtacacttccaaatggcaatgattccccctgcagtaaaacatggaactcactttcttcccaaaatggggaagtgccatgagccactgcatcctgctgtcacggaggttctatgttctagattctgtcctggtgttcattcgagttcagtcataatcctcccttgatatcttataacccgtagacctaattataaagtcacatcttatataaaacacatccaatataaaatgttaagggaaacggggaggacaaatataaattgactaggatagagaaaagaaggaaaacaatgctattacagtcctcatttttccaaggcttgtgagtctgaggttggactgttgagcatccttgctttatcctggcatgtatttcctttcaccatatccggcgcctctgctggttagtgctctttatctagtggagcaatctaagtcttttttcctgagaggtcctatttctgtgtggtctttcttgtattgagatgctgtagtcttccaccaactctgtgattggacatacagccttgcctatgattttccttgaggggttctgcagtggcatattctggcagtggtatgttcagtcttacatttttaaaataagacctaacattttaaaataagacaccatcgtatcctgattggctatggatgcttccagcactattagatctgttacggatccaagtggtggtaaagctgcttgcacatggcctgaaatttttgtttttgttttttaagacagtctctctctgtcacccaggctggagtggcacagtggtgcaaccatacctcactgcagccttcaactcctggggctcaagaaatcctcttgcctcagcatcctgagaagctaggactataggtgtatgccaccatgcacccagctaattaaaaaaaattttttttgagacagagtcatggtttttttttgcccaggcttgtcttgaacttctgggttcaagcgatcctactgccttggccctcacaaagtgctgggattataggcatgagctaccatgcctggcctgccctgggattttctcaaagctggcagactaatgggttattcagaatatgggtcagagctgcacacacacccacatacacacacacacacacacacacacacacacagtacatattggttccccaatccagagtcgtatcaagtgctatagctctttattagcagtagggggtgcaagattcagagagatatcccatcgctcaccagatcactgggcacagcaattctgctgagagagcaggttcttgaattcttgtgacacaacattccactctttggcacacatgtaggcacataatgtacttgtttccgctcactaggtgcaataagaatcgtattactaatgtggtgtcctctggaatggtcacatgaacacagttccctgcagatgtaattgggagagaaggcacagtcctgacacagggtaagactgtggaggtgtattgctgtccctaccaggtaaaataatattgcttctggtggttttattgggaaagagacaacacatttaccaaactgatagctgcatattgggtgctgggggctgtgttgatttgctacagtcataaaactatgtctagaacaaaagctgcaatggaagccatctattgactaaattaacagtgaacccttattatcctccaacagccatatgtgttctacataggtgaagcaggggagttaagtggccgtaataggaaatgtcatctctacatcttttttgtttgtttgttttgtttttttttttagacagagtcttactctgtcgcccaggctggggggcagtggcgtgatcttggctcactacaagctctgcctcctgggttcatcccattctcctcctcagcctcccgagtagctggaactacaagtgcccgccaccaagcccggctaattttttgtatttttagtagagacagggtttcactgtgttagccaggatggtcttgatctcctgacctcatgatccacctgcctcggcctcccaaagtgctgggattacaggcatgagccaccacgcccggccatctctacatctttcaagtctttggcagttcattcagggatgtgatgttgcttttgataactcttgataggaagaagtggttccagggttttccacttgctccttcttacctaaatagtcctcacttcctgggccagggatgagtgtggggattctgtagctgggtgtttctgcatacattcatagagtttctgcatagagagtgctctgcattcagaaacccaggaaatgctacaggataagtttatagacctacaaggtacatcatgagaagcacgtgagccaaaactccacttatcacttgactcctataaccccaactctgaaagcagagttcaagcaactgttgcgtcacctcttgctacagagcaccagggtcccaccttctgatgtgaatgagacctcctgtgcttcaagcccagccaagtcagataacttagtggtcttcaaatttttttctgcatacactcctgaagacaatttagaaaaaatttagaaaaataatgtacccttcacccactttttttttttctgagatggagtctcactttgttgccaggatagagtgcagtggcaggatcttggcttactgcaacctctgcctcctgggttcgagcaattcccctgcctcagcctcccaagtagctgggactacaggcatgcgccaccactcctggctaatttttgtatttttagtagagacagcgtttcaccatgttggccaggatgatctcaatctcctgacctcaccttcacccactttttaacttgacatctcaccttttcctgataagtgtaaatagttgaaatggatcacagaacattagaagtttaaaaaaagctaacatgacaaaacctaagaaagagatctttttattgaagatctgcctgattcatctctattatgtttttacgtagactggcttctggttgtgtacatttccaaccttatttcttctctactgtccacacattcatggtgctggtcaccacagaaaatgaatatcacagcatgacttctggtcctcaggaccgtgggcagagggagtatttctagaaatcatttttacactagaggggctagcaataacataatcatatgtggaagttactgcaccagtaaatacatcctctgaaaccccaactaacttgtttatcccaattcaattagtggactttcaaaagcacccatggccactgcaatgccaccacacatggggagaagaaagacaaaggggagtgtaaaaagaggtattaatccttaaggttgaaaggtcttactcttgtaaattttactaaaatatgtgacccagaagagccatttctaggccttgggggtggcctgtgctagtgaaagcctctgaagattggggtttgttagctacggggtgaatctaccgctgcactgtcaatagggacattatgataaaaatgtcatgtaactttgtgaaaagtatccatggagcctaaacactataatgacatgctatccatcatcatttactttgaaatatttgaacaatctctttaattttcgaaaatttttcaaaattttgaaaatttgtctttttactcttgaacatataaagttccatttcactttcttcttaggattccttcataatgtaatgtgtgtgtgtgtgtgtgtgtatgtatatatatatttttagacagggtctcactctgttgctccagctgaagtacgtagtgcaatcacagctcactgcagctttgaactcctgggcttaagccatcctcccacctcagcctcctgaccagctggggttacagacatgtgccaccacacccagctaattgctttttcatttcttttgtagagatagagggtctcactgtgtttcccacgctggtctcgaactcctggtctcaaacagtcctcccatctcagcctcccaaagtgctgtgattataggtgtgagccactgtgcccagcctaatgtatatttttaacagctttattaagatataatttatctattgtacaattcacataagtaaagtgtgctattgaatggcttttaatatattcacagacttttacatcgtgaccacaatatatgttagaacatttttatttcaaaagaagccctacacccctcagctatcaccccggcaattgttccatctccctcaaccccacccagttctaggtcaccattaattcactttctgtctctatggagttgctcactccaagcatttatatgtaaatggaatcatgcagtatgctatcctttgagactggcttccttcagttacaaggttcatcctatacttacgcttgaaacatttattaatcacccttttctgcaaccaaaaatgtatgtgaatcgaaattgtaaagtgttctttatttcctgccaccaaaagactttaggaatttaaagtattttctgggtcatgattacaatggttgttatcatgcaacttatgaaaacaacataaatgttataaacgttgctaaaaaaattgtgttaattcaaagagtgaaattttattggaaatgtctcacttacatgatgagtttttaaaattttctctgtctttctctctctcgggatctcactttgctgcccagcctggagtgcagtagtgtaatctcggctcactgcagcctcaaacttctgggctcgagcgatcctctcacctcagcctcctgagtagctgggactacaggagttcgagagcaacctgaccaacatgtgaaaccccgtctctgctaaaaatacaaaattagctgggtgtggtggtgcacgcctgtaatcccagctattcgggaagctgaggcaggagaattgcttgaacctgggaggtggaggttgcagtgagccgagatcacgccattgcactccagcctgggcaacaagagtgaaattccatctcgaaaaaaaaaaaaaaaaaatgagccgggcttggtggtgcacgcctgtagtcctggctacttgggaggctgatgcgggaggatcgctcccagtccaggaggttgaggctaccttgagctatgcttgcaccactatactctagcctgggccacagagtgagacttggtctctaaaaaaacaaaaattaattaattaaaaataaaataagataaaaaattaaaaacaaagaccataaatgccatgagttatgtttgttttttctaaaattttattcccagcatagggaataaatgcagaagaggtgcttcataaatatgtactgaattaacagataaaacgagggttcataataagaacctagactccttggagggtccatgagaaggtttttctttgtgtctgcgtgacaaattgtcagtcccaggatggtgccagaagtaaagttgggtcattggagggtgactttgacaacgtctgacatctgcagagaagaggcagatgtttcgatcacctagccgacactgttcatgacgtcaaaggccacggtggctttacagctacaatctcaacagcaacaagaatttaatgagggccgattatgtgcaagatactatagtaagtgcttaatattcattatctcatgtaatccttacaataggccttggggtagcttttattattcctatttataagtgagtaaacgttgtctcaggtaggtaagtgaccaacccaaggtccttggattagagcctagttgaattttcacttgagccatttactctggccacagaataggaacattggaaggaaatccagaggacttggtgatatggtttggatctatgtccccacccaaatctcatgctcaattgtaatccccaatattggaggtggggcctggtgggtggtgattggatcacagggctggtttctcatggtttagcatttggtactgtatagtgagtgagttctcatgaggtctggttgtttaacagtgtatggcatttccccctccttcttcctcctgctctggccatgtgaggtgtctgcttgccctttgccttccaccatgtctgtaggcttcctgaggactctccagaagccaagcagatgctggcaccatgcttcctgtacagtctgcagaactgtgagccaattaaatcccttttctttataaattgcctagtctcaggtatttctttataacagtgtgagaacagactaatatgcttgggctctggacccagctctgctgctgcctgccctggcttggtggacgtcgccagcctctctcctgccctgcccacaaagagaagtgtacttcccagccactgctcggggacagtcacgcggccaactctgcccaacaggcagtgagtggagatgacttgtgctctgtgtgggtgaagcactttgatcgctggtcgcctccttttctctcaccgtgagacggaggagacacgtgttcgccagcctcccagatgagaaggccgtgtgctttgatgctgtggctgtaagatgaaagagcctccatcctaggtcccaaacagggctgtagagcagaattttgtgcaactcatgttggataccatgtgagcaagagcacacgtgtatgttgaggcactgggattttaggattgtttgtcaacataggtaacccaggttattgtgactaatgcatttgatccactcttgttaatcctctaagtatcggttttgccatctgtaactgatgataataatatctatcagccagctatctgggggctgttaaaagagataagggaggaaatggttccctccaggtctaacattctccagaaccatctagcttagtgaaatggcatgctctaaaaatagagttttcttcatgaccattgtattatgtgcttaaggtcttaagatctgaccctctgtattcgcagatttgatgacaaagagccggaactagagatgtccagggcttcctgtggctttgggttgggatttttccaagcttctgtcagaggtcaattctgttattttgagaaaggtgttgcagtgagccttgtttttgtctctccctacccttgtaatgcaaaatatgggaggtatagaccattcccaaagctgccctgtgggttattaaatagtgactgcagtcagggctggtgtggaagacatttcgcaagctccctaatatttttattctccccttcttggacataacggaggattacatttctccaacttcccagagccttgctttggctaatgagatgggagtggcagggacacaggtcacttttgggtggaggcatggaagagctgctgggagacttctatgttctctctacccacagcagtgaacttgaagactgtctggggagatggccatgacctcagatggtgaaactctgtcagccgaagtctctgactggctgaggtgagcagagcacccttctgcagaacagctgtggacatgtggtgtaggcaggaagtcaaccattgttgttttgagccatggagatttggccattggttcctattgcagaataaattagtttgaactggctaattccattaggactgagacaaaatagcaatattagacctctggactgggaggcagcagtcttggattttaggtctcactgggggaaccatggacttggtctccctgggcttcagcttcctcatcagtacataaagggaaatgaactacattttctctcaatcatctgatgattctaatagtttctctatttgtctctctctctctctcttactcttttcctctccttctctcatccatccactcacccttccacctatccatccatccgtccatccatccatccacccatccactcatccatccacccatccactcatccatacacccatccactcatccatccatccacccacccatccactcacccatccatccacccacccacccatccatccatccacccattcatctacccacccatccgttcacccatgtactcatccatccatccatccacccaccagtccactcatccatccaccgacccacccatccatctacctatccactcatccatccactcttccacccacccatcagtttattcttctatttacccatccttccattcacccatccacacacccatcaatccctctatctctttatttattcatccatccttattctaaagaccaaagcaagtgactgaatcatgatattttcacaaaattcaactaatattttacttaattaacatcgtatgcaaaagttaccttaaaagaagaaagcaaacttatcatgaacttttccttagatgacattatttctgagaggaagaagaatccaacattttcattgtgagaaaaccttttgtttctaaggtgggccttgcttcattttgtttgcacatagaaagaataaggagctcttgagttggggtcagacagctggaaaagatatttaatcaaacatattctaatcaaaatagttttgcttcccttcttacatcaatttactgactcaaaaataaacttcctcttattgaaacttgattcctgacagatggagaaaaaggggtaggaacctggagaaaagatcacaactgagtgacttggcaacctcgtggtgagagtctccatccaaaagggcaagcaggcaagaaaatgagaataagatttacaggagaaatttatatcatgaaagcaaagattggtgcaaacccacgtgtataacactttaaggaatctggcaa

SEQ ID NO: 339 - DNA, 4602 bp, Homo Sapiens
gcaaacttcttggcttgtgctcggacccttttctcgtactccactctgttttggctgaggaggtcaaaagagaagagacgtgttagagggctgagctgcctggccctcacgctcgccccggagccagctgggcagaccaggctgcaggatgggacctcctgggggagggcagtgtggagctcgtcatagtaacagaagcagaagcccggagaagcagggaggcctgcgtggtggggagcccatgctggctctgacgtggctgagactgtcccgtggtctgacgggggcagaagggcagggaggagaggaacccacgctgggtgaacgtggtgttcaagggggacagaggggtcccgcagggctgcgaggagggctcaggcccagagggcccacgccagggcctgcaacatcgttgccgatgccaagtctggtcctaactagtaatcagcagcttctcttttctgtaggtctggggacagtcctaataaactgaaaacactgactgcttgccactgtttttgttaattcccaaaaatagacaccaatttctggagggtttttccatgaggctctcagccgcaggggcaaaggtgtgggaaggcaggcctggttgagaaggcgttgtgcccgagctgggcagtgcaggggcatcagcgaacaggtctggagctgggtagagtgaggctcagcctgcaagcagctgcccaggagagtggcatggcacacactgcccgggcaaaacaggtgggcgggagggcggccgaggctgcacctaggggctgatgggtcacagggtgcagtgtgaccctgaggatgggggaacaccatgacatttatggaggtggctcctggggtcgcagtcctgccagtctcgccaggattggacctggtctgagacactgagcctcactctgcatggtggaacagcccaggacggcagcagcgccggtgccacccccacccacgccaagggcctggaccgcagcccagaccccagcgccctccttgggccaccagccggccccagggcagagcagctcagctgggtgggcgtggaaggaaccagaggcggtggctacacgtcccagctcttccttgaccaagcagaggccccgagaaaaggcacctgccagggcaggaacacggtccaaggcctccaggaaacccaggaaaaacgatctgaaacccgcacacatgcttcacaaagggtgcttttcaagcggatgtgtgtaggagaaagaacgtttgtttacgtgcacgcaagtgtacagtgcagcccagcaggcaccaagcccaggagacgctggggagagtcacacggggcgggggactgcaaccctgcccagcccacgccgcagatgggagccacagcccagctctggagatggtcggcaaatggggtgcaggccagacagagctcacgcccacaccatgctggggatggcagaccatctaagggctaggcaggaaaacatttgccttttgttttgtttttttgagacagagtctggctctgttgcccaggctggagtgcagtggcgtgatctcggctcactgtaagctccgcctcccaggttcaagccattctcctgcctcagcctcccgagtagctggggttacaggtgtgcgccaccacgcccggctaattttttttatttttactagagatggggtttcaccgtgttagccaggatggtctcaatctcctgacctcgtgatctgcccaccttggcctcccaaagtgctgggattacaggcgtgagccaccgcgcccggcatgcttttttttttttttttgagacagggtctcactttgtcacccaggctgcaatcttggctcactgcagcatcaaccacctgggctcaagcagtcctcccacctcagcctcccaaatagctgggactacaggcatgcaccatcatccccggcttaattttttttttttttttttttttaaagagagcaggtcttgccatgtggcccaggctggtctccaactcctgggctcaggtaacgtcccacagtggccttgcaaagtgctgggattacaggcatgagccaccacccctggcaaattttttaattttttgtagagatagggtctcgctatgttgcccagtctagtcatgaactcctgagttcaagcaatcagcccaccttggcctcccaaagtgttgagattacaggtgttgggccaccacacttggcctagaaatcattttccaggcacggtggctcatgcctataatcccggcactttgggaggcgaggcgggtggatcacctgaggtcagaagttcgagaccagcctggccaacgtggtgaaacactgtctttactaaaaatacaaaaattagtcaggtgtggtggtgggtgcctgtaatcccagctacttgggaggctgaggcaggagaatcacttgaacccaggaggcagaggttgtagtgagctgagatcacaccactgcactccagcctgggcgacagagtgagactctgtttaaaaaaaaaaaaaaaaaaaaaaaagaaaacattttctgcctcaagggccatgtggacacccacgagcactgtggcttcctgtccaagggaatgcatttcacggactcctagggcacagcaggccagcacacaaacccaggtcacgccacgtcccacgagccacttccagcaatggcttggctgactgagcggctatgagtttttttttttttttgagacagggtctcgctttgtcaagcaggctggattgcggtgctgcaatctcaactcactgcgcatcaacctcctgggctcaagcagtcctcccacctcagcctcccaaatagctgggactacaggtgtgcaccaccatgcaggggagccaggctgagcctggggtggctgctgtgatacttgctccctgcctggggcctctgtgccaccctcggccaccagggagggcaccttgcagacacctgggctgggcccgcatccagggagaaacacatctctccaaaaccacgtgctttttttttttttgagacagcattcctccgtcgccaggctggagagcagtggcaggatctcggctcactgcaacttccgcctcccgggttcaagtgattctcctgtctcagcctcccaggtagctgggattagaggcacccaccactacgcccaactaattttttgtatttttagtagggacgagggtttcgccatgttggccaggctggtctcgaactcctgaccgcatgattcacccacctcggcctcccaaagtgctgggattacaagcgtgagccactgcgcccggccgaaaccaggtgcttttcctcacgacctgtgcaggccgggcctaaggcaaccgggacccctcagcctcccccctcctgaccaggagatgcaccctggagggagagggcctctgatgcccacagtggcagggatgtgtggggtggctgcaggtgagccttctgggtccctggccattgggggccctgagaccccctcagaggtgtggggacccgtggtgagatggggctgggtttctcaacgctgcaggcggagcagtggggggtcggaggccccaacccaccttcttatggacctgcccagaacagctgcagagggaacaggacaggcgggcgcatggcctctgctcagggcagggtcctccctgctttccccagcactgtttggctgtcgtctgcatcctaactcacaccaggccctcctcggtgcagacaggaccccaggcccacggggacccttctagccacagcagcacctcacagggacagggtggaagcccagggtccgtgtgacagcatcacgtcactgagccctgctgggctgggcccccccacagaaggaaccaagttgtagaggggatggggacaagcagcaagggcggcgcgggaggctggggtccatgggaggctgagccggtggagaggcctctcagcatggcctcctctggcacccacgcccagggtccttcccctcctagctggccacaactcactggggcagtggcccaagacagcccgtcacctggcctgctccctccccgggacacggctccggcgccatccatgcccaccgcagacggtgtgcaacggtgcctgctgcccacagggtttatgccccccgaccttccccacagaggcgtggaccctggctgtccgtagggtgagcctgtgtcctccactcccgtcctgccaggcggccttggctgggacggggaggagctgccaccagcggggccagggctgctactaaccagtaaatcgtgtaggcctctgcttgagctgggtcttggatatttggttcatttagaagttcctgtattcctaataggatctgtgccagagacaaaaacacaagacgggtgtgagcagtttgaaagggagacaccgtgagactcggcctcagccacagagaatgaccacagacccacgtgtccggaggggagactaaggcagccctgccggtgccagaggcggaggccccgtacctgtttgattgtgatggctggcctccagtccttgtcctcctctaagatggacaggcacactgtccccgaagggtacacattcgggtgaaataatggtggttc

SEQ ID NO: 340 - DNA, 4105 bp, Homo Sapiens
gcggcgggcgcagcagagcggcgggcggcggcggcgtcgtcgagcgacaatacaagcgcctcggaccgagtccccgaacctgccctagccaaaatggcggccgagaaagagcggaagtgacggtctcactctgttgtccaggcatgatcacagctcactgcagccttgacctcccagactcaagtgaacctcccacctcagcctcccaagtagctgggaccacaggtgagtgccaccacacccagctttttttatatttttgtagagacaggatctccctatgttccctaggctggtctcaaatgcctgtgctcaagccatcctcttgccttggcctcccaaagtgctgggattatagacatgggccattgtgctgggcctcaatttcttcagcagccaagttaagccaggaaaatgtagtaattaggaatactgttcaataaataatttagagacacctcttacttttatttccagaagaaagtcaacttaaacttacttgctcaaagcatgcccttactcaaattttaaaagatactacatgaccataacctatgctacagttagaaattaactgatctcttctgaaatacctactttagagaaagtgggtaaacataatatttgccctggctttattggatagcttagcccaaattttaactggcagaacacttttctaaatggagagaagagcttaaggcagagatttttcaaattagtagggatgtgagctttgctgagggtctttaaataatatgaaaacaagtcttttgagaaaaaaattgttatataattcagtaagatgtttaaaaattactgtagcagctaagtttctgcctcagtgtcattaatatttttccttactgatagaggttattgctcaaaagagaaaaaaacggctatgtaatcaactgctgtcaaattgtttcccaattcacaatatgcattttaaatagacctgctttgatagatgaaatgtttcatcaattcaacagctgaaaagaaccgaactgtaaatgcctgctctaaatgtattttctagtttaagaaatttgagatacatttttaaggaaagggcagaggtgtgtatttctttttcaattcatacagacacagccataaacatttcatcagttaacattatcttacttctgagatcaattaggtataaagatctatgattccagtttttaaaaagactatttcaaattattccccatgtaaaaaattctacattcacatactctaatgaaggcagcaatactttatgcaaaaaaaaatatacatttatttataggtctcaatacagcaaaatgaaaacgaaaattgagaacattgctcattaggccagcaactttaaaattatttaatttgaaatataaaataggtggtcttcataaaaagatgcatgaaatttaccttaccttatattttatactttaagagtacattttatacaaatcagtaaccaggcttctttcatgtttaacctgaaatgaacgtaactataaatgagtatctttcttttatgtagtagcaaaaagagtcaataatcctttcaagaaagatactatttcatttcctcccaacttggattcaccataaacacgatccacaaatgatattggaacctagtttaaaaaaaaaaaagtaacgttagtctttaaaaacaattaggcagcttagccggtataccacattaccaacacaacagaaataggattagtcctacaacagaggtccttaaagtaagtataaaattaggggattatgaaagcaactgtgtgtatctccaagtctttaaaattaaacatgcattatctaaagataggtcacatgaaacaaatctgcaactgtttaaaaagcactgattctaggtattaccttggtttactcaagtttcagtttgcatttcaaggaaaaattatactccaaaagtaaaatggccttgtgcgtagatttttcacttgtcaaatttagctacaatggtttagcattaagtaaaatagcttgtaacttccacaagagaagtgacattccatagctattttcttgctctgaataagagttttactattaaatgaggagagtcttccctaccctaagagctcactaacgagccctaaatattacagatcaccacctccttgctctgtaattcctggtcttctcttactaacaggaaatggacatatggaactcatcattcattttaaagtatggtggccattggcggtgacaaaaggaaaagaagcaaagagactcagtccataatgctgattagttagaagaaagggctaggattgagaaagtaccaggaacttttaattatttaaaagagaatgctgactgttaatgttttaaatcttactgttcaaatgtactaatatgaatttttaccctttgtgcatgaatattctaaacaactagaagacctccacaatttagcagttatgaaagttaaactttttattataaaaattctaaaccttactgctcctttaccaggaacatgacacactatttagcatcagttgcatacctcgccaatagtataattcaactgtcttgcccgaacaatcatctccatctggaagacgtagcctttagaaacacatttttctattaatttctctagaacttcttttcggtataatctgtaagaaattaaaaatatatatcaacttctggataaatacacatgcctatgtatcctgacctttcaaagagttcactggtatgtataaagcctaaaactttcactggccattggtaaacagaaaagctcgcacacttgatgattatgatacatttgtcctaagcaagaaaggccattaaatatttgctaaataacttagaataattgtgaaaatgaattctcagttatctttttatagaattattttcccaccatactatcagaaattagtgaaatacggtaaaatgaatcatttgatgcagaaccatccattatttaagatttccctaaaatttaaagttgaaagaaactgttccaaatattgaacaacagggtggacagatgatcatgaagcaactatatatgttagatgacaagaaagaacctcataattcacagtcattttccaataaatgtttatgatgagttttgatttctcatgatttcctttataaattccccaggataaactaagttgctctaggatgagcttgggaagctaggttaaaacaggaacgaggcatcacaggatagaaacaatcctggtgggattcacctatcaccagttgaggtcacagttagacacttaacagtgggtgaatgtgcagcctaactttagatggactgcaggccaaacaccagatttacaaagacagcggagttgggcagtccagtgggtagacccaagcactttcttcagtaactaaatagcagggagctccgtattttcagagtcacacttttttttttttttttttaaagatcagtgtctcagttcatagggaggcagcaatttctacctttttttgtggggagaggggagaaagcaagaagaggcagtttggtgtaactttgttctcttcaaagttaaggccatctggacctactgtgcctcagggtttcaccctgaatccacattttttttccctcagacttctaaggcgaccttatcttttgactatgaagtgggtataggacagcacagcccttagaaaaacctgacagcttagtgtgtgcaatcctttatccacatagtttccttaaggattcaaaggaatcaatttggaataaatatggagagaggagaatctgatggtagcaatatttattcaataataaatatttattgaccaatgtactgggtttcaggttttttttttatgttttggggttaagaagtgaacttaaaaactcaatgaagatatataatatgtcagatgctgttaggggagggagcactgggattgtggggtgggaagaactatgatactgatgggactatgtttccacattacctttatttatatatttgtatttttggagacaaggtctcactctgttgcccagagtacagtggcacaaccatggctcactgcagtctcaactttccaggctcaaaagatc

SEQ ID NO: 341 - DNA, 3253 bp, Homo Sapiens
gtggacccaggtgctagtccagactcctccccctcaaatagacgcagcaaggggacctgacttcagggagcctccagctggtactggagccctctgccaagggtgaaggggtaaagtcagggaagagagtcgacaggactcctgctcgagcaaagcagagaggagcagagaccacagcctggcagagggactccccagatctctggtgagtgttcccccagcctggcgtagggcatgccccagttcactttcgcctgcttctgtggtctccacggcttctgcaaaatgaagaggaagaaggaggaagttcacagagagcgggagacggcggtgtgatcagaaccagggcccctccatcaagcccccagcaggtcccaggcctgatggtgcctgcttctggctggggcttggagcaggaagccgtgtgtgtatcttaagtcttgatttagccagtgctcttctcagcctgactctcacccgagggcatcagcctcctgtgtgcctctcatcctcctcatgcccacacccattagcttccaattctcagacctccttggagagaggccccagccacacaagggggaaccccaggacctgccgcatgccttccagagactgagaagccccagggaggccaaggagtgaaacttctttcctgccctgagagcttcgggggactcttctcagggtaaccgcatgaggcatgtgccgccttgggctaggagagctgttgctaaatgggaaactggctgctctagcagagaacttccagcagccctgaccctggagaaggcctccagggcggaagtgtgagactctcctgggattccaggacctggggcaagaatccttttccagccccctgccagcatcctcctgggccaggtggggccaggcctgaggtggccagcccagtgaggaggaaggcagaggtggccagtggctccgtggctccctctgttcttgctctccagaaagcagtgtttcctccagccccggccctgacccacccgtgttcatgatgcctgtgcctccttgccagcatcacagatgtggggaggcctgttccccaggccctgactcccctcctcagggactgtcttgccgtggccagactgagggacccctttcctggactgagccgtgccctcccttgattctcctgtctcccctgcctttttcttctctcctcagaagccatagaggggactgcgttcatatgtggtgccttcagtggaaactcttagggtggggggacctctaggaccttcctcgactttttccctcatcccccacccccgccaaccttccagcttcagcctctgcccttacccccagcccatttccaggaggtaggaagcaaaagaaaaaagcatttccttccctctttccttcttccttccttcctctctcccttcattttggtataacttagccttttgtctttaatcctggagttctccggggctagaagacaggcagagacgaatgccagcagcagagatgcttcaggcagattctgtaagcctgttctccctcatcagggagcagctcagccaaggagcaaagtcagaccccctctagctccccagggacagaatagcccttctgacaggtaaacaggtgacctgggtagagagggcaaggccccaagataggagagtcagggctcccctttccttggaatgtgggcctctctgggcaactagggagggcaaaagtcttcctcggctggttcgcccaaaacctgggagaagcaagggcacattctatgctggcagcctctgcctgcccagctcatgcccacactcaggggcctttcctgggctttgggcagattgggtgggattcaggttgtctttatgaggcttgagcacagcttgagttcctcctcccatcctccaaccccttcctttgcccctacctcctagcccccaccttctacaatctgttatttccttttatatccaaagaattataaacagaagtccttccctcaagggaacagcaagattcagcaataaaggccagtggggtcacaaaggacagaagaaaaactccctggttctttgtcctcttggatagtagaggccttgggtgaggcaaagagatgggcagaaaaagttaccttgatacagaggccagagagcctcctggagggcatgtgtttccctagcggtcacctgcgaggctgcaatcctagaaaagtcacttctgtggcagaggatgaaattgtatccccggagactcagagatattgggtgttatgtcctgaccacacaggctcaccaggaggaaaggttaggaaagtggagaaagtacgtcctggggagcgggtggccgaggagagctttccccttgtgcgcctctcaggccttggcagggattgcagctgcaggggtttggcagtgagcccatccagagagcttcctcccccgggagaactcccttggctccagagggatactagatatcttgagccctggctttgggaacatgggtggggtcccaaggtcaaagtgttctgagtggaggtccagttgtcctctgcctccaagccggcagccccttcttcacccagggctgaggttggggccagcactgcagctggaattgtctgagcaggaggtagcagcttctagccaggcacaccccaaccccacattctattgtccctcagtttccttctcaggaaaatggggactttgctccttttagcatctcaggaagcagtctggacacctgtgccctcctctaggcccttggatgagcccagggaatagggaaaggccaaagcagccccagcattcgcagaccctgcgccctgggcctctgacttcgggccaggcttctgctccttctagggttggcctggctgccctgccttcccatcctctctccatggttctctcccagagactccaccttgaggtgggggccctgagctcttggggtgagggaggggcacatgggtagatgattctgtggaggagatcaggcctcttgttcttgctgcgtggcactgattcctccttgcagatgggtgagggggccagttttccccatctgtaaagcgaggacttcccatggccattttccctcttgggcttcaggctgctgaatggaagatcaagaagtgtgaagggtgcttggggtccttgtgacttgagtgttgcctaggaccctggcccacaggacccaaggggcttcttgtctcaggttgaaacctttttatcagaatgtcatttccttc

SEQ ID NO: 342 - DNA, 7823 bp, Homo Sapiens
cgcgtgacgcaccgcggggcctcgcccgggtgttcgctccgccgcctgtccgcggatcggcgctgcgagccccgcggctgcctgcgggacacctgagcgcggagggtgcggcaccttggcaccttgaccctgtggcagggacatctcggcccaggaaagaatgaggtttaggcacggcctaaccacctaagtgagggcactgaagctgccgggggaagggcaaggtccgcgttgcagagcccaagcccagtggcgcaggatttgttttggtaagaggggatttagcgtcccaattgctgcaaattgacacagttgcggacgtgcaagcgcagaagaaatttgtccttcctcaccccacagaacagaaacaactgtacacttctgctttttaacttacatctcctctgtcctccaaacctgtgtgtccagatgtgaaactcagatccccaggggctgtggtaatttttaaatctggggctagccccccccacctctaggccctctgtggctttggctcttggtcaagcttgtgtatttgacaaggccaggccaggctcttcaccaaagagcaatggccttgcagaaagaaaatctagcttctaagtttatttgccaagtatgtattgagtgcctttcgtgtaccaggcactgttttagactctgtggatacaaccgtaaataaaacaaaaacccggcattccgggcatagagcttaaatggggatggagagaacagacaatacatatcttaaaggtaaatagtctgttgaagagtgaaaagtgctattggaaaggggcggggtgcggtgggggagagtcaggagagaggtggagaggcaaattgcagaattaaatcgtgtctatgtaggccttattggtaagatgagagttgagccaatttaaataaggagagttcgctatgtgtatgattggggtgtgctccagacaagaaaaaaaaatcgaaggctctaggtgcgttgtgtgtttgtggaagattaaggcagatccgtgttgctggagcagattgagcaaagcagagagtagtggagagcaggttaaggtgatggaggggaaggattatatagggtcttgtaggtaattgcagacttttgaagggtgtgacttaaaattttaaaaggattgcagtgttgagaatccacctattaggaagctgttacagtgttccagtagagagatggcggagcctagaatcaacatggtgaatttggtgagaagtaagaggattccagctctattttgaagatagagccaatagaatcaaattcgatatgggatacaagagaaagaaagtcatgagggatgatgccaaaggcatgaattaagtaagttaatatatgtagggaacttaaaattatgccaggtacatagtaagcattcaattttattttgacattctcaactctaatagtaggggtgactagagcagtgacagtctacatatcagttttagcgtctagaatcatacagctttaagattttgcagttatgaatatttaccaaatgagtcaagtatttaagaagtttgcagtctaattggaggagataaatacgtgaaacacacttaaaatgatacagctccaatgagtggaagaagcaccagggctctcgtctcatgccgaattgggtaaaatgacacagacacacatggagtggttttaaggggtggagaatttaataggcaagaaagaagggtgaagaaaggaagaagctcccctgtagagacacatggaagtgggctccaaagcctagagaggaaacccccagtgctggggttaacaggcagttatatgaggagactggaagaggcggtgtcagatttgcatagggctcaggggattggtttgaccaggcatgtcattcacatagcccacgaaaaacctggctctcccaccctagccttttaatatgcaaatgcaggtcgccttgatgttctacacgtgtggcgatatgtggggatggccatgttgccagacacatacaggggcaagggcaagaggacagcggtggctatcgccatgtttgtgtggacccagtttctaatggcctgcatttgcatatcaaaggtcgccagccgggctctaagagcaggggctttcctgctagacaagaaacatttctggagctgctttaaaagagacaaaaactttccaaggaccccttttcctatctgcctaaaattatttttttaataaatcctataacagtaatccaagataacacattttgaaagtaacaagttatgtaatgtgtatggcaagagtcccatgagtcaaactcacagggtaatggctggaatgaggatgggacttgaaagatgagtagaattgaacaggaatgggcggaacttccaaacaaagcaaggcaagaatgagcgtggtgtgttgaacaacagggggtagactagcttgactaatttggaaggtatatgggaaagaagaaaaaataagttgaataaataggatgaggccagtttatccagggtcatggaaaaccaaaatgaggaatttcaaaataaggcaggttactgtggctacttgacatcatttttcaggagattgtgtgaaatagcagtaatgaacatgatgaatgattttgataaaataggcactcccaaagatgccaatggattatcttttccaccaagggatatcttttccttgccacttcccaggagggataaagagagaagattctaaggctaccttcctaaaactacatctttaggattatttttttgtttctctttgcgctctgtaggcttcattttaagacatcctcaacaaacaggtttattacagtgtgtatatcctggcattaaactgtatgttaggaaatatgttgaggccgttctccaaggtcacccagtttttagcttgatggtgttgctttccccactcgattctttctagcacctgtggtatctctcctccaggtccttttgaccccttgaacaaaatttctctcagcacctattccctccttttaaaactttctaccagaattatttaaattaatgaatgtttctggttgcctaatgtaacactgcaacgtgtattttcttaaaaatttttatatttcctcacattagtgcctttctctcagcattaccacacaaggctctgtgcttgaatgtcctatcaaggccaccataaaaatggtaggttcaattcattttggttcaatagacatattggtatttccgaaattaatatatgtcagattggtcttgacccagccatcaaagttattcttagagtcatacatatttttgaagttctttttttttatagctaactgaacaaaaccagattaattattgacccctgaaaaacttgttaaaaactagagattaggccatgctctaacttttcccattgagaatctttcttaattcattgtagtcacctttgtgggtgtcattttcttttgccgaaatttaaaagcaacacccagtttgtcaattacaggtttctgagaagcagatgccaagacgggattacatgtgcaggagataagagaaaatgcctgtgaaggacaaagggagaccagcaagagaaggcagggagactccgattggaatgcaggggagtcgaaatctgaaaaagcagaatgggaaggaagaataggttgaaagaacctgtttgtaatgtcattctgagagactcagccaggtcaatggggagtcctaagccaaagttgttcattagaggaattccaaattggtcaggatctgctgtgctcagtaactgtctgagagcagtgcaggaaaaacttagtccggtgcaaactcagtggtgaatccaaaagtgcagtaggcggagactgtaaatcaattcataataacattcatggtgtcgcttcatgatttctgtaaacctctctaaaaacttaggaaagggaagttaataggacaaactatcatcacaggtggtctgggaccacactagtacttaccctgtcctacactatccactctatattcccatcactctcagctctcacttcagcagatcttgttgacttacttggtggcatgacctaaacattcactcctaagtggtcttgggcttttgtcatcatactcttctcagtccgtgactgcagtttgtgtccattcacagttagaactaggtaagggcataccaagaggcacccaagtggatcatctgagtttcacatgtgtatttctccctgtccccaaggtgtaaaggtggccccacctcctcatactaatcaattatccttgcttgctggcccctggctgcaaagagccaaaagtgtcgtgctatacatagcttatagttcaatggattcccgctctacccctttgcaagagagaaaacctgtaattctactcaacccagagttggggaaagtgaagcacagagttctccagtgggttattaggagtgattttaaataaagccatttgtgatttcaccttttggttcctagatccatgtatttgccgtactagagacacagtgccatgtagaaatctctgattagtgcctatactaaatactgagagatgtcatgccatccttgcagattattgtctctgagctgctgatttcgctgtgacttaagtaggcttttccagtactctatgaggccaacttcacctaaatagtgcagtatatgataaaacaattagacctcatggacatggcctattcctgtacctccttttctataaagtaagttttcttgtggatgctctgctaggtgggattctgtgactagagaggcattctgctagtggtgccagctaaatctttgcagacaggaaaggccaggttctagtacctgctcaatcaaagcctggaagcagccaggggaagcgtggcttatcacgaactccacagtggatccaaaggtgtggcagctgaaggctgtcagtcagctgcgctctccacagcaggtgcttttgaggagagatctgagtggaacacttgtaaggctgccagagcaagacagtgactctcacaaaatcatatgaggagcgggaacatttgcagcgccctgctggagtaagaaatgtagaataaagagttattcaaacttagaatagtacttgaaggagaacctacctaaatttgtgaaagtctaaattataaacaatactgtttttaaggaaatgccttaatttacttccaaacaaatattctaatcttgagcatactaacatactgatattgaatcctggctaagggttttactataagttaatagaggaaacatttttaactagtagtatttatttgcctacatgtaatttgctcaaattttaaggacagttcatttaccaagacccctacattcataattttccacatggatagtgtaaaggcaacttcagcccagtaaatgtcaataaattaaaagacttttttcttttgattagtgcagtctaaagtaattctttttgcaatatattaaaatgacttgctcaagattcacttttcaaaggcattgtgagcttacttcctacagtctgagactgttacatatgagtaactatggattagcttgtagggccagcaaaataggtgaacagaaaatcagcctcaaaaaacctccatcctttgccaatttacttaaggaaaactctccatagccaaacactgttgctggtaataaaagctgcaagctgtcactgaattctgctttcttggcagcacatctcgatatactgattgataaagactcagataatcaaatcaagaatgctacaggtggttactcctcagaaaccttgaaaggatttaaattcattctgcttaaagtcatgccatacaggaagccatcagaagttgcctggtaaggatttaagaaaaaaggaattaagtggttatttgggtcataaattttagggcatcaggttatgagtatctgatgtatttatattaataattacagcttaccatgggccagtcactcttttaaatgccacagcaaatttatgaagtaggatatattattatcctcatttgcacatgaggaaactgtgcacaaagacgttaaatggactgccaaaaatcctaaagctagtaagtgccagtaccagtattcaaacctaggcagtctagctcttaaccgctatactatatcttccattgaaatggacagctggttattttgactaaatatcctaagatatgtttggaagggaattaccatcactgacctcttaaatctcctttttctgtacttccaagctgatcaactctttttttgtgaaagactcaaattgttgtgttgtattacatgaatcgatatatgggataattgctaaacattatagacctgagagtcattctatctcttttagaaatctttttctttattccataatggataatgacaaattcaaaagctttaggaagtaggcagataacataagtgagggagatggcttggtataagacaatttgaaatggcgagaactgtggcaaaccactactcactcgtcacttggctccagctgctctgtgcaaatgtggatccaatgttatcagatattttaaggccaggaatggtggcttatgcctataatcccagcactttgggaggccaaggtgggaggattgcttgagcctaggagtttgagacctgcctgggcaacacagtgagaccctgtctctaccaaaaaaaaaaaaacattagcgacatgtggtggcatgtgcctgtagttccagctacttgggagggtgaagtgggaagattgcttgagttcaggaggtcaaggctgcagtgagctatggttgtgccacagcactccagcctgggtgacaaagcaagactctgtctcaaaaaaaaaaaaaaaaaagatatttgaaattttaccttaagggtaagttattacctctgcaaatagctcatttcttcatcgtctgttttactctattcagtttcagagagagaccacagtcttgactttattttcaagttctgtgaatccattatttttagagcttttacctctttacagtctccatgtatatattcaataatgtaaaatatgttaacagttcattgtttggactgtgtcctttttacagacaattgactatataaaaggctgaagggcttttccagtatatccctagtactacaaagtacgttttggagtcagacaaatctgagtttgaattctgtttctgagacattaacttgtaatttcagcaagatgttttttcttcatctgtacaatagggttacttatacctcctaattagatgaggattaaatatatataaatacactgatcatagcagctgtcatatgcaaattctgaagcaaacaaaaaattaaaaaacaatgagttatcattaataagtcataaaggaaataaaggaaagattatatggaatcgtataaaaatactcaaaaagggccaggcatggtggctcatgcctgtaatcccagtactttgggaggccaaagtgggtggatcacctgaagtcatgggttcaagatcagcctggccaacatgggtaaaccccgtctctactgaaaatacaaaaattagccaggcatggtggcatgtgcctgtaaacccagctactcaggaggctgaggcagaaagaactgcttgaacccaggttgcagtgagccaagatcgtgccactgaactccagcctgggtgacagagcaagaccctgtctcagaaataaataaatgaaaatgaaaatactcaaaaaggacatttatatgtaactatatcaaaatcaaaaaggcgatttatatggaatcatataaaaatagcctaaaagaagtcagaaaaaaagaggaagaaaa

SEQ ID NO: 343 - DNA, 1838 bp, Homo Sapiens
tttttgcatatacctcatgtgaacgaaaggacagaaaggggagtgaatatactatgaatgtgctatagtcggagttggggggcaaggaagaagtcatcgatgatggctcttctcaggccctccctcctcccacctctttctgccctccaccccactcccactccatcacctacatctatgaccttgcagcaaaatcattagagcagagcctacaaaaccggccccaagtcccaattcctctacttccttgttagaggaccccaaataactcactcagcctctctgagccccaatttcctcacctgtaaagtgagggaataacatctacctcgcaaggttgttgtgaggacgaaatgagagaacatgggcaaacatgaatgttcttgaattcaccaccccaggagaagccaggggtctgagctgggaggagcagaggttctgggtgccccctgcccctacagagcctggcaccttcagcttttctcaacttctgagggctgcttcctacaggccaaatctcccagccggaaccacttggtcagaggaacactcacagcagcctttcccagcacctgacctcaagggatatggcgtctaccaatttacataattgcctttgtcatcagttttcccataacatggtacgaagttaaatgagagcacctgagctccccttcctctgagtgcatttattccatccctccaagctgtggccttccatccccatccaagagacctgcagctgtgaagaagctcaagacttctttctcattgcctgcctcccagccattagtccccaccacagcccaggccacctggaaaatgggttccaaagcactatcactactaggtgacccctgaatgtggacaaggccacagctcttcaggcagcatttcaggggctatccagttgtcatccctctcatacccctctcctacccacccctatccccactattgtggaatgcacgaagggacagctggcaaaggcagtgaaccaagatgcagggaaggccctgtatgatggggaggatctaaagcaaaagccttttgtgcattgcctcaggttcagcagcagcagccctcactctgaagcctaccttgagaagccaggcatttctgtgaaaagctcatcagcatgcatttacaatgcaaactagaaccaactcccagtcagctaataacagaccccaggaaaaagaaaaggtcttccagacctccccgacacactttagaaccctcaggggtgaaaaagagggtgctccagggcagtgcaacttaaactgtggttgaaggacaaacagcctctgcaatacttgaggagcttgttagaaacccaaactcacagccccctccagacctacgtacagaatgtatattagcaagattcgctaggtggtttatgtgcacgttaaagtttaagaagcactgcctgagaatcccttggtcctaattaattcttttccacactcagatttgctaatgggtttcaccttatctcttgactcttgtttgatggcaacaggaaatagtagcatttcaggaagggtggaaaatataaaaagcactcccaacccaagcctccaaaaaacagcaattttcattttgtgtccatatattcccttctaatcattgtcctcatgcaagattttttttcataaagatgatctgctacataattttatatcatactctttctcctaacattacatcacaagtatactttcatgttgctgctacattcttcacacttgtcattttaatggccataaaacatgacatctagtgcacatatataattatgtagactcctattattaaatatttggatttcttcc

SEQ ID NO: 344 - DNA, 2036 bp, Homo Sapiens
aacaaaaggcaacatttcctgagtaaagggcttgatatcaaccccagggaggatttctggactccagtgcagtgcctgctatgaagcacacacaatgcttatctgctgctccattggaaagccaatagcaaagaagggaaaggaccttctgattggagagtggaggaagaggcatcatctttgatcatcatcagattttacaactcattgttcccttccagtccacagggtgagagaatcatgtaaatggtcaaacaaacacttggattatagaagacacttgatattaataatgacaataaaaatgtttacctaacttggatagattttgtgtatagataggatgtgtgtgcgcatgcacgaatgtgtgtgtgtgtgtctgtgtgtgtgtgtgtgtatactccccccttactgggaaaggacatatcagaagatcaggaaatgcattacacaatttttgtatgcaatattagtccatttcttggcggagacccaaatctattgtggcgagaaagtaatagatgaactaactagggactcagacttactggctagtgtccaagaaacattaaaaaattgagtactgaacataacaagtaggatggtgcatgcaaatttagatgtcttattgaaaacagcacatttattaatatattagacttgtagacgtgagggtgttttaatacctactcagaaattactcatgggtcggcttcacagaaatatcacttgcataagtgtgagcttcagagaaatggtgccaggcatgagtgatcatggctggactaatctaaagaaaactggaatgcctgtagttaatgatactatattttacacgtaaaaatttttaagagggtagatatcatgttaactgttcttatcacaatgaaataaaaatttaaaaataaaactgattaatgggcaaaatatgttattgtcattgtcaaactgtcatctttcttcctaattccttagaaactgcttaacataactttatttgatgcctactatgtgtcaggctattttctaagacactagaaatatccagataaagtaaaaagattaaaagcatgattatataggaactacatttttgtcagatttatttaagatagcatttatgtacagtaaaatgtaccctttaaaatgtacagcttgaggagttttgacaaatatatacagatatatgaccatcactacaatcaatatacaaaacttttccatcatcccagaaagttcccagctgatctctgtagtcaatgccttcctcagacccccagcctctggcaaccactgatctgatgtttgtccctgaagttttgccttttccaaaatgtcatataaatgaaatcatacaaaatataaccttttgtgtctgttttctttcacttagcacaatgcttttggatccatcctagttcacacctttttatcactgagtggtatttcatttgtttatacattattcagttgatagacttttaaattattttcaattttgtcaactatggataaagctgctgcaagtatttgtatacaggtcttgtccattgtgtgggcttatattttcagtaggcaaatacctgggagtgagattgccaggtaatatggtaaatatatgttgaacattgtaagaaactgccagagagcttttgaaatgattctaccattttgctttctcaccacaatgaatgagatttttagtagatctgcatccttgttgacatcgccagtcattttaatttaagcaattctaatcaatatgtaatggtgtctcatcacagtttttccttgcatattgctaatgactaataatgttgagtacatttgtatgtgcttatttgtcaacgaggtctcttctttggtaaagtgtgtgttctatcttttgtccatttttaaaaattgggtttttgtctatcttactgaactcttctgtgaatttaaatattgtttcctaatgtgttaaatgaagataatgcctatctcactgttttgtgtgtgtgtgtgtgaaaataaatgaaacatatgtacaattg

SEQ ID NO: 345 - DNA, 2149 bp, Homo Sapiens
ggttcacgctcctgcctcagcctcccgagtagctggaactacaggcgcccgccaccacgcccagctaatttttgtattttcagtagagacaggatttcattgtgttagccgggatggtctcgatctcctgacctcgtgatccacccgcctcggcctcccaaagtgctgggattacaggcgtgagccaccacaccccgccacttcaaatactctttaactttacacttaagcaaagaaatattacatatttcagtcctgaaaatattatgataaatcaaatagaccctatgacataggatatattaaatatttaagttttggaaatgtcctttatatacaaaatatttccattgttaacaagtgcttttcaaaaaatatttttattataccttagaaagagccaatttagggtctacactatctttgttcatctcgttttcttttttgcacatattcctttactaatgtagattagcactacaagataaaaagtatccagcatcataacattgtaattaattcccccatatcaaattatatgaaaaatcccacctcagacactctgccaaagggtatggaacatttaatcaagatgaagtgcttcaattgaagcagtatatgctcacctctatcagtaattttgtctcactttatttcaaagtattattatttttcgtcccaagattttagtaacacgttgtgttaaattcttgtcatatttaaaattaaaccctcttattcgtattatatttaaaagcaaattttcattgtttcaatgaaatcgttcagtatactcggcaaagtttatagtaaagttctgaacaataaatacattctgaaatgtcctgtgctttcaaaagtacatattagagctgatggcttaagcaccattatttagtggcatttctaattattactttcctttatgtggttttttttaagaggcaccaaagttccttttgtcacatggctcgtgttgccttcagtaacagccacttgaatttgcccttagttgcaaactcagatcatgacacaaaatatactcataaaagaactttattctggacattcttccagactatggaaatgatgttagacaaaaagcaaacttgagcgattttctcattcgagttcaaaatgggtcataaagcagtggagacaattcgcaatatgaacaacacatttggcccagggactgttaatgaaggtacagtgcgggggcggttcgagaagttttgcaaaagagatgagacccttgaagacgaggagcataatggttggtcacaggaagttgacaacaaccgagagcaatcattgaagctgatcctctcacaacaccacaagaagttgcagaactcattgttgaccattccacagtcattcggcctttgaagcaaattgggaaggtgagaactctagataagtgggatgccccatgagctgagccaaaataaaataaaaaagtcattttgaagtgtcatcttctcttattctatgcaacaacaatgaaacacttttctattggattgtgatgtgcgacgaaatgtagattttataggacaaccagtgatgaccagctgaataactggatccagaagaagctccaaagcacttcccaaagccaaacttgcaccaaataaaaggtcatcgtcattgttgggtgctctgctgccagcctaatttactacagctttctgaatcctaatgaaactattacatctgagacgtatgctcagcaaatcgatgagatgtcctgaaaactgcaatgcctgcagccgacactggtccacagaaaaagcccaattattccccacaactacacgtgaccgcatgtagcacaaccaatgcatcaaaagtcgaacaaattgggctacaaatttttgcctcgtccactttattcacctgacctctcaccaactgacctcccaactctctgccacttcttcaagcatctcgccaactttttgcaaggaaaaagcttccacaactagtaggaggcagaaaatgctttccaagagttcatcgaatcctgaagcacgtatttttttttttatgccatggaaataaacaaacttattttctttctttggcaaaaatgtgttgattgtaatggttcctattttgattaataaagatgtatttgtgccta

SEQ ID NO: 346 - DNA, 1212 bp, Homo Sapiens
cgagaacacaccctttccagtttgctggagaaatataagagaagtccagtgaaagagagctgagtttccccaatgatgccatcaagatgaactaactacagttaaccagccagctgatagcagatgcatgagtgagcccagctgagagcagtgcctacaatagttcctggtatgtagaaggtatacaataaatattggcggagtgaaggaacaaatgggatttgcttgattctgctgcagaagactaagaaaaagacataaatgaataaataactagtagaatgttaacacaatcagaaaaaggaccatttcttttcatttggatgtctcaaatctatttgttgtttttgttgttgttgtttttctggctgggcttgaaatgtaggcatgcagccaggaggctccatgctgactaatgagatagaggtacccatttagcccagcaatattcatacattgtatatgcattcatttttctctagtgactttttaatatattttggtgaagatattcccaagataatgaagatatgttgagtgggcattaaaagtgatgagtctttttttccattatcaaagacaaatacaggtgtgtgatgtatgcagagaattagaagtagggaaaaaaatgagggaatccaaaataatgaaaagaaattaaagctctccaataatcgaaagaaaggccaaactgaaaacataaatctccagactctgcaaggatttatactgatgtggggcatgtggaccaatggctttcaggatgtgattcattttgaaaaaagtgtcatttccattgccaagtagagttcatggtttagtgaaaatttcatcttcagtctgatcacatgagccaaattctggccctatatattctgatgtgaggaatgaagtatttctagtttatttgtgagattccaagcataatatccaggagggttagtcacattacagctaaggtaagattttgttatatttgtgttagtccttattctaggcactgaaatttccttgtaacattacttgaaaaagcataagaactatttaatgaaagaatgctttggctctgcccaaatgaccaagaaagacatcaactcacttataacacagtcttgatggtcagaccaaaaggtacgtgattgtcaattattttcagcagagactcatagaacaacaaagcagggaagaatctgaacagggattggactttaa

SEQ ID NO: 347 - DNA, 12826 bp, Homo Sapiens
ctttctggattcactctaggactatctggagaaagaggtaagaatgatcagattctgtaacttattgcttttcctttccttctgtactatccctgcacacagatctacagtttgaaagtacagtaataagatcctcacccagccccatccgcaggaatgcatcaacagctggccaaacataatccaacacacagagctgcctttgtagaattagtaacaaacagtggaagggccagacaggcgtcccagaagagctccccatgacaactgggaaacctcctcacccccagggttgagctgactccactgagctggggttggagaaccccagctctcacatctgaatctacaacaagcctcaagtgcctgccctcaacctcactagaagctattcagagggcattcggctctccataacagcaagttagaagcaagcattctccatactaacaacagccatactctgcctcatggcacatgccttttgaaatgcaacactgcaaatctccaaatcacatgaacagcatttacacctgtacctaaccatcagctgtgagctggtaggaccacctctcgtctttagaaaataatttctttttgcaaattataggctgatcccggcactctgaaacatgtaaatataacactgtattcatctccactgagcatttagcatctgaagcctgtggtagccagctggtctcaaagtcatctgggatacatttattttgattaaattgatcagatttctatttacaggatagaatttttttgccattactgaatacagctgtgtttacagggatttgtagaagaagaaaacaaaaccccacaatcggtcctagcaaagcacagagcattcagaactggaaggagttaaaacagagggggcttgctttcacagtaaaaagaaaattctgcatgcagctgctttggccatgctgtctcactagtcaggaaatgggtgttgaactggagctgaaaacacaagctgcaatcaagcccgatccagcaaagtgacagacttcctgtgtaaaatggtcagaaaccttttttcatgtctctacatgcatgcacatgcatttaaatccatgctgcgaggctgcgattttctctggggacactggtacagtcacctagcccatcagttccttcgtcgacagcgccggggacatccagactacaatttacagttcctctatccatgtgctgggttataaattatgccatcctccctagaatgagaatgcacagcaagcggcagacaatcacccggcattcggcatctctttcttttcacgcgctccctcgctccgcctttctccagctctgccttctcaggcagatacatcagataccttgtttatccatcttcagctccactctgaggtaaaatgccaccacatctcgccatgggttgtccccccagactaaatccctgggaacagcctgagctgggtgcacgcggccgaggcgacggctgcccttgccctgcggagcacgggtgggcattggatgtaaggtattcctaacttccccttccccagtccttggcgtcctctctagccatcccaccccaggtcttctgcagcttcaccctgtcctccaagtcccctcgcccagctgcgaggcaggagaccccggccggagctccgccagcaggtccttctttcgcagggcgcagacgcacgattccgggatcgggtgcaccacggcgaagcccaggcgggagacggcaggagcagctcagatgaagaaactgaaacccacagagatgaagtaacatcctcaagatcaaaaggtaacaaacgattgaggcaggatttggatattgctctacatgacgggaaagcctgtgctcttggaattacagtcatagtacaacagatcaagttcaaagcatcatctaagtcaaggaaaaccagtaaagaggtttggagagacaaacagggtcaactccaggcatttgggtcagcagaaacggcacgattgagcagcactgtgactataggatcatggatcagaggctgcttcctctttggttctgggcatcagcctcatgtccactcaaagatcccatccgggccaccacattgaatttatttgtcattttaggtacctcttggctgtgagtttcttagactttccttgtttttggtgaccctgacagtttgagggagtactagtcagtcagttatttttgcagaatgccctaaatttgagtttggctgatgtttttcttagggtttgactggggttatgggttttggggaggaagaccacagaggtgaagtaccattctcaccaaattatattaaaggtacataccatcagcatgccttatactattgatgtgaactttgattgcctggctgtggtagtgtttgtcatgtttcttcactgtaaagttactcttctcatcacccacttttctgtactgtactctttggaagaaagtcactatatgcatcccaaatttaaggagtgggaagttatgctccacccatttgtaagcagaaaatctacataatttgtttggcattcttctgcataggaaaatcatctcactctcccagttatttatttatttgatctttttttatatcagtatggactcatgggtatttcttttatactttgggttataatccaatactaacacaataaagaaatttttaatggagatgcattcaaattcgttgctaaaatgggcctgacacctcttgaccttggctaaacagagattctggatggagcaaagcactgtgacgtcatgtggactttgaaggttaagaaactacggatcatcaggacatatttgctcttccatctcacagagaaaatggggatatacctcctcattccaggaaactttcttcctatatttctaatatatccaggataaaattcaatatatatagtcagtagcttcaaagttaagcataatttgtttactagaattcttaaggcagatgttggatcattaactcattctcttagaaataactttggtgcttataagtaggcatcacataatctgatacactgatattatatatataatcgtgaaaaacatatcagattatatgatatcacataatctgatatatgtgatatataatcagattatgtggtatcatataatctgatatataaatgtttttcataattatacatatatttcaagtataattgtgaaaaacatttgccagtttaaagtttaatatgtagacagaataatgcctggaggtatagggatataattgggaattagagtaataaaataaatattttaagtacttactacatattactcattaacacaaaagtaactttacgtataaaatgcatgacaagactccattataaagaagtgtctgaaagctatagggcagaaaggtatagaacacagtatagactagaaggagataaagacaatcagaagattttattcattcatttattcaacaaaaatttacagagtacctccaattatcagcagctgtgctgaagattaggtatattacctacacagttacaaattttgctttcatgtagtctgcaggaagagagacattaatcaaagaatggcactattgacacttgtgcaggaaagggttacgtcaacaggcctgggctgctcaaaccttgcgtattcccagagtctcaagactggtcttggcctggctcctgggaagattacttctgagcccttggctgagataggagtttatgccaacagtgtgatttatggcaaacacctgtttttgtatgcctgaggctttggatcatgctgtaccaatttgatctgaggcctgaagactggtagctaaggtgctgcatgcctacatgactgacctccagtaaaaaccctggacacatgcctcaagtgagtttcgttggttggcaacactttacatatgttgtcacacgttgttgctgagaaaattaagtgtactccatgtaatggcactgggagaggacaactggaagctggtgcttaatttctcctctactccacgctatccaccttttcacttcgctgagttttttctgtatcctttcaatgtaataaactttaaccatgagtataacagcttttttgggtcctgtgagtctttccagcaaatcactgagcctgagaattatcttggggatccccaacacaatactacaattaaaaaatgaggtacatattctaaagaagaagaatatagtttgtgggagtttataacatagtaacctgaagtagactaggaggtcaagaaagtcttccccgaaaaagagaggtttgagctgtgataatggatgcataagacattgcttataaaggtggagagagctttccagcatgatgaattgcatgtacaaatcctctggtcagggagagtaaagtgtgtgtgagcagctgaaagtgacatgcacagctggagtggagagaacagcaggaggtgggatgggagatgtgtgggacagtcctcagaggctgggcttggcaaaccatgtgaaggattttggtcattatcctgagagtcacgggaagccatggaaaggctggaagcaaaggggggctcagggtggtcttctgaaataagcattctggcaatgggggttggggggagaacttatagggggtgatgagtcgacagaatgaaaacaaggcaatctctttttatagaactcagaagagagatgatggtatctctggctattgtgctggcagagggaatgttgagaaatggaagcttttcatagaaatttagtgggccaaattactttgctggcttgtgcaaatgacagaatggttggaccactcattgaagcaggacacactaggagagaccaggtttatttttgtcaggatgaagcacaagaatgacatacatttggtcttggatacactgagtttgatgtgcctttagagttgaatatggagatagttataggccactgaatacataggtatggactgatgtcattcaggtttcatccacaaattgtaactacagctatcgactcaaggggcaactatcatttgcctggcattactttaagtactttccatatatgaactcattatatcctcacaattattaaatgagcagatcctataactagcctatgtcattctcatagcaagccaaggaagggcgttgaaaccaactttggagacggtagggggtaaaaaagaagagggattttgacgttgccagtattagtaactgattcctggcagacaagactgagagtatatcaccagacctgaaggaggaggaggctgggctatcctggaagccaagggaagttggtgctccagaagaagacagtttttatttaatgctgttaagtttactaagaagaggactatgggatggacaacagtcagtcattgcaagtaaaagttgttttgatgaagctggaagctaaattagagaagggtgcatggaaggcaagaaagtgaagacagggaagtgctttcagcacatctcgctataaagagtaggaaagaaagcaatacctgcagggagctaaaggagtcagggaggagctgtttgtttacaggtgagatgggagagctgtattcaagtctgaaagtcaatggaaaggattcatttgagagggaatagttgagtacacatgagagaagtacatcgattgcagtgagctgagatcgcaccattgcattccagcctgggcgacaagaacaaaactccgtctcaaaaaaaaaaaaaaaaaaaaaaaggagtacgttgatagtgtaagcttcttcagcagtccagagtgagagagatgggatgtaaatatggtcaaacatatttgggcagagccagtcagtgaaatgatactcttcataacacatgtcacagaaaccagtaatagatccaagccctgcctatgctccactctgctctcatacccattggtttccttatttctctttggctatccctgccttccttcatgactccatatgccacgttcctctcacttcggacacatcgcacttgctgtttttctcagctaagaatgtttttcactccatccaatgccccacctcttcaaccagtttctagcctgatgaagatgttcaataaacagtcattggttgaacaacttgtgttcaaaacatttactgaaacaaacctgtattagtccgtttttacactgctataaagagctacccaagcctaagtaatttataaaggaaagaggtttaattgactcacagttcagcatggctggggaggtctcaggaaatttacaatcatgatggaaggcaaaggggaagcaggtatcttcttcacaaggtggcaggaaggagaagtgccaagtgaaggtggaagagccccttataaaaccatcagatctcgtgagaactcactcactatcagtatgcttcaattacttccacttggtctgtcccttgatacgcggggattatggggattacaattcaagatgagatttggatagggacacgaagcctaaccatatcaaaacccaatctgaaactcaatccgattttggatatttgcttctgattttggtcaccaataagtatttttatcaatataaatttgaatcataattaaagaaggcattgtagtctaatatttagttatacttttatatccatgatcatattcatccctcctacaaatataaaaacatatgcatatgccattttattattttatacaaaagagtatttttaagcagacacacacctgtcaattaattctctcctactaagcaaacaacacggaaagaaattctaatcagaatgtcaatctattaatttacaatgagatgtacaactgtcaattcaaccagatatttttgttaatctgaccaatgcatatttttaccctggccaagccagccacagattggtaaaccttacattaaaaaatgtaggtaggcccatatctctcaccatatacaacaataaactcaggatgaattaaaaacttaaatgtaatacttgaaactgtaaaaataccagaagaaaacctagagaaaactcttctggacactggtctaagaaaataattcatgactaagacctcaaaaacacaagccacaaaaaacaaaaataaaaaactgagacgtaatgaaataaaaaggtttctgcacagcaaaggaaataatcaacagagcaaacagacaacctgcagaatgagagaaaatattcacaaactatgcatctgacagaaaactaatatccggaatttacaaggaatgcaaacaactcaacaacaacaaaaacaaccccattaacaagtgggcaaaggacatgaatagatattttttaaaagaagacatacaaatggtaaacccgcatatgaaaaaaaatgccccaaatcactaatcatcagagaaatgcaaattaaaaccacaatgatattatcttacattagtcagaatggctattagtaaaaagtcaaaaaacaacagatgttggcgaagatgggaagaaaagggaactcttatacactagtaaaacctctgtggaaaacagtatggagatttctcaaagaactaaagatagaactaccactcaggtcagcaatcccactaccatgtgtctgcccagaggaaaagaaattgtgtcaaaaagatacctgcactcttatatttatcacagcactattcccaatagcaacgatatgggatcaacctatgtgttcatcaacactggacaaagaaaatatggtatatatacataattgaatactattcagccataaaacaagaataaaatcatgtattggagcaacatggatggacggagaggccattatcttaagtgaaacaactccaaaacagaaagtcagataccgcatgttcccgcttgtaaggggaagatgaaaaaaaaaaaaaaagatagacattagagactagaaagcggggtgcagaaggagagtgggtgatgaaaaataacttagtgggtagaatgtaaattattcagatgatggctaccctaaaagccaagacttcaccatgcaataaatgcacataacaaaattccacttgtaccccttaagtttacacaagtaaatataattttaaaataaaaatacatttttaaaatgtaggtgggaacggaagacagagcaatggcttccaggtacttagagtaggaatatagggattgttttcaaagtggcaggagagatttgattatcttgatggctgtatgactctatgtgttaagtgggtacttcaaggagtataagaagtttattttacttatagcaaatagtcttggtacaagaaaattatatagcacagttagtgagactgtagtctttggaaccctaaaaccttggttcaaatcccagctttataactgaattacttggtaataagaaatttattagaacgaatccctgacagttcaaaacacaacagtagattctaaaaaattgaggaggagggaatcctcctccctaacacattcaatgaggccagtgtcattctgatactaaaacctggtagaaacacaacaaaaaaaagaaacttcaggtcaatatccctgattaacatggatgcagaaattctcaacaaaatgctcgcatactaaatccagcaccacatcaaaatgctaatccaccacaatcaagtaggtattcctgggaggcatggttgcttcaacatatgcaaaccaatcaatgtgatttatcacataaatagaatttaaaaccacatgatcatctcaatagatgcagggaagtcttttggtaaaatacaatatctcttcatgttaaaaaccctcagcaaactaggcattgaaggaacatacctcaaaataataagagccatatatgacaaaccacagccaacatcatactgaatgggcaaaggctggaagcattcctcttaagaatcagaacaagacaaggatgcccactctcaccactcctcttcaacatggtactggaagtcgtagccagagcaatcaggcaagagaaagaaacagaaggcatccaaataggaagagaggcaatcaaactatctctcttcacagatgatatgattttatacctaggaaacgccacagtccctgccaaaaagctcattgattccttgatctaataaatcagcaaagtttcagggtacaaaatcaatgtacaaaatcagaagcatttcaatacatcaacatcaacaatgtccaagtcaaatcgagaatgcaatgtcattcacaatatccattaagaaaaaaagaaaaaaaaaaacctaggaatacagctaaccaaggaggtgaaaaatctctacagcaagaattataaaatgctgctgaaagaaatcagagatgatagaagcaaatggaaaacattccatgatcaagaatagaatcaatattattaaaatggccatattgcccaaagcaatttacagattctacactattcctatcaaactatcaacaacatttttcaaagaaatagaaaaaaaaactattctaaaagttatgcagaaccaaaaaagaggctgaatagccaaagcaatcctaagcaaaaagaacaaagccagaggcattatactatccaacttcaaactatactatacactacaataaccaaaacagcatggtatttgtaaaacaaacaaacaaaaaaaaccagacacatagaccaatggaacaggtcagagaacccaaaaataaagctgcacacttacaaccatctaatctttaacaaagctgacaaaaacaagcaatggggaaaggactctattcaaaaaatggtgctgggataattggctagccatatgcagaagattgaaactagaccccttccttacactatgtacaaaaatcaactcaagatggattaaagacttaaatgtaaaacctaaaactataaaaaccctagaaaaagataaaggaaatacattcaggacataggccatgacaaagatttcattttaaagactccaaaagcaattgtgacaaaaacaaaaattgacaaacaggacctaattctacacaacaaaataaattatcaagagagtaaacagactacctacagaatgagagaaaatatttgcaagccatgcacccaacaaagatctaacatcctggatctataaggaatgtaaacaaattaacaagcaaaaaacaataccattaaaaaatgggcaaaggacatgaacaggcacttatcaaaagaagacatacacgcaaccaacaaacatatggaaaaatgctcaacatcactaaacattatagaaaagtaaatcaaaaccacaagatactgtctcacaccaatcagaatggctatttttaaaaaggcaaaaaataacagatgctggtgaggttgcagaggaaaaagagcacttatacactgctggtgggaatgtaaattagttcagccattgtggaaagcagtttgaagatttctcaaagaacttaaaacagaactaccatttgacccagcaatcccattactgggtatatacccaaaggaacataacatgttctaccatgaagacacatgcacacatacgttcactgcaggaatgttcacaaaagcaaagacacggaatcaacctaaatgcccatcaacagtggactggataaagaaaatgcagtacatatacaccatggcatactatgcaaccataaaaataatgaaatcatgtcctttgcagcaacatggatacagctggaggccattaccctaggcaaattaatgcaggaaaagaaaactaaataccacatgttctcacttagatgtgggagctaaatagtgagtacacatggacacaaagaggggaacaatagacaccagggcctatttgagggtggagcgtgaggatcgaaaaaccacctttgggtactatggttattaactgggtgacaaaataatctgtacaccaaactccagtgaccgtaattcacccatgtaacaaacctgcacatggatccctgaacctaaaacaaaagttggaaagaaaaaaatgcaacagtaggtcaaaagtccttttaagaagttatgagaatagtgcagataaagtttttagcatatgcctggcacaatagatgctaaatttatcagtagttttgctggtaaggttcaagtcttttattcaagacttcctctccaccagactttgcttacatgaacatcaacagtatttgcctttgtgactttccttttctacattttcttagttgctaacctggttatatttgtatagcccttttcaaaacaggatacaatactccgataatgtttctgattagcaaatgataaccactttccagtcctgcctctcagatttttcccagagtccaccttgattagcatctatgggttctgtaatctcttgagtctctatttatagaaaattttgagttaacaattactcatgataaatcactttgtgcagatttatgcaagttgactcttaacaggccaatctaatgtctatggtagtaaggtatacgttctcatcatgcccacagactaacaacattgtttaaatgccttcagagagctaatgccggtggtagaacctttagactcatctatagaaatcaagacccaaaagaaaatatcctgcaaagatattgcttaaagcagcaagcttcaatctgataagattgctattgctaaatcaggattgaacaggggcagaaaagtggataattaatgtatatagggcccattctgggatgcaccaagcagatgtgatgttctatctataatctaattggtagcatcacaaaggcagaaaggataagatacagaaagttcacatgagatcttgaataaaaacctaggaggtactaaaagtcatcaaaaaaatcagagtgaaacaggagtaacagtaatttggacccagaggacatgtacaattttcaggacagtagcaggggccctaatcaatctgccttataatgaagcaatgttaaaaggagtgtgcccatcagttcatgttccccaacctcttaaatgtgccactcagcctttgcaatggagaggattaatgaatgatcataaaacatactttcagttgtggtgtgtgatatttgataatcaaggatatgcagaagttcatggacaaagtcaggtatctcgagacattcctatactctaacatactccaggagacaacagttcaagctttcaaaattccttccagaaaaaagaaaaaaaaaatccagtgcattttatcacatttataaaactaggctccattcttgtacacaagaaaatacatatgaggtggccacaactaacatgaatcaaatcagtctgagactaatgcatagactcatgccaagacatgacaaggtaaggaggcagaatttggattcagaggttttgtaacacgactctttgtaggctgaagggaagtttgaagaaaaagttccaggtaaggccagtgcagtggctcatgcctgtaatctcagcactttgggagcctgaggctgaggcaggtgaatcacttgagtccaggagttcaagaccagcctgggcaacatagtgaaaccctgtctcaacgacaacaacaaaaaattaaccaggcatggtggcacatgcctatagttccagctacccaggaggctgaggtgggaggatcacctgagccaaggaggtcaaggctgcagtaagatgtgattgcaccattgcactccagcctgggtgacagagcaggaccctgtctcaaaaacaaaaacaaaaacaaaacaaaagtgccaggtaaaagagaatggctttgattcaaattctgtctattcaaacccaaatattaaagcatttaaaagggaaaagaagtctttttgtttgtttgtttgttttgatatggaatctcg

SEQ ID NO: 348 - DNA, 3188 bp, Homo Sapiens
gctgggacctgttggacgtgagggtgttgagcatgtagaacatctcctggatcaggaagtagatgttagggtcactgttggtggctgccccagtgctgccacagtcccacttctatggctcattcaggagcctaagcagcgaggggctgttgctggaatttgccttctggaagagctcatacgtgtttagcaggtcccccgagggagggttcttcttctccatgaccttgtgggagatgccatacagaggcttcttgtagtaaggggtggtggcatggttgcggggctcctccttgcctggccacacagagcccgagctcctgccttgccggcctgctctccattgccttggcagggcgagctgttctcgggttccacatgcctgctaggagcgcctctgggatcagctacctcctctccacgctggggatggagtctggctggccattgctgaccagctgagtcctggagggcagtaaagacgctgtccagaaggtgcttctcagaagtcctggaattcacggagcagcctagagcagcatctttggcctctgtctccactctcacttcttagaagttcttctacatcaattttttttggagatggttctgactctgtcacccaggctggagtgcagcagttgctcagagctcactgcatccttgacctcccagactcaaaagagcctagctacttaggagtagctaggactacaggccacggccaccatgcctggctaatcttttaaattttttgtagaggcagaggtctctcattgtgttgcccagacaagtctcaaattctcgggctcaagtgttcctcccaaagtgctgggattaatggcgtgagccactgtacctggccatattttttttttcaaaaaattcatttgtagagtttaaaaagtatcttttgatcaagagttcttattgtatttatgtttgcaaatttcatttcccattctgttgcttgccttttcactctcagtgagttattttatgattacaaatccttattttttatgttattttattactatttattaacttatttatcttatttattagccttcaatcgttactttttgagtcttttttaaaatcttaaggtcatagaagtgtcctctgtattactttttaaaaactgtactgttttatgttacacattggcttctatatgaaataatttttgtgtatgttgtgaggttggatgttaatattcatttttatctgtaccgatgtatgaaagacagcacaatttattgaaaatgaatcttttcctcattgtactgaagcactatttttttcacaaatcagctaaatatattgtgtggttctctttacgagctctctattctgtttcattgaaatatctatacttgcaccttttccataatgtcataattaatatacatttataaaaactttatatctaatagtgtaagtcttcacattatattttttcttcaaagttatctatacactgcatttttatttgcattttatagtcagtttttcagttgccaccaaatataatgcagacaaattatgctattactaatcacagtattgtgattttcagtgtattacaaatatagatttatttaaaatactgaatctttcttctaataccaggaatgacataggactcacagtacacctttatttctgttgaatatctttaatttctctcagtaaaatttcacaattttcagtaaagggattgcatatgatatgttacattttatattaggaattcaatgtttcttcctggaaacatttcagatttttaatattttatttgatttagactcactacatttggaaagctttaattgtaattttatttttaatagatatagagctattaggatttgctatttattcttgtgtcactattaatgattttctagaaatgtatctatttcatcaaattatttcaaaatttttgacttaaagttacttattacattctctttttctctcccatgactatagaatctataatgatttccttgttattattcatgatatttagaatttgtggatactcttttttttaaatttcatgcataatcatggtatatttttatcagtcttttcaaagtaactttggcttttgctgatttcatttattttatgattgtttccttttctcatgcttcttatgtatcttctcttttctaattctttggatttaatttgacatcacattttaaatttttgaaattgacaattagattattaattttcaagctttaattttttaaacatatttatgtaagcatatgcatttatctccaagctgaggtttgcctaagcctcccatcttttaacaagcagtatttttactttcgtttttattaaattcaaaatatattttaatattcactgtaattactttttcgatccatgaataacttagaaatgtgatgcttaatttctaaacatttggtcactttcaaagtcttgctatagatttgcagcttaataacattgttgtacaaaaaacactgtcaaggatttcaaatttttggtatttattgattcttgttttgggcctaacctcagcctatatctgtctatctaacctatctatctatctatctatctatctatctatctatctatctatctacctacctacctatctattatctatctacctagatagacagagatatctatagatagctatggtaaattttgaaacacgttccaaatacattataataaattgtgtgttttgctatttttgggtgcagtttttatatcaaagtatttaatcctactgctttaaatttttctattattattgatattttgtatcctttttgctatcagttattgaaaaaggtatattaaagtctttatgattgaagacgcggctattgctccttttagttctataaaaattgtaaatgtgtgttaactgtgtgtgagtgaatatacatacacaagtttgacaacttcctcaatagttgattcttttatatggatgatggatacatcttcctttcaagtaataatttctgccttaaaatctcttttgtctgatattaacatagctaaacaaattttcatttggcttgtgtttgattaccttttatatgcatatatgaaaggtttttaaattaagatggttctatagatagatatatagatagaagatagtagatatcttctac

SEQ ID NO: 349 - DNA, 1620 bp, Homo Sapiens
gggtttccctgctatgttttgtcacacatcattgctgggagagttcagtgctatccaagtgactcccccgggagaggacaactggaaatttatgcctggtgtcttcctggactccgacctatgcacctttttccttggatgattttaacctgtctccttttgctgcaatgaaccataaccatgagtatatcagcttttctaatttttgtgagtccctcaagtgaattatcaaacctaaggtagttttgggacccccatcacagagagtcaaacaggggcagggcaagaagagctgcttttcctggaaggctaatgagtctgaacttcgccctggaggtaatcgttatagtaactccaggctctaacctggagctgacatgataaggtcaaatgtacacctctagaagacttccgactgcagaggggaatggatgggggagctgagggaggagagctgaagcaggaagaccatggcctggaaagagatggctgaaccagtccaggtaagagctggtgggcccttggtagtgggcagtggccacggcaaaggactaaactcaagagacagaaaatagatacaacaagacttgccagccaattagactgtggggtgagggagacaagtcaaggacgactcccagatttctggcctgggcaattggagggatgatgaagtcagtcactgaagtgagaaatcctgagtggggaagctgatgttcaggggcttgagggaggttctgacccccaagcccagcctggtactttcactgtgttcatttctacaattcaggaaccatccgattgctcttttttctctccttgaagccatccccttagccctctgcccacagtgatcactaactgattgctcctccttaaaagccaccgaaaagtgtgcttggctgatctccctgacctcaatttctctgctggcagaatcacaagaaaggcatcagcaccttctgtgaaatggggagccatgcagaggaggtgcccaggtggcgaggagtccatgtcagctgccgtcatccacaccacagatcagacatggcaaagagtggccaggccttctgagtgaaggtgatccaacctgtcaccaagcctaagggcaaatcctggctgtgctgtgatggctccaacaaccccaaacagcagcgcagaggctgcagccgccctcggaggcaacactgggaaacgctcattagcagccttccattgctcacccgccccatcccacctctgtgcatcccagatcatcagcgaagtgcacagctggcttccatcctcggagccttcctccttcatttgcctattcaacagttacaaaggcctgagttgcaaaggggcttacaacccattccacccagaagaaagagaactgagactgagcaagacagagaataggtggaaggggagatgaaaccaagcaatctctagatcccaaatggggaccctgatgtagcaagagcctcttttaaatccttttccaatagggtaatatggaaaatagttgaaagcacaagccaagtggggctggaatcccaaatgggccatttactagctgtgtgactggacaagtaatttcatatttctgggcctcgatttttctcatctgtaaaa

SEQ ID NO: 350 - DNA, 1643 bp, Homo Sapiens
tcagcggactacaagaagcagagccaccctcaatctgggtagacaccatctaatcagctaccagcaaggctagaataaaacaggcaggagaagatggaagagcagacttgctgagacttctggccttcatctttctcctgtgctaggtgcttcctgccctcgaacatcagactccaagttcttcagctttcaaaatcttggacttatattggtaatttgccagagacccttgggcctttggccacagactgaaggctgcactgttggcttccctattcttgaggttttgggactcgcactgatccaccactggcttccttggctcctcaacttgcagccggcctatcatgggacttacctagtgatcatgaatgctgtgacctctgagataattcacccaccggagtcagactgctgaagaacactggatgggtggaaaaggaacatctcaaccaggagagaaggaactgagtcaagaaagggctgcatctggtgaatatgtccctcccagtgatggaacccagggctgctgcagccaagagtctataacagtggagacgccttgagcaaagccccagagcccttgagctgcctgttcccctcctctgacatgatgggtaatctgatggaagcgctgagaggcactgcctagaattaagccctatgtgtaaacgaagcaaggaagaaagaacatgtgctatcaaatatgattcatgattcaaatatattttaatatcttattcttttcacactctgagaaactattctgataatgtgattgttttgtaaaggagtgtatcttcggataatatacagattttatagctattgcacagttttaataagcaaaagacttgctaggttgaactgggttcaacccaaaccactgtacaatttaattcaacacaatattcctctgtttaaagtgcatgtaattgccaatttatacagtcaccaagaccaaaggtttgctaaatagagttctgcaaacatagtatggcatgttttatccccaagtaccataaacgaagaaagaatgaaactaatcattaatcaatcatgtatctaattcatttcaagggcttctttcaactgtacaattatccaatgaataaattcaaatccacctgtgttagtatttttctagactttatcaccataagtttttaaaaatccttagaaactcaaggaaatgcgtaaaatgaaattgacattatcttaaacagtattagattgctattccctcttctttcataaagattttctttatggagagttattcttaaatagcactgatatttctgaaagtttccccaagtgctccattcttaaagaaatttttatttaaaggatgaacaatacataacactgcttagtgtgtgtgtgtttcagtgaaaaccattatactgtaaaaactcattctacaactttttttctgtctaaattgtaatttttgagatgtagtaaacatatcactgtgtgtaaatagatctaattctactaactggaaaaaacgctcaacactcatgacagaggttatttctagggacctagggaggggaatgaggcttggaatcccagacaaaaggcatgtgaactttatatataatgtattatttattttattaaatattgaagtaaat

SEQ ID NO: 351 - DNA, 1363 bp, Homo Sapiens
atgctaaaaataactattcctacaattatactactaccaataacatgactctctaaaaattatacaatttgaatcaatatggctacccacagcctaatcaccagcttcattgccctattattctttaactaattcaacgacaatctattcaacttctcattaactttctcctctgatccgctaacatcaccccttctaatcttaacagcctgactactacctcttataactatagcaagccagtaccacctctccagtgaatcacccctatggaaaaaaccctgtatttccatattaatttccctacaaatttttctaatcatagcatttacagccacagaactaattatattttatattctctttgaagctacacttatccctatcttaattattatcacccgatggggtaaccaaccagaacgcctcaatgcaggtacatatctcttattttacacactagtgggatccctccccctacttattacacttatttatgcccaaaatatcctaggctcactgagcatgataataataacatttaatatcaagaactaccaatctcctgatccaacaatctcatgtgattggcatgtataatggccttcatagtaaaaatacccctatactgacttcacctatgacttcccaaagcccatgtataagcacctaaggctggctcaatagtacttgcagcagtgctcctaaaattgggcggctacacaaaatgcgacttaccctcatcctcagccctctgacagaacatatagcctatcctttcctgatattatccttatgaggcatattatgacaagctccatctgtctacgacaaactgatctaaagtcacttattgcacattcctccgtaagccacatggtacttgttactgtggctatcctcattcaaaccccctgaagttttaccagtgcaattatcctcataattccccatggacttacttcgtccctactattctgcctagcaaattcaaactacaagtgaatccacagctgaatcatattactctctcgaggacgtcaaacattacttccactagtaaccttttgatgacttacagcaaatctcaccaaccttgccctaccccccactattaatctagtaggagaactccttgtaacaacggcttcattctcctgatcaaacactaccatcatgcttataggacttaatatattaatcacagccctttattccctctatatacttgtcacaacacaacaaggaacactaacatactatattaacagcattaaaccttcctttacacgagaaaacatactaatactcatacacctttcaccaattctcttactatctctaaatcctaaaattattatag

SEQ ID NO: 352 - DNA, 2952 bp, Homo Sapiens
gactcgtcgctgagggactttaagattgcggaggagtcggcaccggggcctggctgccggggaaggagagcacgggagcggggactcctgtgtctggcggagggacacggcgttccggtggagggatctgttccttgtacctggtccagggttgcggtcggggatggagcggttaccccgaccctgcgggaccttcttcctctggcggaggtgcacggcgcggcgtggtgtttttctggcggaagtatctgtgcgtggccccaggcccttcccggcgcggtctcatctggggccacttgttggccctcgcgttggggaggttcatgtggtgcatcctgatgagaaggggggtcacaggggtctcggggccagggttcagccagccaggccccagcttgctctcttctggtgctgcccctgtccctgaattcatagacccggctttccctctcttgagcacctactatgtgccaggctgcgctttgcgcatgtagcagaggcaacagtgtcacctgggaagctggtttcccccaaaggaactcttgtctgtccgttgttgcagagccagcgcatgagaccaagtgtaacctggatcccaaaatgagaacagaagaaccacttcatgtgacttgaaccagatctgaaatctgaagtgaagcccagaagagtgtagctgaagacaagtgaacctacttgaccagcaaacgcacatagttggagatgaggtctggagatgtttcccaggctggattcgaacttctgggctcatgtcatcctcctgtctcggcctccagagtagctgggaccacaggcacatgccaccatgcctggctggttactgtacacatttaaagattaaaaaaaaaatcaagggtgtttgaaaaaaaaaatactaccctgtctgtgtgttcatttacatacccctataggcactggagtttttgatatctaggtaggtcaacagaacaaaaagactcctttctcacctaccccaaagcccagatcaacaaaacagttaaaaaaaagaaagaaaaaaaaaaaaaaaagaaaaaaacctcagctgcgcagacaaacacagaaactgaggatggggagaagaaagttgtggattctattccagatgcaatttccaatctcctatgcatagtaacagacaactccttcctaatgtaaattgccagccatcaagtattcttaggtggtatttgaatttaagtaaaatgactccttgggcaactacctgacggccaacagcttttacaacatgttttctgatataaactgttttacaaagagcttgtatctttttactaccaagcattacattctgaacagaaacttaataagatttttcagcagagatttttaagagtttccatcataggacctaacaacaactgtgttctattatttttagtgcaagagtaaagacccaagagaaacagcattttcaatttgactttatggccccccaagttgtgctcaaggtaaatcagagttaaaaactggtactgggaaaagagcaaagactttcgactccaacttgggtttgaaatccactactacttatgagctattgcactttgggcaagttgcttaagtcatttgtgtctcagttttctcatctattaacaaaagtaattctactctatagaattgatgcagcaaaggtttatagtatggagcctcatacatagtagggtatcccaaatgctttagttctatgtaactcaactcaaaccggcttaagaaaaaatgaaaatttcttggcctgcctaactgaaaagttcagcgtaaggtggcttcaggcatagctggatccaggagctcaaacaatgtcatcaggatacaatcacccccaactttaggcttcattcttcattgagcccagtggactagctagcttatttctggagcaagcaaaacagaaaactctgaaagaacagaggctgagatgcaggaaggcctggatgaaccctttccggacaggaaaaaacaggtttggacaccatagcccatgtgatgtgtcctagtgggaatggcattcaggccagcgtaaggacacatttcatctttgagggcagcaaagatcccctggtggccatcaagcagaccacccggaggcaaaactccttagctgtggaattcagaagtaattagacttttctattatctgaaacagacatctggtaccaggcttcttttctaaaatgtgtaagaaactagaatttctatacatctctgcatagcatgcatgtcagaactcattgtgcaaaccttgctgacatcaaggcaccaaaatgtctacaaatgtaatcatttatcatgaccaacatggatgatagggcccaaattacccttaggctctgtattagttcatgctcatgctgctaataaagacctacctgagactgggtaatttataaaggctagaggtttaatagactcacagttccacatgcttggagaggcctcacaatcatggctgaaggtgaaggagaagcaaagtcacgtcttacatggtggcagccaagaaagcatgtgcggggaactcccctttataaaaccatcagatcttgtgagacttattcactatcatgagaatagcatgggaaagatccacccccatgattcagttacctcccactgggtccctcccatgacatgtgggaattatgggagctacaattccagatgagatttgggtggggacacagacaaaccatattaaagtaaaaatccacaccatggcaccctcagtcctctcttcctggggcaccttgatgccctcttctgcagggttctttctttttaacaaaacctatactgttgttgggaaattcttcttactaccggtgagccaatcactttccattgccagggctctgatgcctctcctggtaatcatcatcaaagtcccatggaacaggcaggtccaagattataatttcc

SEQ ID NO: 353 - DNA, 4766 bp, Homo Sapiens
cccaaaaaattggacacagcctactagcccaaaaagaacatgttgccaattatctccatgtttatttaaatattttgctctaaaggaagcaatcattcctttatacttctttaaatttagtattaaaccttttcctatttgccatggccactgcttgtgaagctaaaggtggtgaaggcagacacaggcaatggggccaggagcatatgcctttcaattccttcctggcaaccttcctgtcttctcctccactgactcttccctctcatcaccctctctatggtgccaaaataggcttagtggaatgctaatttggcaccctgacatataatgttctaaaatggatgcattctgaatttcttcttcccagatttgaaatgttttgaactgaatttgaactgaaattctattgactttctctttgatttcttcacctataaactggaccagtaccagccactacaaaaacataccaaattgtataggccatcgacactatgaagaaactgcatcaactaatggactaaataaccagctagcatcataatgacaggatcaaattcacactcaataaaatactggcaaactgaatccagcagcacatcaaaaagtttatccaccacgatcaagtcagcttcatccctgggatgcaaggctggttcaacatatgcaaatcaataaacataatctatcatataaacagaaccaatgacaaaaatcacatgattatctcaatagatgcagaaaagaccttcgataaaattcaacacccccttcatactaaaaactctcaatagactaggtattgatggaacatatctcaaaataattagagccgtttatgacaaacccacagccaatatcatactgaatgggcaaaatctggaagcattccctttgacaactggcataagacatggatgccctatctcacccctccaattcaacatagtattggaagttctggccaggacaatcaggcaagagaaaaaaataaagggtattcaaataggaagaaaggaagtcaaattgtctctctttgcagatgacatgattgtgtatttagaaaaccccatcatctcagccccaaaactccttaagctgataagcaacttcagcaaagtctcaggatacaaaatcaatgtgcaaaaattacaagtactcctctacaccaataatagacaaacagagagccaaatcatgagtgaactcccattcacaattgctacaaagagaataaaatacctaggaatacaacttacaagggatgtgaaggacctcttcaaggagaactacacaccacttctcaaggaaataagaaaagacacaaacaaattgaaaaacattccatgctcatgtataggaagaatcaatattgtgaaaatggccatattgcccaaggtaatttatagattcaatgctatccccatcaagctaccattgactttcttcacagaattagaaaaatctactttaaatttcatgtggaaccaaaaaaagcctgtatagccaagacaatcctaagcaaaagaacaaagctggaggcatcatgctactttacttcaaactacactacaaggctacagtaatcaaaacagcatggtactggtaccaaaacagatatatagaccaatggaacagggcagaggcctcaaaaataatgccacacatctacaaccatctgacctttcacaaacctgacaaaaactagcaacgaggaaaggattccctatttaataaatggcattgagtaattggctagccttatgcagaaaactgaaactggaccccttccttacaccttatacaaaaattgactcaagatggattaaagacttaaacgtaagacctaaaaccataaaatccctagaagaaaacctaggcaataccattcaggacataggcatgggcaaagacttcatgactaaaacaccaaaaagcagtggcaacaaaagccacaattgacaaatgggatctaattaaactaaagagcttctgcacagcaaaagaaactatcatctgagtgaacaggcaacctacagaatgggagaaagtttttgcaatctatccatctgacaaagggctaatatccagaatctacaaggaacttaaacaaatttacaagaaaaaaacaccatcaaaaagtgggcaaaggatatgaacagactcttatcaaaagaagacatttatgtggccaacaaacatatgaataaaagctcatcatcactggtcattagagaaatgcaaatcaaactcacaatgagatatcaatttacaccagttactagagaggatgtggggacataggaacgcttttacattgttggtaggagagtctagctatgaaagtcctagatgacatcttctaatagaagactatttaatctacattggaaatctgttgtttagggtaaccaccttcatcagtaatcttagctagatcttctggataacttctccatcagctcttgctgcttcaccttgcacttttatgttatagagactgcttctttccttcaacctcatgaaccaacctctgataggtactgacttttcttctgctgtttctttgagagcctcatagaattgaagagtgttaggggcttgctttagcttatgagtatgttgtggctggtttaatcttcccagatcactaaaactttcaccatgtcaccaataaggctgttttgctttttttgtaattcacctgtttattggaatagcactttagttgcctttaagagctttacctttaaatacagaacttggctgtttggtgcaagaagccagtttagcctctctcagctttcgacatacctttctcactaagcttaaacatttgtagcttttgatttaaagtgagaaatatgtgactcttcctttcacttgaacacttagaggcaattgtagaattattaattggcctaattttaataatgttgtgtctcggggaatagggaggcccaaggagagggagagaggtgggggaatggctgtttagtagaccagtcagaacatacacaaaatttgtggattaagtttgccgtcttacattggtgtggttcatggtccccacgacaattaaaatagtaactttagagatcactgataccagatcaccataccagatatcataatgaaaaatttgaaatattgtgagaactgccaaaatatgacacagagacaagagctcatgctattgaaaaaaatggctctgatagacttggcttgatgcagggttgcacaaaaccttcaatttgtaagagacatggttatctgtgaagctcaataaagcacaatacaataaaacaaggtatgcctgtatgaattcctttaatataatcctcataataatctaacaaggtagacattatgcccatttgatagaactaggaaattgaggcataacaaggttaagcaaattgcacaaaatcacttgctttgtaaacggcatgatcaggaaccaaactaggccagcctgatgccaaaacttgttcttaatgcactaaattgattggtttcaagacttaactcctgctgcatttaaaagtcttcctatctcattggttccctttattctcacttctaatgggcattttgggcaaactttcacgatttagcttccttgaaatagcaggtagatttcttacctttgagcctcgctctgaccccttcccggtagaagactcatgaaccataggttgaaggtgccttctacttgcagggtattttggtttagctggatgggggagggatgttgatcccttttttgattgatttacatttggtggctcagcatgataaagtagaaagagtattgatggagtaagattcagtagatccaaatcccagatccagtgcttgcagcagcatcacttcaggaaaacttgaagagtttttctgagtcttcctatcacagattataggatttctataaatatttagttggaatatataacaaaataattaggaaagttagttttctttctacttaattggcttaaagcaattctgtaattttattcttatcagtttaaaaatatctcctccgctatttaacatttgatattatattacttctagcactaaatgcataatcaatgttgtggtgtgtttgaaccagggaatttatcagtttctgaggatgttagaaatttaagtgcctaatgtaagaaccatgcccagtttggcagagaaattttcagttcagagacaattcaagtaccctcccacatttcccactcctctagaagttaggcaatcccgtctaactacttctggccagtgggctgagatgggaagtaatgtgagtctcttccaggcaaaatgcatttatgagctggtgtgtggtgcttcagctctctttttccctaatgcagcaaccttgaagttgaatattcctgttgacatagttagaagatataagtagtctgaatccctgtgacatcacttggaagccagcaaacccacagaggactttgcatgagcaatcactaaatctttatgaattatactgtgatttgggggatttgtttgttattgtattatagcctaatctaacttgactaatatacatagcctttggaggtgtgtggtttttgcttggtaaggatataggtaactaaaaaatactaagaagagttgcagcagacacccaaatctaagtagactcctaatcaaaaggtcattgttaccaataactagttctgtggttctatagatagagaaaaatttttttcgtaacattttcaaagcaaacattttgt

SEQ ID NO: 354 - DNA, 969 bp, Homo Sapiens
tgagaatgggcctacaaccgctggatttactggttgtatcatatacttacagtatcaagaagtaactggcctgttgctctaacaggccttctagcaatggccttctcaagacataggtgaagctccagcttgaaggcaataatccgaaaggatgaagaagcaccatactcagaatgcacactatacatttaaacagagacctaaatgtgatgctctgccaataataggaagaatatatgggcccaggtaccaaggtgggtagcagaagggttcctcttgccatcatctctgacatactggaggacattgtacttctcatccctataattctgggcattgcattgctagagttccttgcctaaagtgagaggactcttacaaggagacatagcaagagtttcattcaactggaacactttggacatcttgtgttcagggtctcacaggtaagaagagactcatcatttggtagaataattgacactgatcagcagaaggaggtagcgaaactttcagacattgatggttaggaggaatgtatagaaagcaagtaatctctgagcacatcttggtactctcttatctcaacataagtctacatggacctatgcagcaactctgaagaaagaaccgtgtgaaaaccaggagatcagatccttcagaaatgatattttgggtcacaccaccaggttccattgaagacttgacgaaggcgaagaatctgcaacaccttttggacctttgggctcacaccattgatacctctgatcttgatgacaaaggccaatttggcttctgcaggtacatagaaattgccagcttttcttgccatcctcgccattcgaatttcagttctgtaaatctgcctatattccttgtaatagtgcttctctttttcatagataagcttcctccttgcctttcaaagcatcttttgggcaaacttctttctcaggcgcttgatcttca

SEQ ID NO: 355 - DNA, 772 bp, Homo Sapiens
ctgggtgaactgtctgattacattcagaaacgctccatgcaataccgcatggaaatcaaaaatgccttttaccacagacacggcagattccaattattcctcagatcggaatttttttcccctccattgataatcaatgaatgatatttacatgatttttatcgtatgtgttccctgcagagcaaactagtatctgaaaattacattgtcttgtctacagtttcctatgttcaattttattgagttttgtcttccttagtcaaactacagtagacttggggaacaaatgtatcatctctctctctttctcccctctctctccataccgtgaatatcataaaactttttattttctgctaattcggaacacaattttctactccagttttgggggtttcctgtcatttctaactgaatgaaatttatgcctttttcacatctttaatgtattcccaagtctcaatcatgttacctactgtaggtcatcttcttcatgctttaagacatcattttcagaacattaagaccttctgttcaatctggatcattttctgtggaaaagccaaagttgtatgttcaccaaactgcttgagtttttccttggcacacacaaagattgtctctcccagatcatttaggcgatgtcatgtgattaattttggccagtggaatgcagtcagatgcgacgcccaccactctcacctctagtctatgagaaatctcccacacacaatctccactatcacccctttcataacagtcttgggctgat

SEQ ID NO: 356 - DNA, 1257 bp, Homo Sapiens
aagtcttggaggacagtcaccaagaactgctttggattcgggaacagagctgcctaacccatccgcagccctggggtcctgccctgttcctctggccccttcagggcagcgggggaagcagggaaaacagcctgtcagagatggcagagaaaccgagcaagaataattatcctggaaaagactttcagaagtaaccaccagaaacttcgagtccccagatccaaacagctgagaatgtggggcctgagccacgctctgactccactcccaccacatgaggagaaacaagagctgcttttctggaagacttgaacaacccctgctgtgctctggaaggacacatatccaaagaacaacaggactcagatgaaaactggatgacaattagaagaactatttctcagggctgggcgcagtggctcacacctgtaatcctagcacttcaggaggccgaagccggtggatcatgaggtcaggaggtcaagaccagcctgaccaacatggtgaaaccctgtctctactaaaaacacaaaaattagccgggcatggtggtgcatgcctgtaaccccagctactcaggaggctgaggcatgagaatcgcttgaacctgggaggcagaggttgcagtgagctgaaatcacgccatttcactgaagcctgggcaacaagagcaaaactctgtctcaaaaaaaaaaaaaaaagaaagaaaaagagaaaagaaaataatgccggccagaggcggtggctcacgcctgtaatcgcagcactttgggaggccgagccaggcggatcacctgaggtcaggagtttgagaccagcctgaccaacatggagaaagctcgtctctactaaaaatacaaaattagcctggtgtggtgacgcgtgcctgtaatcccagctactcggaagccagaggcaggagaatcgcttgaacccgggaggtggaggttgcggtgagctaaaattgtcccattgcaatgcagcctgggcaacaagagcaaaactccgtctcaaaacaaaacaaaacaaaacaaaaaacaagaaagtaatccccatctccctcactgtaaagggtttcaatgaacaagaagataatttggacaaagcaatctatgaaacaaagagaaacaagctatgatgacgttgatatgtgacttgggtattgcacatgaacaataattagtatgtgagtaggcaaaatagctaggcatggtggtgctcacctgtggtcccagctactcaggaggctgaggtggg

SEQ ID NO: 357 - DNA, 1000 bp, Homo Sapiens
ggtgaagaatttggggttgtaggtcttagcagtctggaatgggtccagttatctgaactgttgagactctacctaaaacaggaatagaaaatccaactatgagaactaagagatgagcttgatagagcgactcttgagaatgataacattttgtatcaaatataaaaaatattaagatctaagaggtttaactaactttttttgaatcttctccagaaacttttattgtggctgccaatattttggacagatccttggcttttctgaagttgaaacctaaaattcatctttcactggggtctgttgtttatgctgattgccagaatagttgaaaaagaatgccatgttttatctactcatgaagtaatcttgattcgtcaatgtaaacgcactgcttcttctgacagaaaactgatggaaaaataatttcagaaaaaaatttggaactatgaattggaacgtactgtaccttaaacttcttttgcttctataagactcatatttctttatatttgagaaaggaaagaaatattgggccttataaaccggaagctcagctgaaaacttgcaattttttgctaatgttttcaaaagcaaaaccatctgtattagttttgtgtcttcttaatctggaagtagaactgttgtaatttactgaattattgaaaaatgtcctgcttcttataaggcattcaaagattaatgacaccgaattcttttagtggagggaactagtttctaaatgcctagctgaatattttctctatgtgttggaagaaattgctttgcattgtttctagatgcagagcccagaccctccaagacagctactgtggtgttcctaaattgtcaacaatattggaggataactgtcctgatgaaagtgaaagtgaggactctgaagatgtgagttgtggggaatgaagtctcagcagctttcatcgcagagatcaaagacgtacatctttttgaacttgaaagtgacacagtctctgtgctt

SEQ ID NO: 358 - DNA, 1816 bp, Homo Sapiens
actcccttatgtggggagcaggactgatgccttgagttacttatagtgactcgttagttgggggatttgctagtattttcatcaaacttgaatctagtgaaacatttgattgaactggcttccaaattgaaaataaaccaacaccactcaggaaacctatttacagcgagaagtcaggagtgggaatgcatcttgcactgtcaccttgattaacaatagctctgacctgtgggaggacggtcctctctcctgtaacaaacatagggtagtgatgggccaggtcctgctgctcctacattctcatcacttagataagcacaggcaggtgactgcaagccttccagcctccaccagcatcctccagttctcccctgaccgctctcattcatattccgcactgattcagaggtccagtcctgagtggcaaaaagaaacatgcgtgagcctttctagaaatcaatcaatcattcatggattatagtgaattcttccctactaaacacatctccagaaattcaggcgtagtaactcccttcctgaatgtctttccaaggccctaagtgacattgatgttccatagacaatgtcttacacggcaaagtgcttctgggggtgggaacctgctgaccttccctggaatcctgactgcaggttctgtttagaacatggggtctcattttgagaagctcttggtatttatcattcacgggaagttcacaggttccagaaaacactggacagcattcaggggaaagaaaaggggcagagatggagacacctggtcagtttggccagagcatcctgggggaaatgcactgagggacagaggggcaaatgcacatgggtggtggggagaggagcaacgcagatagcaaagacactgtccagacaacctcccaactcaggagaagggactgaatccaagaggagaagaggagggatgaggctgggtgctgaggcatgccccaaagtctttgaagtctgaaaatcagacacccgtagacttgattttggtgtcctgatagaaaaacaaaaacaatgctagccataatttttaaaggctttcatattttgggaaataagcttctcatttgaggctagatttagttccttccctctgaaacatgttcaattcatgatttctacttaattcagattttctagttttgtaacaacttaagctggttgatctagctttgcaggcaggcaggcaggcaggaaggaaggaagaaaggagggaaaagaaggaaggaaggaaggaaagaaacagtaaaagaaaaaaaaggaaagaaggaaggaagaagactacaaaagtctcaacatgaagtgtttctgcaagtaaacaaggaattcctgcttttgtaccaaggactccatagttgtctggactccttaggggccacaaggccactggccgtgatgtttcagtgaactgtgaaacaaagcactgacccgctgctgttccaccatgatgcctccaatctctgggcctcgagggaagatagtattcgttcattctgaaaatacttatttaggatgtaccacttgtctggtgagtggtgagcatgatggctgacaggcagacacaggcaataatcaagtacacaagtaaagagtaattaagtccgcttattttggaattaaataatttggagttcaagtcatagttcagtttttgacaaccatgtcactttgggtgagacacttaaatgtatagagcctgcacttcctcacttgtaaaggggaattaaaaatgtgggtattgagaagattgaagcagataggttaggtagtgcttagaaggcagttccaagca

SEQ ID NO: 359 - DNA, 2619 bp, Homo Sapiens
tttgttctttcactcttcacagtaaatcttggctgctgctcactctttggttctgcattacagcaagggtctgctgcttcactcctgaagtcagctagaccatgaacccaccaggaggaacaaactctggacacaccatctttaagaactgtaacactcactgggaggagccacagcttcattcttgaagtcagcaagaccaagaacctaccggaagtaaccaattccagatacaatgtcatactacatttcaacaaacattgtgctacaatacaatgcatttaaaatatttggactttttcaaactttcaacttttagaagactaacattttctttaaaatatatgttgcttttctctgttatttatgggttatttagccaacaatttgtgattgaagctgtgtgtccaagcaattggagcttctgaatttaataaaaacaaatcttcaccatttggtttccattatttagcacaatgaagtaaatactgtgcctttaaatgcttttttgacatactatttaaatgttttattgacatattatttaatctgtgtaataatactatgtataggtcatataacacctattttaaaatgaagaaataaggcccagagaatttaaataaatcacccaaggtcacacagacaatcaaaagcagagctaaatttttaacccaggtttatctaactccaaagctcatggtcttaatcacactgtagtttacattgcattatttaaatgagtgagcatcattattaagtgaatgagtatataacttattttcttttagccatttcagggagcctgttttccatcacatggaagataatttcacaataatatgactattcttctctcatagccataagatgatgaaaataaatcatttaaagtgcattttcttacctagaaatgtcttttgtttggcagaatgattaaaataactgtcacttattcacttaggaaaataaaagtagttgaaggggagaataactttataaagtgatattttcagcagcaagggtggcctctttttcttctcttcaacacaattatttctagttaattttactgagggagggaatttcatgaattttgtactctgtatttagtgaccaatatgtttctcaaggtgctaattttctgttaatgagcaattgctgtggttggttggcattataaactgaagtttataaactactttaaaaaattagttaaaatatctgattgtgatcctaccagaaggtaacattagaaacctattgaaatgatccgtagctttattttttttgttaagcataattgtattgcttgataatatgtactaatcatcaagagtcatagtaaacatataatctactcaccaactgaaatcttatggctcaggaaaattttttgttttgttttaataagcagtttctttgcaaattaagatatttttaaattgtcgggataaatataatggggactattctcatacattcatacatactaaaaactgctttaggcaattttttgaaaatatttccacattatatgcaagctttggaaaacaggaaccaccgctataagcatatctgctatgttagaacatgaagcaaaggttaatttccaatttaatgtttcctcccagatggagcttctacctagcttgtcatcaacatctccatttagtgtgaccaaaatgaatagtgaccaaatcagaattctagagtttatagaaatgttgagttcatcctccagcctctaagctgaaatgtggttaattctcccctggcccaagtctctctcaatgtaatgctgttcatttcccaaaggtttcttcttcttcccttatataaacatgactgaagcctacaatgatacactgtaggagcatccccactgatgcaatgttggaaggaagcagagattggcaccttatatccttattttaattattagattttggagaaatccctattctgagcttctccacaaaaagatctcaggtgcttttcttgcctcgcagcaccaattcctcttctgttaatatcacatatattcacttgaggaaaactctcctcccagacatgatttaggtggaattgctccgatttccacttccttcacttgaaaggaaaacacacacaccaagacctaaaaaactagtgcttaagtgcttggcagacaaacccaaatttgcaggcttctaagagctcacattctggatctgaccgccccaagatcctagtttacaggtagtcatatgtcaccttcaggatattcgccacagctaaataccacctgttctgtaatttacttactcttttttctctaatttgactttgttaagtaaactttctattttgaaatgattttaaattgacatgcattggtaggaaataatatagagatgcatttgtaggagataataacatgcatttgtaggaaataatatagagatgtttttacctggtttccctcaatggtagcatcttgtaaaactatagtaccacatgccaacgaggatattgacattaatacagtctaccaatcttagttggattttgctgctacccagttttacatgagctttggataccagatacatagaatgacatgtcctcatttgcatc

SEQ ID NO: 360 - DNA, 4642 bp, Homo Sapiens
gtcaatgggcagggcttgcgatcttcgcatgtgtcttatcgtaaagaattgttaaaatttaggatagggaaaaaactatttaatggatgaagcgagaacagcaggaagaaaaggagggaaggtagttttctagtacaagcatattgagaagaatggaggacaaagtttgcgaagagccaggtataaataggctggggcagggtgctagtaactgggcggggtggggtggtgggaagtctcccgaaatcaggaggtgcgtgcctctggcttgctgtgtgaacagacacactgggtccggtgatttaagctgtaaaatatgtgattagactgcaggtagtctaaatgtcaaaactgcagcactccacagctctcactaggcactgctgccttagtatttattttaaaatatagattacaaggccgggcgcagtggctcactcctgtaatcccaacactttgggaggccgaggcgggccgatcatttgaggtcaggagttcgagaccagcctgaccaacatggtgaaaccccgtctctactaaaaattacacaaaattagctgggcgtggtggtgcacgcctgtaatcccagctacttgggaggctggggcaggagaattgcttgaacctgggagacggaagttgcagcgagctgagatcgttccactgcactccagcctgggcgacagagctgagactgtctcagaaaaaaaaaaaaagaataaaatatagactacaggccaggcgtggtggctcacgcctgtaatcctagcacttagggaaactgaggcagtcatatcacttgaggtcagcagttcaagaccagcctggccaacatggtgaaagcccgtctctagtaaaaatacaaaaattagccctgcgtcgtggcgtgcgcctgtattcccagccactcgggagggtgaggcaccagaatcacctgaactcgggaagccgagtttgcagtgagctgagatcatgccattgcactccagtctgggagacaaagcgagactccctctcaaaataaataaatagactacatagagatatatagactgtgtatatatatcatataatccatataaatgcagaaacatttattgaaagacatttcgaagccatcgtgtttgtatttcatgttcatgacaataaaacttgtaaacttcagtaacagttaaaccttctttaattatggattagccattaacatttttgaaacgtggaccatttaacctcggcctaccccctccaactgtcctggtgatgagttcattagctaagttaaaattaatttgaactttgatctaaaccaaaacaaatcaggaaaataaagctgtaaaggaactttatcaagcattccaaaaccaactagaaattacttgaagttttcgagtgagcattgcctgtgccagtattcttcattataggattataaactcgtttttttcccaaagcgcatgtctacgccaggcagaggagtaattattcagccaatttcatggatgtaaacgatggatataaataattgatagcacctagaggcttccagtttgggtggaaggctaaaagtagaggggaactcactcacttgagaaatgatatttaagtgaataaatagttctcttctatgaaactattactatttagttctctggaaaacttaagtgtattaatgattagaacatcaaatcctaagtaaagaaatgacattttaaatataaaaagccaaactttaaataaatcatagagacctcagacataatataggaaagaattcttttgtccttgtttacactgtgtacatagtacaaatataattttaaagctacatcctataacatttaagaaataacagtagtttcaaaatgcttaagatgaggagaaaaatgccttagaagactaggtttctaaaagtcagaaataaaagtacaagttatttttcttctatccagcaactttataaagcaacttgagtcctgaagaaaagaccgttgttcttttaagaaatgggtcttctcgaattataaactttaacaccattttgcatcgaagaatgagaatatttagtgagtaatgcacctatggtttgcttctctccacacaattactgaatatatggagcaatatcttcttctgtccacttctcccttagagagaaaaggctattaaaacgttcctgattatcctcaggtaaatcatctactttcagcaaaaatatgatttctggtctcgagtgtctatccaccagcgctaaaccctacaagaaatgagaagaaacagagcagttaaagtaatgttgtaatgtttaaacatgactcattcttttacctttaggtttagcttagctcaagatattcaaaatgtcagctacatgaaacttaaactatccagagatttacaatcgcctttttcatacaaagagctcctttaagcagtgacttctttcctcctctgcaatctggcttctaccatcagcagtctatcaagacagctttggttctaaaggtcaccagtaacctgtcattgccaaatccagtgggcccttttcttggattcatcgtgttagccctctattttctattttgtttttttttcctttttgagacagagtcttgctctgtcacccaggctggagtgcagtggcacagtcttggctcactgcaacctctgcctcctgggttcaagagagtctcctgactccgcctcctgagtagctgtgactacaggtgcacaccaccacatccagctaatttttatatttttagtagagaaggggtttcaccatgtaggttaggctggtcttgaactcctggcctcaagtgatccacccacctcaacttcccaaagtgctgagattacaggtgtgagccactgtgcccagtccctagccgtctattttcgttactgttgattactcctcctcctttaaatatctctccatccctgacatcagtctttttattttcctcgtaacttgatgttgtagctccctgaggcttccatcccaaccactccacttgcttcactgtcactctactgagtaacctcatctaaacctgtagcctgagccaccacttacttgctaatgactataatacttatatcttcagctgagatgtctctcttgagtcccagacctctatatccaaatctatacatgaactcatttatcatccaaacctgctctagttccactatcctaggaaaacaggaaactgaggcatcagctttgattccattagtcaaaccccacacctatgtggtcactaaagtctatataataggtgttaaggcttcaggattcctctgtccattcccccattacctatctctttagccagtactctcttagttgggagcatatgtgttgacagcctgcacagtaatcctttttcataatctaaccaaccttccgtctgtccatcttgtttattgtcatagtattcttttcaaaaggccaaactgatgagttcctgatgaggtaacctctctaactgatgtcactcagtggcctcaaagagctttctagaaagagttgaaagtccttagcgcagtccacagtgtccttacctcacaagcatcctttactccagcccatgcatccctacaacagtgccttaatttttatttgccccccacctttgaccgtgctctcctagatttccacctctggctttccctccatctagagagcaacagttcatctttccatactcagcagctaaaacgtctattccgtcagaaagtcatccgtgattgaccagtctgatggctaagccccttttctttgttctcataacatcgtgtgcatgcctttcccatggcgtagatcactctgcattgtaagaacagatttatgcatgtaatatgtctcccccattgccagttcccaggctaagcaccataatgacacctggtatgacatttctcctgagcacctagcatggtgcctcaacataaaaagaactccataaataccaagcaaatcttttcatttaactaacaaaatatttaccaagtatacgccacatgccaggtagtatgctacatactagcaagcaacagcaaacaaaatgccatcaaagtagagagtggtgaaccacataaacatttttccaagctaaggggagagtgccatgaaggaaagaatagcgtgctatcaaagagtaaaaccagaggtctttgcttcaagcagagaatgaaggaaggcctccttgaagtgactcaaagatgagcaggaggtgaccagatgaaattagagagaatatcattctagaacaaaaagctttgtgtgaaggtcctaaggtaggtgagagcttgatgatgttgaaaacctgaaagagggttggtatgcagtgagcagaagggaagtagccagagatgaagctatgaaggtgatcctgaagggccttataggccaagacatgaattctgagttttttatcctgagtgcagtaggtgaccattaaactgatttaaggccgggtgcagtggctcacatctataatctcagcactttgggaggccaaggtgggcagatcacctgaggtcaggagttcgagaccagcctggccaacatggcgaaaccccgtctctactaagcatacaaaaattagctgggtgtggtggtgggtgccagtaatcc

SEQ ID NO: 361 - DNA, 4674 bp, Homo Sapiens
agcaggagtcggaagtggcccaggcgcaggagagcgcggagaagggctgggcggcggcccgggagccggactcggaccgcgaggcccagatcgctgggcgctggagaacaggaccctcttgggagatgtgcataggatacggtattcctgagcctctcagtttcttccgttgtaaaaatgagacgccaacctcgtagtgtgttgagatggttaaatggggccatacacatttgcactgtgccttgcacttaacaagaacgcgtgaatgttagtgtctgctgccatcattattgactattatgatgatgatccgtgaaagcccctgaattccgcctgctcttttgcttttaattttctgcgggccttaagtctaccctacgatagctgacgcgctcccgattcctggtttccatttgcggagaatgcagggcttcctcttggagttaaagactcattggctcctggaaagccctcgctctctgccgccccccgcggacttagctgtgactgtccttgcctgtggagcagaaggcttgccctcctcaggggccacccgagaccgccaggatggagtaggatctggaccttcagtctgttgaggagccctggcccggggtagccattttcaagggcgagggaccttggtgggagtacgatgaatccatccatacaataaacatccattaagcacctagtacatggcagcggggggcagagggctggaaatattaataatactagtaaaacttaatatgtgtaggtcaccgttctactccttacaacaatctatgatatagatcctgtcgctatccctgttttacaaagggaaagggagacatcgtgaagtaaatagccttcccaaagaaagttacacgtttgggaaatggctgagtttggcttggagagaggaaagtaaactcttgataggtgaaatagacaaaatcacaacacatttgggtttaatgcaaaagatagaaacatacacaaggtacggaggtttttaaaagaggaccttgtcctgtggttataactttggggaagggcgtcagggagatcttcctggtgtaggtgatgtctgagctgggtttggaagaagaaatgggagcttcaaaggcagcttataagtgaagaagaatcacagtaaactttttcaagcctgaataaggatggaggagaagtggaatggtggccggaataaagctaaaacagtaaaacaggaccaaactcaagggctgttttcctatagaaactaaacaacattaatttgacctttgattggtaggaagccagaagggttttaagcacaggagatatgtcaggtgtggttctagaaagtttaatctggaaacatagaagatcccagaaccaagaaacttgcttaggaaatattgaaatatgtcggtgagatacttcagtaggcagaatgagtagagttacagaaagaggtccacttcttaatccctggaacctgtaaatatgttatcttacatggcaaaagaatttttgcaggtgttaccttctcattcggtcatgggaaaaaaaagaataaagaaattttgcaggtgtgattaagattgatgccattgagatgggggattatcctggattatttcagtgagcccaatctaatcacatgaatcccctaaaatggaagaagagtgggtcaaagagattcaaagtgtgagagggactcaacctgaaccacgaaccaaggactgtggataacctccaggagctgggaaaggaccttagctgacagccaacaaaaaattcactttctttatctggtctagacttgtttttcttccacagtcctacaacagcagaaactgaattctgccaataacctaaatgagcaaggaaatggatcctcccttagagtcttcagaaagtgattgagctctactgacaccttaattttatcctgaaggggtttcaccatgtttcccagactggtcttgaactcctggactcaagcaatcctcccactttgacctctcaaagtgctgggattacagacatgagccacccctcctcccctgctttttttgagacatggtctcactttggacccagactgaagtagtggtatgatcactactcactgcagcctcaacctccccagctcagacaatcctcctgcctcaagtagctgggaccacaagaatgtgctaccatgcccggctaatttttaaattatttgtagagatgggggtcttcctatgttgcccaggctggtcttgaactcttaggctcaagcaatcctcttgcctgggccttccagtgctgggattacaggaactggccactgcacctggcctagcgtgtttttgtatgttcaaagaaacgttttgagagtaaatttgtgtggatttttttttcacatgtggtataaactattcacgttacaatagtaaacaatcttatggacaagtgtaggggggctgtttttttcattcaggagcacagtgctttatttgtaaaataaatcacgatttcctttaaaaaaatcacacacctttatggaggatatttttggattctttgatatcttgttaaacgacacttaccttcatttacttccttctctcccttcaccaataagcctccaaaggacatcagttcctctgaagatggcctatttcagaactaatttcccaaaatattcacacctaatcacatacaatttccaactctatttttcagtagccagttatttgttctatttcaccattcagaatgagaccctctccttctaaactccagttcatattgtgtcagtaccagtagaatcctgcactcttctatgtaccccttttccaatcattttctgctacagtgtggggtctgggagactcagatatttatttcctaaattatatgtaatttaaaggttgctgtcttctctgccatctaatatgcttaggtatggtatctgagtgatttgttctttttgttctttaaagggatttgtgaaacagttgaaatttagatgactgtcattactgtataagaatcttgggcttctgactatgaggtacagggccatggtgaatgcttatataacttattagggggatgtgttggggtgaagtctagccctcgcttcatttgctgtttcttgtggaactgcattatcagaagatatgcctcatttgtagggctacatccatgtaacttcatctacacatgaagttttctttaatgtaaactccagatggggcattcccccccgtcataaaacttctcattaggaaaaagccctatgagatcttaacatacactgcaagtattgtagcttgcttagttatcttcatgtctgaatggccatagtaatctgatgcattttctgcaaaacacagaatgaaacaacccaaatacagacaaccagatcctattttaaggaattatctttgcttgtgttcagaataaactgaaaaaaaaaaaaaaaaggtatggcttcagaaaacaaatatgctgcaatttcagaaatgatgctaagagtagattccaaaggatttttaaaacttatttaacgtatgtccagggatacaccatactggctgagttctgttacacaggtcatacctgtacattgcatagaaaattgattgtccatgaataaagcattttttccactgtggagtgaaatgtgttgtcacaccaattgtttctattagtcatctgtatttgcagtggaagaacttaaaagtgtttttgttccaaggacccctgtgaaacaatgtgacactctcagtgttagttccttgagtaatggaccatatatgtgcaatgacagccaagcagaaagaaaaaacatcttgaaaagctcaaaaacagattcagctttgaaaataactggactgaaatctacacacatttctagaatactaacaggcacattcaaataatctatgatcaactttttccaggtactccaatgcagcaatccccaacccttttggcaccagggactggtttcgtgggaagacagttattccatggagccagatggtttcaggatgattcaagcgcattacacgtattgtgcagtttattattacattgtaatatatgatgaaataattatacaactcaccatgacataaaatcagtgggagtcttgagcttgttttcctacaactggatggtcccatctgggggtgatgggagacagtgacagatcatcaggcatcactctcataatgagcacacaacctagatcccttgcatgcgcagttcacagtagggttcctgctcctatgagaatcgaatgcctccactgatctgacaggaggcggagctcaggtggtaatgcaagcaatggggagcagctataaatacacatgaagctttgcccaacactcacctcctgctgtgcaacccggtaccagttgtcacccatgggctggggactcctgctccaaagggtaacattttaacattcagcttaaataaatttcaccaaaaatatctcaacaattcaaagaggagtgttcctgacaccagatcactttattcaacagagcagctcccaaagtcatgaagtactacttggtttaaaaataaagctgtttttcccacgtacacacattcaacaaaactatctttggtattactttactgagtgaggtttaaaggagtttgggaaaatattacagccttcttcctttt

SEQ ID NO: 362 - DNA, 4392 bp, Homo Sapiens
gggacacggacagccgccgcctgcggctccgaagctcgaggtctcccggggtgcggggacgtggggccgaagaccccgctccgcagccgcggcgaggcctcgtccttcactgtgcagatgcgaagctttcaaggacacgtctgcaccggcccggcgggagggaagagggaaggagctgccatctatggaacccaatctcacttcatctgcaccgagcatggtctcagggagcatagcgagacatctcaccatccacccagctttccgtggggtgcattagtttcaagatgaaagattagaaacctgtggtcatgtactttcggatacaaacgttttagtgagtataaagcagtggtggtttttttttttcattcatattcttttattaggtaatgtaccccctaatttataagttgagttccatataactcaataaagggggtgtcatttttaaagttaaacattttctggagataattttagattttcatgcagttgtgagaaacactaaagagagatcccatgtacccttactcagtttcccctgatgataccatctcacagtgaagtgggctgtcacaaccaagatactgacagtgacgtgaacgtttccattaccactggattcctcatgccaccctccagctggccaccccttaaccctgaacaatgactaatctattctctttttctataattttatcatttcaatagtgttatagaaatgaactcattcggccaggcacagtggctcatgcctgtaatcccagcactctgggaggctgaggtgggtggatcatgaggtcaggagatcaagaccatcctggctaacacggtgaaaccccgtctctactaaaaatacaaaaaaaaaaattagccaggtgtggtggcgggtgcctgtagtcccagctacttgggaggctgaggcaggagaatggcgtgaacccggtaggcagagcttgcagtgagccgagatcaagccactgcactccagcctgggcaacagagtgagactctgtctcaaaaaaaaaaaaaaaaaaataaagaactcattcaaggccgggcacagtgcctcatgcctggaatccctgtactttaggagactgaggtgggtggatcatttgaggtgaggagtttgagaccagcctggccaacatggtgaagccccatctctactaaaaactaaaaacattagctaggtgtggcgtcaggcgcctgtaaacccagctactcaggaggctgaggcaggagaatcgcttgaacctgggaggcagaggttgcagtgagccaagatcgtgccattgcactctagcctaggaaacagagcgagactccatctcaaaaaaaaaaaaaaaaaaaaaaaaaagaaagaaagaaacgaactcattcagcatatagccttttggaactggctcttttcaccaagcataaccctctggagattcatctagattgttgcatgtgtctctagttcacccctctgtattgctgggtaacagttcatggtatggttatgccagcatgtaaacactcacctgttgaaggacatccgcaggatttctagtttccaactacagcttagaaaactgaggccagagagtgaagcaactgcacaggcataatacggcacagctggcatttcagctccagtccatttgccagagtcacacgggatgacaggtgagaaacagaccaggcagcttcaatgggatagatggagacttgacgtcattgataatctgatgccttgaaagtcgtgtgtaagaagctgactctgaattggagggaggccaggagatttgcacccagctctggcaatgggtttggggaagctataaaccacctttcaaagggaacacctggtcgggtgcagtggctcatgcctgtaatcccagtactttgggaggccaaggtgggtggatcacctgaagtcaggagttcgacaccagcctggccaacatggtgaaaccccgtctctactaaaaatacaaaaaaaaaaaaaaaaaaattagccgggcatggtggcgggtgcctgtagtcccagctactcgggaggctgagacaggagaatcacttgaacctgggaggcggaggttgcagtgagccaagattgcgccactgcactccagcctgggtgacagagcaagactttatctccaaacaaacaaaaaaccacaaagggaacatctattgctgactgaaaacagatgaggagggacgtagcaactgatttgcattgttctaggagcatccagatcaaacgtatattcaggggccagaggagaagtgtaactgaatttagaggagcggatggagtggagaataactcgaggaacagcgccatcggtgtgacactactcacactgcagccatgaagggatgggctctccggggagtgtggagaccagaggttcgggggtaggctacaacctggggctggaagagatgacaacaaaggagagagaagggggctcagggaggcagggcgagccagatgaatgaatgaaggccaaagacaaagggactcagtatttccgaggcaagaggtcagggaggaaggagtgcatttgttatctacagcgcataacaagttagcccatatcttagcggctgaaacaacacgtattgtctctctgtttccatgggtcaggaatctgtgagtggcttgctggggtcctcaggctcaggctctctcacagactgcaatcaaggtgtccggctgctgtcatctcaaggtttgatggggaaggatccacttccagcctcactcacatggttgttgttgacagaatctagttcctcacaggttggtggactgagggcttcaattcaatgctggctattggccagaggctgccctcagctccttgccacgtgggcctctccacaggacgctcccaagatggcagctggcctcaccagagaggaaggaggagagagcgagagagtgtgtggcaagcgaagagacgaactttcataaccaaatcttggaggcatttgcgctgttctctccgttaatagccagtcactagaaccagcccacactgaagtggaggggattacaaggatccagataccaggaagccattttagaagctgcccaccacaggagcaaaggcaagggggctggacccgacctaagactaccccaggcagcccagagcagactgtccgagagtgtgaggacagaatcccagcccgaatcccagctgtcccagcaccacagggagacatggacacactcagggcctcctgccggttcccagaagagcctggctcagtcatttgcctgggttcactcccaccacccccagcagtgccgggaataaaacaataatacacagcagcaaaatgcccctccagcagcccatgtacacagcctggctcaccttccccatcttaccagccggcactgccatcgggacacggaaacctcttcaggacgtgggaggaggggaagcaattccatagacatttctgggcccttctcagctgcccccaccagcagccagcagccccctggatccatctggggaaggagactcccctttccctgagggcctccccctctgagcctggccagcaccctgggcctgttctcctgtccccctgcagctgcagggccataggtccccttgtgggagggacagaaggacagagaggcaccaggaaggtgggcaccagggccttcccaccaggagccgacactccccagggaacatttccggggcatgctcaggaggcaggaagtgggatgcaggggaaatcctcaaaggctgaggctgcggctggacagagacttgagggaggaacagaggaggatggcaggtacaaatctcaacccacggcaggtaaaagacatgcacctttttagaagtcccctgatgtcagtttttagaagtcccctgatatttgtctctgcccaaatctcatgtcgaactgtaatcctttgcatgggaggtgcttggatcactgggctggatttcttgtgaatggtttaacgccatccccttggtgccgtccatgtgttagtaagttcttatgagatttggtcatttaaaagtgacacatagcatctctcacaaagtgtgggagcacactctcactctcttgttcctgcttttgctacctgcctgctcttcctttgccttccatcatgattggaaacttcctgaggcctccctggaagccaagcagatgccatcatcatgcttcctataaagcctgcagaactatgagcccatcaaaactcttttctttagaaatcacccagtctcaagtttttttgtgtgtttttttgtttgtttgtttttgagacggagtttcactccgtcacccaggctggagtgcaatggcgcgatctcggctcactgcaacctctgcctcctggct

SEQ ID NO: 363 - DNA, 1047 bp, Homo Sapiens
tgtgttacagtttcttacagtgttgagtagagttgcatgctgtacaggtttgtagccgaggagcaataggttctgtcatacagcctaggtctgcagtaggttgtcccatttaggtttgtgtaaggacactctttgatgtgtacacatgaagaaaattgcctaatgacacatttctccaaatgtgtgtctgtcattaagcaacagatgactgatgtgaaatgtcagaataggccaatccatagagagattgtctggggatggagtaggagatgggtaagcaggaatcaggaagactgctgtagcacagggtttctcccccacttcccaccacttttttcaatagagacagggtcttgctctgttgcccaggctgaagtgtagtggcatgatcatggctcactgcagcctctaactcctgggatcctcccacctcagcctcccaggtgagtgccaccacacccagctaatcaaaaaaatttttctagaggcagggtctcactatgttgcccaggcctgcagagagtttctttggggggcattgaaaatgttctaaaattagattgtggtgatgtaattcagtgtgtctttgaatgagtttaagtgtcatgtcaagtacaattgtcttattcagcttagatttttggaatgtttgaagacaaacattgccgtggagatcacctggtagctttctgagcaggaggctgtggactgaggggagccatccactctgccgagagcttgagaaaatgaagactgaaaacagagcactggaggtcgttcatacgcaaaaatgctttcccctcggaattgtctccagctccttcacctcttggttgtaggtacagacagcagagacaagaagagccttgaagaggcagccacacattgtggtgaggagcacacagcctcttgctaggataggaatatgctacctatgctttggttcccaatatccttgccaataaaacctttgtctctgatcctctgatgaacatcaaatggatccacggctctgcggaggacccaagacaacttgcttgaattgtt

SEQ ID NO: 364 - DNA, 2239 bp, Homo Sapiens
aagaatgaagtggggtttagaccctaaatgcttcagtgtgagctgtgaagccccacagcttggctggatcaatctggacttcgggcagatgcgcactaagggctgcttacctagaggagccacgtttctcctgggcagtcaagataactgccagaggagccacatgctgggtaaatcctgaacccaaagtggaattttgccctagtataatgggttcatattcgattggctgcacttagctataaatcctgaggaggagaagaagaaagacatcagaaagtaattggactagaagaaccttagtttggaagcaaaacacagaatccagaaactatgaagaaatttacatgcacacatatgtatacaagccatgagagggaaatgggaatgtacctgagagtgtcgtcaaagcgtacagtggctgcacagtgaaatattatgtttgtacaggagagaagctcctgcatgtcctctttgctgatggcaaagtcattctgattgagatctgcataaatagctctgatcttctcatgcacatttggacaaacttctttgactttctcaaatagctgaaacataaatatagatcaatatacaaaaaatagcaccatcattatcacattgttcttgtttataacaacctgcttaattatactcaaaaactggttttagttgtaataacattacttaaagaagacatctggctgggcatggtggcatatgcctgtaatctcagcactttgggaagccaaagcagggagatcacttgagcccaggagttcgacaccagcctgcgcaacatgggttctgtggactctttcactttggcctgtgaagacttctgactactggaaagcaagaagtaggagatggtttcagcatccacccttctcacgatggggttccttacatatgataatctgatgcctaccagaagaaactctgacccagacaggatcattgcataagaggttggttttagaagtagagttggctgaaattaaagtctcgagtgacatgaagacagtgttaaagataaatccaaactcttctttattgcttgacacttttccaatcagcattgacttcattcctggcaagctgatgtaacatgaatgagttatgaagccaaagatcgcaagaagagcacacttcttaacagccacttcagaggtgacagccagggaataagaaataaggaagaactttccagaggatggagccaccacaaataataatggaaaagaaggttcctcccagagattagatttagaggctatttaaggaatttccccactcccagtgtaggaagcttctcaatactcgctaatcaggatttccttatggttatattctagggactgctgcttgcctgcctgtcttctcttttttgaatagaaggtgtctttgtttgtttgattttattttttcttcaacttcgctgttctacaatgacaagagatagaacagagacattttctacctcaacattgggaggcagaaaattcacctttttatccaagaataccaaaccagaagctgaaatatctggatctgatagagaggatagtctattcccccttggactttggactggatgcaataatggtatgagaccctggggtaggaatgagtgtcttctatgtgtgggaaagagaggaaagcagatatttggcgacctaaaaagaaggccatggcagaacctcattagttgttcaacaatcctattttccttttctcctggacacacagctatgcattttccagccatccttgtggttagatgcccagtgacagttctgagaatggaatatggacagatgtgataggcacttctgggcctgggccacaaaaaccttccacatgatgtccagtgcctcttttaccccactgacagttttttattgtcatccagagagaccttggatggtttagaagccatgtgtagaagatggcaaccttcccttagcatggatccttgaatgactgtggagtgcaatgccttctaccaattacacctactgtgtttgagaatcaaatttcatttgtattaagctactgatttggggggtttatctccttcagcacccacattagtacaactcatgcagaatggagagttaatgtgaacacatatggcacagactggtgaaacctaggactttaagatgatagatgaatttctgattatactttcctttcccgcaaaaagtttttttcaaattaaatgttgtaatat

SEQ ID NO: 365 - DNA, 5764 bp, Homo Sapiens
agttgtggccgcgactgcccgggagtggcgcttgccgcggtccgggcttgcaccccgctgggcaaagtacccggggctgtcacacggcgagctgagccctgggccggcgggtgaggttccccaagcggcgatgcccctggctccctgttccgccattgcgagccgttagggccaagctggagggagggcggcgaggcgcggctgccgaacagcaagccattggagagtcctgagcagagaaaggactgacctgcctcatgttttaaatctggctgccgtattggaagtagattggaggaaaaaaaagtggaagccctgggacccaccatcatgaacaatcggggagaagacaagaggccagcaaaggaatgaacacagggacgcatgagacatttggtgccgaagacctgggtcagcgggactcctttgggagaccagtcccccatcctcaccctcactctgtgaagagatccacctacgaccttgggtcctcagaccaaccagcctaaggaacatctcacctattttaaatcgggtaagcggcctctttctactctcttctccaacctctctcactatccctcaacctcttttcctttcaatcttggcaccacccttcagtctctcccttctcttaatttcaattcctttcattttctggtagagacaaaggagacacattttatctgtggacccaaaactccggcacaggtcacagactcaggaacacagccttcccttggtgtttaatcattgtggggatgcctgcctgattattcacccacattccgttggtgtctgatctccgtggggatgcctaacttggtcattcacccacattcccttggtggcaagttaattgtagggacaattgctttggctgctcacccacattgcagcccagggctgctcatgtcaccccttctctccgtgtctctaccctctcttttctctccactttcctggggggcaagcaccccccaccccttctctctgtgtctctgccccttttccactttcctggggggcaagaacctcccaccccttctctccgtgtctctgccccttttccattttcctaggggggcaagtaccccccaccccttctctccatgtctctgccccttttccactttcctggggggcaagcacctcccaccccttttccactttcctggggggcaagcacctcccaccccatttccactttcctgcgggggcaagcaccttcttttcaagggcctgtttcccttgcctccataactgttgtgagtattgacagccaggcttctaaacctcttaaaactccccaactctggtgccaacttggacaacattctttaatgaactcctttttagttatcccacctgcccagctcgcttattagttcaaaacattgtaactaaattatctgcttccctgactattcctgggttaaagccacacctcactactgccttttgccccagttcaatgcctcctgcacatcctctccttgtatctccccaccttaatccacaagtgtaggacacctctactccctccttggcgatggatgatgcaccccttaccatcctattaaaatctaatcacccttaccctgctcagtgccaatatcccatcccacagcacgctttaaaaggattaaagcctgttatcacttgcctgttacagcatggccttttaaagcctataaactctccttacaattcccccattttacctgtccaaaaactggacaagtctcacaggttagttcaggatctgcgtttatcaaccaaattgtcttgcctatccaccccatggtgccaaagccatatactctcctatcctcagtacctccctccacaacccctccataacccattattctgttctggatctcaaacatgctttctttactattccttgcacccttcatcccagcctctctttgctttcacttggactgaccctgacacccatcaggctcagcaaattacctgggctgtactgccacaaggcttcacggacagcccccattacttcagtcaagcccaaatttcttcctcatccattacctatctcgacatagttcttcatgaaaacacacgtgctctccctgctgattgtgtctggctaatctcccaaaccccaaccccttctacaaaacaacaactcctttccttcctaggcatggttggatactttcacctttagatacctggttttgccatcctaataaaaccattatataaactcacaaaaccaaacctagctgaccccatagatcctaaatcctttcaccactcctctttctgttccttaaaaacagccctagaagctgcccccacactagctctccctaactcatcccaacccttttcattacacacagccaaagtacagggctgtgcagtcaaaattcttacacaagagctgggactgcaccctgtagcctttctgtccaaacaacttgaccttactctttttggctggcccccacccccatgactgtatctctctgatccacctgacattcactccatttccccgtatttccttctttcatgttcctcaccctgatcacacttggtttattgatggcagttccaccaggcctaaccgccactcaccagcaaaggcaggctatgctatagtatcttccatatctatcactgaggctaccactctgccctcctccactacctctcagcaagccaaattcattgccttaactcgaacactcactcttgcaaaggaattatgcatcaatatttatacagactgtaaatatgccttccatatcctgcaccaccatgctgttatatgggctgaaagaggtttcctcactatgcaagggtcctccatcattaatgcctctttaataaaaactcttctcaaggccgctttacttcccaagaaagctggagtcatacactgcaagggccactaaaagacatcagatcccattgctcagggcaacgcttatgctgataaggtagctaaagaagcacctagtgttccaacttctgtccctcatggccagtttttctccttctaattggtcactcctatttactctcctactgaagtttccacctatcaatctcttcccgcacaaggcaaattgttcttggaccaaggaaaatatctccttccagcctcacatgcccattctattctgttgtcatttcataacctcttccacggtaggttacaagccgttagtctgcctcttcaaacctctcatttcctttccatcgtgaatatctatccccagtcctccactcttgactccctcttggagtggatagatgatctttgctgacaggacacattccaacactttcaccctgatgaagtcctattctttacttttatactcactcttattcttgttcccattcttattgccaccctctacctctccccagctatctccaccacactatcaatttcactcactctctcctagctatttctaatccttctttaacaaacaattgctggctttgcatttctctttcctccaaaatcaccaaggcctcaatttactcactgctgaaaagggaggactctgtatatttttaaatgaagagtgttgtttttaccttaatcaatctggcctggtatatgacaacataaaaaaactcaaggatagagccccaaaactcgtcaactaagaatataattatgctgaacccccttgggcactctctaattggatgtcctgggttctcccaattcttagtcctttaatacttgtttttctccttctcttattcagaagttgtgtctgtcatttagtttctcaattcatacaaaaccacattcaggccatcaccaataattctatatgacaaatgctccttctaacaactccacaatatcaccccttaccccaaaatatttcttcagtttaatctctcccactctaggttctcacaccaccccaatcccacttggagcagccctgagaaacattgcccattatctctccataccaccccaaaaatttttgccacaccaacacttcaccactattttgttttgtttttcttattaatacatgaagacaggaatgtcaggcctctgaacccaagctaagccatcatatcccctgtgacctgcatttatacatccagatggcctgaagcaaatgaagatccacaaaagaagtaaaaatagccttaactgatgacattccaccattgtcatctgccctaccctaactgagaagatatattctcccccgcccttaagaaggtactttgtatgcctatcccaaacctataagaactaatgataatcccagcgccctttgatgactcttttttctgactcagcccacctgtacccaggtgaaataaacagccttgttgctcacacaaagcctgtttggtggtctcttcgcaaggacgcatgagacagcatttactatgctattgagattgcctgttgaacctttctgcctcctccaacagagaataagtttattgaaggcagagaatatttatccttcacgcagaacttgaaaaaacagttataattttttattttttgagacagagtcttgctctgttgcccaggctggagtgcaatggcaccacctcagctcactgcaacctctgcctcccggattcaagcaattttcctgcctcagcctcccaaatatcttggattacaggcacctgccttcatgcccggctgatttttgtatttttgtagagacaagatttcaccgtgttggccaggctggtcttgaagtcctgacctcaggtgattcacctgcctcagcctcctaaagtgttgggattacaggcgtgagccaacacgctcagccagtatttttgaatgaatgagaaaatacattttgggacatgcttgggacatgttgaattgaggtatttatgggacacagaaggcagaagcatctggtaagagcagtggtgtgctggtaaatgtttatcaactggctctcagtggaaaaagttccgatttgcagcatttgttgaattccacaacatcaacactcccaccgttggtattcaagctgccaatgtggcattgctaaatatagagttgagaagagatgtgcactgttggctctcacaagttggtgtgagcaggctccagcacaccactgcctgtgggtaggtggatttaagggtatgaggttcaggagtgcaatgtgggctggagagatggatttggtggtcatcttcgaagtgatggtcattggagctaggggaacagcaagataacccaaggagttggttcagggtcaaaaggagagaacaggaatcgaatttgatgcaaggccaacattttaggtagcatgtggaagaggagcatctttgaaggagaaagacgtgaatgaaaaaatcattcaggagaacaattcaggagaaaacctgaatgattttctcattcagacaggaagacctgaatgagaaaatcaggagagccaggtcagaacagtgtcaaggaagtcagagaataggaattttcaagaagattcttcccatcgtaaaaattatgcagagagatgcagtaatgcaaggtctggaaaatatctattaagtttcaaagttagcaggttattattacttaaccagaatagtaaggagagtggccagagtatagagaggaaagtgagaagagagtgtatatggtcagggatggtggcattttgggtgttgtattagttacctattgctgcatatcaaattactttaaaacttagtagcttaagccgggcccagtggctcacacctgtaa

SEQ ID NO: 366 - DNA, 11304 bp, Homo Sapiens
gccctgagcctctctgagcacactttcttgcctttctgccttctgccatgggatgatgcagcagaaagggccctgctggatgtgagacccttgaccctgaacttcccagcctccagaacagtgttacaaacggacttccgtcaaagggatacgtgggtatgaattggaagaatctgagtggaaatgcaacactgatattttggatctccagaatttgcctataagaagagtcatttattcaggaggtcctgaatttgcttataagaagagtcattctctgcagagaatgcaaaagatgagtcaagggatgattctgcaatataattggaggatgtaaagcaattgcaaaaataattctgtctcatggaatactgaatgtctctaggaaataccaaccaatattggagttctgaaaaagtgataatgagcagtatactgtagggaactaggaaagactacttgacaaagatagtatttgagatcatagataagtgctttgggccaaaagaattgttactttctcagtttagttgaaagcaaataatgatactgtgctcatttttatagacaacaatagcacacatgtatgtggatgaaaatgagcgatacagactaattatgagtgaaagaaatccttgcagaactaacaatccagtgttgtccaaaacaaaccaatggacaaagtatttgaaaatgctagtaccatcctaacatcccaattgttttgagcaaattcttattgatagagatctctgggcctgcttatcaaccagtgagtaactccaatagtcaataaacaaatgctgcctccctcattagggatggatatagatggaaatagaatttcagaagagttgacagacaagccaaatattgtcaactttcaaatttgtcatgttgcccctagttcgagcctcactgtccaaatcccagagaaagagatggtgggatgtgaggaatggagataatctgtgtctctttgggatgttttggggtctacttaaggccagcatgacaaacatgtatagtgacaaccctaatcaattgttcatggctgtctgaaagggttggtgaggctacagtgagcaataaaaaattgccatcagtaattggccataattaccttgaacaagtggcaacttgtgataggcaacagtttctatacagtggtaaaacatgtcttatactgttccagagggtatatgatttaatcaacagtacaattgaagctgtattgtattggggcacttaatattagaattttgctaaaatatttgatttctatttagacacacagatctctaaaagatagttttctgtcttgattacatgttcttcacttcattctgaatcagattggaaataataagttgtgctttatatgcttggtagctcattcattcattcacaaattcagccagtcagccactgtcctagttatctattgctgggtaacacatgacttcaaaatttggtggattgaaacaacaacaattatgtcattatctcttccagtttctgtgggtcaggaatcttggaaggactcagctaggtggctcagctcaggttccctttgtggtttcaagtcatatggtggctgggagagtgtggggctgaagcagctgggggctggatgggcagcttactgtcttcatgtagttcctgggcctctgcacatgggttaatctggactccaaaggtaagatgtaccaccttttatgacctagcttttgaagttacgcaatacacgttgagcatccctaatttgaaaatctgaaatccaacatgctcccaagtctgaattttttgactgctgacatgaagccacaagtggagaatttcacacttgaccccatgtgacaggctgcaagtcacagtgcaggagcataacaagcagtttattctgtgcttccaagggaacaaagacccttggagccctcctcagctgtgatgtacatttgttgcacatgttcagattctcccatgcaagcaaccagactgtccacataggtggttgctagtgacatatttaccttctgatggctcagtgtatacaatcttagtttcatgcaaaaaaatatttaaaatatgatatgaaataccttcaggctatgtatataaactgtatataaaccataaatgaattttatgtttaggcttgtgtcccatctccaagatatctcattatgtatatgaaaatattccacactccaaaaaaaacactaaaaatccaaaacacttctgtcccaagaatttcagaatagggatacttagcctgtatcacttctactacacactactgattataagctagttataagactacccacccaggttggagaagaagggaagtagtctgcacctctttatggggatgtgactagggttttagaaaacatatgggataggagatgatgttgctatcttggaaaaatatgatcagctgattagccagagtcacaaacatttgttgggagccttttatgtgctaggctgcacatactctgggaatacagtgaagaggagggacaatgtccttgctcctgagtggcatatattctactgaggatgagtgaggagataaacaagaggtaaatacacaggaaagacaagattgaattgtggtaagtgctatgaagaatgttaaacaaaacagaataactggggtttggagagcttctttagataaggtggtcaggacaggtctctctctctctcttttttttttttgcttcagtgtctattttatttatttatttatttatttatttatttatttatttatttattatactttaagttctggggtacatgtgcagaacatgcaggtttgttatataggtatacatgtgctatgttggtttgctgcacccatcaactcgtcatttacattaggtatttctcctaatgctatccctcttcaaggcccccaccccatgatggccctggtatgtgatgttaccttccctgtgtccatgtgttctcattgttcaactcccacttatgagaacacgtggtgtttgattttgttcatgtgttactttgctgagaatgatggtttccagtttcatccatgtccctgcaaaggacatgaactcatccgtttttatggctgcatagtagtccatggtgtatatgtgcaacattttctttatctagtctatcattgataggcatttggcttggttccaagtctttgctcttgtgaacagtgctgcaataaacatacatgtgcatgcgtctttatagaatgatttataattctttgggtatatacctagtaatgggattgctgggtcaaatggtatttctagttctagatccctgaggagttgccacactgtcttccacaatgattgaactaatttacacttctaccaacagtgtaaaattgttcctatttctccacatcctctccagcatctgttgtttcctgactttttgatgatcgccattctaactggtgtgagatggtatctcattgtggttttgatttgcatttctctaatggataggtcacttttaattaaagaacttaatgagaagaaaacagtcagggaaacaagagttccaggtggatggaagagcaaaaatacagcatgtgagctccagtgcccagaagcctgtctaacaaacacctggcattcacttgagctctgctgaatagagaatgactgaatgaacaccagaccttaagttgccacctgctcatatcccactgcaagctctacatgaactcaaactgtggcaaagacgcaaagccaggagaaattgtctcgacaaccaaaacaatctgtaaacttggatcaagaggacccatcaatgacaagaatacacacgaaaatcttttggccactcttgaaacagatcattctaatcaacaggcaataacagtggggacacctgggccacaataaaccctttcacaactgtgccctttaccttgggccctcatagcccctctgctgggatttgcaagtcctcttcaacaaggagttcccaaaccaagggccaagacacatctggagactgtctcttgggtttgacagttgtacttttaagcattcctgcccttctggtttcttgatcctttggctcatttatgagaagcactgtgtaatcatctgaccctgagccaagaacagaggcctacagaggccctggctaatgtgggaactaagctttcagctttgtgggctgagtctgctgagctaagcagcttcctaggactgtcagaggattggtgctacttaagtgcagttgttctattacactcttttctatgagttggatgagcctttgcggattaaacagttgtttgcacttccccagttccacgctgacttttataacatatcaccaaaaggtgtttcacattgaatggagtgttataaggttccatatggtgaggtatggtttcctcctgcctggagttctgaatcattctgcaatttgtgtgaatctgctttgctatcaggttcttgaagatggggcaaggtactgtcccaacatcagaggaaggatgtccatatccttctggttcctgtgctattcttgatccttactggcctccaagtagaaggcccttgctccaagggtccctcaccatcccattctggcatatggtgaggtatgcctggccctgccagatctttgggatgtggtgctggctgtcactgctgaagtccatggcccctctgccaccttcctctgataccactaaactcagcaaagaagactggagatgtatgttacacatgtgactattgtaatgaattcagatatgcttttcttctgatacagaaaatattttataattaaaagaagatggttccttatatatgtgccttttcaatggccatcaacaattcatagctacagattctgctatgtctgcatagcaacagactcagtctgcttataccttatgaattataaatttactcatggacgagtgtgtgttgttctctcaaaggtttgattatttagattcattaagtgttgtactcgaaagaaataagactggtaactgtattttaataaagtatttaaatacctaaacatgttaatattttaacagatataagagtgtattgtgctgtaggtacaggtatttattattgttgttattgtttttaaatagagtaggacttcgaaaggaaaccacaaggaactttaagtcctgcttttaatcaccgtcaccttattttacaaagaaaaatatatttcattcatgtaagttgctattcatatttagttatatatttctacattatgaagaaagtattcaccctgaggcggggaaaacagaatccccagttagctcctattgaatgcctccatcctggaatactgtacaaccgacacatgcattggaattattcatgctgcttgtataccttgggagatgaacaccttgaagacaaactcagaatttcaacaaacccctcagggtctattcatggaagcctggttgggtctcttcttttggagaactaataaattagtccacacaactgaacttgctgaaggtaaatttggagttggccaacttttgctgtataacaagcagtgtttgtgtacagtgtctgttaggcattttactatccactggctaatatgttcagggcaggaacatccctttctaccccatggctctcccttttctctacatgcaaggaagtatgtaactgggcacagtgctgctttgatctggttttcattatgtgataattgtggactttctaaattgtaaatgtctgtgactttttccccagcagtcagacaatctatgctctgggaaaattaaagggaaaaatctcaggtaacaagaggagcaacatgaagcaatactttgctataatcatcctcttactagctgaggtccaaaatgctgtattgagtgaaataacatgattagagttaaataaataatgacagctaagagagaaatcagctagaaagaagttatttcagcctattaagaaaggagatgagatgttgctcaaaggaaaaaggcccgtatatgaagagtgtcaaaataaaggaatgaaaaaagaaataaatgaagtctgaagagcatgctagaaaaggcagatggataattttaagcaaaatgtgttgcacagtgggattggagctgaatgggaggaggtttgattgtgtaagcagttccaggtttcttgctttataacagggatctgcaacctttttctctaaagggctagatagtaaatattttaggttttgtaggtcagaatatctctcactctactactcaatgctgtcattgtaacatgaaggcaggcatagacaccacctaacaaatgggtgtctctatgttccaataaaactttataaaatctgatggtaagctggatatagcccacaggctgtagttctgtagttctgactcctggtttagatgatcaaagtggtggcagttcctttctccattgaatgggactcatattagtttggtgcaaaagtcattaattttgcaattaccttaattaaaggtgccattacctttaagggaaaagaccacaatgacttttgcaccaaagtttggtgtttgtgaggattaaataacaagtgtgaaaagtcctaacacagtgcttagcacaaggtccacactcaaatgttatctcacccaccgtctttcaagtcagtgatcatactccacagggaagcattcatggcttcagttaatcgtgcatataaattgaagacagaaaaacaggtagaaaagaaagacatgataaatgaaaggtcattattgattttggtttggtttttcaatacatacaactcaggacaaatcattaaaatgcatcttcttgcaaactgaagaaacagagcaaagtacaactacaaaaacaaattatctcaggttgatataattttcattttcatgacaataggctcattttcctcatctttcattgagcttgttaaactttaagaaaatccctacttttaagaaatgattttttttaacagtagaggcagaaatatactgatataggtgaattgtacttaaccaaaattgtaaaatcgtctatttaacattgttaatttcagttaaatggcatctcaattttgactggaagtagaatcactctggttttggtttttcatagactctgagtagcaccactgcaggttctttgaagcatttctaaatgaggtaattttattttacaaggggtttcttgtaaaaactattgtctttctgtacatctaattaaaataaagatgtaataaagaatttactgttttaattagggcatagatcttaaagcaattatcctgtcattaataattccttaacagactttcttgcacaagatgaataaaaagatttttaagctgtgaaaaatcaatacacattactcatttacattaacaaagctacacaaagtaatctgagccttcattaaattatttctcctgtaaaccagagaagtttggagagttattagctatttataacctagtggaacttcacttacaagagagaaatcttacccatgactgggcagttgtatcaatgtcatttaaatgaacagccaaataggattaatatattagtgagtggaaatagattgatatggtccataaggatgactaaatgatgaaagctatcatcatggtgttataatatgaatgattcagcactccatctgaaaattacatgtcttaacagttttttttcagtgttgtaattaaagtccctcccctccatacccccaccatctgccatatacacatttggctgtcttttaggcaatgtagcatctaggagacactaagatcactgagcttaaaatacaatcatgaaggtatctcaagtagtattgccagactttggtattttctataatttcatctaatattataggataatctgggaagggcaaaaccaaaccaaacaaaaactcaaaatgatttttttttgttagaaaaggaaaggctatgttgttatgagaagccattaagaagaagaaaaaatattttgcaatctaaattttagttacattgtccctaattgataatttggaggcagatggaaacccttacatgtgaaagcaaaaggtccaagaccacatattgtccagtttccctgcggaagaattgtctaagaaattaaatgaatcaatccgtaactgcaacagggactttgggtccttgttcctgtctgtgttgtttcctgagcccatcaaggtgacggttaatgggaagaggtattaacacaagttcttgttgggtcatttggtaaagccctcaattagcatggccagattttaatgaatattaagtaatgatgatgaaattaaaagcatccggaaagacagcagtaatcaaaccggtctgtgaacgtatggctgaaaaagctgttctggggtccttgtgagaaatttgctccaggacccttataagaatttagagaggattgctcaccaatttttcattatatatatatgcctgtttcaatatatataaaacaggcttaatggacctcacagttccacatggctgggaggcctcacaatcatggcagaaggtaaaaggcacttcttacatggcagcaggcaacacagaatgagagccaagtgaaagaggaaacccttataaaatcatcagatctcatgaggcttattcactaccacaagaacattataggagaaaccatccccatgattcaattatctcccactgtgttcctcccacaatatgtgggaattatgggagctacagttctaagacgagatttgggtggggacatagccaaaccatatctaccctggcccctcccaaatctcatgtcctcacatttcaaaaccattcatgttgtcccaacagtaccccaaagtcttaactcatttcagcattaactcaaaggtccacagtacaaaatctcatctgagacaaggcaagtcccttccacctatgagcctgtaaaatcaaaagcaagttagttacttcttagatacaatgggggtacaggcattgggtaaatacagccattccaaataagagaaattggccaaaacaaaggggctacaggcccgatgcaaatctgaaatccagtggggcagtcaaatcttaaagctccaatttgatctcctttgactccaggtctcacatccaggtcacgctcatgcaagaggtggacccacagctttgggtatctctgccctgtagctttgcacggtatagccctgctcctggctgctttcatgggctggcgttgagtgtctgtggcttttccaggtgcaaggtgcaagctctcagtggatctaccattctgggttctagaggatggtgggtggccgtcttctcatagctccactaggcagtacctcagtgtggggactctgtgtggggtttcacaccccaaaattcccttctgcactgccctagcagaggctgttcatgagggtcctgcccctgcagcacacctctgtctggacatccaggcatttccatacatcctctgaaatctaggtggaagttcccaaaccccaattcttgacttatttgcacccacaggcccaacaccacatgtaagcctccaaggctcggggctcgaaccctctgaagcaatggcctgaggtctacgttggtctgttgtagccacagctgggatgcagagcaccaagtcccaagactgcacaaagtagcaaggccctgggcctggccaggaagccattttttcctcctaggcctctgggtctgtgatgggaggggctgccatgaagacctctgacatgccctggagacattttccccactgtcttggtgattaacacttggctcctcattacttatgcaaatttctccagccagcttgaatttctcctcagaaaatgggttttccttttctatctcatggttaggttgcaaattttctgcacttttatgctctgcttgctctttaaacctaagttccaattccaaaccatacctttgtgaatgaataaaactgaatgcttttaatagtagccaagtcacatcttgaatgcattgctgattaggaatttctttcaccagatgtcctaaatcatctctctcaagttcaaagttccacagatctctagggcaggggcaaaatgccaccactccttttgctaaaacataacaagagtcacctttgctccagttcccaacaagtttctcatctccatctgagaccacctcaacctggactttattgtccatatcactataagcattttggtgaaaggcattcaacaaatctctaggaagttccaaagtttcctacattttcctgtcttcttctgagccctccaaactgttccaacctctgcctgttatccagttccaaagtcgcgtccacattttcagttatctttacaggagcaccacactcccagtaccaacttactgtattagtctgttttaacactgctgataaagacatacctcagactgggtaatttataaagaaaaagaggtttaatggactcaaagttccacatggctttggaggcctcacaatcatggaggaaggtgaaaggcatgtcttacatggtggcaggcaagagagaatgagagccaagtgaaaagggaaaccccttataaaaatcatcagctcttgtgagacttattcactaccatgagaaaattatgggagaaaccgccccccatgattcaattgtctccaactgggttcctcccacaacatgtgggagttatgggagctaccactcaagatgagatttgggtggggacacagccaaaccataccactccacccctgcccactcccaaatctcatgttttcacatttcaaaaccattacaatcaattattgtgatgcaatcttgaatctatagccaaatttcccacttctcaagatttattggaaaaaattatccctagtgtccctcagaactgtttggttttctttttttaacatttagacctttttcatccatctccaatgaacagcattggagttgtttatctagtagagtatgtatataatttatgacaaagttaatttcaatgatcctcaagtaagcgttttttcagtaccccccatgactattatagtcaactttcttgttctcagaaacacatgaattaatatttcacagatgaagcacaaataatcaataaacttatgaaactgcttagtaacaatatttattaaattagtcaacattaaaaaaaacctcagctgacatgggtatggtgacagataatctctttacccagtgatgtgactgtgaattactttctggaaagcaatttgcctatatgttacaagagcct

SEQ ID NO: 367 - DNA, 2944 bp, Homo Sapiens
ggtgcacgcctgtaatctcagctactcgggaggctgaggcatgagaatcagttgaacccaggaggtggaggttgcagtgagctgagatcgcaccactgcactccagcctgggcaacagagtgagaccctgtctcaaaaaagggagggaggaagggagggagggagggagggaaacaaggctggaattcaatgatagaggaagaaaacgatgcaaaatgaagttgtaaagcaactagttgacagatcagtaggtcctgataggtcaaggcaaggaattagatgatgatgatgatgatggtgatgatgatgatgatgatgatgatgattatcattattattttgtagatggagtctcgctgtgtctcccaggctggagtgcagtggcgcaatctcagctcactgcaactcaagtgatctcctgacctcaagtgatcctcctgcctctgcctcccaaagtgctaggattacaggcgtgaggcactgcgcctggccttaggtattattttaagcgcaatgaggggctaggggagcactttaagagaagggtggcatgatttgtcttacattttaaataaatcagtcaggctgttgtgtggagaataggttttagggtggcaagaaaggaagcagaaaattaggaagctattataggactgcaggcaagaaatgacaagtgacttcatctggggtagtaggcgatggacagatctgggatgtgtcttagatatagcatcggcaagacttacactttaacctgagcgcagtggctcacacctgtaatctcagcactttgagaggcagaggcaggaggatggcttgagtccaggagtctagagacctgcctgagcaacacagtgagactctgcatttcttaaaaataaaaaaaaaaaaattagctgaacgtggtggcatgcacctgtggtcccagttactcaggaggctgaggcaggaggctcacttgagcccaagtcaaggctgaagtgagccatgatcacaccactgcactctagcctggacaacagtgaaaccctcaaaataaataaacaaacaaataacttctgtctttcaagtttgttgggaggataaacaagctataggataagtgaaaaacacttagccccagcacctgacacatatcataggcaaaagggtaacagccggcttctcttccctttcacagtcctatggggattttaaaaaaatagcatctcttggtatactgtcagtgtttgtggtgatggactaccacctgtgtagacctctcagcatgtattaataaatacattcctcaaaaacggacatttgggagccgggcatggtggctcacgcctgtaatcccagcactttaggaggccgaggtgagcagatcacctgaggtcaggagttcaagaccagcctggccaacatggtgaaaccttgtctctactaaaatacaaaaaattagtctggtgtggtggcgggcgcctgtaactccagctacgcaggaggctgagacaggagaatcacttgaacctgggaggcacagtttgcagtgagctgagattgtgccaccacacttcagcctggctgacagagtgaatgagactccgtatctcacacacacacacacacacacacacacacacacacacacacacacatgcatttgataagcacttgccaattaaccttatacatccagaaataacatcaccaaattaactaccattattctaaacataaacaattttgggtcttttaactgatacttcaaaatccctacttacttttctcatattccttccaataatttgttaggaggtggacctgtcaataggaaggacaaaaaattattatcaccaatactctcaaagtaatcgtcactttgggtagaaaccccagtacactcggggaattttcagaattcaatcaagcccatccaactgtctccaagttttgacactgcctaaaggactcctcacagttggtttagcccaacccagtaagaaacatttaacaaataattaaaagtgctgtgccagggtggttgtgttgccgagatacggttgttggtagctggggagtggcaggcagatccagccaagaattgtgccctaagccaggagctctgatgatgaaatcacaggatgtttgagtttggggcttgatggtcatcccaggtggtttcctatcgtggaaaacatttgatgtataagagtaaggctcagccaggcgcggtggctcatgcctgtaatcccagcactttgagaggccgtggaaggcggatcacctgaggttgggagttcaaggccagcctgaccaacacggagaaaccccgtctctactataataatggcagttgccctgccagcccggtcacctgtcactccctcctccgacttctcccgcaccgcggccgcaatccagcccggacactctgagggctctctctgagctgggcacggtcctcgctgctcggccgagtgcagccccctcacctcagtgcgactgagacaaagcaagggtcccaccggcccctgtcccctccctaaggcgcgccctcagggcgggagacccacctcagccagccccccagctcagtggtccagaggctcgggtcccgcgctgacgcccagcgcctccctcctccacagccgtcactgaccgctcgctcgcctctagcctggaccccgctgtccagcagtcccggctggcccgcgccgcgctcctcccgctctggcagtcctggcactggtaggacgcccgcagccttccaccctagagggcgccgggcgggcacgcgctgggggcgacgggggtggggcgggggaggcggggcgacgcagcgcggggcggccggcggttggtgctcgcagcccgcgcgcccgccttcccggccacgtgacctttgggccccgcccagatcgggagttccgcgcggactcttggtgcgaccccgtcccac

SEQ ID NO: 368 - DNA, 1732 bp, Homo Sapiens
cgctggcgacgggacagggtttttgctgcccggggcctagtctacctcggcacgcttttctctgaaggagacacgcacttgcacgacgtgggcctctgtgcagctctactttgtccttaactcctctgactcaacgttatcgcagtttgactctggagccactcaggtttttcctaagctcaactctagccagctaggttcctggtgctttgggggtaagttgtgtgcagggagggtgttttacaggaggctgtgtggtgtagtggaaaaagctgaattaagtacattaatcctgaaaacggtttgacaagggcagatgacgtccaagttctccaacagctgtttttactcctccattcagaataggagctgtgctaatggtttggagaccgtcaattggcctagcacttggccatcctgcccccaaattcttgtcccagttccgtgccagctgcatgatgccttttgatagtatccttctttcctgtacctcaagcatagtagggtttcagaccacaagttttctgaagcttttcggaattcatgcagcttgatgcgttattagtaggggctgctcgtgggaaaacgcttgtaattacacttcctcaagaagttaatgaaaatgtgtgagaagagagatttccaacaggtgatgaatatgccagccagttattcccttcttccttcaaatatccagcctagactgatttctggataggtattgtagaaataaaaatttcagacaaaacaaacttagattttgaatcggacaacagtcagaaccaaaagaggctcagacacccctgctctagctgcccaggcatcaaactttataggctgaacacgaaagtaaagaaatttgattggctacagctaagcgtttgccttatttgggtatggtcacatgggaggtccctaattatataaccacttggctggttgtctgtttgtgattggttgaaactccattcaaaatcaggtacaaggggccgggcgcggtggctcacacctgtaatcccagcactttgggaggctgaggcaggcggatcccctgaggttaggagttcgagaccagcctagccaacatggcgaagcaccgtctccactaaaaatacaaaaattagccggacgtggtggtaagtgcctgtaatcccagctactcgggaggctgaggcacgagaatgacttgaacccgggaagtggagattgcagtgagcagagatctcgccactgcactccagcctggatgagagaacgagactccatctcaaaaaaacaaaacaaacaaaaggtgcaaggaatacctctaaattttgggttgctttctgggtacaaaaacaactccaaactaatggcctgctacttattttgcattaacagtatcaagtatcaagactccagcaaaagtggcagacagcatgggaatgctaaagagcatacaatatcaatacaggatagtactccagaaaatacgttaccctgcatgtggcgttccctcaatagatgtctcccctccccccaattttttttagctctgtgctttagtggatacaaaaattacttgctttcccaaagcctccttttgaagatagagctagcattaggttgattgctaaattttcagggattttatgagccaggtcataagcacaaccattattagaaatcaaattatataagctacaattaaattatcttaaaaataaaagtaataggccaggcatgttgagtc

SEQ ID NO: 369 - DNA, 4606 bp, Homo Sapiens
aactttatatctggaagttctaacacagatagcttaacaagaaatacctcttattttaatgtcagatgtcatgatttttttaaggcttctctgataaaatatcttcttccagtattctaaattcccagcctttttcattctcctctttcttccatcagaggccaccacttccacagaagggactggtacttctggaactggattcaaaactggtgagaagaaacagcccatgatttggcatcataagtattaggtctctcaagcttttctagagagagtttgtgtttgtgttatttagggacattgcaagtgattcaaaatagatttgctagtggaggtacgttttgttttgaaaatccactaattctaaagtggatcattactgcttcatttctgaggatacgatgcacttctccatttatgttccaactctcgctagcagtttaggtggaattcagaaagtttcagtgcatgtgtgtgaaacagaagagctctgtggaaccaggacacatacatttaacgtgtacatttgaacaaaaatgctggctcagtattttctcctacatgtgaagttcaatacattcaaactctttttcctcctctttctatctcacagcaggcatcactgcagcaccagggaagcaagcagctgagcattgggaaaatgcatctagtttctctcttatcaaattttcagttgtgcttgtacttggaaacattgtatctccttttgttatgaattgctgaaagcagacaaatacatcaaattttccacttgcctcgtgctcagagaaagaggattctgttatggcaaataaatacagaaatatagcatataccttttagattcgggtcctcatttgacttactcgttcactgtgatcacctcagtttctttgtgtttcaggcacctcagaggtagctcctgccacaacggttgccccaggaagtttcagcacagcagccacaacttctcctggagcaagtggaatgactggggttacaacaactacaaagaccacaacttccctaggaggaagtggcaccactggagcaaaaataaaattaggtaaagactttggagtatttgtatttattgttgttctttgatcgatttcttagagaaaaatttttaatgagctttttatttgaaaataaatttaaattacagaaaattatcatagataatgcagagaatctttttaatgtggaatgtgggtttaaatttcctttgaggctgtaatatttcaagaaaacagagtttgttcttggatttggacttgtaaactcttgagaccaaaatttctaaagtctttcccttctgagagactaacctcagggttctaggtctctggagaggagacttgcaataatagctctggttttgaaaaggttttccctttgaaaagggcatagtctgtatgccattagtgtactgatttctacaatgtagaaatcaccaagatgtcatattttagtttagagataaaaattcaaaattgtctttcttccttcttgttctttcttgttttctcctcttctttcttctccctttctcttttgattttcagtaggaaccaccactacagcaccagaaagtaggacaggtaaacttggggaaagcctttcatatgaccttcaactttgaacaaatcttggtaataatattcggggcaggaatattagccactgcgttacccttggctttgcaaaagcacacaataaaccggaagcctgttagtcctcatgtcagttataatttcaggaagtgtgctttcttgcttcaaagtcacaaatagacatactgttggccacatttttccaagggtcatgaaagagttcccatatccatctttctcttttcttttctaccttggcacagctggagtgccctctggtacaagagtcacccctgggagctccaactcaggtaaagcaccaggctgggaggaaccactgcttggaaagtgctcctcagtgaggtgtctgcctgggtgaccctaccgtactcttctcagattcttctaatctttgccctcactgccattctttttccctgttttgcagaggccacaacttctgtagaagaaagcagaataacaagagccgaagtaatcacagaggccacaactttctcaggaggcagcggggccacctgagcaggattacccagaggtaccactggagaattttctggaacgaactttatatctggaagttctaacacaggtagcttaacaagaagtaaatttttatttaatgtcagctgtcatatttcttttatggcttctatggtaaagtaatatcccaatatcttcttccagtattctaaattcccagcctttttcattctcctctttcttccatcagaggccaccacttccacagaagggacaggtacttctggaactggattcaaaattggtgagaagaagcaacccatgatgtggcatcataattattaggtctctcaagcttttcttgagagagtttgtgtttattttatttagggacaatgcaagtgattcaaaatagatttgctggtggagatacttttttttaaatctactaattttaaaatggagcattactgttccatttccgaggatgggatggaatttctccatttgtgttacaactattgctagcagtttaggtggaattcagaaagttttcagtgtgtgtatgtgaaacagaaaagagccccatggacccaggacacatgcatttataagtgtatatgtgaacaaaaatgccggctcagtattttctttcttatgtctcaagttttaatacatttaaacccttttttccctcttctttctacctcacagcaggcatcacttctgccccagggaaacaagcaggcacctctggggtatctcttgccacaacagttgcccctggaagcttcagcacagccacaacttcttctggagcaagtggaataactagggctggccccaactcagagaccacaacttccctaggaggaagtggtaccactggagcagaaataaaatcagctgcagtgccctctggtacaacagttgcccctgggagctccaactcagaagccacaacttctgtaggagaaaatggaaaaacaagaggtgaaataatcacagatactactgagggcacctctggcaaagttctggaacctggaagtgcccacacaggtcaggaattctgaacatggccccttaagcaatatcagctttgggaaacccagaatgtcctgtccagtctttatacctccaattcctccctctctcagaggccacaactttcccaggaggcagtgggactacccgagcaggaccaccaggaggtgagcttgtcaggctgaggcctggggctctcatcatctctctatctgggtggctgcagtgaacagtaatgaacagtaatgcagtgaaagtcttttgagggagggtcctgcattttctctgtggccacagtgtgtcatatcaacctggtcagttattctgcttgtgaattcatgacctcagatgtctcagccaggctgccttcagtgtcctggcttatggaaacgatttttttctgatatgaagtatgagcgtatattgcatatattccaactttccaggacttccaactctccttacccagttttcctttccacccacagtttgagacattttctatcatttttctcctttacttacacatgatatttctcccctcctacaaaacttagtgaaaacaactgattattaaaatcctccaagttgtatcaaagagtcctacttataaatatagaagtgtgctttgtttctcccgtaggcacctctgtcacaccagggggctatgctcctggaagggaaataggtcagggtgatttaagccttattcgtcccttccctcatagagaaagggaaacccagtagcaacacacacggcccaggttggcctggaaaatcaagtacttggagactgttcattttccattctctacagggatacagtgtcctcaggaaagggcttccagtactttagggccacacatggatgcttccaagcttaactggggagataatgatctattgctccatttcccttttttggcattttaggtaccactggagaattgtctagaatgaccattatacctggaagttctaacacaggtagcttaacaggaagggaatgcatcttatttaatgtcagatgtcatgatatctcttttagggatgctattataaagtaataccccaatatcctctgtagtattccaattcccagatgtcactattctcctactttttttcctcagaggccacaacttccacaaaagggactggtacttctggaactggcttcaaaactggcacctcttgggtggcgcctggcacaacagtttcccctggaagtttcagcacagccacaatttcccctggagcaagtagaacgactggggctgcacctgccgcagaaaccacaacttccctagaaggaggtggcaccactggagcagaaataaaatcaggagccacctccggagtaccgggaagtaagacaggtaaacttggggaaagcctttcaaatgaccttcaacattggcaaaaaaaaaaaaaaaaaa

SEQ ID NO: 370 - DNA, 4587 bp, Homo Sapiens
aactttatatctggaagttctaacacagatagcttaacaagaaatacctcttattttaatgtcagatgtcatgatttttttaaggcttctctgataaaatatcttcttccagtattctaaattcccagcctttttcattctcctctttcttccatcagaggccaccacttccacagaagggactggtacttctggaactggattcaaaactggtgagaagaaacagcccatgatttggcatcataagtattaggtctctcaagcttttctagagagagtttgtgtttgtgttatttagggacattgcaagtgattcaaaatagatttgctagtggaggtacgttttgttttgaaaatccactaattctaaagtggatcattactgcttcatttctgaggatacgatgcacttctccatttatgttccaactctcgctagcagtttaggtggaattcagaaagtttcagtgcatgtgtgtgaaacagaagagctctgtggaaccaggacacatacatttaacgtgtacatttgaacaaaaatgctggctcagtattttctcctacatgtgaagttcaatacattcaaactctttttcctcctctttctatctcacagcaggcatcactgcagcaccagggaagcaagcagctgagcattgggaaaatgcatctagtttctctcttatcaaattttcagttgtgcttgtacttggaaacattgtatctccttttgttatgaattgctgaaagcagacaaatacatcaaattttccacttgcctcgtgctcagagaaagaggattctgttatggcaaataaatacagaaatatagcatataccttttagattcgggtcctcatttgacttactcgttcactgtgatcacctcagtttctttgtgtttcaggcacctcagaggtagctcctgccacaacggttgccccaggaagtttcagcacagcagccacaacttctcctggagcaagtggaatgactggggttacaacaactacaaagaccacaacttccctaggaggaagtggcaccactggagcaaaaataaaattaggtaaagactttggagtatttgtatttattgttgttctttgatcgatttcttagagaaaaatttttaatgagctttttatttgaaaataaatttaaattacagaaaattatcatagataatgcagagaatctttttaatgtggaatgtgggtttaaatttcctttgaggctgtaatatttcaagaaaacagagtttgttcttggatttggacttgtaaactcttgagaccaaaatttctaaagtctttcccttctgagagactaacctcagggttctaggtctctggagaggagacttgcaataatagctctggttttgaaaaggttttccctttgaaaagggcatagtctgtatgccattagtgtactgatttctacaatgtagaaatcaccaagatgtcatattttagtttagagataaaaattcaaaattgtctttcttccttcttgttctttcttgttttctcctcttctttcttctccctttctcttttgattttcagtaggaaccaccactacagcaccagaaagtaggacaggtaaacttggggaaagcctttcatatgaccttcaactttgaacaaatcttggtaataatattcggggcaggaatattagccactgcgttacccttggctttgcaaaagcacacaataaaccggaagcctgttagtcctcatgtcagttataatttcaggaagtgtgctttcttgcttcaaagtcacaaatagacatactgttggccacatttttccaagggtcatgaaagagttcccatatccatctttctcttttcttttctaccttggcacagctggagtgccctctggtacaagagtcacccctgggagctccaactcaggtaaagcaccaggctgggaggaaccactgcttggaaagtgctcctcagtgaggtgtctgcctgggtgaccctaccgtactcttctcagattcttctaatctttgccctcactgccattctttttccctgttttgcagaggccacaacttctgtagaagaaagcagaataacaagagccgaagtaatcacagaggccacaactttctcaggaggcagcggggccacctgagcaggattacccagaggtaccactggagaattttctggaacgaactttatatctggaagttctaacacaggtagcttaacaagaagtaaatttttatttaatgtcagctgtcatatttcttttatggcttctatggtaaagtaatatcccaatatcttcttccagtattctaaattcccagcctttttcattctcctctttcttccatcagaggccaccacttccacagaagggacaggtacttctggaactggattcaaaattggtgagaagaagcaacccatgatgtggcatcataattattaggtctctcaagcttttcttgagagagtttgtgtttattttatttagggacaatgcaagtgattcaaaatagatttgctggtggagatacttttttttaaatctactaattttaaaatggagcattactgttccatttccgaggatgggatggaatttctccatttgtgttacaactattgctagcagtttaggtggaattcagaaagttttcagtgtgtgtatgtgaaacagaaaagagccccatggacccaggacacatgcatttataagtgtatatgtgaacaaaaatgccggctcagtattttctttcttatgtctcaagttttaatacatttaaacccttttttccctcttctttctacctcacagcaggcatcacttctgccccagggaaacaagcaggcacctctggggtatctcttgccacaacagttgcccctggaagcttcagcacagccacaacttcttctggagcaagtggaataactagggctggccccaactcagagaccacaacttccctaggaggaagtggtaccactggagcagaaataaaatcagctgcagtgccctctggtacaacagttgcccctgggagctccaactcagaagccacaacttctgtaggagaaaatggaaaaacaagaggtgaaataatcacagatactactgagggcacctctggcaaagttctggaacctggaagtgcccacacaggtcaggaattctgaacatggccccttaagcaatatcagctttgggaaacccagaatgtcctgtccagtctttatacctccaattcctccctctctcagaggccacaactttcccaggaggcagtgggactacccgagcaggaccaccaggaggtgagcttgtcaggctgaggcctggggctctcatcatctctctatctgggtggctgcagtgaacagtaatgaacagtaatgcagtgaaagtcttttgagggagggtcctgcattttctctgtggccacagtgtgtcatatcaacctggtcagttattctgcttgtgaattcatgacctcagatgtctcagccaggctgccttcagtgtcctggcttatggaaacgatttttttctgatatgaagtatgagcgtatattgcatatattccaactttccaggacttccaactctccttacccagttttcctttccacccacagtttgagacattttctatcatttttctcctttacttacacatgatatttctcccctcctacaaaacttagtgaaaacaactgattattaaaatcctccaagttgtatcaaagagtcctacttataaatatagaagtgtgctttgtttctcccgtaggcacctctgtcacaccagggggctatgctcctggaagggaaataggtcagggtgatttaagccttattcgtcccttccctcatagagaaagggaaacccagtagcaacacacacggcccaggttggcctggaaaatcaagtacttggagactgttcattttccattctctacagggatacagtgtcctcaggaaagggcttccagtactttagggccacacatggatgcttccaagcttaactggggagataatgatctattgctccatttcccttttttggcattttaggtaccactggagaattgtctagaatgaccattatacctggaagttctaacacaggtagcttaacaggaagggaatgcatcttatttaatgtcagatgtcatgatatctcttttagggatgctattataaagtaataccccaatatcctctgtagtattccaattcccagatgtcactattctcctactttttttcctcagaggccacaacttccacaaaagggactggtacttctggaactggcttcaaaactggcacctcttgggtggcgcctggcacaacagtttcccctggaagtttcagcacagccacaatttcccctggagcaagtagaacgactggggctgcacctgccgcagaaaccacaacttccctagaaggaggtggcaccactggagcagaaataaaatcaggagccacctccggagtaccgggaagtaagacaggtaaacttggggaaagcctttcaaatgaccttcaacattgg

SEQ ID NO: 371 - DNA, 3428 bp, Homo Sapiens
agtgtttaatggcaggttgagtggtgtaaactggcagaaaatgagctgtgatatttctactttaagatgagaatgagaaacaacttatcttgataaaagcgtagaaattggtttcttcaggaagccttccctgcttctctagtttgaggtaagtagtcctttcatgtgttcattatgtcttgtgcttcctcttcctatcagtttatgataatataggaaattattagcctgcttaattctatcagaccaggtgccctgtaaattcacttgttgcattctcgggtacctgcatgggatctggtaagttgtgtgtactgcaagttcttgataaatgaataatgtcattcattgtttctaaataagcaggaatagtaaagacttcaagctattggccacttgactcatttagtcatgcttataaacctaagaattccacaaaaacttatggtttgaatgatttatagtttatttcctgaggatacagacatcattgtgcaagactgggacaatttgattcattgaatcttttacaaaagtttatataaattattcctggatgaattagtcatattattagtcagccatacaaaacaattgttttgaattctttaaggactgtatccaaattcattaagttttcatggtagaagcacattaatcaccaataccatcattttctgcactttctttaacttacttttatttctcacgtctccatgtcatattgttgttgcatttgtaataaactttgcagtaaagacaaccaccatacatttgtatctaatggctaatcttatattaggtgaacttgaaaatccttaaggaaaagttttttcttagtgtttgttagaaataaatatttaatggttttaaaggagtcttcctataaagaactctttgaggaactgtatatgtgtgtatatacctttacttaagttttaagttaatgaggcagtgtttttcctgaagagctagggatatggtatagaaagagtgtggctttttcttttcctgggggaagaaggcttgtagtaatattgtcatgatgttgctggtattgagttattgctgaataaagaataggtgtaaagcaagcatggacctgaatgcttgtcttttattaatgaaacagtaaattctttcattttgttgatgctacctgggcatataacccagacataaataatcacaaagcctaattttgagggtctaaacagaattgcatatcccatttgctttggtgcatcgattacaaagccagatgttaagaacagatgtcaatgagctatttttcatatgccatggttcacatttatgaactctccatttatcacctcagatggaaacggttaatttgacagtgagtgttttggttgttagccaatttcaacatgagtctttggtttttgaaatctgatgtacagagatgtgataaaacaattacaatagaagcactgttaacttgattttgtgccttagaatttaccaacatatataaagtaatggaaatgaatgttcccttttatggtgaatcaacataaatctaatgttggctaagaaataatgtaaatgttatgactgaaatacagagtggttaatccaattgtaaattccatataactgtaagtcagatccttgtagtgatgtatggtgtgatggcgtagtgggttttgcttatttcttctatttgattgtaacaatgatactcatcaaaaatatttcaggcaatgtttgtgctaaatatgtttttagaattggcttcaaaattttgctgtactatgggaaaattttcatattggtgaatactgtatttccaattgtctattagctatgttgatataatacatatttaaaagcagccatctactatattctactaggaaacttaaataacggaaaaaaggaaaaataatatttttatttttaaatgtgtggacagttatctggaatattaaactctttagtatatactatatttttatattttttcagcaactttgtgagatatatcactatttttattttattgttcccaagtctggaaagggatagaagtgggacttaaaggttattttttctctctgttttctattctagttttctttctactacatttcattccctctctttgaattcagaactcaaaaaataatagttactttaatccaaagtttaaagaatggattaaattctaacctaggagatctgattatgttgcaaacaatataagctcttttcatatctttaaataaactgatgactttgataagtataacagaagttggcttaaatggtttatgcttaatcaacttctgtattaatggaagccctccattttctctgtaaacaggctgattataaaacatagcaccttgaaacctttgcatctctgctcctaccactttaattgtatgctgaaagtgagtcagtagggtaatttcaaaaccctacacaaattatatctgtgatattaatgaaatttaattgaatattgcatgtatcagtgaaagatgaaagtgaatgagaaaataattatatctatgaaaactgagtgacatagtttgaaagatacagataaaggttaattgaaataatattaactgaaaatgtacaagattgttggaagaggattatgaagtgctaaaaaccttctgcatttaaattgccttgcaattatttttataattcccagtttctctctaaagaaatccaaactgtcaataatagattgtacacattgctcatagacgatgtaagaaaaatgataaaaaatgcaaagagtagctccattcttcaagaaacagccttactcctacaatggaaaatgagcaagaatttctatattttaagttaaaattaaatgtttgtcatggttatatcactttttaaaataatttccagatttgacatccttttacgatgatcttaaccaatgactgatttcaaatgtgtcagatatgagggattctgttgtttttaaataactaatatctgttgcctaatccagtgtccaagtcacagtgaaggttgttcatagggccaatcaaaggctagagatccatcatgtgaaatctgccaactctggaatctgaattgctcatggtgggcaaggaagaggcaggaatataagtgtgatgggaagagacataatagcacctcacagcacatagaaatggtgagtttttcagggatctgaagtagtatcctggttcagagaagttctttctgtgcattgaagtttgagctgtttgttacaggagtggaagaagcaggtaatgcagggacattttagtatgagattccatcctcagaccttaaagggaagtggatggatgtggtgtgcagaaggatgaatggcctcaaagtaattatgccagtggggattccagtttcactcttacaaatgtgtgtgtgtgtgtgtgtgtgtg

SEQ ID NO: 372 - DNA, 2464 bp, Homo Sapiens
atttatttcaaatcgtagtcataatatttggctgttgtaaatagacactgattttgtgtgtttgctttttttaaggactaatgttgctggacaggcaggtattagagacagggtggatctgctggacaggcaggtagtatagacagggtggatctgctggccagccaggtagtatagatagcgtggatctactggccaggcaggtagtgtagacagggtggatctgctgggcaggcaggtagtgtagacagggtggacctgctggacaagcaggcagtgtagacagagtggatctgccggccaggcaggtagtgtagatagcatggatctactggccaggcaggtagtgtagacagggtggatctgttgggtaggcaggtagtgtagacaggatggatctgctggacaggcaggtagtatagacagagtggatctgctggacaggccggtagtatagacagggcggatgtgctggccaggcaggtagtatagaaagggcgggtctgctggacaggcaggtagtgtagacagggtggatctgctgggcaggcaggtagtgtagacaaggtggacctgcaggataggcaggtagtatagacagggtgcatctgctcgacagttaggtagtatagacagggtggatctgctggacaggcaggtagtgtagatagtgtggatctactggccaggtaggtagtgtagacagggtggacctgcttgacaggcaggtagtatagacagagtggatctgctggccatacaggtagagtagatagcgtgaatctactggccaggcaggtagtatggacagggtggatctgctgggcaggcaggtagtgtagacagggtggatctgctggccaggcaggtagtacagacagggcggatctgctgggcaggcaggtagtgtagatagggtggacctgctgggcaagcaggtagtgtagacagggtggatctgctcgccaggcaggtagtgtagatagcgtggatctgctggccaggcagttagtatagacagggtggatctgctgagcaggcaggtagtgtagacagggtagatctgctggataggcaggtagtatagacagggtggatctgctggacaggcaggtagtgtagatagggtggacatgctggacaggcagctagtgtagacagggtggatctgctggacaagcaggtagtgtagacatggcgcatcttctgggcaggcaggtagtgtagacagggtggatctgctggccagtcaggtagtatagacagggtggatctgctggccaggcaggtagtatagacagggtggatctgctggccagggaggtagtatagacagggtgggtctactggacagggaggtagtatagacagcgtggatctgctagccaggcaggtagtgtagatagcgtgcattactggcaaggaaggtagtgtagacagggtggatcttctggccaggcaggtagtgtagacagggtggatctactcggcagggaggtagtgtagacagggtggacctgctggatgggcaggtagtatagacagggtggatctgctagacaggcaggtagtatagacagggtggatctgctggataggcaggtagtgtagacagggtggatctgctggacagccaggtagtgtagacagagtggatttgctggacaggcaggtagtgtagacagggtggacctgctggacaagcaggtagagtagacagggtggatctgctcgctaggtaggtagtgaagacagggtggatctgctgggcaggtaggtagtgtagacagggtagatatgctggataggcaggtagtatagacagggtggatcttctggagaggcaggtagtgtagacagggtggacctgctggacaagcatgtagtgtagacagggtggatctggtaagtcaggtagtgtagatagcgtggatctgctggccaggcaggtagagtagagagggtcaatctgccggacaggaaggtagtaaagagagggtggatcagttggataggcaggtagtggagatagcatggatctactggccaggcaggtagtgtagacagcttggatctgctggcaggcacgtagtgtagacagggtggacctgctggacaagcagttagtgtagactgggtgaatctgctggccagggaggtagtgtagataccgtggatctactggccaggcaggtagtgtagacagtgtggatcttctgggcaagcaggtagtgtagacagcgtggacctgctggataggcaggtagtatagacagggtggattggctcgaaaggcaggtagtatagacagggtggctctgctggacaggaagggaatgtagatagcgtggatctactggccaggcaagtagtatagacagggtggatctgctcgacagagggaggtgtcacaccccaggtggggctgagtgggacggcatgagacttcatcaagctactcaga

SEQ ID NO: 373 - DNA, 4900 bp, Homo Sapiens
cctcttttcctcctccagtgtcctctcctccactggacccacccatcagtctcaccaagccctctgccctcgccgtcttacctcattttccctctggccactaagggctgtcatcttcacaagcagaaagagcgatgcagagggagaggaaggccacaggtgagagctcctcctcgtggatcgtggctatcggcgccccagagacgccaggcacccccccgggcccagaggatttgctctgtccggaaaggggcgcagtggagaccggcgcagagttctcttccaagtcgggttccaattaactcaacgagtattggatctccggtggtccagggacttggcttcctccatttgcagaaagtccagtgacccagccttaacagtgtgcatccttcgatagctcagctggtagagcggaggactgtagactgcggaaacgtttgtggacatccttaggtcgctggttcaattccggctcgaaggaagcgcctgactcttttgcgcacaatgctgcctggctgcacctgttcctcgtcaaagaccttgcagccttccagtcataactacactttccccaggaaaacccagcaaaatcctgcctttcctgatcacaggcctgggagcctattcattcttcccgaatcctcatagtcttcagctcaaaacagtgccccttgccttgtgacccagccagaccccaattcgtgcccccaccatcctacgcctttccacttgtatttacaaactgcccacccatccccctgtcccagacccgtcaagcttcatctttcctgagctttcacaagtttttatgttgctacagccaagtttggctactgctggaaaagtaaggatatctaatactcagttcaaagtctgcaaaaacacctgcaccaagtgccctgcctacttgggagggtaagggaaagggaaagcgagtaccaaagaagtgcagacttcaaaacagcttcagtgatcctggagagttaggggctattgggtccatggcagggagcagacgtaaagcttgagtgacagctgcctttatacagaggcacgtggatttgcctccttagacaggccactgcctcgtgggtctaagcagttcggagcgtttgctctgggacctagaggcacagttgggttctcctactcccaagaaaaatgtgctgaggcccagtcagagagaatggagtcagaaatggactgggctttatcaatcaagtgaagcttcaactctggggagttggagtgggtttggtggatatgtggcagagaagaaagccaatgagcatcctttggtctcatcacataatcttggaaaaagcttcccgatgtttgatgtaaagatgcaacctatcagagagtactccaaactgaatggcccaggaaagcatggccttctgaagcctgcttaggactggcttgccccatctactacctgctgggtccacatgaactgtttaattgtgcctctcaaactggatactgcacatattactgcacatatctttttcacatggaaagcagctcctggtatcccgccaccgcctattctcccccacgtcaccccgactgtgtcaacctttcttctttggtgtcaccagtgctctgggatgcttctatggctctggaggcacagagagaccccagctccaatgacaccaaaggcaaagaccagctaacaaagagggaccaaaggtagcacctcaggccttcattggatatattcctgatggggcgtggagtcaccagagcccttggaacctttgctcagtgctttggggaaaaaccagagaaacccacagaactttgccctacttcagaaatcagcagcttctgattggaattctcagcctgtttgcagaagagggtatctcacatgtgcctctgcaagcctgggagagatttcctcacctcacttcccagtgcacctcaatgcaccaaaatgtgagcatagactactatgaggagaagggcggggcacctggggaggagggccctgtgtgtgtggtaggggagggagtagagaggccagactattatggaagcgcccattagagacctgcaccagactctgaggttgggttggagttgtcagctgcctatccagcgcccattagggttctcctcttttcctcctccagcgttctctccccgactagacccacccaaccacctcgccaatccctgtgccctcgctgactcaccttctcattttctctcaggccactgggggctgtcatcctcacctgtagaaaggtggatgctcagggagaggaaggctgtcacagatgagagctcctcctcgtggatggtggctatcagagcccgagagacaccaggcatcctcgcccagaggatttgctccgccctgaaaggggtgtggtgtcaagcggcgcagggttctcttccaaggtgggtgccaaccaacccaacgcgtattggacctcaagcattccagggatgtggctccctctgtttgcagaaagtccaatgaaccagctttgatagcatgcatccttcgatagctcagctggtagagcggaggactgtagattgtatagacatttgcggacatccttaggtcgctggttcgattccagctcgaaggaagtgcgtgatgcttttggttaaaagccctgcagcttccaagtagtaaccacactctcccgggcaaaacacccacgaagtctttcctgatcacctagcttcccacgccttgcttctactttgtgaccccactaatccctctattcatgctgaccactacttccccaccctgtgctccttcgcttttcttcacagactgctctcgagcttgagcatctccactggctgtgacaaaaccgctgtgctcacctttgacagagctctcctgaccaggtgggcaaagcctggaaggtcaagttccctggagaacgtcaagcttacttgacaagggtgtaaagtggggataaccgtggtatcttccgtgaaaactcaccctctcactctcatccatctcaggctctttatcactgcattgagatctgacagtctcatgtttgtctctgtctcattctctttctctctttcaccgtttctctgtctctgtatatttctctttgtctctgtgtctctgcctccctatctctcttccctgagccctcagcctgcccctctcattctccttggctggaaatgtatagacctatacaggcgtaaagaaaatgttcattcccactttgctgtgtctactttggggagacagctgtcaccctgagaatttcctaatcctaagaacttccattagcaaggtcaggttgccctttaggttgaggacaaggtgagtctatcccctatccccatagcttttcccaaatccctcaagcctcactttttctgagccttcacaacttttcatgctgctacagcggagtttggcccctgctagaaaagaaaggacctaatattcagttcaaagccagcaaaaacacctgtgttgagtgccctgctacttgagagggtaagggagatggaaggggagtacaaaagtgcaggctggaaaagagcttcagtgatcctggagagttagaggctgttgggtccatggcagggagcagaagtaaagcttgagtgacagctgtcattatacagaggcacacgaattcgctgccttaggccactgcctggtgggtctgagcagtttggagctttgggactagaggcacagttggactctaccctcaccccaaaggaaaaagtgctgaggcctaatcagagagaatgaagtaggaaatggacttaggttttctccaacgaacaggggttacacctccagggagatggagtgggttctgtgggtatggggcagagaagaaagccaacaagcgttccttggtctcatctcaccatctcagaaaaaatctccagagatttgatgcgcacatgcaacctatcacagagagcactccaagccaaatggcccatgggaacgtggccctctgaaaccctctggggactgggacacctgcctccactacctgctgtggccacaagagctgtttcattgcaggtctcaaactgaagactacacaggtctttcttgggaagcagctcctgatctccctccacctccctatttcccccaatgttcccctggctttgtcagcctttcctgcttctcattgctaacagaaggaggccaagctgtggcatcgccagtgcccaggatgattctatggctttggagccacagagagatccctgcctccaatgacaccaaaggcagaggctagcgaacacagacgaaatgtagtacctttgtcccttattggataagttcatgatgggatatagagacccccaggttcttcggaacctctgtttagtgttttggtgggaaaatcagaggtgagccagtgaatgggctttggtggccagcacaagcaaggttgaaacctgggtaccaactcttcctgtttgagccatgacagagtagctgggttctgtgagcatctgacccttgccctcagagatccagacccacttgccataagacagggagtggacttaaactcaatggtggccaggttccttggatgtggcttgctgcacctccagtaggtgttcagctggggggtgggtgtcccagtggtcttggggtagtggtgttgcgggaagtcagggaccccaaacagagggaccggctgaagccatgagagaagaatgtggattgtgaagattttatggacatttattagttccccaaattaatacttttgtaatttcttgtgccttggacacttatcacttccccaatcaatacccttgtgatttcctatgcctctctttactttaatctcttaatcctgtcagttgaggaggatgtatattgtctcaggaccctgtaataatt

SEQ ID NO: 374 - DNA, 15844 bp, Homo Sapiens
agcttctgcccgcgcggagataaacaagcaccgcgaccgccgagcagcgccgaacccagcgcgcccagtcagaccccagggcctgtgtaccgagcatgcgcagttcccgcccaagccaggagcagcgtcaacctgagactcccgagacattaagaattcggaagggatgagatggtagaggggctagagctacctccaagctttatcctgaggcggggagtgaaggagagatgcccaaggcccaagaggggccgcgagggcctttgtccgatgccacccagtctgtcagcactcctagagctttggttttatcttgtattagcatgtgaagctttaaggggggggcacctacaggcttctgactgaagttgtgtaaacgcaacaaaatgaagctttggagcgttaggacattgatgggagggtgacgcccccctctagcagcgcgccagaggggcgagtcagaggcggccacacaccacggaagtcgggtccaagcccgctgacgtcgccggggtcccgcccaccaaccctctggacccgcccacatttcttctagacccgcccctttcggtgccgaactgaagtcgagctcttcccacgccctgtcagccacgggtgagttgaaaacctggagagcggaatcccgaacggcagccggaaggccctggactcctcatagcaacagccagctaggggcatctagtgggaagctgggattcattctagccaaccacatcacgtctctgtaccacaaggtaccattcacgaccaataagagagcgcccccataccacgtgcctttactccttcaaccaatcgagaaaaacgctagtcgtaggatccgcaagcccacctcccagtgccttgccaggcggggctcttcgcgcacgctctgccaaccaatcgtaggtgagctggcgagtgacggaagcttcggccaagccaaccagagctcgcgagccccttgccaccgaggccggcgggatggagacagggaccggctgctggggtttgggaggggcagagattgaggagccagttgctgtgccctgttctggcaaaagaacaagatgcgttgcaagccagaatgatgaattccacttttcacgtcgcctccgtggcattctgcctaaatgatgggcatggaaatggtgctgagggatgtgggctgaatcgagaacacagggacttttgtcttcagggtgagaaatgttccggtccttaaggaaacatcgtgcagcagttgcatgggtcttccaggcgttcctcccaaaacattattttttttctttcactattgagttttaaaacttagcgttctgtcgctagcattgcatcttagttacacatcctctcccacccataacgtcaaatttaggagacgatacatccccaagctttcctgcattattttttgcagtaactggttattcagtttactttctttaaactatgtccttctcaaactagtctcacctgttcgttactgtcgcacatttcctgcgaataacacgtttctgtagttctgttgttagagcctggcatacctctccccgttcctctttcccacaaggtcatcatgcagaggggattttggtctgagttaaaagccaggtattctttcaccatcttttctgtcgatagtcaaactactacaaagactactcaaatttagtagtttcttatttccctatagcttcgttatattagaatggataacttatatttgcattaccttgctgtaatgaacacacaccaagttttcatttaaaattatcaaggacaaatgtcctctgaatttaaaaatgtgtatgtagtaaaatataactcagcatttcttgattacatatcattaaaatatgaatggtactatctgagccaccagaatcagcagtgaaggtattatattaataaaaaggactaagaatcaggactgttttaagggaactggaaccgaagaggatctactatttcatcctaggctagttaacatgaaatagtgaattaaaattgaaagagcttacatggatgcttcatatctgagctactttggcagggatgtttcaagaggatgtaggtccctagatgttgagaagctctggattgaagctgtcacaaaaatagtgagtgggctccgtagtcactccatttagcataatacagagtaggacagctttgtgacatttctcaggctatttcccctgacctctcatcaatgctgacgtttttgataagaaggggtatagagactgcagcccttggggtggttacagttcatttatttacaggccttatattgacaggcctcagatttcatgctcagtaccataaaggttgatttttaaccaccaagaggcaaaagaaacatgacaggtcggagcatattttctcacctattctggcttaaatgatggtacttacctgatttgtggttgtaggtgaaatgttgggtgaaagattagctgctataaaaaggatgtcaggacgtgtagagaatttagaggacttgggtgggagatggatgtctattttctaaccccttagtcatgttcattccgatgccagcataaactctattttgagatgattatagaaataacttatatcttcatttgtttgtgggaaataaaaaataaaaatgatataaaagaaatttgaattattcccaagagctgtaaatctgtaagatagtgaaaacttaacgcagtaactgacactgcaggatccctttagtttccaaagtgcattgccaggagaataaaaagaaagaaaatcttcatttctcctctctccactaaatctgaaagggagttatctcacctatagccagataccttcaattatcgcacttgtgttaccgtggaaacccaagtccatcctttctttctgtaaaaggtgttggaaaaggtggtatgaagtgggaaaggtactgtattctgggacttcctgacaccagcaagaagcaaatatgcagataatttaatagaaacaaattagtagaggatgtttgtaatgcgaggggtacttttcgactgtaaaaccctgattcctaatgcttcttattaaagcctgcatgcctctgattaaacataaaggggaagggcatgtcaagtacatttagcacctgtgaaacgctgctggcaagtataaggagagcagacgatggtttcttgacctgtgaggctcctaatacagttgagaatctgcagtatatatgtggagtggaaaggaaggggcaaaataaactttgttcttcctttaaaaaatgtgatatgtctcagtgcttttgaaaagaaaaggaattagaatgcagaaattaagagtatggaaacaactcaataaaagaaacgtatgggtggagagagtagatgtttcaaaaggccattttaatcagaaaaaaaatctgaaagaaaagacgtaatgattaaaatgtaggcagaaaaaagaaaaagcctgaagaatcttaagagctagaggattctgcggaaaacagagcttcagtgtggttcatttaacaaagcagaagagcaggcacagtgttgcttgcgtacccagcagtttccctttatttttgccaaagaagctgggatgaatcaggattggactttaatagcattgctttccctctgcccacggttagtccaaaagtaggcacgtgactcagttcttgtcattggaatggggagaaggctgctagggctggagggatttctaggatattgacaagagtgaggaaatatccccgttttctgatgtcgctctctttgcttcctgctttacacattgaaatatgagaatgtggcctccatttgggggctatgatgcattatgacattatggtgcaatactgtagaaagccagcaacttcggatggccagggaggaggatgggaagaacctaggtcctgcatgacaacattggacagtcaaaccaacattagaactgcccacatttggacttatggctaagtaaacagctggtgtctttcaatttaagtgtgtgttggtaaggttttctgcatcttacagcaaaatacatcccacctgttaacaaaaagtatgagggattccagccaaaatcgggctttaaaaaatcagcaagcatttgtgagcactttcatttcactaatatctgaacgatagttcaaagatactataatattaattgagtaattactgtgtatattttttaggctctggggataaaacaataagcaattagccaaaagagcttgtattctagcaggagagacagatattaagcaaccaattacatgtttatattataaaataatggttatgcttaaaactaataaggaaaaatcaggaattagaaagggtatatagtaattatataaataataaaatattacaaaatatataactaaataactgaatgaaattacaaaaacaaacactttccaagtaaatgagaatgaaatgtatagtttttactgacattcccagaggtcgagagaaacagtaaattggagtaggttagtccaggagagttgtctgaagcaaattaatattgtatcaggttttgaaggaagtggcgaaaggacaggctagatggggcagaagagagcactctagatgtaaggaaccagaagagcaaaggaagaaagcaggaatgaagtaagagtgaatgagggaaataccagaatcacttgattttttaaattccctgtagcaacagcattctaggggcatctctcagagaaaaagacagaaagatgccagaagtctcaaagcaagattatttaaaggtataaaaataatataggagaaaaatacagaagacaaagtaggagtacaagagtgcatttgaaattaaggcgtcattcaaaataatgaataatttataatgtgggcgtcaaaagagttgtcataagaagtaattatggatttaagggcatcaagaaggagggattcaaactttcacaaatagaaatagaaggaaacatgaggagtggcaaaaaatgaagacaggtagaaaaacagtttttgcttgttatttttccatgatagctgttattgacatgcattatgtagaaatgaatggaatttgtttgaaaagaaaaatttcaatagagcagtaatacataaaggtaggctttttggtaaatagtgtaatttaaaatgttttcactagaatgcctttttgtaccttcctgtaggaaaatcttttcaacaaaaaaagctgtaagtcataataagttacagattagcaaagcatttttgaaataaaaaaaaacccatagatgtgccaaatgtaatagtagagcaacaataataaatatttgtaataaaaatcagaacttgttaggcattatgtggtttctggtcaaatatggttgtactaatttttctaatgctattttctgtacaaatataagaattttttaaattaagctatggtaggtatatgaacacatcttgatattactggaggtaggatttaccactcactttttgtgaccccaagtgtaaccctgaacagacttctgtcttaacaccaataacacatgattgcactgtcttctccagtgactggggaaagggacagtgctttgttcatttttgctttaccagcattcagcacatcgcctaaaaacaattgtgggaattcataaaatgtttgtaaataaatgagcaattgagtggactataatgttgcttctaaaaaccctgggttttgaacacagagaagatgagaataaaaggaaaggaataaggattttccccaaatcaaggtgaggttgatgtaaatgtcctccaaagttggtctaatctccaaagaagcttgtatctcaaaaacagtaagtctccaacaggcaaagtcaatggcagtttgtagacctggaatttaggagtgccaggaaagatctgaaaaatcatgtcttctatcaactgactgttgtctgaaattctgcacttaggttttagtcttttgatgtaaaagttatttttttccaattaaaatgtaagtaggagatatacagttaaattgtaccatcagtctgtcaacttcggggcatgcaactatgcttacctggatgaaaaagaaaatgaagaaagtaaaatagaagaacgtagtttaaattgggggataagtcatggcatgagtatgtgcccagagcgagtataagaaggccatggaaatccactgtatttttgtcatacacttattaatttgtttcaataaggttaatcactccacatggtgtaacaagaaaaataacagcctttacaattactagattcttaaacttatttcaaatactttttaatttttatgagattataagaattttttaaactttgaagctgcatgccttgtctgattccttccatttctcttctgcttctcacattattgtgttcagcaatggtttggaggcatcttggggaagacagagcagagttatggtgtaaggaccatccaactcttctcagcagccatccagttatcttgtcaagggaagttactcatcctgctctctagaattatctcctcaaaaatcggtttcctgcttttcacagaacagtacaccatcttttactattatcctaattaatgcttctcacacagccttacaaaatattagtcacttaattattaaccacattcattgggctgcactagttgaaaaagatgtcttgtttacttagtcaaagcgctgtctctgtgcaatggcattgatggtgaaattgatcagagtctacgtttgaatgagagaagctgagggagacatttcagaaatagtaagcctttttatttccttggtgtaccaggtagtcaaggaaagttaaagtatttttttatactttgtcttgattacattcttttggggactggtctctggtgttaggtttttaataaagattttggccattttccatgcaaactaatgtttccaatgaaaagatacaacattgcatgtaaattacctaagaaatattaatctgtcaatgtaattaaattatataagcaacaattagtttcaaagctggaatggattaagtcagttctatactgcacactgacaaagtgaaaggaactaaaatggacaaattgtggtgctgtaaggttatgattcttaagatttttatattaaagttgcagagtttcaaagtgctcagtgctgctctttacattagggctgtagactctcttaagcccgaggattctatctggatatgtgattgatagggtggaggctgggctgaggcttagtaagacatttaaccatgctttgtataatactccttaaatgttggctctcacaaacatagaaatagcgaacattaactagctctctgtttcaatgtctaccatctacctgtcaacttaaaatcatgaaatctataaatttggagaggagagctttatttcttaccaagagttgcagccagcagggtggccatcctaactggctgggaagtgtaacctcaggcagagaccaaaagcaagttattcaagggaggatgagataggaatttatgctgaatggattggccaagtatatttatttaacagattgtaggaggagctatacatatccatgaagagggggcatgtgcatgaatagtaagcaaacatggatgttacatgcatcccttgttcactttggggtgcagacttcacatttaaatgcattccaattaagccctatatgtcaaaaggtgaagcagggacaggaaggcactcagtgctcagcctctgtaaaccagacagaaccagaagatggtcagtggtctcttatcaggagaaagttactgaaatcagtcttttatccaatcaaagctgtagctgtggcttgtggaacagaggggtcagttagtcagcatctggtgctcagtgagctacgattgtttcaatactgcttatcttgaggccagtgcttgtttagctgctagagaataagaaaaacctgtggcaattagagcatagtttattctataagggtaggggtacgtgacttcagctttttctggcatggccttaggtctcatttattatttggtactttattgccacaaggagtctgttccattagtcttatgatctctattttaacatatctattttgtttttttcctccacttgattccagaaggactaaagtacatttcataaatacatacaagataaataaaaataagaaaaccttcaataaaaatgatctatattaatacatttccagttttagggtcaaatagattgtttcaagaaaccttaacattatctattcaaaataagttttttcagaaactgtgttgcacattggtgtacatctctttaaatagatttcaccttggcattcacactttgtctggctctgtgtgtgttagggttggggtagggggagcattgttaatgcccaaatccttcccaagtctcatcagtgaatagtctgggggaaggagggttgggaatgtgtatattgaacaaaatcctctaaatgattctgacttgcctctgggttgaaaatcaatttaacaatactatgtgttttctgaagtaaaagtcacacttaaagtaactggtgatcttggaaatttttaccaaggatactgactaatgagatggcctaccccaaatccagaatttaacttaaattccacctccccctgttttccttaaactaatctctcaccatattttccaaaaatgttatacttttcttctcatatgtactgcaatttgtcttgcattgtatttatctttgtgatttcagctagtatatggactcatggatgtctgatggggaggagggtggagaatctataagttttttcatctttctaatctttattatgctttagtcaatagtatatattcaataaatgctgaatgaattggattaaatataaaacattaaatgttatgaaaagtatgcttaattttcaaattatcaaatgattctctctattgaagggaaatcaatggtgtttttcaactttgaactgaaactctaaactatatgaaatcataacaatgtgaaattttaaacagtattattcttcataaaacagtaatataggctttaattcacaagaactgcaatggggtctcatcctttaagcagtcatttttaatgttctaaccaaatccttatactaaaacagaaacaactgctgaatgtgataaagtaatggaaaatatagaaaaactcccattttctctatctcattgtgtgtgaaatcattcttaaaaagaatcacttccacttctatttgaatcaaaaatagccaatagggcaattctaactggttaaaaaaaaaaaaaaaaccaacgagaataaaacaaatcaccaaggcaaacgagttttaaaagatatgagtcatcaaggttaaaaaaaattagaaaaatatataaaaacttacacatgtccttgatatagttttgtcttgtgtccccttaaaatttcagtagcttttcttgttgcttagaaatcaaggacatctgattggcaggactttgacaagctgcctaaaggaaactatgatgttttcagtccccatattaaagacccccttttacattccagctgagggctggtataggcaggataggaaagcttacagatggtgggaggcacagaaccttcataggggctgaggcaagaatatccagaagacaggagagagaatgaaagatgccagccgcctcattgtgagttcacagtggctgccttggtcgggagcttttggcatggttctcatgaattacacaatctaatctacttctgtacagaagattttagaggcacagttgagtgtgctaaaatggcattactacctactcagaacatgatgcttctgtgtgcccatatgcccaacttattttcaaatgtatttgagaaaaatagaaaataggcattcttagtactagagacatacaataaaaatgcgcatgactctatccatttgtaggtttcttgggagttttatcaggctccaggggacccatgtttgtagcacatgagttctctggtcgtagatcgttgatgtggtcattggcacacggtgcctagctcatgagccagtaagatttgtttcctcctaggaatttagaactggagtccagagggtggggctgggcatttgaactaggaagtaaggaaagccacactgggaaagcctttgatgggctgtgtgtacaactcagcggaaatgccaatatacagagaaatgtcaaagaataaagtcgattcttagagaagtagtgatggctcacttagttcctgagagctttcctactcatgaggagatccaattgcattttctaccattggcattgagatccccgcctctaccccaacattacactaaattttcctttaagttagtatcagtggttttctggttttctattacaaccagaaggttcctgaaaaagacaaaattatcctgttagatcatgttctcttatatctctgttagaagtacattggaaatgaacagcattctattgtcagtttgtcagcattaattataaagtatggcccaataatttttcagaacctaattgcatatagctgatgacagtggcttctggagctgttttatgatagtgttagttagagagtcctgccagattccctggaggagatagtttgtcctttctgtaatgttggaaataatgtctctcgtgcaggtttaataacaagatgcagtgcaaaagctccaggcactagccaggtcatgtgacatgaggcttgggatcagcttatctcacaaacccagacatagaaccccgtgccagccccacaacaagtggacaatccaggaggatttgagtatttcctcagctattcaacaaatacagagaggtggtttgcttcaataacaataaatagttatttattgttgtccttatgcaacaacaattctccagttgtcatctggagaaactgaaaagtaatatgaaatcatctagttcctctttaagacagtacttgggatcctgtgaatgcaaggatttccttattgtcctacctgcagggaggggcattcagggcttctggatcatagcctcggtcacattttaaaacttgacataatgtctaaaatagctgtatttatattttaaattaacttgaaaatgaaactgctagaccatataatttacctactaaatttggacacttttgagagtaaaacgggatgctattaataataaaatgaaagcaggccttggaactgacccaggcaaactggatgatagtattaccctattcttaggttttgcattcttggtttgtgagtaactcacatattgggaagcccaacaatttttggcacggtttttgaccaaatcaaattttagccgccattttggagtatggcccacgatcccaccacgagtcactagctatagaaatgagcttctctagggcttcagcttcttcacctttacaattgaatgggtaactccaaatccctttcagcactgaatagtccgtaatcaatgacacatctatgaaagagttttactttttggagaaatttgtattattttgattcatattcaatataagatacagaatatgaatatccataaaagaatattatgaataaggtttgtacacattataaaatcatactgggcagcatggcgtagcaacaaacacctggactggaatctagccacttatttcctctgtgaatttgccgaggtttccaaaccatcctggatgcctaaactggaatactttcaactgtaaaatgggcgtaagaataacaactttttagtaatgttatgagaattaagtgatatgtagtgtgtgaaggtatcaaatatataccacataaatagatgtatatgatcattaaatactagttcctcttcctattagaaggttagtgtcattattgaatatttaggtcataaatgtgcactgcaccttcttataactaaagtaagaatattgccaatgagtttctctattcccaatattggcttttattgacacagagagcaattacgtcggatggaagcacatccatgattacaggcatcatcaaagtcaaacacacctggacccaaaagccctctttcttcttttagatatatgacattgggaggttacttaggcttacagagtctctcttcccttatctgcaacaatgaatgagataatgtgtatagatcacgtggcacaggtcctagtgtatattcaataatatgcattattgttactcattattgttaatatgggagaagagaaattaaaagtctccatttaaaggtgagagagatgtttccataagaagagcttatagtgcatgtggacttcagaagtgactataagtgaagaataatagttgagaaagcaaacccatgagcatgtcgtgggtttagcattatgctaaacagcagcattgtgctattcccactgagaataatgtctttcatggacattgtggaacgattatggactggtcatgatactatgactcctgagaattctaacaccttcagattcacagtagggctgcagatgtgttttacccatccagggctcctgacagtgaaatcaaaggcttggattgataaactctgcgaacaatgtgtattagtccgttttcacactggtgataaagacatacccaaaactgggcaatttacaaaggagagaagtttaatggacccactgttccacttggctggggaggcctcacaattatggtggaaggtgaaaggcacgtctcacaggtggcagatgagaaaagtgagagccaagtaaaaggggtttcctcttataaaaccattaggtctcatgagacttattcactaccacgagaacagtatgggggaaaccacccccatgattcaattatctctcactgtgtccctcccacaacatgagggaattgtgggaactataattcgagatgagatttgggcggggacacagccaaatcatatcacaatgttaagttgctcttaatcgttttattgatgaagtacaacaggttgattagtaatacaacagttttatctgagcctcacttatctgttttgtaaatgttattttggagaaagccactcctacaatttgtttataagaagtctagcatggagtattggtgatcacatttagagaattataactgtgatattaatgaagactgacaatgtggatgatgacgatccaattcatgtgcatcagaaaaaaaaaaatcacaacttgatttttctacctgctttgtttcaattaatcctaatttttagaaaacagacaaatgcaagacccagacaagggtctttgcttagtaaagatttggaattttctcatgccaagagatccttttctgaggccttttccaattgaatccaaagtttgccatccaattcttccagaggagaggggtctagatttagtagagtattattattattattattttgccaacttctagtctctccttcatgtatttgacagctccttaaagtttctggctatagcccagccctccagctccctgactgagatgggacctatcggaagcatgttggtgttaaaatcccaacttgcctccattcctcaagccctggacttaaattggggtcctctggccctgtggatagccttaacctcactacctaatttccactccaggtttgaatttcttctctgtttctgtatctagtgagttcccattctatcttccaatcccggctttaatgtaattatatttgctatatgttgttcaataattacaagtgtttggaatggggccaagggccctttctcagcagtttagtctccagattttggtataagtgaagattagacttctcctgatcttcacatctttcagaatgccatttctaatttttttcatgaacagaattaacagaggaaaccagagccagtatctaaaatctcaaagtccatcactatatagcagcgccaggatctaaaaatctcagagtccattatatattgtgatatagtccatcacaatattttgggaaaacaaaataaaacagtctcctaccctaaaatacttagtatcttgaattaaaaccaccaaccttaaaccctgatggcagtgaaactgcgaattttaaactttgccaaggagctggggttatttgttttactgggaataatcacaacgggtcaggtagtatttgtggagggttcacttttgagtaggagtacgggggtcaccacaagaagttctgtccacatcaactcaacccttgaaggacatggagcatgcatcaggatgcagatgtatgcttgcctttatggtgtgcaagttcctatcagtgagccacactgttctcagatcctcagtgtccacagtgttttagcacgttttttatttggtaccctgaactataggactgggtaccttcacggtagcttcagtcaagatgtgattggtgtagaggcattcactgacctgtgtagggttttcctggatttgttttcctttgcagttttggatggctggttctcttgggatcagtgatgacaccaggcagtcagagtaaggctgtgctctggcagggactgatgaggcctggaggagcagggatgtgcacgactcacaatatcttttttctttttcctttttggcatttaaaaagcatcagattacattgtgaataaatccatattggaaggttatttaagtcattaagcaccagtctgccaaccacataagctgtatagtagcctctagcaggctgcttaaaggaaagcggcctgaagattgatccaggatgccaggacttgcatcctaaaagtcaggctctttgtattcttctgcctttactactgagggaaaggagtaggggaaaccaaggtagagtttcacgaacctccactttccccctcacatcagctctcagcaccaaagaggcaagttaggaaacaacacaagtgtccatcaacagactaaatggatgaacagaatgtactatatccacatagccgagtttcagccctagagaggaaggcaattctgacacatgctacaacatggatgaaccttgaggacattatgctatggtgaaataaactcatcacaaacaaacaaatactgtatgattccacttatataaaatatctagaacaggcaaattcataaatatagaaagtagaagacaccaggggctagggggagaagggaatgcggaattgttgttgaatgggtataaggattctgcttgagttgatgaaaaagatcaggagagggatgatggtgatggttgcacagcattgtgaatgtatttaatgctgctgaacttaaagccacttaaagtggcttctgtctgtaaaaccacagttcttaaaaaggcaagttgaggggattaccacttctggaaagatggagtggattcacttttctctatttctcactgagcacagctaaaacccctggacatgcatgatatgtagaacaaacagaagagtctaaaaggtggagaaaagaaaacaaagcctccagggaccttgagatccaataaatgacacaaatgtgagtttcctcggttttctttttgcttcatataacccagactgcgtgctgcagaagtctcccgcttggaaacacaccaataattgcaggcaaaaaaaaaaaaaaggccctgagtaaaaggcttgacattgaaggtgctggtttcttatttgttgagggaggggaggaggtggagctacaatagggtgactcgatctctaggcctagggagtagcccccagatcactgtggatgcaaacttgctggaaggatctcaaagacacccattgactcccctaaatttttcctttattcagattatgtaaaacttttgttttactctattcaggttaaat

SEQ ID NO: 375 - DNA, 630 bp, Homo Sapiens
ggctttggtcacagtgaccgccaccgttgcccggggatgggtccctgagacttggcgaagtaggagccctgtgtgatcgtgcgtcagagtcggggctgagaccagtcctggccagggcagttaccaggacggtctccggaggccgggatgcgcggaggctccaccagcaggaagaaacgccaggaggaagaaacctgagacagatcgccggggacgcagcgcgggatcccagcctcaggcttgcgcggacggtgtgcggtgaaaatacaatgagaaggcagctgtctgcaagccaggaagaacccttaccaagaattgaatctgctggcacctttaacttggacttgccagcctgcagaactgtgaaaaacaaatgtcttttgtgatcaagtgccaagatgacttactagaagcagctagtatgctccactctcgtgaaaaggaaatagactggccagtaaacactagcacttcaactggatcttccaagaggacatgttgggattcagcaaggaagcaacagaagccatggagaacaaaaacagcaagacacaacagccacccacccaggattgggtggagtcaggggaggatccttaccacaaagaaatagtgactgagagagagccc

SEQ ID NO: 376 - DNA, 1513 bp, Homo Sapiens
tgaaagaattaaaagtaaaaataaaacttgttagccttacagtcagaacatgtgggtaaataaatatgaaaagagcgaatagttaagctggcttaagaaagagatttaattgatagaaaaattaaacttttataggagagtctgggtaaatttaaccagtaagtaaaaacttaaagtccaatctcaacatatataaaggaatctgtataaactatatttgaaacctggatgtatgtgctcttcaaaaagttattagataagttttagatatcataaatattatcagaccagaaatggtgtatggaactcacagatatctaagaagacaagaggtgggatctcaaaaatcatgctctgatttccctaaaggatcagaagatctcagaatttatggagcagtatctcctcaaatcagaaagtaaaggatgcacacaaagaggaatctggaaaacctcccctttatcactggatggctatataaacgttcttaccaaaaatctgagaagacattcagggagatcagcttcgtctacttcaagcattattaggtggtcttcaaagtcttaggtgcattgaagaaatattttttaacgtattattgaaatggtatttgaatggaatattttgtaaaaataaagcacaaaaaaagcagatagataggagaaatatagaagaagtccaaaattgatttggaagttgatcatatagggtcagatgtctaaatcagaaaatggattggtggcagatttcttggaatagtgtgtaattttgacaaagccacctttcaatgtaatctcctgctaaagttgtcacctttatctctcagtctcttttcttcacattgatcgtaaagcttttgcacatttcttcttttagaagctcgtcttcctgatttatgcatgaattcctcgtttttgtcatttattcacaaataaagattacctcgtgtagaagctgtttcctttccacttgctagaagttattttgccaatcacatatgattattttatcattttttaattaccatcagtgcatgaaattatctttattattcacttgtttttattataatcttataatttcaaataaaatgtaaatctactgtcccttgctttacctccgtgtcttcagtgcctagaacaggactgtcatacacagtgactcaatacacatttacttatgggtgattccctgcctgactgttacaggaagaaggaccaggaatatcagaatctgaagtgtcctctaaagtcataaagactagaaggcattgaataatgtttcttaactatgcaaggacttcagaattagatctcacatagatatatacaactgtgtgtagattcgaaaaacagaattaaatgggtaaaacttttaggaaaatgtacatttttgagttaataaatgtatataaaataattattaatgacttaaaaatatgatcacagtgttaaatgtgtcttttgtaaattatacaaatatgagttttatttattaaagcatttcaaatgtt

SEQ ID NO: 377 - DNA, 1062 bp, Homo Sapiens
catcaagaaataaccataaaaatgggcaaccagcagctctcagggctgctctgtctatggagttgccattctcttattcctttactttcctaataagcttgctttcgctttatggacacaccctgagttctttcttgtgcaatatccaagaatcctcacttggcatctggattgggacccctttcctgtagcaaattccctcttctgtctgggttgaggcacaggtggttgggtcacagcttggatttatacattttagggagacatgagacatcaatcattatgtgatgtccataagttgggtccagaaaggcgggacaacttgaggcagggaaggggtttccaggtcataggtaaataagttgcattcctttgagtctctgatgaaccttttactgaatacacaatttacctgtgagaggagggtagaggaatagtcacttatgccttagtctgggttagtgaaaaaatagggcagaggaagcaatcagatgtgcatttgtctcaggtgagcagagggatgagtttgagttctgtctgtcttttgtccaaacgcaatttccttgtgagcaaattgtagcttttttatcgttgtagctatcttatttagcaataaaatggaggcaggtatgcttgactcagttcactgtttgacttccttttgccttagtgattttgggggcccaagatttcttttccttttgcaaagtgtagaatgaaatcccgaaatatttttttcttggtgacctttctctcctcaggagtggagatctggtctactgtaaacaaagggtatcgaaacaatggaacaaacgttaatttcaggaaacaaaagaccagaagttcaaacgttgaagaatgatttcactacgtgaccactgaacaatcacagatatacattaattccagaattttctaggttttttcataccagagcatcaatacccctaaaaaccttttcttgctggccttgaccacccttcgtactaggatgtagtgttgatgttttactctgcctcccaagtagctgggattacaggcatgcaacatcacacttggcta

SEQ ID NO: 378 - DNA, 2364 bp, Homo Sapiens
agaatgctggctgtgcgagtctcccaaggtgcgagctttctttctctctgaattaggaggtgaaaccatttggaagagccattgtaaaggggagggctttgggctgtgcatactcctcatatccaggtgagttcatttttcttgtgaacttttcacctaggccccaattagtatcctattaacctccttaaatatggaattgctaagatcttagaatactccagaatggactattagccagcccatttcctggctccatcagatgaaaatgccaaagtaggtcatacaacagaattatcttgattaatttcagctctcttgcatgggccatgatgtcatgcaagttaaaggagattcaaatttaatgcatcatttcaatgactgattaaacatgggattttctgaaaaacatttacaattccaggtttataaggattctccttctttaatatgacaaacatttcaaatgtgctaaattgatcaattatacaaatgataaattcccttgaatatactttttcatgttcatgttctccagggcctaatatggaaaaaggtttattatccccagtaactactatgttagatgaaaagctctcagcattgtgcccctttcctatccatggatgcaggctattaaaaaacaaaacaaaacaaaaaaacactatgaagatgccacatctactccagaagcctactcagaatggcatttccaaatataaatggctttgctaaggctaaaaaaagcatcaaactttacatcctttatcatacattcctaaaggactcccttgaaaaaagcacttaaaaacattgtatcttggaacatctcatatattggtgcaatttatttacaagagtcagatttaatttgttttcatgtataaagcagctttagggacttattagcaatttcaaatgttacaggaaaatatgctgaatctaaagttcattatcacaagtaagcttatttaagtgagattatttgtttcttaaaatgtacaagatagctagttctttaaaaggcttctgttgcatcatttcacttagaaataaagcttttggatgcagctgttatgctctaaagtcagggttgtgtctgttttgtgtttataagtaacatggacacagcctgctactataaacactgaacccggcttaacatgttcctgtcttttccagatgaaaatgcaacttactttcgtgatttaggttatgaaactttaaaaccatgtcacattttaatatgcaggggttccttcctgtaataacctgcaatgtatattcatgtttgcaatttctagcaagaagtaaaataactgatagcttttatgaagcatctttgaactttgcaagttccacttgtctgaatcagagcttcacagacacccacttagcacagactgggttgtgccagggctagagtaactgcctgccaaagggatcctggccacccctcctcttctttctgatcagtccactgatcactaagaaaccagtggtgagctgcttaccttttagaatatgaataaataaagagcttgccatgatcaaagagactgaaagcttcagatggatgtttatgctactgagccaaatgtaatgttcacaaaaattagggagcttcaggaccccgtatctctactctctgaaattcaacttttctcagatttaaaacagagggattcagcttttctagaatctatgtgtcaaagtggacttatctgtcatcagagaaattccatcctcatattctaacatcagattattccaatacatgttctattcatcggtcgccttagttagaaaattaggcaaaattctaaggcatctttatgcggtgacataaaaaaaaatgtattttggtagtagttgctagaaaaatatcatacttcaggactttagtcacttttttctccatctgagaatttatgagagtccctttaactcacttatgtatgtttgaagtatctttatttatttatacactttccaagcaatgtaacttatgtgttgtatgattaaaatgtagaaatgaaaactcaggctgggcacggtggctcacgcctgtaattgcagcactctgggaggcagaggtaggtggatcacctgaggtcaggagttcgagaccagcctggccaacatggcgaaaccccatctctactaaaaacacaaaaaatagtcgggcatgttggtgagcgcctgtaatcccagctactccagaggctgaggcaggagtattacttgaacttgggaggcggaggttgcagtgagccgagattggccactgcacttcagcctgcgtgacagagggagacattgtctcaaaaaaaaaaagaaaaagaaaaagaaaaaaagaaagaa

SEQ ID NO: 379 - DNA, 2766 bp, Homo Sapiens
agcaattggctggggtgtttttccgctctgtgggagatttgttctttcgctttttgggtccacgctgcgtttgtgagctgtaacaccgtgaaggtctgcagcttcactcctgaagtcaggcgagaagactacgaacccacctggaggaacgaacaactccagactcgccgcattaagagcggtaacaccgcgaaggtctgcagcttcactcctgagccagcgagatcacgaacccaccggaaggctgtaacatatctgaacatcagaaggaacaaactccggacaggccgccttcaggaactgtaacactcaccgcgagggtccgtagcttcattcttgaagtcagtgagaccaagagcccaccaattccggacacaacaggacacactgcggcttctcctggctttttcaaagttcagcccaagaggaagagagacctaattaatacccaggagatggtggtgtttattttttccagctgggacaactaaggccccgagaggagaaagggactatccggggtacagaggccactgagtcagagctaggaccaacatatcaccagctctccctcttcagcgcagaccccaactcaccagcggtggcttcctgaagagctgggttaaggaggattctgaggtgcagcagagctcgctaagaggctgacgggtaaggggtgctgcgctgtgagcacaggagccaggtgggtgttgcctgccatcccctctacctctccctcttctctctgccacctcggtttttctccatcctttcactcacccccgacccgccattgtttcacctgcccttcgttgagagtaaggatagggcctctgctgtgcccaggccacgtttctgggcctcttttttcctctcccaggtctgaaggggcctcagtttggggttcttaagggcccagagacctgtgaacagttgctccctcccctacttagtggcccacgtggaactcaagagtatcccgctccgtggctgttcagaaatgcagcagcacagcccccaggcagcaatcgttcaggagcgctgggaagcccacagccagcctgagccctccgagatgcctctagactctgggcccgggatcaatacttgggagggggagagcagatgtgaatgcgatgcgggcacacgcacagcgtgctgctggaggcccagctcagaggagctgggccagcctcccccgccctctcctttctccttgccttgcgggggccaagagggctgtggagggctctgctggagtctgccatctgctgctgaaaacatctgcgcttgctgccttccacgcagacgagctgtccgtccttcctcctccccctcttccgccaaggctattcagacgggcgtgcaggctgcgggcagaggtcaggaagctccccggcctgtccaggcacgagacagcaggcactgcctctttggtacctaggcagctgtgtctgcgagtccctggctctctcccaggtgccctgctttaagaaaatccaataggaacaaagtcctgtttgcaaagtggacacctgcgggcaatgtatgtctctgtctgcattgcacagagatcatcctgagcgattcaatgattttttctctctgtgggttctaagttcttaaccagaaaaggagatgttaattgaatcacctgggaggtttttcaacatgcacccggccagtccccatgtttcccactctcagacaaaacaggtttggggagaagagtttgttgaaagaggtccctagcacccagtgttgctgacagatcccctccccacctctccctgctctgctacccttgcgcatttcagcttttatttaaaagtcagtaactacctacagtggaggagggggctttaaagctgaactgttctatctcactatgaattaaagatcagttagaaatgaaatttcaacacccaagaaaagaataggtacatttattagaaaatgggagtgctgtatatttaaatttttaaaatgtatacagattaggtccataattcattgtttctataaaatcatatctgtggcaagcccctgcctccacagaaacaattttatttcatagagcaatctatttgtaagcatggaaggaccattatagatcctaacagtgtcctttaagaatgaggacacagagttgacccacttctcctagtatatgttggaattccaaattctatcggtttatttactcatttattgagacggaatgttgctctgtcgccaagcctggagtgcagtggcgcaatctctgctcactgcaacctttacctcccaagttcaagcgattcttccacctcagcctcccgagtagctgggactacaagtgcgtacgtcatcgtgcccagccaatttcttttgtatttttagtagagacaggttttcaccatgttggccaggctggtctcgaactcctgacctcaagtgatccacccgcctcagcctcccaaagtgctgggattacaggcgtgagccaccgcacccggtctctatcaagtttatttgtttgtatccacatggaaaaggtaagcccccttctgctcacaggtactatgtctgctttgctcactgctatatccccagtgcccagaatggtgtttgttgaatgaatgaatgagcacatagacaggtctactggtggctgttgcattgcagggatctgtgagaatgcactgatgcgtacatctgtgtcattttaatatgtccacttctgtgcatgtctgcattactaatgcatgtttttatggatcgagc

SEQ ID NO: 380 - DNA, 2362 bp, Homo Sapiens
atcctttaaattctttcactatgaggaatcagaatgttatgctgcatctattcctattaagttaaattgcaagaacactcacttaaaaatgagaaagtagcatcttactatttccctgtgcttttctcctttgaaatgtttttggaacactcttgggacagtagacacatttttcattttgctgtggacttccattacctcatctacacaaaaaagaaggtgtaaaatacattcatatgtttaaaagtggcaccaaactaacactctagttagtactgttttataaacaaaaatatagggaacaaaacaaaatattagaaatataagaacacactgaagcagccaagatggccgaataggaacattctaacataccacttttaatttggatagtgaaattaattctacacatgagcacattacataaatcaaattattaaagaaattattagtatcttcacagggaagatttttaccagcatataaatgttgcaataattctcaaattaaaaagaaaagatgtggaacagagattggaaatccaattaatattctcattttctatttctcctttgtgcaatcaatgctacatttatcatattttaattcatgggaaaggcaaaccttataaatgagcacgtactcacgagattgagcacagaaaaaatatatactatgtcttattcctactttatgtagtaaataaattctttgtcctttgagagcaacttattcaaaatttgtatgctacagctcctcttccactaataatgtaaggctgctagagtcttttcctctttattgacttgaaagtgtgcatatgtaagaagcagttatttggcctaggatataaaaagctaaaataaatttcctattttctcaattttttcctgatgaaaaatatttaaatgctagctgcattataaccttcaaaaacactcaataccagcccttgaagtgttattaaatgactgaattcaagtaaatgctaaaggactttaggttaaaagccaaacaaaatggcatctatttatttactttctgacaacagaagcatttaaaccctgctcttctgaaatccaaaatatacaaatttacaaatcttagccccataattgatgagaaacatgctaacaaatctctaatgctgagccattagttaatagtcatttttctcaacattctgaatcagataggctattaagatatttactttaaaaattttatttgtgggggaatgggcaaaggagagagagggctggttacagctgtctaaaattttatttatacatataaataaaatttatatataaatttatatgtaaatttttagtgtgtgtatatatatatatatatatagatagatagatagatagatagatagatagagagagagagagagagagagagaactacataaatatcccaggaatgaagggccttcaagaaggtaaaacatttcataaggcatctgcccttaattgtacttaaaatataaaagtaacataatttctttgtaactagcatcttctatcaaaaaaattaggattacatacaaatgtgttgcgtgtattaaaatattaaatactttaagtaaatttttataaatatttaaacattcctagggatagatattacagaacagaacttcaatttgtcctgatggttattcacaactgcctccaagaaaaactatttttacctagtctgttctctgtgtaaacatagcatatatgcttagatttattccccgaatacgttttccaatatttgtaaattgatattagcgtcaaacataacattaaactttttggacaattttctgaatttagccaaaatagtttaaaggtataacgcagtaaaatatgattagatatttgaatgaattcacattttggatgactcagacactttctaagtatcaactcaagttttccactaaaataaattcagcttcttcgtaaattaattattttagaatcctattctttttacatctttacatcagtcatcacttgtgctagcttaatgtatctatatctttttaagatataattatccaaaaactgaactgtaactggcatataatcaaattataaaaatattttctagatcaaatgagtattaacatttctacatcttttaaataacagtttggatatgtgactcatggtaagtttttcaacattagttgttcccaggcagttctacaattgagtcattcaagatgacttgcaaatgtccctggtaaacctcatacactgtgacttgtctaggaattttggatggtattactgttttcttacttataacatatactgtagttttatataaaaataaaatgaaaagttttttcattaat

SEQ ID NO: 381 - DNA, 1782 bp, Homo Sapiens
gagaggtgttaactgagttgagcgttaaagaatgggtggcagttttgcaggagtgaaagcagaagctcagagaacctggtgtgtttgagaggaaggtgaaaggatttttaatgcacctgtgagccaatttttggtttctgaagaggaggaaggatgcagagtaaaaggaaatgtaaaagtgttgtacaccagctctcagtaaccttagaagatttatatgatgctgcaacaagaaaacaggctctgcaaaataatgtgctttgtgacaggtgtgaagacagaggtggggaaaaaaaaaaggaacagtacagtgctgtcataattgccaaggtattggaatgcaaataagaattcatcagatagaacccggaatagctcagcaaattcaagctgtgtgcatggagacccagggccatggggaacagatcagtcctcaagatagatgtaaaagctgcaacagaaagaagatagttttgggagaagacgattctagaaattcatattgacaaaagcatgaaagatggccagaaaataacatctcatgatgaaagagaccaaaaaccaggactggagccaggagatattatcattgcattagatcagaaggaccatgctgtttttacttgacaaagaaaagaccttttcatatgtatggatatacagctggttgtagtattgcatggcttctgaaaaccaatatccactcttgacaactgaaccatagtcatcatctctcatccaggtcaaactgtcaagcatggagccatcaagcatgtgttaaatgaaggcaggccaatttattgtagaccacatgaagagtcacttaatcattgaatttaaggtaaactttcttgataatggctttcccttttttgacaaactccttgctggaaaaactcctacaaaagagtaaagaagtagaagagactgatgagatgaatcaagtagaatttgtggactttgattcaaatcaggaaagatgatgctgatgccactacagtgcagaagcaaatgtgggaccattacaatggaaaagcatgaggatgataaacatcatttcagaggtgttcagtgtcaaacatcttaatgggaccagtgataatactcgctgctggcattttatgggcagtagtgaatgagcaaaggactgtaatcctaatatgctcactacttgctattgttttggttttactattcaactagagtagtgttttaaaaattaaaggaagaataaatacaatttttttaaaagttgacaaggatgagcatggccaacaaacctctctccactttggcaacaaatagttttaaatttggtttccagagtaagttaatagaaggtataacacagagaaccagaaatacaaagtgctctattagtgagatatcagaagtgattattgctgattattatctgatattttataaaacaatctcttttgagatattaaatatatactgagattcataaaacggtagatacctaaattatctcatttagtaaatcagtggggctatttaatccagataatttaaaccctaagaataattttattttccagtagattgacttttacttattttatttattttcttttacataaactcagagggaattacactttttaagaccatgtcatttaatatttccagttttaaagagaaatagagtatttggcataatgaatgcctattttactatttgtctttatgtcatatgtaatttttcctcttaaattttattttaaatgtgtttcaaagtccaataaagggaacactaat

SEQ ID NO: 382 - DNA, 1746 bp, Homo Sapiens
atacttcatttactcccatgtggcttgtgcctgattccaactagatttagtcatctctacatacgttttgaaatctttggattctaactttttctagtttcactaaggatatatttggttctttttttctctgaagtcacagggcgggagagtaaaggagtagaattttcaacctaagtttatatgattctaaaattttccactaccatgctgctaaaagagattactcaactagttcttcctgttcaggtaagtcagttcagactttgctaattctgaataaagaggacagaagttatgatgctgtaactatttgacatagactgtgttagattagagatgagaggcaaaaacttgaccctagtatatttgctttcattgattccaatgtcatctttaggtttttgtatatttctttctgattttaacatatgatcctttattttcttcttactttcctcccttcatcctttctctgtcaaattgttttcctcttcctcctcttttaaaaattctcaaaatttgactataaattgctttttcttctttgctccttttcacaactctttcattgccacaaggcattcaggtagaaaaaaaggccaaggtagtctgcagtgtgctagctatttacccaattgacccaccatatcttttatataaacaaataaattaacaagttatgtaaataatttatattcaaatattcagaagtgtcttagacatgtttaatatgctacaggtaaactccttttaggaggagaccacatgcagctttagaatagaaaatagaagaaaggaaaaaaataaacaaatgaaggtttttctctgcagtctttatgcaagcaacgacttatttcttaaactctcccctttgtggctatcactcaaagaaaataaagaagaaaagctactggctttctagtttaaatcacagtctcattattctgtaggtgaatggggagggggattggaatcgtaggtccgagtgggcagtaacttgaagtcaatggagatatatacaaaacagaagcacaatcacgatccagcagttctggagctgctaactttttctgcctttttctaaatgtccaataataaggttctaacggagactgaagatccatcacctgctccacatctccagggggcccatgtgtgcatcgcagtgcaggtcatacatgcttctttcccctcccatggcaaggggaataccgaatgatgacaactcacatgtgtaacccaagggctttgctacagtttactgaggactagtgcacgatacattctttgagtgttataataacattaagtcaatgcacgaattataatccctatttcacaagtacaaaaacacattcaaagaaattaaattccttgctcaccaaacagttattgacaaaaaatacaacatttatgtttcttttgaaaaatattataaagattctcaaattgtctaaccaatcatattatccgtagttgtctcttctcaagctgctaataaagacatacccaagactgggacatttataaaggaaaaaggtttaattgactcacagttcggcatggctgtggaggcctcaggaaacttacaatcatggcagaaggggaagcaaatatgtccttcacatggcggcagcaaagagaggtgggaaaaaggagggaaaagccccttataaaaccatcagatctcatgaaaactcacttactatcaggagaacagcgtggaggtaactgttcccatga

SEQ ID NO: 383 - DNA, 2170 bp, Homo Sapiens
acgaaatgtgtttaagagttcaactcacaaatttagtttatttctctgcctataaatagagatttgtagattcttataggtagagaaataaaccaaattccaactgctccttatgatcattcctctaggtgttaagagtgagagagggaaggcttgacaaatttactgaaagaggtatgggagtgtgaaagctttagacaaggtacaaagatccactctcagaaagagaaaatctgaaaaaagctccaaaacattgatcataggtttggagtttgatagttcacagctctatgtatggagaagagcttaaaggtaagcagtaccagaattggtagctttaaattataagcattgcctcataagggaaacatgaagacttggagacatgtcagtgaagacttggaaacatggcagtgaagaagaagaaagaagaaaaaattcttcaggaaaagaaaaaaactgaacttagagaagagggtgttcttgaagtaggagctctgcctatgaaatgaacagaaatagaaaagagcaggccacatccatacagaactgtaagaaaaaacaaacaggaaatgtgaatcagcatttcaactgatgaaaatctacccccatcaaaaaaagcaggaaaaaattgacacaatgctccaagtgaaattaaacatcctcaaaccaatgtttggagatttgaaaaataaaattaagaaatattctgaaacaaatacaaagaacaaaaagcattaagaaatgaacacaaagtagattaaacagaaaaatagaagataaaatcataaccaataatgaagttttaacattcccacatttcaaattcaaatttaataaaaagtcttgaagaaaagcaggaaaacaggataattgagatgagatttttgttttgaaaattgaccaagttgaaatgggagatggatccaaagtctactgtatataattggtgtccttcaagaagagaaaatatttaaaactataatccaagaaaactttctggaagtgaaaagagatctgaatctataccacagaagttcataccagaaggcacactcaaagatatttcctagtaaagctgtatgactgtaaagatgcaaagaattctcagggtctccaggcaaagacgtgacatagaggcaagagaattagaccagtgtcagatttctcaaaagcaacataacaaagcaagacagtggagcagcatgaggaaagtgactgctagccaaggattttatatccagctaactgttgtccaggtattagggctgcagaacaacagtttgaacatgcaggaactcagggaatactgtactcgtttacccctcctgaggacactcgaaaaggatgactttcatctaaaagatatttgggacatttcctacaaaaagactgtgacaataagtatttcagatatctttttgaactaagattaaaaccaatagtagggacctagagaatagtacataaacattatacattctgacaaagcagaaagaatgcaactaaaatataatgggatggaaaataaaaggaaaaactaaggccatgtgtggtggctcacacctgtaatcccagcactttgggaggcttaggtgggtggattacttgagcccaggacttctagaccagcctgggcaacatagtgagacccagtctctacaaaaaaaaaaaaaaaagtgtttaattagccaggcatggtggctcatgcctgtagtcccaactactcaggaggctgaagtaggaggatcatttgagcccaggaggtcaaggctgcagagagctgtgtttgcctaactgcactccagcctgggcaacagaatgagaccctgtctagaactgttctttttcagaactagaataagaataattactgtaattgaagtaatatgagggagtcagaggctaccatctaaaactgaaagaccaaatagaaaagattaggtaagaaaaaaaatacagtgtactgtaaaagctattaatataaaggtaagcgtgacgaagactttccaaaatactgagagaaatttttaaagggacaaagaaaaccatgatggaacagaaaaaaaagtatacagtacataatgcataccctaatgataaaatatgtggagaattgagagcaaacataaaggccaggacaaatatgtaccaggcaaatagaaacccc

SEQ ID NO: 384 - DNA, 2172 bp, Homo Sapiens
acgaaatgtgtttaagagttcaactcacaaatttagtttatttctctgcctataaatagagatttgtagattcttataggtagagaaataaaccaaattccaactgctccttatgatcattcctctaggtgttaagagtgagagagggaaggcttgacaaatttactgaaagaggtatgggagtgtgaaagctttagacaaggtacaaagatccactctcagaaagagaaaatctgaaaaaagctccaaaacattgatcataggtttggagtttgatagttcacagctctatgtatggagaagagcttaaaggtaagcagtaccagaattggtagctttaaattataagcattgcctcataagggaaacatgaagacttggagacatgtcagtgaagacttggaaacatggcagtgaagaagaagaaagaagaaaaaattcttcaggaaaagaaaaaaactgaacttagagaagagggtgttcttgaagtaggagctctgcctatgaaatgaacagaaatagaaaagagcaggccacatccatacagaactgtaagaaaaaacaaacaggaaatgtgaatcagcatttcaactgatgaaaatctacccccatcaaaaaaagcaggaaaaaattgacacaatgctccaagtgaaattaaacatcctcaaaccaatgtttggagatttgaaaaataaaattaagaaatattctgaaacaaatacaaagaacaaaaagcattaagaaatgaacacaaagtagattaaacagaaaaatagaagataaaatcataaccaataatgaagttttaacattcccacatttcaaattcaaatttaataaaaagtcttgaagaaaagcaggaaaacaggataattgagatgagatttttgttttgaaaattgaccaagttgaaatgggagatggatccaaagtctactgtatataattggtgtccttcaagaagagaaaatatttaaaactataatccaagaaaactttctggaagtgaaaagagatctgaatctataccacagaagttcataccagaaggcacactcaaagatatttcctagtaaagctgtatgactgtaaagatgcaaagaattctcagggtctccaggcaaagacgtgacatagaggcaagagaattagaccagtgtcagatttctcaaaagcaacataacaaagcaagacagtggagcagcatgaggaaagtgactgctagccaaggattttatatccagctaactgttgtccaggtattagggctgcagaacaacagtttgaacatgcaggaactcagggaatactgtactcgtttacccctcctgaggacactcgaaaaggatgactttcatctaaaagatatttgggacatttcctacaaaaagactgtgacaataagtatttcagatatctttttgaactaagattaaaaccaatagtagggacctagagaatagtacataaacattatacattctgacaaagcagaaagaatgcaactaaaatataatgggatggaaaataaaaggaaaaactaaggccatgtgtggtggctcacacctgtaatcccagcactttgggaggcttaggtgggtggattacttgagcccaggacttctagaccagcctgggcaacatagtgagacccagtctctacaaaaaaaaaaaaaaaagtgtttaattagccaggcatggtggctcatgcctgtagtcccaactactcaggaggctgaagtaggaggatcatttgagcccaggaggtcaaggctgcagagagctgtgtttgcctaactgcactccagcctgggcaacagaatgagaccctgtctagaactgttctttttcagaactagaataagaataattactgtaattgaagtaatatgagggagtcagaggctaccatctaaaactgaaagaccaaatagaaaagattaggtaagaaaaaaaatacagtgtactgtaaaagctattaatataaaggtaagcgtgacgaagactttccaaaatactgagagaaatttttaaagggacaaagaaaaccatgatggaacagaaaaaaaagtatacagtacataatgcataccctaatgataaaatatgtggagaattgagagcaaacataaaggccaggacaaatatgtaccaggcaaatagaaaccccaa

SEQ ID NO: 385 - DNA, 4969 bp, Homo Sapiens
ctgcctggtgggaggaaaaggaaagagagctggcaggcagaggcctggaactctcaacccctctccgggaaatgcctcagacatatttcagcctctggtgtctgggcagtcggggatttatgggccagccatctcccacgatgatctcggtggtgctgaactgtgtgtcacccccagctggcactgtggctgccctcccagtggggaggcctcctgcagcctgggccacatctggagcctcgcccagtgtggagaaactgaggcccacagagacatggggccatgccagctagtggaggcatagccaatggagctgggctctccagggctgtgctaacagagccacagctctcccaccccagcttgcatgtggagcccactaaggcccgaaggggctggcctgcccaagttcacggctctgccgcaagcttgctgcagatcaccatctcctccattcctggccccaactccccttgcatatggagcaaggaaagatcttttgaatgctgaacgggcctgagacaccttcctgaaggaaagctgtccttggatccaggcattgtgaccttgttacttcatttggccttcatgaccacctgtctagggccttcatcaacctcttttacagatgagccctcttggatgataagtaaatggcagcatttggatgtgaccctggtctctctgagcttagctctggactcccctccctcgtgcccctctcaaacaagcaagaagaaggcaggagagtaagttctaatcctggctgtgccactgactccctatgtggtcacaatgaagtcttttccctctcagcacctctgttgctatacctgcacaacgaggagctttgcttggccaggaagagggcacaataggtacagagtgcaggtatttctgggcccatagacaaggaagggtgggaggaggggagcaatggtggaccctcttggttgacaaatctaaacaataatatggagcctgagaaagccaaataccagctccccagcttcctctgcagccaggcatggccatctgactgagttcaaactgatgggacattttgtaaaagtcttatgagaggttctagagatgcttttgctttcttgataaagagccatttgcagctggcacttcccctgtcccctccagtcttgaacatggatgcgatgcctggagctatggcagccatcttgcagctgtgaggctcagagagtcccagagataacatttggaacagtgttgagcccctggaccaatacagcagctgcctagctccaggcttcctgttgagtgaggaaaaacaagcaccatgttttcaatgagtagttctgaatgatacaagcagggctggtagacatccccacagttataccaatttttttgccataaacaatattaccatattttgtctatttcccctggatacaggggaccaataacaacacaagaggggccaggggcccagggggaaggaaccagatggggaggggtgaggactcacgaagttagaagctggggaaggaggctctgcaatagtggaaacaagcgggagccgtaccgtccagtcttaggggtcccgagagtgggcaagggtgtagccaatggagaaggagctggagaagaccattcatggggggggcaggacaaactggtgggatggaggaaggagactgcaaagactgaggctgcaaagcctccccttcgccctcagtggacccactcccacagcccagctgacctccgatgtaggccacagagaagcccctgcgggtggtgctgcggtctgtgtgcagcagaagcagaagctggttgtggcttgaggtcacgggtggtggcaggtggtgtccacaccaattccccagcaggggtgcctcctcgctggccccatcgaaggccgccagatggtcaaagtcacaggtcttggtcaggctgttgggctcctccaggtccaggtccaggaagaacaccttgacctggtagcccgggggcaggcggatggtccagtggcagcggatgttgttggggtaggagctggggtactgtgggctggagaagttgccccgcatggccatgtatacctcctggcattctcctggatgggggatggggaggtggaaggagcaacagtgaggggagaggagaagtcactctctgcagttacagcttaggcagcaggtgccacagtggtccaaaaaccaccagcaggttgtgggcaccatggctagcacaccagacaattgatcccaactatctgaaagttgggatgcttgatcccaaagcttgttttaaactgcaactagctgaaagctgggacttgcattccagttgacagtccccttcacaggtgtaggccctgttaggaattcaataataatacacaatacctgtcctcagagttacctctgaactccctggcttgacagatgatgtggttcatgcctggcctttccccttttctcactgccccatttggtatgtactatgagcataccaaacactctctgccctccaggcctttgcacatgctgttcctcctgcttggaatgcccttcccttctgcttccgtctaactccttcagggtactgctcaattctcttctccacgaagtcatccatgattcttactgatggatagcacagatcataatggcttgcgctgtctgtttccttataatctctctaactagactgtaaagttcccacgacttcatccattcatttgtacgaaaattgagtacctactatgtgccaggtacaaagataagcccataagggactcagtcagacaggggagattgacatgcaaaccacacacagaagtgacaaatgttagatcatagtgtaaaaaacttatataaggagttgaaaaaaggattaattctggtaaaacagtaagtcttcgcagaggtgacatgcttatgtcttggcataggccaagggtatgctagagcattccaggcagagagagtgcagaaagctcaaggctgcggggggcagaaaggtgtgacccctgcaagtgtaatggggagacaggagcccagtaggcacaggaggattcagggtggagcgccagcccctcctacctgagaagtagtaggccttgaagccacggcctccgatgttgaagtcggacttgaagaccacctgcagttcgtggcccagagacacgagggtggggggcctggtgctgccacagtagtggtgcccacgggtggggccaggccccccaagcacagccacgtagtcataggtgcactcttcattgccctccacctggaagtccacgaacaccagcttgacgtgggcagggccagcggcccggatcacccagtggcactccatgctgttcgggtagttgttgggatactcaggactggtgaggacccctgacaggccagtcaggacgccgccacacacatctgcaagggagcccacttgagctgacctttctttctccttgtggctcccagtttcctcccttgggaacaagacactccaacatgctgcccccacaggtatctcattagggcctcattaccatccagcaagcacctgctacccaagtagcaagtgtagcacgtgctcaggcccagcatttggcacctatgctgcctgttcaaatcctcagagtagccgcacaaggactgtgctgcagtttctctgattttataattaagaaaagggaggcaaagacaagttcagtagcttacttgagtttgagttcacccaggcagaccttgagataaggatttgagtgcaaggagtttacttgggagatccaggggcccccaggtggggagggagggagaggacagagaaggggaggtgtgttcaagtcagctgctgaccttggggggaactctggggacggggtaaagcacatacttcagagttctgtcaatctaggagcaagggagctgcggcatttacatgccaactccccagagtgcaggcagagggctgctgtgggctgggagtgccctactgagacttcagaaaaaagccctccagcatagaactgtggaggttggcagaagcacatcgacgtggcagggcccagggaatgtggtcagggccctgagagcaggtcacccgactggtaactgggaaagtgggatttgaacccaggaagactaactatggatcctgtgcacttgacccttgtgaccttcactgtccactcctacgaggccagtggggcacagaggctgaggtgcctgagctcaggaatgtgatcaaacctccctaatggatgaggaaaccaagacttagagagaggacctgatgaagtagagcttggtttgacatctgaagacaagtagtctcccatctctgccttttattagctgtgtgactctagggaagtaacccagcctctctgagcctcattggaacattagaaatcataagactgaaccagcttgatccactgggctcagacttgagcacagtctgaaaatatgctgctggaaactctcaggaagccagcttggccagtacaactacacggcaagtgtgggtgaatgctgcgacttgctggaggtcaccagcagggaggacatacgtgggatgtgtttcctgagactccagcatctcgccctatggcacggctgtgtgaccagggctctggatggggcatctaaggacttggcgtcttttcccagtgctggcccagccatgtaactttaggaaggccctctcagggactcagattttgtgaaatgagagggcaggtttagatagcctgtgagatcccttccaacactaacaaccttcgcggagacttcccaactgtgccctggggctccccagcagccccctggagcacctgctggcacctggtgcaaatttcattcttatgctgtatttcaagctctcttttaatgtaatgaaaagatagcacccacagactttaatatctttaacaagatattaaaatttaaatattctacatttaaaaatttaa

SEQ ID NO: 386 - DNA, 5204 bp, Homo Sapiens
agtagctcccgagcacgccggaggcctggcctgtggatgagattgttccttatttccccagcttcagcaccacagaagagaccagagtctaccttgccagctcctctagcaccgaccacgtgccaattcatgtcctgaatgctcacttcacttcttcaccttgcttcacttcacttactgcacgggaacagaaaagcctagagaggatggattacctgtgcggttgcctccctctgcagagtgggcgtgtctcaggagcttctcttcttctccagcccagtgcggcctcgtgtcatccataggacccaccggcagagggcagggcctgcgagtggggccagcctcctggtgactctcgcctcctcttttccagcggacgctaccagaggacgaaggtctgactctggccaacggcccagaatttctggcccagttttgcctgaggaagccaactgtgcaggaggtcaggatcccggtagggtgagagtgggaaagttaacattcccaagagactccaagcaacaggatttcctgacctgggactattacctttctcacattacatggccagatttacttcctgctattattaaaagtacgaaaaagatgaagatatgtgtttaatggaaacaagggcaagagtttgcctgactggactttgaggaggctgtaggatcatggcgctaacggcatttggagggctgggaagggactctagccctggctttacctgcctttgtcatcagctggagcaagcaactccgcaacctcggagcctcagtttccttttctgtaaaaggcggggagggtgggtggtaagtgcaatgctgaatcagaactcatagagctgctgggtggacatgtgaagtaaaagaggagacagcttttgctcctgaaggatgccatttgcgttttcctcatcagtttgatctcctccaatcatccagcacctccatctgaccttctcagctgagaggtcctcagtgtttctgtggcctccaggagaaaggtccccctccccggctgaggccaggctgatggcaggctgcacggccagccttccacagtcacctgaaggatacagaaaaggaagagctggaggcttctagcaagctgccgaactgtgtcctccagctgcgcccagccccctggagcttctgcctccccagcagagagggaccttcccagagaagatgtcttgcgcctcacctgatcttgttctgagagtaggagactggaagagaagcgttcaactccccaaacacagctgggtttgtttcgtttaatctcccagcctgtttttctgctgtcctcctgaagaatgtttaatctcacagttaaaaccaccaaaagcgacttttttccccctcaactgctcagtaacacatgaccgtgcaaattcgtttggccccagcgccacaagtcataaaaggcatctagtgggcggcatgagtcaatcaggcctttggacggtgacgtaaccacagcttgtcagtttccccatccaggcagccccaatcccccagtgcagacatctggagccagggattgacaagtggattccaggattgggccctgcctcccgccctgttcagttccagcccagccacggccgccgccaacgaggacacgcactgtctttctgcacattcccacgtacacacacccccgcagccccctctccactcattcctgcatttccggcaatgtgaattctgacagctcgggcagtgtcagcctctccggtgcattcctcaccacaccacctcactgctcccgagcctgctgacagcactccccgccatacctaccaagccgaaggtgcaaggaacctcttgatccccactgtgtctttgtcccagggccacagcaaaatagcacccccctcccccacacaccctctagcctaatttattagacttttaaacacatttatttactgtgatatctacaccacaccaaacatctggagggaaaccgggagacaatccaccaggaatttaaatgtttgttctgcaatgtaactttgaaaaccgaaccaggaaaacttgacatctttagccaattgcttggtggtgagtagacttaagccaatatataatctgtaaaggttgtccctctttgccctctctctatccatgaaacgcattcaccaaacagcccagaaatatttctttcttctcctctcagaggtatgtgaaaccaacctgaatcaacaacatagttgttcaaccagcctcactgagaacgaaggcatttcagagctggaaagacgctagggtctggggtcttatcttccacatttatctgccttattataatccatccagtcatcctctttgcccttgccagatctcatcgcttacactaccactaccgaaggagcataacgtctgtgacttttctttttttttttttttttttttgagatggagtcttgctcggtaaccgggctgaagtgcagtggcaggatcttggcttactgcaacctctgcttcctgggttcaagtgattctcctgcctcagccttctgagtagctgggactccaggcatgcgccaccacgcccagttaatttttgtatttttagtagagatggggtttcactatgttggccaggttggtctcgaactcctgacctcgtgatccatctgcctcggcctcccaaagtgctgggatgacaggtgtgagccaccgcacccggccacgtctgtgacttttctaaagctttaagatgatgtcacccataggcagaaaggcccactcatttcgtgcatctgcagtcactcttctgacgaggtgcggctctcttttgttctatcaaagagaaagccagtctaaattaatgggaaactagagaattaggtcatttttcaagatgaaattgctggtagcttaaggaatcagctacttgaatcccatgctaaaaaagtgtaactcctgaggagtgagctcttctttcttccttccataatgtcaggcactaagggaggttcagaaacacagagcagcatctactcctttctcaacgagcgtggggtccagtgcagttggccctcatttaacaaataattacacccatgcgtgaaaggtccagtggggaaacagtgcggggagcctcaggcagagctgattcaggcctggggaggcacgggagccacatgttcagggtccacaggcccagcggagtgatacggaagtttccaagatggtaagcctctctcctggcccatgctcaccaacgggaccccattcctaaccaggctttccctctctctcttttaagtgttccaggaatgttcctacccctgcgtctttgctgaagcccctcttgcctgggatgccctctgtcctctctttctgcccacacacatcctgccagtccttcagacagggccagcctcacgggcataggacctgagcagtttcacagggccctatgcacagaaggatcccaagctcggttgattgctccgatcttgccatcttgaaactctttgataattttatcttttatcttgtgttttgggagtgaaatccaatgggatattggggcctgcaaaggagaagaggagatccgcacaaacccgttcctggctgctgcattcacctccagcgtttgtgatgccccagagcacagaactccagggagcccacgatgcaggagagttcagcgacattcactgagtacaagagaagtgagttactcctgcagctgagcacggggggcgctggcaactgcgaaaggtctcgctttccattccaaccagaacttgctcctagcgcagacagaaggccgtggcattctgagaaacacacatgatgaaggagccctgtcatatcctctcttccttgcatcgcttccccgtgtgagcaaccacttgtgctggaaatgatgacaaggaaggaccgggaaagacagggccacccgcagttccttttccttgacgtctttccttcctcatcagcgagctgaggtggagagcgttggtagaatgtgtgcataataagaagtgaaataaaaacagtcgagttagtattctactgtttccactgttctggtgagaacaaaacacatatgctgtatatgctttgaaatacaaagtgtgtaattttagtgattctgcataggagttaaatgtttttatatttgcatttaaaactgccattgtatactataaagataaagagtaaaatgtattctaatagtttaactttactaataatttagtttttacttttatttacctagagtaacattaaatagcaaacaaacaaaacaaacatcacaagttgagagagaaaccacaaaagaaagaaaaaagctttatatgttagtaccttgagaggcactttttcctgctttttgagtagggattcatgttttcccgttgcactgggcctcacaaataatgtagccagccctgccttcaaagtgcattcaagtgactcccccttcataatcacttaagcctggagccacggccttgcccctgaacacgtagaacagtcatggccgtaccaaccgtgagccattcttgcctctctctcttttgtcttattctcttgtcatctgtccacctcgcaggactgttgggaggcaccaatggactttgcaactggagatctcccaactggaccatgtcactgttatgtttaatttgcactgtgcacagtaggtacccagtcaacgtttgtcgaattccatggactgggccttatacctccgaggatttttcacagcagtagcatgtgcacatgcacagaacgagaacacaaccaatgcttgtttgctggtgaagacctggtctcagtattttgcccaggaaaccctttcttcatggacagcatgaggcaagctatggcccttgctgtggtctcagtggttcagcacggaagatgaagatgacgggcagtctcagaatattagctttagaagggactttggatccttttgattttggtaggtgaaatactttttaaaaataaagaaaacggactttggacaaatgctctcattttgtaaatgaaaaagtagagacaggaagagtaactgatttgtccaaaatcaaacaaagtaaattgtgttgcatcctctccatccgtaaccaccttcgccttccctaactgctccatgtggcctgggaaagtccacttcacctcgtcttagaggtgggcttctgattctagctaagccaaccccca

SEQ ID NO: 387 - DNA, 6037 bp, Homo Sapiens
gcctcttcccccagcacaaggtgctctcggggcacatagtctggcacgcgagggccccggcggggctgttagaggctcgtggtcatcctgaccatgtggtccagggcgccccggtcctctgggccccgcatggagcgcggcgtcagcgcggacagctcgcagtccctgagcctctgcaggcagttcttggagccctcgggcttttgcggcctctcggggagcggcggcagctcaagctggtactttttccccaacagctcccggcaggggcgctccaggagcctctgcatgaggcggacgtataagtggccactcctctggcgacatcccacggcgggggccctcgcgtggacacccgcccctgctagctcagggctccgatgcgatccgttcgaccctgcatggcggctttcaacccgaacgcgtccctccttcaagatcaagaccctgaacgtagttcaacaagtagttggtgatgatagcgtgccctgactgggccaggatagcctctttagtaaaacagccacgaaagtcatgaaacagatgctcagctcctttcttcattttcactttaattcggtgatgcctctgtgtctgtctgacgacatctctcctggggtctgtgattctgctgatggtcttcagtgcctactgagaagggttcctggacatcatcaggtatgaaaacctcaaagctctcggtcctcaacgtgagaaccctgggccagcggcatcagcctcaccaggaaacctgttcttctgctcattcttgggccccaccccaggcctattcaaagaaagactccaggggcagggcctggcagcctgtgtttccaccagatctgtgttaaagctcaaatgaaccagcccacgtgatgctgaccaggaagcacaaggctgagagccagtgtccaaggcaacggtgcccatggggccagaggcagctcctgcctgtgcagctgtatttagggctgcgttcccctccctgtcctgccagttgacgtcagtgtggggttactcagctaaggccaccacggtatatccacaaagccgtggtagcaggcgacattaaggctggtccagccattgtggtcagtctcctgcgccttctcaacgctcacccctcgccgcaccagcgtccgcagcagccccatgcctcctggacgccctcctccgggacgctctccaagccctcgacgccgtgctcctcctcgtcctggaaagggtacagagtcgtcccaggctatgctgcaggtgtggggccctggaactctttgtagtcagcgcggtcctcctcgacctgtgcgcctaggagtggggacggcggtggcggggtcatgcagcgctcccagccaccctgcggccgggtcccagccagcagcaccatgccagcggccggaggcgtgggctgggggccggggcaccgtcccggaaaaccgggcgcgccccaaggtccctgcttctcgcttccgcgtccccagagaagccgtagctcccgcccccagcccggcagaaacctcctttctttacattattaagtttgttttcattttaattttcttaggacattgataaaatcactttcggatttttgagattaaaaattaaataattttcatctttaccctttttaaatttttcacactttattttaatgcttttattcttttgtaaattttaattattgtaatttatatcttcaattattatggaagaattttagaaaagtcttttcacataataaagactaattaatgaactattatttattctctcctctatctcaaatacggactttaaacttttagaacactttttgttttgagactcttgttacttatgtgacattttaactattcactcttctagtgaatttttaatgtcattcaaagggtacatctttctacactgagaattaaacaaagttctcaaaaatattctcagataatttagaatttcaccttccactggcatgttaagtatgttctccttcccttctaatgcatattttcctcacacgtcctcatgttatactccttattcaccctccatgcaagaggtgattttatttatttatttatttattgagacagagtctcagtctgtcaccgaggctagagtgcagtggcatgatctcggttcactgctatctttgcctccttggttcaagtgattatcctgcctcagcctccatagtagctgggattgcaggtgtgcaccaccatgccccgctaatttttgtattttaggtaaagacaaagttttaccatgttgaacaggccagtcttgaactcttgacctaaagtgatccacctgccttggcctccaaaaatgctgagattacaaaaacagcaactaaacgctggaatgatgactgggaacttgtctagagtctccagtgattatcctccttataacaaggcagaaagccttcctcagaattatctggactgacatcactcattgtccagacctgttaacagcaacaagtgctgtgagtctcaaatgtgctccttcaataatgcagtagaaggcctgagtttccacataatagtatccttgaatgcctggagacttaaggcacaagaatgtattgatcctatgaactttatgttttgtaaaatttcagattatgtgaggtgtttggacaaattaagtttcagggtgatatccactattgagacagaaaattagtttaaagaattaagacctcaaagtccagaatgagaaaaaattgtttttcttagagcctccttataactgtcttatttgttttatagatgtaagtactagaggacaagctctacctgatatagctggcctagacatatgcagatttattaattgtagaagaaataattatacctttcaggtaaaatggctatgcaaaataattagttgctgtttttgagacaagttctcactctgtcacccaggctggagtgcaatagcacaatcagaactcactgcagtctcaaactcccagctggtctcaagcaatcctcccaactcagcctcctgagtagctgggacaacaggtgcacaccaccactcaaggctaattttctttttatttttggtagagataaggtcttactatgttgcccaggctgatctcaaactcctggcctcaagtgatttttctgccttggcctcccaaagcactgggattataagtatggccactgttaccagccttagatcattttttttaatacagatagcttcccaactaaaaatattttattagaattctctgaattcagcaaagcaatgttattactgacccagtcttcacttattttcagctgacatggaagaacaaaattacctttatttttaaatttattttattttatattttcaaggtgcaaagtatgttgttttgagacacatatacataatgaaatgattactataatgaagaaaattaacaaatctatcatatcacttagctgtgcttcttttttatgataagaacaccaaaaatctagtccctcagaatatttcccaaaaacaatacattatcaaatatgcctacaggttgtacatcagattcacttattctactacgcctttacaacttttgcccttcatttacctatttccttcccaccaatgtaaccaccttttttaatgtattgaacttttaaaaatagatttcaaatatgagtggaaccatgaaggatttttctctgtgtgtctgtcttatttcacttaggaaacgtgccatttacatgcctcctaaatttagtacagaaatagagtgctagtcaagaatgtgtctcagtgttgttatattaattttttccaagttatcctctttatcaatttttactttttgtactatagaaaagtcaaaattattgtattaaaaaatctgtaacaaggctattgataaataacttcttttagggatagaaaactcaggaagttcaagatttctggattaatgattgacaatgttcttagtggtccctctttgatttatttcaattgtaagtaattcttggtgatattctaacataaattctgacaggtgaagagaataaataaattaagtatctctaggagaatcaatagaataagattatcttggttaaatagctaagaaagtatgctaaatagacacaaaaactttttcatcttccaaaatcagagttaaatagtaaataatcgtaaagtagctaattctgtctttctgcaaaagtgaatctgagctaaattagaagaatgtcaggaataaatttttccttgaaaactaggaacaaataatgtaattaaattatgaggcactgactgttgcatacagttttatgttgcatagagttttagcatcaacagaaaagcttacaaaacataggtgaaaatcaaaaaggagtgctgggttggagccctaaggtgaataattttatcatctcagatcacttggaaaaaggcagcgagtccaaaagaagctggtgataagctttctctctgctaacccctaatgttctgcatgaaatatgtggaggcagaagagagacagtttattatagagtctacgtggtatagagcgaaggaataagaacatttctgataagtattttcaaaatttgaagaatcattcctatataaatcattcatttaagagactaaaatacaagtaagatgtttcttgccacataaccctcagcttagccaggctctaaaaaggacaacactggacaccttgacagtggtaaaaagcagggtttactcactcttgaatactaagatctggtgctaaccttaggcagcaacttgtctatttggttgaggttcagctcaaatctcttgggttattttcagttgtgccagtcatttaatttattttctgaatcaaataataagaatggatatggttttgagtgtaaacagcattcccagatatatcttacaacttggtgtgccatctgcctaattttgaacctataggacgggaataactgcattgtgaaaaataccaggtgatttccttaaagccaaatactcttgtccctcctacttttcttttggctttcctgctgcatgggacgtggcaataaatggcagttttctgcacacagagataaaattcacttgttgaggatgtcaatcttcttgacaactcctatattggtacaaacatgtgagagcaatgcaccttctgaatcatttcaaatttgtggtctttgttagagcaggtaagccggtgccctaggagacatagctattaacgttctattatagaattttccattctgtatcatctggattcttatttaaaatgtagactaattttgttctttctactgcataagaaggtttataccactttatgcttagtaaataattaaatttatatgtcagtttaaataaggacagtctccattgttttaagtccttttcctgttccccatcatcttatataggaaacttcctctttcaatggtttatattaaaaaacctaagacaattgaaatcaaccctataaaaattatgctacaattattttaaaccctaacataatagtattatctttgatatgaatctgaaaatcaatttatttcttatcttttgatagatattcattagtatgttctatcctattttgttacttatattttggaaaagtttcttaacgttagaataatatttatacgtattaactcctctacttatccatttattcatcttatttattgtgtaatctattctaaaaatttcactggataatggtaatatcttagcaaagaagacaaatactgccattgcttccttggaattttcaatctggtagtaataagtataagagttttctgaatattataatctgatataatatactcagagaagatgttatagcagagcaacccagcactgaaaaactgttgtatgagctgaaatgtgattaataactaagatgttgagaaataataaagtctgtgaggtcaacttaacttggtcagacttaaaaagaaaataagcactcttctttattctttataagataaggtatccactacttcatttttct

SEQ ID NO: 388 - DNA, 2459 bp, Homo Sapiens
gtggagagtcgggttgtgcctcccgggccttatcgggccaccaagctgtggaatgaagttaccacatcttttcgagcaggaatgcctctaagaaaacacagacaacactttaaaaaatatggcaattgtttcacagcaggagaagcaggggattggctttatgacctattaagaaataatagcaattttggtcctgaagttacaaggcaacaactgttgaggaaatttcttaagaatcgtataattgaagatatcaaagggaggtggggatcagaaaatgttgatgataacaaccagctcttcagatttcctgcaacgttgccacttaaaactctaccacgaaggcatccagaattgagaaaaaacagcatagagaacttttccaaagataaagatagtatttttaaattacaaaacttatctcgtagaactgctgaaaagcatggattacatttatctcaggaaaatgccgagaaaataaaacatgaaataataaatgaagatcaagaaaatgcagttgatgatagagaactaagccaggaagacgttgaagaagtttggagatattttattctgatctacctgcaaactattttaggtgtgccatccctagaagaagtcataaatccaaaacaagtaattccccaatatataatggggccaatacaagtaaacatggagtagttatactacaaaacaaatcagatgacctccctcactgggtattatctgccatgaagtgcctagcaaattggccaagaagcaatgatatgaataatccaacttatgttggatttgaatgacatgtattcagaacaatcacagattattttctagatctccctgaacctctacttacttttgaatattacgaattacttgtgaacattttggttgcatcttcatttttgtttcatttcgtggtagttgtttgtggctacataacagtttcagatagatccagtgggatacataaaatccaagatgatccccagtcttcaaaattccttcacttaaacaatttgagttccttcaaatcaactgagtgccgccttctcagtctgcttcgtagagaaaaaaaaataaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtagtatgcgtgatctatcctctaacagcaaaccaaggtgctattctttggaaggaattgtagatgtgtcagggaattcaagtaaagaggcatccagtgtcttccatcaatcttttccgaacatagaaggacaaaataataaactgtttttagagtctaagcccaaacaggaattcctgttgaatcttcattcagaggaaaatattcaaaagccattcagtgctggttttaagagaacctctactttgattgttcaagaccaagaggagttgtgtaatgggaaatgcaagtcagaacagctttgaaggtctcagagtttgcttttaacaagtagtacaagaaggaatagttattatcaatacaccagtggctgaaattaccatgaaaccaaatgttggacaaggcagcacaagtgtgcaaacagctatggaaagtgaacttggagagtctagtgccacaatcaataaaagactctgcaaaagtacaatagaactttcagaagactctttacttccagcttcttctgtgttgactggcacacaaagtttgctgcaacctcatttagagagggttgccatcgatgctctacagttatgttgtttgttatttcccccaccaaatcatagaaagcttcaacttttaatgcgtatgatttcccgaatgagtcaaaatgttgatatgcccaaacttcatgatgcaatgggtgcgagatcactgttgatacataccgtttctcaatgtgtgttatgctgtgctgaagaagtggaccttgatgagcttcttgctggaagattagtttctttcttaatggatcatgatcaggaaattcttcaagtaccctcttacttgcagactgcagtggaaaaacatcttgactacttaaaaaggggacatattgaaagtcctggagatggactatttgctcctttgccaacttactcatacggtaagcagattagtgctcaggagtttgatgagcaaaaaatttctacctctcaagctgcaattgcagaacttttagaaaatattgttaaaaacaggactttacctctaaaggagaaaagaaaaaaactaaaatagtttcagaaggaatatcctttgatatatcagaaaagatttccaaccatggagagtgaagcagcactttttggtgacaaacctacaatcaagcaaccaatgctgattttaagaaaaccaaagttctgtagtctaagatactag

SEQ ID NO: 389 - DNA, 3826 bp, Homo Sapiens
ctaattgaatacctttggcaaatcatgtagctcttcagtgcctcaagtgcttcattctgcactttcatttgcagaatgaagatgatacttgctatttacctgctgatctaccttacaaagccattgtgaggaagttgaattggtgtttatgtactggagtttataactgtgctatttttcctagtgatacttgaaggtattggatggggaaatgatcatcccagaaatgggtccagtttcttattattacagaaaagtttacaagtacttaaagcaaaaacgcttttggactaattcatcaaaagtcctgtgaaagtagtgttgttttatttagtctttgggtttactttggaataatttcttaagtataatgtttctcatcaggttttgtcatgaaattaagatgctgttgttgaaacagaagcagaaaaggaaaagaaattagccaattacttttataactaacttttataatgccctaagataaattggtaggaacgtgtaaggtaatgttaccactttcctttagtattaaattttttatggttataataattgaagtgtatacgtgcatacacttcacaaccggtatagattcctttatgactttcaagttatatttaaaatatttggttgtttcagtgattcagaatattcaactttaagcagaatttgtcttacagaatgttatatacaatcatataaaaatgttattttgttggataaatttgagttcagaaggcaatgacttgaccctggaagactcagtttattgctggggaaccaagttaatatttgtcaagccaccctgtgtaaaaaactgtaatgggtagaagttttctcttttgagaagcttattgaaatataatgacatctactgcaaaataggactactaaatacatatactttacatgcaaagtacatttcttaaagaattatttctggtaatttttgatgactttattacttgataataagtattagtttaaaattttccaaattattctttaaatagttgttaggtaagaatattcagtaagccagtaattcagaataactattgtagaaaataataataatctattaatttaatgaatcacctctaaattactaattaacttcttttacaacataaataacttgttatcaatagagcatttttgtaaaaaacaaaagaaagaataagtttaattattaaaatttgctctcttaccaaatgaatacaagggcttttgaataatctcattgcataagaggccctcatttcacagaaatggtaagaactaaatcaaaagattcaagggttttccctttataaagaatagatcagaaaatttgacaatccagacattcaaaaaaacattctgccagttgatttttttggactactatttgattagatgatcagttctgaaatttaagctgcatgtatgcccaaattaaattagcataggaaagtcaatgtgtgtggttttttaaaagtatattttagcatattaatggagcaatttaatttacattcagttacaaacctcattcttattaataggtttagggaatgttcttgctggtgtgctgattaccatattagagaaaaaataaactctccatattataattcacctgtttagtaaggtgagtttcttacttgtgatttgagtggattatgcctaaaaattacaagtatatttgcactaagcgacaaaatatgtccctgaaaaatcttagcgtacttgaatcatcaaatgtaatggattgtattgaattctaaatgttaagaagtaagtggatttagggttttgtctttcttttcttatgtcctctctcattcctttatacctttcttcctttctgaggcctatgtttatagcatgacttttaatgtgctgaaagattttccttctgttttgtgtacagagttgtttttgatgagtggtacgctcagaaggaactagttctgactacaaatcccactacttgaaatagcaatattgtacctaaagtagtcaaacagattttgctagacaactaagcaacatctgaatacaaatgtaaagtatgctggctcagtgtatcttttaggtcactaaagaggacacatcagtaaataaattgttttcagtgtaatatttttacataaaaatagatttcccccccaaaatttaagatttatttagattcttgagacatctttttatgaaaaggaattaataacatacatcatcaaaacttttcttaggagcgttgaaacaatataagaaggttacagaaggccttctaaaatatgaattcccatctgtatgaggtacttctttccaactcagtgactttttgcccagagacttggaagactgggcaatgttttctttcccctttcccaactcctggagacaaggccctaggagcaatttcctccagtagggcaggccgtagtcctgctctgtcttacttcccactgcagcaggaacatgtcctcgcctctgattccttctgtaccaagccattggtccattgaggtcaattgaggactcactgtaaattttaaatctgttaataaagcaaggatattggcatgttcctcttctcatcaatatcctaaaagacatttattttttacacactccttgggaaaaattaactttttttcactgaaaatatttccttttttggttatcttgatctcagattattttgtgaaagaattttactgtacttagttcaaaagagtagaaagaatgatttactattgcagacatatgtagggtaaaatcataatttatttaaactgactgtacaacaccatttagagttgatattgacataaatgttattagcctactaatttggaactgcatttctcaacaatgctggcaagcatcttccgtacttagcataccaagttgtaggggagagactgtgtatatattttttaaaagcaatccaatggatttgtttttgttcatattttgaaaacaactcgaaggatttttcttattttagaaggtagaaaatatgtggacctgtgttttaaattaatatgtatttataaattataacattgaatgatacaacagagctctaatattgatgttctcactttctgatatttaatttttataaatgtttttgtaagtaactaattgtagtattgcttttaaatagttttaaaatctatctcaaataagttctgcccagacctatttccttaggacagtattctaaagttcagtagtccagtgtgagcttgaaatactcctagatcccgtcagtgatttttatatataccaatacacaagcaaattattaatataccaaaaacctaatttctgcattgcattaataaaatacttgttattttgcctttatccaattcagttgattaggtgaaatagaaaattaatcttttcaaatgtgcatatgatcataatttttcaaaatgttactgtggtcatttttggtgcatgatgccaagtttatctttagttagccattgccacctgatatgtaatgacaaatgttttactatctgatcattgggttgtagattaaactattttttttctctgtagattctcactacattttcaaatatgtacttggaaaaagctgcaaagtgctacctataagcaaattagtaactttggccttatctatgcatagtgttcgctcagtttggttttgataaattgattgacttgcagttcctttgtagtattttaacttattgtgatgtaatgaattttttgaaatgtttatttgattagctgttaaaatataggaaagaatgtagctttgcatgaaataaattacatttctacaagttaa

SEQ ID NO: 390 - DNA, 4233 bp, Homo Sapiens
ggggctccagggacctgttgatcgcaggtgtcactggcctgactggtccctgggtattggggcgtatgcgcatgctccgctcacagggtcgggctctgggcggcggagaccagccgcctgtgctccagttcccggtgagcctcggtactgtggcagcagtcagtgtgtctggcgggtgtcggcgtgaagcggggctgggccagcgggaggtagctctgtgggagtggaaggcctgtatttctctacctggaccgcacgctcctcgcgcaaggagggtagagctcaagatgcttgggatttgctttacattctaagtggatttggagaagagacaataaagaataagcagtcaattctataatatatttagaaggagaaaagtgccaaggaggaatgaaaaagtagaacaaggtaagaggaatttggaaagcgtggtagagattgtgatggtttgcaattttaaataagtgtaggcctcatttaagtgacttttttggcaaagcaattatgaagggagggagggcaaagccatgtgggcgttatggggggaatgtattccaggcaggggaatggccagtgcaaacaatatagagaacagaagtttgtatagtgtgcaggaatgagaaggaggctgatgtggctggaatgggaaagccaaaggtcaagtagttagatgaggggctgggcagatagtgacattatgatttaattttagaaagatctctgtctgctctccagaatagacttatatgttactgtgtaaagggtagaagccaggagacaagctgctatttttttaatccacacaagatgtgatgatggccaagactagaattgttgaagtggaggtggtgaaaagtggtcagatcctgaaatatgacagaaaaaggagtcaaagatgacatcaagatatttgttctcagcaactggaaagataaagttgccattggctgagatggggaggaaggtatagataaagtaagagttcagtctggggctttgtcaaggcaaataaatgttaggttattgctggcttgacataattttcttctggagatcatgtcttaaaagtagactgctgtaagccattttctttaatgaccatgtcctatattctggatacatgtgtatgcttgtcttttgctagttagttactagtggaaactagtgaataggtaaaagcaacatgaaatatagcacggttttttgttagacacaaagaaatagagcaaaaaagtggaaacattgaaaattacttaaaacttactgtttttttgttggcagtattatagtcttttttcttattaattttattttctgtgttttataaattttctactgtagtcttctctaattcctccatttctagagtgacaatggttttacacatcaaagaatatttattcttcaattataccttccttactataatcctttagctttataaacacagttacttctgtaatgaaagatatattttttcttttttctgacactatctacttgaagatgaagagtttttttgtattacttcaacttggtataactcttctgtttgctatctagttatctaaaataaaatcttaaatacttctagtaagatgagcagttgtagcatatcatcagaaagtcctcagtgtatctttgaggtgctatattgttagtgaaaagatgttaatatgaagttttactttacagtttgatggctaggactgtgtactattaagaacatatttgcagtgattctgtgctaatatggaattatggatatttctaattttctttatgtagtatttctgtggtatttcagaaatctaatgaacaagtactgtttgataatcaaaaaaatccatacacataaaagaacaaagagtctcatggctttatcaactattatattagtttcctagggctgttgtaacaaagaaccacaaactgggtggcttaaatgacagaaatttattctctcacagttctggaactagaagtccaaaatccaggtgtcagcaggattggttccaactgagggctctgaatagaatctttccttgccccttcctaacttctggcagtggctgttcatctttggtgttccttgacttgcagcttcatccttccagcctctgcctctgtcatcattctctctctttctcttcttataatgactgctaccagtcacattggattagggtccaccccagtgacctcatcttaatctgataacattttcaaataccctgttgccaaatacattgacattcataggtctgggacttggacatatgtttttgggagacacaattcaacccataataggtataatgaatcaggtttaagatgccattatcatttacccagaccattctagtagcctgataaagttattggatgttagaatttgaacaaattccatatagtgtcatccccttttgggggaaaacacctgttaaataatttatatagcatggtgaagattacctaactaattatgtattgggcttaagttttggaaggagaaaagatagtttgatagtcttgtctagggtaatgaaggagagtggccctggaatcttgccttttaggataaaattattgctggtaaagcactgactcataagaaaacagcagtgacttatttcctttcttttcttttctttctgtctctctctctttctcaaaacttctggttcattttaaagttcaaatttaagttttttattttaaaatattttattggaaagtattaataactgatattaagcacttaataaagttaaacattttgttttttcttatttaagccttacagaaattttaataacagtaaatgttgtaattatccttattttacaggcaaatgtggatatatgtttataactgcacaaatgaattctgaagggacgcataagacattggtattggttgcctatggggaatataattgatatgggggagacttggttttccttgtatgctcttctatatggtttaaaaaattatttatgaaaattaaatatatactaaaaaagagggaaattgctgagtttttccttttagctgcactattaactcttttaggaaaaagcagtgatctatcaaattgtattgagatattcagtagatctgctactgaagtacttatttacattggagttaaaaacacaaatgcagtttgacaaatataaattcttagaaaaagtaagttctactcttttatttggggatataatattttacttatttcatatttgcagtgttgtagggtaatgcagttgcttttaacaagccataagtgaacttctgagaatttcattcaaagtaaacagttaggagaatataagatcctttgaagtgattctgccagttttctaatttttttctttaagaatttcttaagcattgtgaaatatatttatgtatttaaacttttagaaatttatgctgttaaggaaaaaattattcatgacaattgttaaagatggtaaggaagacacttgttacagataggtacagggagcactgcaatggagtcttgcagttggggagagagattgggctctactctatatactacaagtaaaagcgggaatttatagacaaggatgtgggtgtggttggtggatggaaaattactagggggcaacattaggaataagagaggattctggccaaactgacctaacaggattcttgttgaaggcaggccagggtgatcagacatcacctggaggatggtgaaggatgaggaacctaatcagatatgaggatgatcagataaggagaatggctgacttgacttagtaggactcttgctaaaattggacaacgtagagacaaacaaggaagtccaaaagttgaggaatagttgaaaaagaacatggaatagctcgagtggagtttgatcaatgagagaatctttgtcaatattttctgacacctgtatctgaaaatatcaaatagttacttatattaggcccatttagaaaatcaaaactgttgtattacattagaattagtattagtggcaggggcacagtggctcatacctgtaatatcagcactttgagaggctgaggcaggaggatcgcttgagcccaggaggtcaaggttgcagtgagtcatgatcaggccactacactccagcctgggtgacagagtgagaccccagctcaaaaaaaaaaattagtactagtattgaattagaaaatttaatataagaaaaaaatttaaaaa

SEQ ID NO: 391 - DNA, 1263 bp, Homo Sapiens
gaagccagagggcctgcgttcgaaccctcaccctgctgcttattagctgtatattattggaaaatgcactcaatctttcggtgcctccgtttcccaatctgtaaaataacaagagttcttatctcataggggtaaggaggaaatgagtaaatatgtatgagtgaagcactaggaacagcgcgtggccctgcggataacagaatattgaagaactgataccacacaggttacagccagctaacaaagttaacaaccagtgctgcagctgcagcccagcccacccagcaccattagcactctggcagaaaccacatctactctgtcctcaccactgccaccccgcttcccagcacaatgcctgacacttcgtgggaggccaaaaactatttgttgaaagagcaaataaatgaaggaatcaagtgtaaccctcttagagcctggccatttcgcctcctccttgaagtcaacctcagcatgagtcacattcacagaaacattcatctcatacccagagatcatcaaaagaccagctgaaggcttttctgcagtccttgagagaatgccaaaaggtggggttgcattcaccgctcaggaaacagctcaaaatccttccactctcgctcttgcctgctccagcctctcgggaaaagggccagtctgctactccaagagaacacgcggactgaagtgctgtccacgcggtgttcagatggggctctggaggccatgccatgtgatccctcggtgaggaaaggattccctggccagccatggggaatatgaactcctgaagatgaacaagagctctcagccccctcccccaggcccacccagctgtcctgaggtccccttggaagagaccaaaagagaagaagcaacagggggccagagacccccaggcccccaaccaccatataccacataaaccaactgatgaggaaagaaggtcctaatacaggcacttcccctttcattcttgataaactcagagtccaaacagccctcacagaatgactgcaatgtcagggaactgaaaaagaagagcttactctctcccttcaataagtttcttcccttctctgagcctcagttttctccatctgtaaaagggctgctaaacttccttccagctggaaaccaagatggcggtcttggcaaacctggcacagcaagaaaaattggcctagggcataggcaggaggagttagagagacagccaagtcttcctttgagtcagtcagaaagacaagaaggctttttttt

SEQ ID NO: 392 - DNA, 6454 bp, Homo Sapiens
agtgaagaaggccaggaagagcagaggatggtgccaggaggatgatgtcgggggacacaggcagctcatgcctggatcaggcagtgactggtgtgtgtgtgtgtgttatgaagagagagggatggaaattgtgaccagagagttggagttgggacccctgtcttgatcacttgagcatcagcagctccagggaagaacacattctgaaggaggaactctccagctaggatttcatcctgtcctagaggacacgaagaggtggagaccacccccacaactaaacttgaggattactaaggcaatggggactgcctaggaatatttttgagggggtaaaagcaccccataattgtgctaagtaacaaaagacagaacaagcagccttaaaacattctacatgatacactggtattagaataataagatcttaaagaccatccacttgaaaactggatttgcccctggtcatatgggcagacccatggcagacaaagaactagaagttcctcctaactcccaactcaatgtcctttccttaaagaataactgttctttattataaataggccaagcttttattatttagtatagaactcaggctgatatttttattgatggattaaaatttgaattatttctgtagcatagtatttaaaagttttcttctacatatttgttatcattttctagcaaatatcctcaaaattgaaaactgcaacgtcaatgaaatcagtgagcacactaccatccttctaatgggaggtctaatttatcattcatgcatagtaaaaaaaaaaagcataatatttaaatgtgtactctgtgattgtttataaaactatttaagtataaatattccaaacaaagcacttagcttataaatgaacttaaatcctcaaagttaggatttaagtcactcgtttggaatttgttacatatttttcctttgtaatagttggtgaccatattcttaaggcagcccacaaaagtctagtaaattccctactgtggctccagtgtttacatttgtaatggaaacgtgttgaaaatgaatactaatgtagtgctagtcatggaaagtatttaaaacacaaagtaaaaggattggacacatgagttttcaagtcgctaggaagggagaaggtaatgggttaatattaggtcatagagttctatgtctggatgctaggtggcgctattgaaccagaacagctcggttatttgccaagtcaagggtttatagagggatgctcatatgactgttcctattacacatattcacatgttccttgtctttcatgtgcttatttattttggcccttaccaccactgagattttagctcctaaaaattatgactagaaaaatactgatggctcacagcatgtctttaagagttaaggagaaaaagtgttcagaaatacattaatattcactgctcagaaatatgtgagtcttgccccttacttacacatttttgtggatgactatggatcattctctcaacttctctgggctggcttcagtttctcatttttacttttattttatttttgaaacaaggtcttgctctgtcacctaggctagagtgcaatgggtgcgatcatcatagctcactgcagcctcgacctccccaaggctcaggtgatcctcccacttcagcctgcccagtagctgggaccacaggcacatgccatcaggcctgttttttttttttttttttttagatggagtctcacactgtcacctaggctggagtgcagtggtgcaatctctgctcactgcaacctctgcctcccaggttcaagcaattctcctgtctcagcctccagagtagctgggattacaggcacctgccaccatgcccagttgattttttgtatttttagtagagatggggtttcactatgttggccaggctggtcttgaactcctgacctcgtgatccacccaccttggcctcccaaagtgctgggattacaggtgtgagccaccacgcctggacttttttttttgtatttttagtagagacgagcttttgctatgttgctcaggctagtctcaaactcctagcctcaagtgatctgtctgccttggcttcccaaaatggtaggattacaggtgcaagtcactatacctggcctcagtttctcatttttaaaaggtgataagtaataaacaaacataataaggattaatcaataaaaaataattatgtataagatgacatatgtgatcatatgtaataattatgtatatgttcaaccagtgaggttgcttctaccgagtaaacctgctggggccttggtgctccctaattcaaactcatggtcaggattgagcagtgttttctgaatgcccactccacagtacttgtcctaatatcagcagctgcgcaccggctggaagaaataccaagcatattctcttggttatccatcttgctaaaactctaatttttatttcatctcaagtacttactatcctaagcttctgagatactctattctgtctccataaaatgcaaatattaacataaaatgactgtttaaaaaaagttctaaaggctaagtttctccaatatttttggtaggagacaaatttacttgatgtcagcatatatttctacaagaaaggaacagaagaaaagacagttacgctgttattgagaaaggttattaacctgtctaaatggtgagttattgggacaggtagtattgatttgaaagaatcaatgaatatcatttcaatctgaaataagtgacaacccatatgactaacagacattacgatttttactagctctccaaagagtcattgctattagtgttttttcttctgtaatgagactggtatacatatttttagtattgctagagaggagttaccagaagtcagcaaactcctatttttttttttgtttttgtttttcaataacaggacaaacaccaaagaaaaatggccagtggtgtttttgcatcttaattcagctcttcagatggttagttaatctacaatgagttaagggtcactagatcccttaaatcagtatcttagattttagcttttcttctctctgttctctaatctactcagttatcaaactcttcaataaagggaaagagtaatgattttagtatgccctaagacatgaacttagactaaaaatacaaagatgagatggtgaagtaactagaaacttgcagctattctttctttaacctacttgacaccaactcagttgtggtgatgagaaaacaatatgggtgctaagtcttccctgaggctaaaatatattgagaaactggccaggagtgtgtgttgatctcttgtcctctgcctcaggggacacggaaacttgttgggatagaggaactgtggactagcttggtcttcaatgttaccatagaaacatatcacaagaagatgcccaagagaacacaaaacacagtagaagttactgaagcaacaactcaaaggttcattttattgggcatataatgtgtggcagctgagagagttatgctagggtgatatttaaagtatttgacaaccagctccactcaagaactgaactcagaacagtcactgagtgtgacactggcccggggtcctgaagatccctcttgtgccatgaattagtccttccgttacatcactgttggaaaaggcgggggtaacaaggacgggcagccaggctggcaggtgcaccctgaaggccgtatagaagtgtttcactgttttaaccgctagtccagctggaccacgtggactggccaagtggcctggcttatggaaacctttcatcccactacacaggaaaaccagatgtcctttattctctttgagatatttactatgccaaactctgagggaaaaataatctttaatttataggtggaaagatcatggctgaaggtaaaagagttaatagtaacttggttttcagaaatcttttctccttgaattaacgaactttcagatcacggaataaaggcccataatttctgagaagacacatatttaaatggagaaaataggaagtcaatatgatataccacgacaagagccactaagtgggtcctctgggctaagctttttataggtggtttatctgtattcaaaagcatgaagataaaaataccctcatctaggttctcaggtccacaacccctgtgctgggttttgcatcctgtgaatggtgtgtgttccagacctcaggatggatggtgatgtaactggaagaggactctcacgttggctcctcctcccaaatgctgggacaagagagtgctcattaaaataaacaatattaataaaataaaaacacatacatttatttcgtacactggctctgagggtcagaaattcaggggtagcttagttgggtggtcctggcttgggatctctcatgagacagccattaacatgttggttggggctgcagttatctgaaggcttgactggggtcatagtagctgctcccaagatggctcacacacgtggctcttggtctgaggtctcagttcctcactatgtgaacctctcttcatccatagcagctgatctctctcagagcaaatgactgagcagacagtaacaaagttggaagccataatatcttttatggagagtgttcatcttatgtgtcaccaggatttagtttgccctttatctcagactgtgtattagacacacacacaccacacaccacaccacaccacacacacacacacacacacacacacacacacacacacacacacacaccatagaacaagataaagccaaaaggagaaaatgattaacataaacctttcttcttcaaaggagtctaatttaggataagacctctccttgcacaaagaacggagtttatgttgtcttctagaaataaaaatcagtcacatcaaactctttacattaaaattctataaactctttaaatggcttgttgttgaaaagacaaaggaaatcctagtttcacaaccccactcaggtaaatgggatttgaactctaatgagagctgggaggctaaggcagcctccaccaactatccaccttccttcagcaagtccctgatggtggtagggccaccttgaccttgtgcaacgggatccagggctctctgggcaaagaccagtttccctgggccttgggacctaccagtgatgcaggtggggttcgggaaccctgtggaatgtgaggcagcagactgcatttggggagctttcatctgctgcttccttctttctttctttcttttttttgagatgaagtttcgctcttgtcgcctaggctggagtgcagtggcgcgatcttggctcactgcaacctccacctcccaggttcaagcgattctcctgcctcagcctcccgagtagctggaattacaggctcccaccaacacacctggctaattgttgtatttttagtagagacagggtttctccgtgttggccaggctggtctcgaactcctgacgtcaggtgatccacctgcctcggcctcccaaaatgctgggattataggcatgagccaccgcaccgggcctatctgctgcttatttctacagggcagaatgccttcttccatctcaggacaacaaaacagaacaataaacagatcactgaatgtgtattcaaggcttgttgtcacagcagtagattaaggagaataggaaaaaacaaacaacgttgtttgtctttctctttggataaaatgacaatgaaaaaataaatgatggatttctgaaagtaattatacttacgatgataccacaggcagcccttgtaattgctttgccacattctatttcttgctgctatttggggaccactcggtttgttaggataaaatcataattgtattttcaatttgctgctctatctattccactgtcaggatttgatacactagagtgcttttatcaaatggaagttgggccagagagaattcatcacaaggatggctctttcatactcacgcatgtttccatcaatggagtccaggtgcacacacacggattcatttgtacccaccccaacaacatgctcaagacaaggctgatggaaaatgttgccagtttcagtttccagcaacatgctcaagacaaggctgatggagaatgttgccaatttcagtttccatagggagaaatggagccattaagcctttggaacatggtgcttttatgtctgaacatgaagctcaagattttggcatctgcagctcctggttctaactttcctttgcaagcccagggaactaactgccctttgtcatcagaagagatcatttcactcctttatttcctgaggccttttcaaggtgagtagccctggacacagacctctcatggagaagagcttgcttacaaatgaagttacctgggtctttgtagatactgagcacgcccttgaagtaatgaggtaaaaatctttccagtaacagc

SEQ ID NO: 393 - DNA, 23792 bp, Homo Sapiens
ccggctattcacagacatcctcttgatataattctgtcccggagtggagttgaggaggctataaaatgtgtgggaaaacctcagaaatctttagctgcattcttttactgcactgacagtgcacgtattatgatagttgaatgtagggtgctctcctaataacaggatatgccgtctcgagcttcccagacttagcgtgctgctgctgggccttagagaatttagttaaataaaaagtgtcaccgcctattcctgtttctgccctgtcaatgaaattttagtctttataacctttccaagtaggctggagtttaacatcccaacaattcaggagactgattttctccattgtaaattctgtggaagttctggagaataatttcatcactaccacccagcagtatgcaatctagaaatttcagctttccctatacttaaaagagatgtgtgtgcaacatttttctccgtcctcttagccccccacttcctgttcccctcaccctgagtgatattacagctcctaatcagaactctcctctaagaaaaactgcaagacgtcaagccactaagcctgtttacatttgctaatgggtatgcatgtctttttatattaatatttttcctaagtattttcagattgttgctttcagatttattgcttcctccttaaaatatagctgccctgaaagcagctgtattgtatctattttttgtgtttccccacagatctgaataatccagggcttttctcacagatgacactcagtgtggactaattgataatgtataattttatagcaactattttctgagttttaaaaaattgttattttatttctgttagtctttcagacactggaaaacatttctattttattggcatttttcttttcaataaagcattggtttttttaaatcatttatttttattaaactgctaaacatactatgttaggttccatacatgattaaaccaccaaaagataaaggtcttgccaatctaatgtatttacatgcttattttctttgattagattataagctttctgaggtcagagacattaaatcttgataattctattttttcctgttataaacagcaagtaaagcaccttgcatgtatagtactttagtaatgattttatattatcttattgcagcagtgtctactgttgcctcttatcttttatccagatgagcaaatgacagttttggtcataatgtagttaccccagatgtatttgtgctacagcttttattttttaaatgctcttttgttagagtagtagtttataagacttatttggggatgggggtcagttgcttcagactcaggtggctttccaacttgtaaatacaattttcaggctggatgattagcatgcatcaagcatcccttcctatgaactctaaataaagcagatttattgcatattctgtggccctctgttttagcacattggaaaccttagactcaaatagcagtgaaaggatagttattgctgagctcagaagtcttccctgccaaaggtagaatgtaatgtgttctgtggtaataggattattttgtttgaccaggtgacactgtttatttcttatgaaaaattttgatatactgctttaaaatttagtaagatggatgcataatttatgcagtgaaatttgaaaggtttttcaaaatgataaggccaaacctaagctaaatgagggggtaggcattctttataataaagctgttatactctgcccagctaggccagttatccctagatgctacagattaatggggcaatctgtgttatgtaacatttgttctatattattctgcctctaatgaggtgaatcaaagacgatgtcagttttaattctggatgcccttgcttcagtatagtataatacataggtacagccttttttagtagttttcagatggcttctttatgtttttatattgaagaaccactaacttcccattggcctataaggttagcaattgattatttatagcaaatggcttgaaatgttagatcatcagtatttgtcaataagcctgtaataacttgtttccctagcccttaacttagtgttgaagaaaaaaattgtggtattcattgataggacttagaaagcacagaaattacttattatttaagatttgttctaccaattgatatttaaagtaaaacatttttagttactgaacaccattctgtaaatgacagtattttatcctgagtatatggtctgaaatgacttagggacaactttttaaagcaaataactaattacaaaattgggtcttccaatttatttcaaattagatgcttttgtacaaatattcttggttagaaatagtcatataaatacactgttggacttgttctcattgatctccacacctcagttccttctacatgagtcatgggcttgaggttacccagaaatggactgtgaacctataaaccccagcatgcatgtggtattgcgtcgagcatgttctgtgattcccttctactcttgttacagctttattcattggatcaatgtgcattatttgctgtgtgtgctcaggtaatatttttgtttcttttttttagtttgaatatcagtttgggcttagttactttttaaaataaggctgtttcagatagtctctgccacactttgcctagcctggttaattgtgggtggacccatgctacatgttttggcattgcctttttcttatctgtaccatattacaaacttcctagtaatttgacattcactgctgtctttgctttagctttccaacaggtttggtgaaacagtccattgctgttcaatatcagcttgcatcagaattacttggagggcttattgattaaaacacagattgctgggccctgcaaaaaaagtttctgattcagtaggtctggggtggaacataagaatgtgcttttccccccacagttcccaagtactgctgatgctgctcctctaggcccatgctttcagaatcacagagctcatcttacattcttttcctgctagatattatgcccaattaatacatgaagtaaaacagaaaaatccttaacttaaaaacatgtattaatccagaagtttgattataaaaaggtttgttgaaaatgtgagaccattttttctcccagagaaaaagtatattaattgtctagctgggaggggcctatttgaatgtgttttcagagaaaagcagaagaaaaaaatacggttgtaatagaagtagttaaaacagaaaagcagtatggttgtagagtggggtggcggggaggtatatgtgtatttaatcttgagaaccaatgcttttggaaaacagcccgaagggacaagagactaggtagagactggcgaggttcctgaaagtcctgggttacctgtgaaatgccaaagatttttaaagtttgctggcagtggttattatatgtagttttacttccaaatttgaagatttcctcttctttgatgcaagtgtgttggtaggaccactgataatagttagtggagatatttgtgggaatatatttttaatcagaaagaatgcaaaaagagggggagacatttctttgagacaccttaatgacactgggaacagtagaaggtggaaagagatcagagtgtgggaaagatgtgcctgagatgaaattatctgaattctgaatgtgggggagaagatgaggagagggttgagggggaggagagatgactaagctcctcacagtgtttcattaactgtcttttacctaaaggaggaatcttcttaatgaagattggttgatgcatcatactggtcatcaagtaagttcttataaatgcaagtttgattgttttgaagggaaggatataggaaggctggataatcagctacatttagatatggaacactacaggatgtcggcatttattgttgtaaattcctttggtgaaaaacgttatcacttgtttgtgactagcctgggcaatatagtgagaccttgtctctaaaaaaaattttattaataagaaaaattagccgggcatagtagcgtgcctgtagtgccccccactgccctggacacgcccccacttccaaaaaaacaaacacccaactcacttctgccttttccttggattctacactttctctcaggatatctttccgattgagtcttgcctcatttatgtgaatgctgtgcctgttctttttttcaacagagtcttacgtaaagaaccgtacaaacttagtaaagagtttaagtcctgctttaaaccaagtttcagttcatgtaaacatcctacactcagctgtaatacatggattggctgggaggtggatgtttacttcagctgacttggaatgtcaaccaattaacattgataaaagatttggcaagaatagtatacagaggcttgaatttttaatgtaattaatgtaattaaaggtttgttggaaatgtgagaccattttgttctcccagagaaaaagtgtgttaattgtctagctggcagggatctacttgaatatgtttgcagagaaaagcagaagaaagcatggttgcagtaggagtagttaaaacagaaaaacagtatgcttatagaggaaaaattactctaaatttattaaaattcctttaaatttgttactcaatttaaatttttattgtatcttttcaattttgctatagcactaacatgacataaggctctgggtattgggacaaaagaatgcccttgtttggtagttggggtcgggtttgtagtattgcagtgtgctttaacaagcatgggctttgacatcagacatttgttgccatctggactccacaagtgaatttgctacgggatttggaggagggaaaggcactgtttccatacctcagtggttttctcatctgtaaaataagtatgtgattgcatggattgacttacatgatgaatataaagttgttcattagtacagtacctgtcatattaagtactcaataaatgctagttattattaatgctgtgttgtaggtgttcagtaaatagttgccataatgcttaaagcagacataacttgtttttatttttgcaataaagatgatgccaactttttggtttaatggaaatgctttgaatctttgatattgttgtaatatagtggcaaagaattttgaatcccagcttctggagctcatatcttgattctgcgagttacttcgctatgttactttgggggaagttattaatctctctgtgcctcagtttcctcagtcgactaaattgaaattataatagcacctacctgataggattgttgagactaaatgaggtaacaatttaaaaataagctaatacctgataattagttctatatatgtactgattggtctaaacgttatttccattttcatgtctttacttaaaatactgaaaattaattttttatagctttgtttttcagttccatgaaatcagcctgccttttctttttttggtgatacatccacattctgtataggtgaaaagcaaaacaaacaagtataaaacgaaaattatgtaagaagtacacacatcctagcagcttggcaagtgtctgtatgctcttgcctgtgcctaaatccagaattagaattcatgcttggtgctcctgtggaagatgtctaaatgttatgagaaatacatgattaaataaaaatgtgaaatgaaagcatggagacttgttgaaggtgagtgctgtttttctaattatatattttatttgtttaatgaataatttgttaattttctttgtcattacgagagagctgttttattctgtacttaggtgcatagcatactatgttttagtgagctccacatgttaatttgaaacttgccaaatttttacattattttataatttatagtactttgagaaacatattgcaatgcattacaaagcatataatgtaaaggtagttttatgaagtgtttttctcccaaattaagcatatttgggaattgcccatcaatttgtttttgaacctcagtgcataaaatatagaatttttctttcatatgctagatgtgaaaaatactcagcatatgcatgtggtttaggctacaaaatagcctgtaggttaaattcctaattctagtgtttaattcattgccttttttcttcttgtttaatggccatatgtttatatctttatattacatacattcctgattatgtaataaggtctttgatcatgtgggctatcagatttgcctcactttgtctcttagaagaagctatacatgaaactatgttgtacttaagtgaaaatttgagtatttttcttgtttgaattaatgcagtgaaacattctacttacagttagctgtctcccacccttacaggaaggtacatgccttcattttttaaaacactgtatatttattagaattgttacagaattttagtaaatatattctaatcacatattttctgattaatgtgtgcttatcagttttaaatgttatgaaatctggatatatgttaaaatgtctcagttttcccctcttgtttaccatattgccatttggtattaatagataacataatgtaaaattggatgtctttgataattttgggatatgttctgaaattaaacttgaacttttttctgtgaattttgaagatttggtatcttataattatttggtgagcatttggcatgaattatttagcttctcccctgtttatgatttatttctcttgtcatcgatttccaataggaaaatgttatggttctaaatgtctcctgtagacttcagtaattgaaaaatgtcagtcaagatggggggaatctgtaatatataatagagtttatcttttagttatgttcatttccactttttttaatgtgttttttttttagtaaatgtcaaaagtgttactcagtgcaacatattatgcaatattataatcaactaacctcttcattgataatgacttcatattgagaggttttttaaatctagaaatattcttgttttaaattccaggttaaaatgtaaaggtatttttatttttttaattttaattcttctcaaagctactagtacattataaaacaacaatttcacatttagaatttttatatgtatataaattaggattattttttaatattagccttaactttctttaacttttatgaaaaacaactagtcccaagggtatttttactatttaatatacattattcctgtgattcaaaatcttagcagtagaacctgttgagctacttaactttctgtcttgggactatccaggtgcagttataactggtttcaaagttgtgaccttttccttgcttgtttcaaaatcattccttaaaaaatgttcagtatttttcttttgtcaaaaaataaaaacaggatttgtgggttgttctgttttttaaaattagtttgagaaacttcctttgccacttgttttctgtgcaaatgttgtaagagctcaaattccctgggggtagggaggacttttataaggtttttttggttgaagggtataaaaggcacttaaaaggtatacagttacttttatttcgatatcccagtcattttgacattatgataagctttccccactttataggttatctgaaaatttggtggggggcgggtattttatttatacttaatataacaaaattattttcctatgtgtagtcaatagcacatacaaaaaattatctcctgtttgtagtcagtagcacagtcagtattcaccaaaatactgagttatttttcaagtaaaggtataagtatgaatgagaaacagtttgtgggttgggtattgtcagtccttctttttcagataactttctaaatggtcattcaatctgtaatcttaaacttttttaatgttataaattcttcaaatcagtatttgtattaaatgcagtgaccagactatgtcactgatacaatgtcatgattagatgtgcagaagactatgttacatggatgataaatgaacttttaacatatagaaattaatatcagattaaactaaaacattaagcaaagttaatacatgcttgcatacatatatatatttatttattaatgatatgtggagaatctttgtgcttcatagtcactagacctaaagtagaagcagttgtcaagaatgtccaactgctattcatctttgtggccaaagtaaatttcagattttttttttgtaatggttttctttagtctctttattaacccatcatcatgacaagtctgtcaagtgacacatgtgaaaagcagatgtcctttcttattcctggtgcttcctaaggaggcagtgcaatgcaggagaaggaacattattagagataaaggaaaaaaccagaagtgctttctcctctcacattccactcaacacttctctcaccaaatgtgtgtggggatttctctccaccaacaaccagcagttctttactgcagattctccagtggataccagccaggtgtcctctaattcagttcaattctgacattatctactgggagatagtgtcagatcccgcaagtggagggctcagtcctacaagactaccccttacttcagatgtcagtcacaagcagttagcggtttgtgattctgaccaactggctagaggtccccctcctcaagtgtgattaatttgctagagcagctcacagaattcagggaaacactttatttacatttacccatttattataaaggatattatgaaggatacacatgaactgccagaaagacaaggagcataggcaagatactgagaagggtcacggagcttctgtgccttctccaggtgcaccaccctctgggaatagtcagttcatgtgttcagctgtctcgaagctcattcgaaccctgtccttctgagtttctgtggaggcttcattacgttaaggttcagaaatcaataccccaaaatatggggctttgacatgctgaattaaagaagcagcctcaaggcctcttggccttctccagctctcctcacccaaatcctgtctctcccaaagcacaagatgaggctgttcaccaaagttcccttatttacctagaaactggaccttaaagaggaacacagttgcctgcgattccatccctgtaattttattaaccagagattaaaacttatatcacagaggaagagactaaaaattaaacaccacacctggagcccagatgacctgtcccaatctattatctgttctccagtcccatttagttcccaaagggaatcatttacaaaccattgtctgatcttccggcccatttatttacagctccccctctttccccaatgaaaatgatacttaagtgtcagccatctatcggctctttgagttttcacattttgtatgactcctgtgcacacacatgcatgtaataactgttatacttgttaactttttttcattataggggtatccaccatgattatatatgatggggaggaaagggattactccatttctgcccctgcagtctgtaggcatgattgattacatcattggtcgccggtgattaactcagtctccaagccctgtcgtgtccctggaggttggagggtggcactgaaagctccaaccatctcatcatgctttgatctttccgatgaccagaccccaccctgaagctatctacgggtccccagcaacattcatttcgttatcatacaaatgacattcttacaatttcagagattccaagggctttaggaaatggagatgaagagcaaatatatatttcacaatatcacaaacatacccttgggaattagacctctgatctaatctaggctccctcacttgccatttttgtgaccttgaacaagttgttcatcttttctggatagttctctgttaaaaaaattaaaataaaaaaatggtggctatcaggttgttaggaggactagataagagaactatgtgaaggaccctgcacagtgctagcaacaaagttgtttagtaagtgctatttcaatttattttgcttccaagctcatgtgagctccctcagtgtgtaccaccaaatcacatgatgtgtatcccagtcaaatcttaaaggtcatccaccttgaatctttaagttaattaacgtgtgtttttaaaactgcattataagaacgttagggtttttgttttgatcctatggaagttaaattttttacacaagcattcaactgtttagcttcaaactgaacagataaatagtctgtattatttcattatgtattaaaaaatgattaagcctgcctcaggcagttcaggcaaagcaggtaaaagattatcaaggagtaacattagaaaacactaatcagagtgcctaaaaagctttatgcggtccaggttgtacagggatgttggaacagtaaaacaaacaaaacattacaaggtatgaagcgttcgagataggtagaatagagcaggttatattagagaagtctcttctaaaattgtgttggctagcctgggatttgaacttataccgtgtatgtatgtccatgtgtaacaggttgaacatgcaagaagcagtgttcataaaaggtggcaaacttgttttacttgtttctcagtcttttcagatcagtacttataaaacactgatatttacagtaaatatcttatattaaatattagctaaccctattaaattgtgtgtccttgtgctgcagtcatttaatgacctcattctttggtaagttggcatgtgatttgagatagctctaagtgctaatggattgtttgaaggagttaaaggcaaaaccaggaagagaaaactatttttaggaaaaagcgatcatacaacaggccttaaatagaagaaatgagatatctctatctttactatgtaacctttaattccttacacattttgacttcatattttttgtatgtaaatgagaatgttatagtcttgtaaattccttttcctctgtgactacattcagttatttattttattgtgtgtttgtgcatgtcggtagagcacagtatttagtagaatgagttattggttaaaccacctggattcatttgtaaaatggggccacctgtctcttaaattgtaatgaggatttgattagataatctagataaatcacttagcacaagagtctccagcccccggactcttgactggtactggtctgtggcctgttaggcactgggctgcacagcaggaggtgagcagggagcaagctagcactagggcccaagctccgcctcctgtcggatcagtggcagcattagatactcataggagcacagaccctgttgtgaactgtgcgtgtgagggatctaggtttcgtgctccttacaagaatctaattaatgcccgatgagttgaggtggaacagtttcttcccaaaaccgtctcaggaaacctgtccctggtgccaaaatttgggggacctctgacgtagcacactatctggcacataccaagcactcagaaaatatcccatttctcaaaactcagttccagtgtcaagtcttaatagtatattgatcttggaactccaaggtagttggtcctctctttgtgccataaatgtgccttgtactcagtagtgctaaattgctatcaactagtgctaaatgtactactaattcatctgtgtgtccacttcccttcttagattgtgagccccttgaggacagagatgggtttactcatatttataaattcattggcatgataaatatttgctgaaagaataaaattgtattcttatgttttaagcagggtcccctccacctctgagtggaagatggtctgggagcaaaggtgacaggtcttctaaaaaatctggccacattctcaacccaccacacccccgcttttttaaacagctatttaattgccattgtaatcctaaggattggatcaatttttcacttccctttttcacacttttttccttttactaagaaaataaagtaataaagtgactgccaaatggagaaaactgtccactaaatatgaattaataagtgctattatcagaaattgtgtaaaagcaacataatggcactataaaaaggtattatcttagaatcaaaaaccttgggtttatattatagccctgctactttctagtcatatgacagtgatcaagctatattacctctttggcttgacaaaataggggtcatctctatttctggcttgttatgattgatgtgaaatattcatacaaactaccactgtgcctggtaagtagaagacactcaaatatgtcttggagttacagttaatactgtatcgtttaaatttgagaaaaaccaactttaaaaaatcacatagatacagttgtttactgctagaaattttatttaaattagttgatactcttggttaggtaatgaaaaacaatggttttatctccattatgctgtgatagggaagagtaacacagttcaaatggcaaaggcatacctgacaattaaaatgcatagttaaaggctaatacttcctgaacacaagaagacaagtctctacttgatactactctccacagttaaatcattgatactttgtgccatacagtgaaaacagaaccatctaggtgttcacggattgtatttttccttatgaaaggtagaaggttagagaaaattattcccaatacaattaatacaaataaaattggttattaggtgccttttaattaggcagtaagggcatatgaagcttcattacctatgagaattttgtcaaaattatttcccagttaccatgttttaaaacagcctctcagaattccccacttctaatttctcctttctattctaccaattttactccatacctttttgctaaataaacattttcttccaactctgagtttggtgtttttttcatttgatctgctcttcaaagtgtatcagctagtgattgaattaggctatggtgtaacagagaactctaagacagtagcttaaacaagattttttttttaacccctgagtcttgctgcctttttcacaaagacaaagctttttcagaaactcccagcttatgtctcatttgccacaactgcgtaacatggctatcttttagctgtaagagatgctgagaaacatagtttttttgctgggcatattgtcactgagcaaaatcaaagttttatttggattattgtacttacaattcaccttttatggcaatttaagtagtcatttgtcatagattggaggatttcctggaagggtgaagaacttctatataggttacttattctgactaacataaattatcctaccaccacaatcccataactctaaacttacagagatgtcatagaaaacaacaaatatacacacagctaaccacaaaagaaaaaggaaatcccagctgccagaagtgaagaaaaaacagccagaatagtgaactcagcagctgaaggtacactgacctaggtggatgatagtgttggctgtgggtctcaccaatggaccctgagactttaacagcaagagatatggcctgactatacagggaagctgggactgagacctacacaaagccaagaccttagaaggtgctccagcctcaggaaggaggatgagcaaacttctacacaataacccagggaagctacaaagttgtctgaacccaagactttagggtggagaaagaggaaggtgtctgtgagaaagagttgaagtttacatttcagttttgctttcagaatatccatgcttagcttaaaaatgtgaggcacattaagttactggctttaataaaggaatgaatgaaatgtacagaagtatgtgttctcggggcctcttttaaagtcattaggggaaagaattggcatatattcagacgcatttgaagaaattatatatttttggagatggagtcttgctctatcgcatggcatgatcatggcttactgcagcctcaatttcctgggctcaagtgatcctcccatgtaagcctcccgagtaggtgggaccacaggcatgtaccaccttgcctggctagtttttaaaatttttgtagagatggagtctcactgtgttgcccgagctggtctcgaactcctgggctcaagtgatcctcccaccttggcctcccaaagtgttacgattacagtcatgagccaccatgcctggcctgaaggaaaattttaaaacagaaggaataagctagaatgcagcacagaagaggtagaaaattgaaagtaattcatggaagatccaatatacatatatattttaggagtttaaggagaaaacagaaggtgtgaggcagttgtgaactaacagaatgtgtagtatacaactcttggtagagaaatggtacgcactgaagtttttgaggcgtgggggacaggtagcttccttctctcatgcatactcctgctgccaaattaccccctaacggctacgttataatgaaaacagtttcatgccagcttctgttatattaaccgagcaagaaaactgatcttagcatgttctgcaggctaaaggaaattgctcttggcccatttaggtgctctaaccaccatcttgcctgaaaggttcctttaagaagcagaattctattactttaacaaaaggtgtgttcatggctggacaagagccttttagggggttagactaggacatcatcccaaaatataagggctacaggccatgctggattcttatggcctcttcttgcaatggtggtatgtgttactctgctattagtcagtctgaaaacctttaatctcaccatcggaggcccatttaaaaaattactttagcaggtcactaataaaaatttctaccatttagtatgaaaattaagacattgtatgttgatcaagatgcagtcaacaatacctagaatagcttccactagagtatgcattctctgattagaacactagttcatcttcctagtgaactgttctatcaggatggtagcaagacttaagcgatgactttacataagttatgtgtaccacactgtgtatactggagtatttccatgtaaattacagacaacagctatactggaagcaataaatggccaagaaatttccagagttgaccaaagacatcaggaatgatacttgcttccagaaaaagaaccaatgtaacattggcttaaactgttgtgcttttgcttttctttcagatgtaggctgtccaggtgtccggtactataactccacaagatcagtagggccccaggctttttctgttctttatgatccactctctaccatgtagcatttgtcttcaagatcaaaaaatggtggctgtagtgctcacattccagataaggaagaatgggcaagaaacaaaagatccactccaaatgtgatggcaaaattaagacttttgagtgaaaaatggaaatttgtcttcagtacatacacactgaaagaaatgttgaagagagttcttcaggcagaagcaaaatcattccaagggaaatcctggaatgcaggaataaatgaagagcaatggaaatggtaaatatgtgggtaaatttgaaggaatattggctgtattctgtggtttaaaatatctgtggaattaaaatgcacctacaataacgagacaggagaagtttgtactggagtttgtcctcaggttctagcattaggtaggtaaatggtaagattactttttttagactatgaagacaagggtgcatgttgtaatctcttaagcactaaaaggctaatagaatgtatacctaacaatttaatggagacaaaagcatttaaaagaaggcaagaatagaaaagggacataaaacaaatgggtcaaatttaaagttgcaaaatagaaacccaaatactttaaatgagtcattagttgaattaagtttaaaaatttatcaggctgaaaattccctactacatgttgcttacaagaggcatactttaaatacaaggccacacaaaaaggttgaatgtaaatggcatagggaaaaaaaaacacagcaaaccaaataaaaacagtttgaatgtggtattgtcaggcaatgagatttaaggcaaaaagcattaccagagataaagagggacattttataatgatgaaggaattaattcacccaaaacacataaagatcctaaatctgtatgtgttgaaaacagatttgaaatacataaagcacgaatgacatataagaagagaaataggtaagtgtctaaccatagctggaggcttatgcagctttttccatagctgatagactatccggaccctacccccaaaaaatcagatgcagaggatctgaactttacatatatgaatacttgatttaaaaaacataattcacattttcttcaagtaaatttatcaaaatttaccctattttgagtcataaagcaaaccaataatctcaaaagatcaaaagcattcatcttacattctctaacacagtggaattaaactagaaaacagtaaaaaagatgattagagaaacccgcaactactctgaaattatgtaatagatttcttgatagtccctgggtcaaagaataaaacaaatttaaaaatattttcaagtgaataatatgacataccaaaaagtgtgttgcagctgaagcagtgcgtggaggaaaatttatagatttacatgcatacattagaaaagaagcaaggctgaaagtcaattacctaaactattttcaagtagctggaaaaagaagagcaacgaaataataaaagacaaaaagtcagtgaaataacacacaatagagaaagccaaaatgttggttctttgaagtctaaaaacaataataacctctactgtttaacatatttgagatattagccaataacgtaaggcctgaagtaaaaagatagaacgtttagaaagaagaaaataataccatttatagacaactggttgtgtgcatagaaatttgaaaagactcaacaaacaaaataacttatcaaggtcactgaatacaaactatacagaaattgtatttctatatatcagaaacaaatagaaattgataaaatgataccatttacactagtgtaaaataaatacaagaaattttccaatcatttaagcattttttttttaattctaaatatatggatataccatgttcatgacttggaagtcaattttgtaaattaatctgtaacttcaatatatgatattatcaaaatcccaacagtatgttggagaaattaacaaactgaagaaatgcaaaggaccgagaatatccaagataaacttgagcaataaaactgaaaaatgttcaccaacagacataagacctgtgattataaaagtgtagttgtaattaacactgttgttggctggcataaggatagacaaatagaccaaagtaacagactagagcaaagtagactagaacaaaatagaacaaagtaacagaattctgtatacgtggtgatccacacatttaggtcatctgtgatttatgagaaagagaaactattgtaatggtacagtcaattagatagctgtattggggaaaaaagtagaccccttccttgataccatatatatagaaaaatcaattccatgtggaatatggtttaaatgcgaaaggaaataatgaaacaggagagtgtcttcatgttttggggtaggcaactatttaaaggacataaagcataaaggaacattttaaactaatttgtggtgatagaatcagggtagaggttatcactcgcctggcaaaattaatcaataagaaaagataacttagccagacacagtggctcatgcctgtaatcctagcactgggaggctgaggcatgaggatagcttaagaccaggagttcaagactagcctgggcaacatagtgagaccttgtctctacaaaaattttaaaaattaactgggtgcagtggcatgcacttgtagtcccagttacttggcaggctggggcaggaggatcatctgagcccaggagtttgagcctgcagtgaactataattgtgtcactacactccagcctgggcaacagagcaagaccctgcctgtctaaaattaaaaaaaaaaaaaaaaagcttgatatcaggaaagaaataaggcatgaaaacggataaaattaaaattatttgatttagaaagtgattgtgaatttatgtgaataaatttgaaattttagatattttttgattagtgttgccaaatatgtattagtaaataagtctcaatctgttttttaaaatctactctgaataatgcacaagctctggatgatttattaaaatacattcattgtgaccaagtaaggattatttccatatgggagaatgatttaacactgtaaaatcttttcacatagtatataccatgttaataggttaaagagaaaaggcatgttactatctcagtgaatgcagggagttggagggggagaaccagcaaaatgcaagttatattcacttaggattttaaaaataaaacatcctcttaatagatgaataaacgtattagtacgataaatgatagcttaccaaaacccatagttattgttacaagttaatggtacaactttagagatgttccttaatgtcagcaatagtacaggaatgggatattgtattaatacatctgttccatgttgcactggagatcttggccagtgcagtgagactagaagaataaataataggcataaagactggaaagagagaatcaattattgttaatgggcaagatcattgtttatttgaaagtccaaggaaaactacaaagtagcaaaactaatgtgagtgttgagagattttggatataagagcaatctgcaagaattagtagtgttcttttccacttcagtgtgtttgaaagtgtattatttgaaagaatttcattcacaattaaaactctaaggggacctaataatacatccaataaaaatatgcaagattttgtagaagtagactaaaatgaatggagcagtattctatgttagagaatgggaaaaatcagtgcattaaagtaccagttctctccaaatctataaattcactgaagttccaatcaaattctcaacaaaactttttatggaatttaatcaacctaacctgaatgtggaaagacaaagctgagattttttttttttaaacaggaaaaataggggagtacctatcataaaagacagtagggcttataaaactatagtgataacacagcccttgtgatgccaggatagacatgtaaatctatggtacagaaacagatacatgagaacttgatacgtgacacagtggagaaattagtaacttttcaataaatggcactaggacaattgcatgtctgtatgtgaaaaaattatatacccttctcacaccatatttttaaaaactggtagattaaagacctaaatgtggcggaggggggagggggcgggaataccattttaaatattttagaaggtaatacaggaaaatttgaaccaatgtaaggaaggagttgttggatgtgactcaaagtgggaaccatgaagaaaaagagtcacacatctgactatattaaaactagaaacttaagtatgacaaaagacactgaatattagagggccagccacagacgtggaaggtacttaccttgcaattatctaccaggaactgacaaaggaagtgtccaaattacataaaggactacttaaggggggaataaatgagtgatatatgagagagaaccaaaaggtcaattaacagaaaaatgttttagctcactaggagtcaaggaaatgccagtcagcacagttagataccatttcacatccagtcagataatatcagggattggcaaacatgttgagaaaataattcatactttagtaaagttgaaattacatattgcttataacagcagttcaacatctgtctttttataagactaaagttttgcatcatatttaggtacagaaattgtcagaacacttaaagcttgtaggcatttgttgctgggagaagactgaattgcttttttcaaaaactggaaatcacattgatgtgttgtaaaagagaaccttagatttagagagggaaaaaaaactacagtattttgttaaatttatctacatttaaagatactaataaatgcagtttatgaactaccagtctcctatattggtcatattttgacaagtaaagctttttttttcataacgtcaatattcacacagaggttacagttcagattaggagaacatatgtatgataaaacaattagactaaaaaggtcctttctttttatatgaaatggcagaaaagcaacagcagtttattgcttatgacagaatacatatgatactcgaatatttcttgagatctttgcttaaatctagtatctatacaaaatttttatgttcgctagattgtaaattcagttttcttactaagaaagactgaaatttattaataattttggggttctagtgattagcattagagactgatttgcttttaaagagaatcgcatattttatatatttccaattttacatacttctgaaagaacataactttgtcattaatatatggcatatgtatacaatgaaaaatgtacaaggatgtttcttacagcagttattgaaatagcaggaagaaaaaggtaacttaaaagacacttagcactagagtctccagtcacatctactccctggcccatgaactaagaacgtttttaacgtgtgtatgaaaggagtgacttaatagatctggcgtgttgaaacctgcacctttcaaagaaaggtctagccctcaacttgctcctgggagatcacagcgctaagcccctggaatatcctgcctgatgcaaggcctttgtttacctggggccttggatcacaccagatagtttatgctacagatttatggtgagggcattgcaccttgcagtatcaatttaatcgccgggggaggtggaaactgaataacatctgccatttctgttctccatgcctatgtgactaacacccaataaaaaccttggacaccaagtctcagcttccctggttgataatatttcataaatgacccacactcattcagagaggattaagtgctgtgcatgcatctcctgtcagatgggacaactggaagcctgtcctgctctcttctgaactctttcctatctgccttttaaaactgtactgattttaaactgtacttttgctctaataaactaattgtcaacgtaacttttctgagttctgtgagtcattgaactggacagtggtcttggggaccctgccataactgtttaaagaactgttttttaaaaataatatttgatagagactgtatgttctgcaaatcctaaaatatttgctatttggtcacttacagcaacagtccccaacctttttggcaccaggaaccggttttgtggaagacagtttttccatggacaggggtaaggggggaggtgtcgggatgaaactgttccacctcagatcatcaggcgttagattctcataaggagtgtgcaacctagatcccttgcatgtgcagttcacagagaccactgctgatctgacaggagatggagctcaggcggtaatgctcacttggccatcagtcacctgctgtgctgcttgattcctaacgggcatggaccgatactggtcctcggcccaggggatggggacccttgacttacggaatacttttgccaaccccagcagaaatataatgaaaaaataagtttgtttcatacattgaaaacagctaaaatggatgaaatctcaaacttttaactggagaaaaaagtaacagaaggttgatatagtgtattatttatgtgacttaaaaacaaaacaattactaaagatgtatatgcattaagaaaatcacaaaggtttttattttcaacatatgttgaaaataaatgtgtgtgtgtgtatatatatatatatttacatatttgctcataacaatagtttgaggatgtccgcaaacttaaagcttggggtagggggtggaaatggaatggatgataaaacttacttgtctcatttttgtttcttaaaaagagatgcagggtgtattagtccattttcatgctactgataaagacatacccgagactgggtaatttataaagaaaaagaggtttaatggactcatagttccacgtggctggggaggcctcataatcatggcagaaggcaaaaggcacatcttgcatggcagcagacaagagaatgaaaatcaagcaaagggggtttcccttataaaactatcagatcttgtgatacttattcactaccatgagaacagtatgagggaaatcacccccatgattccgttatctgccaccgggttcatatctcagggaaaaaacagaccttgtaaaacaaataaggtagttattttaattaatattttcatgtatttccttaaatcaacttagcttagaactatggaaagtcagaaacaggccttggtaggtaaattgcccaagtcgtggtgaattcttaaagacagcattctataggaaatattttagtgctggcagatttagttattttgaatggtggaaacttgaaatttgatctttgaaatataaaggaataaagatataaggactgtactgtacattttagagacatcaagttctcttaattttgtgactctacgttgagaagaacattgagagattacatgagtaacaagaaagagaaactttctgagaatgcacagctacctcttttacaaataacaaagcattgcctttgcaggggttagttttctttaggcttggggcaagacattaaatccacccctggtttataatggaggcaatatacagttgacctttgaacaccattggagttggagtaccaatcctaaccccaccctgccaccccctgaaaatctgagtgtaacttttgactgctctcaaacttaactactgctattgactggaagccttactgataacaaatagtctattaacacatacttggtatgctatatgtattatatactctattctttaagctagggaaaagaatgttaataagaaaattgcaaggtagagaaaatatatttacacttcattaagtgaaagtggatcatcataaaggtcttcatcctcctcacgttcacgttgagtaggctgaggagggggaggaagaggggggttgatctagctgtctcagatgtagtagaggcagaagaggtagaaaaggaggcaggagaagcaaggcacggttggtgtaacttttattttccaaaatccacatataagtagacctgtgcatttcaaacccgtggtgttcaagcatgcactgtaaccaattggtattttcttaaaaataaaaaaatcttggttatttgtagctgccacaaaacacagatcacaccaagtttagtgtccactgatatctggaagactttaagggtattacattttaagtgctattaggatcttgagtaatcatcaaataagaaaatgggtattaaaatgctttgtaaactgtaagttaagataaaagtggtattcctgatgttaaccactctcaactgagcttagatttctagtatataccagcttgggtgacatagtgagacctggtctctacaaaaaaaaattaaaaaattaagcatggtggcacatctcagtagtccgagttactctggaggctgaggtgggaagattgcttgagcacaggagattgagactgcagtgagccacagtcatgcgactgcactctagcctgggcaacagagcaagaccctgtctcaaaaataagtaaataataagaagatttctagtatataaagtttaatgataccttcccta

SEQ ID NO: 394 - DNA, 6661 bp, Homo Sapiens
gcaatcaggctgcagctggagaggacaagggcggcttccgggtgttggcgggggcatttgtctcctgccgcagctggggctgcagatctagtcttcagttcacagagaactgccccccaactgctcccccgtactctgctcctacaggcccagctgctgtggctgtgcgacctgcagggactggcagacccgtagctaagacgccaggatttcctggaagcagagaaatggccgatttcactactagatctcaagtgactcttgaagaaaggcaagttggatcttgctgtgttctcatttcacccaagacctttggctagatcagaacataaaaaattcatttcaaaaagtgatactgagaagatatgagaaatctagacatgagaatttacaaataagaaaaggctgtaaaagtttgaatgcatctaagttgcaggaaggaggttataatggacttaaccaatgtttgtcggttactcagagcaaaatacttcaatgtaatacatgtgtgaaagtctttaggaaattttcaaattcaaatagacttaggagaagacatactggagagaaacctttcaaatgtaaagaatgtggccaattctttcacaggttctcacacctaagacaacatgagataattcatactgaagagaaaccctaccaacatgaagaatgtggcaaagattttaagcagtcttcaggtcttactatacatgagagaattcatactaaagagagaccctacaagtgtgaagaatgtgacaaagcctttaaacaatcttcaaaactgaataaacataagaaaatttatactggagatacaacctacaaatgtgaagaatgtggcaaagccttttcctattcctcaaccgttactcaacataacatagttcatactgaagacaaaccctacaaatgtgaagactgtggcaaagctttgaagtagtcttcaaacctgactatgcgtaagattattcatatgggagagaaaccctacaaatgtgatgaatgtggcaaagcctttagaatatcctcaaaactgaaagaacataaaagaattcatacttgagagaaaccctataaatatgaagaatgtggcaaagctttttactgttcctcaggccttactcaacataacatagttcatactggagacaaaccctacaaatataaagattgtggcaaaatttttaagtggttttcagaccttactatacatcagagaattcatagtggagagaaaccctagaaatgtgaagaatgtggcaaagcctttaaacaatcctcaaaactgaatgaacatatgagaactcatactggagagaaatcctacaaatgcgaagaatgtagcaaagcttttaagcaaccttcaggccttactctacataagagaattcatactggagagaacccttacaaattcgaagaatgtggtaaagccttttattggttgttaagctttactaaacataattgataggggagagaaaccctacaaatgtcaagaatgtggcaaagcttttaagtggtcttcaaaccttactatacacaagagaattcatacgggagagaaaccctgcaaatgtgaagaatgtggcaaagcttgtaagcagtctttgggccttactatacaaaagagaattcataatgaagagaaaccctacaaatgtgaagaatgtgataaagccttttactggtccttaagctttactaaacgtaagatagttcatactggagagaagcactacaaatgtcaagaatacgtcaaagcttttaagcgtcttcaaaccttactatacataagagaattcatactggagagaaaccctacaattgtgaaaaatgtggcaaagccttttactgttcctcacaccttattcaacataacatagttcatactgaagagaaacactacaaatgtcaagaatgtggcaaagcttttaagaagtctttagaccttaatgtacataagataattcatagtggagagaaaccctacagatatgaagaatgtggcagtctttaaacaatcctcaaacctgaatgaacgtaagataactcatagtggagaggaatcctacaaatgtgaagaatgtggcaaaggctttaaacaatcctcaaacctgaatgaacataagataactcatagtggagaggaatcttacaaatgtgaagaatgtggcaaaggcttttactgttcctcaagccttactaagcataagatagttcatactgaagagaaaccatacaaatgtgaagaatgtggcaaagcttttaagtggtcctctgaacttactatacatcagagaattcatactgaagagaaaccctgtaaatgtgaagaatgtatcagagtctttaaacactcctcaaaaccgaatgaacataagagaaatcatactggagagaaaccctacaaatgtgaagcatgcggcaaagctttttaagcagtcttcaggccttactatacataagagaattcatactggagaggaatccagaaatgtgaagaatgttgcaaaaccttttactggtctttaagctttactaaacataagagagttcatattggagagataccctacaaatgtcaagaatgtggcaaaactttttcttgttcctcaagtttactcaacataagagagttcatactgaagagaaatcccacaaatgtaaagaatgtgggaaagcctttaaccagtccttaagccttactaaacttatgagaattcatactggaaaaaaatcatacaaattggaagactgtggcaaaatcttttaagtattgctcaaatatatccagccataattcatactaaagattatgcctatgaacctaaggaagtttggcaaagcttatgaatacacctcaaactttcctaagccttggagaaatatcagtgagaaacctcagaaaactgaacaatgtggcaagccctttaaatggttgtcacatcttactgtaggtaaaataattgatagtggagaaaatctctacaaacaaagaatgtgtcaaaacttctaacatgctcatactttatggcacataaaagcgtttatacttgaaaaattatacagagtgtggaaaagccatttctatctgctcacatcatagtcaacatcaggaagttcatacttaataaaattattataaatgtaattactgttcaaagaccttggaaaatataaacccttaaaataaaaaagagtattctggagacaaacattacaaatataaagagggttgtaatacctttacttgccctatataatgtacagattttacactagaagaaaactctaaaggaattactcaaacttgtttggcatcagagaatttatgttgaaggaaaccgtacaaatgtaataagtgtggaaaaacatttgttcagaaactacagcttacaaaacaccacacagtttataataaaaaatatttttgcagatggaatacatatgtaaaaatatttagtcaaaattaagtctttgtaaactttagaaaattcacggtagggagaactaaggcactggcacttaagacgttacactaaatcagaatgttctgtaaagaaagtaatccaaagctaaaactgttggataatttatttgtatataagtttaagaggagtggaaggttattttttggagagttaaaattacattcaaggtatacgtttttccttgaaaaaagtgtaagttttttgaaaagcaagtaggtaattcaactgtaaaattgcttcatgctgttccttttttcctgttgtttgtgtaaaagcatgtcatcaatttctgttgcatcagaaatctgagagattcctttcttattaggtaggcatcattcattaatttttccatggaagagtaaggatattaaaatgtaagatgataatgaaaatctgattggagaggctctttatggctgacttttaacattgttcatgtgatgcatgagttatgtgtttagagtaatattctgcattatagtgagaggaaaactttgagttttagtagtaaattgttttaccaattgtacttttatgtaataaaatgtagggaattttaaaattcttttataagactgtgataacttaacttttaaattaaacgaaatggttttaaactttttaagacgtgcatttagtaaagtgttatgtcaccaactttaacgtatcccactgtattaaagatgtagataaaagatggtaacatagtagaatgacctctctagcaatctcttttgcctgtggcattaaactgaaaagtttaacagtattgtttcaatgggtaaaatgtacatttgtttaactttttaaatttttgtaggaacataatattgtttacctatttatggcatatatagaatattttcatacaggcatacaatttgtaatcacatcagagtaaatgaggtattcattacctaatgcattttttttgtattacagacaatccatttaaacatttttagttatctaaaaatgtacaagtaaattattacttgctacagaggttttttatcgtcttgataataattacatagtagtataataaatctcacatttctaagtcctgaatgaatatttttaaaaatttgtcatatatattttgaacaagtggactctctgcctgtaaactcatgcagactgttagtttttacttacatgatgctaaatatacaaatatattactcttaagataaacattaggtgtaagaaaattgtggggcaagtaattgtgtgtgagagtacctattttcagaagacaagcaatattggaacaaaatatcactttaataaagtggacaaatcatttactagaaaaccagaaacctcagtgattttgaataatatctgtattctctgcattttatttaattaattactgtgaagtcttatggactgtgtttccgaatctttccatgcaaattctttctttcatttgcctggtactcatggtagactgattttttttttcatattttttgtgtttataatttattaagtattcattatgtgagttgctcagatattctaagaatttttataaaatttagtaatgcatgcaaaataatttttcaatgttatttcacaatgagtgtattaacttatatttcttttgttgctttcttttttcttttttttttttttgagatggtgtcttgctctgtcacccaggctagagtgcaatggtgggatctcagctcactacaccctccacctgctgggttcaagcaattctctagcctcagcctcctaagtagctgggactacaggcatgtgccaccatgcccagctaatgtttttgtatttttagtagagactgtgtttcactatactggccagagtggccttgaactcctgacctcgtggtccacacacctcatcctcccaaggtgctgggattacaggcgtgagccactgcatctgaccaacttatatttcatttagttagaacatcccattttgttattttaattggagaaacctgtgtaagctaagtttccttattgttccttttactctttataattgacataggtgaatttattcattcagccaatttgtttaagtaaatactggggaggcttcataagtcacaaagatattttgatatgtaaatgtagcaaacacaatgcttgctgtaatagaggcaccattattggccataaatatttctgctggagttagtttgtagctccaagtaaagataaagaaatatgcgtggtgaagaaataaaatcgattctgtatgtggagaggacgttgttcttatgctgcaaaactgactctttctgaatttaaagagacattcttcttattttctgattatctttagttttgtttttgtgtctacttatgtttatcccaactgtgtatgcatcacagcccttctttttcttctttgtgttatggctacatttttattgctgtttgttttgtgccatgtcatttcacacagtactttgtaggttctgatgagaagtttgtcaatgtaactttcagatccgttaattgagataaaaggcatccggtgttcacaggtgagaggaataaatcagtcagaatttcttgtctttgtaaaaccaaacttttattaaattttaacacagtctgtgtgtggtggctcacgcctgtaatcccagcactttgggaggctgaggtgggagaatcactaagtcaagagattgagaccttcctggccaatatggtgaaaccccatctctactaaaaatacaaaaattagctgggcatggtggcatgcacctgttgacctagccattcaggaggctgaggcaggagaatcgcttgaacccaggaggcagaggttgcagtgagctgagatcgcaccactgcattccagcctgatgacagagcgagacttcatctcaaaaaaaaacaaaattaacacaatgtgtggaaaatataaaattagttagaagatatgtcttagaaattaaacttttagaagagttaatggtaagtggagaatgttaaattttttattacatacttacagctcaacttaagttttcattcagaatcttttattttggtgtgaatgttaaatattcaaaaataatagaatgacacctgtggatttcacatgtgaagtaatctttttcatattaacattaaaatcttgaggaatttctcacacttgta

SEQ ID NO: 395 - DNA, 1597 bp, Homo Sapiens
ccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggagagagttagaaaataaacgtttgcgggaagaggaaaaaagaagaaaagaagaaagatgcaaaaaaaaaaaaaaagagagagagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgctcccggtgcagtcgtaaaagccaggcccgtggaaggctcgctgaaggagccccaggagacgtcacacagcggcagtgataaagagcacagggatgtggagagatctcaagaacaagaatctgaatcacaaagacaccatgtggatgacggcaggaggcacagagctcaccacgagcctgaccggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcacttccgagcgcgagagtgtggcggaaacaggaggatctgcaaggcagaaggttcggggactggtcctgagaagagggaagaggcagagtgagtcactgcacgcacctggcctccatggacgagcgagggcatcccagaaacgtgtaaatgaccccgagtgtgactgggaaggagaacttattccttaccaggaaactggaagctaaaaatacagagggtgacatagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtca

SEQ ID NO: 396 - DNA, 2693 bp, Homo Sapiens
ctggtctcgaactcccgacctctggtgatctgcccgcctcggcctcccaaagtgctgggattaaaggcgtgagccaccgtgcccagcctaattcttcaattcttaataaacaatttatactgaagagaaaccctacaaacgtgaagaatgttgcaaagcttttaacgtcctcaaaccttactgaacataagataattcataatggaaactagccctacaaatatgaagaatgtggcaaacactgtaaccatttctcacatcttaccacacattaagataattcatactgaagagaaacccgacaaatgtgaagaatgtaacaaagtctttaactggtcttcaactcatactaaatataagagaattcatacagaagataaattttataaatatgaagaatgtgacaaaagctttaaaaacatttcaacccttattacacataagataatttatgttgtagagaaattctacaaatgtgaagaatgtggcaaagttttttttttttttttgaaatggagtctcactctgtcgcccaaattggagtgcaatggtgcaatctcagttcattgcaacctccgcctcctgggttcaagcgattctctggcctcaacctcccaagcagctgggattgcaggcgcctgccaccacgcccagctaatttttgtatttttagtagagacggggtttcaccattttgaccaggctggttttgaactcctgacctcaagtgatccacccgccttggcctcccaaagtgccccaaagtgctgggattacaagcatgagccattgagcccggtcgaatgtggcaaagtttttaataagttatcaaatcatactggagagaagctctacaaacctaaaagacatgacagtgctcttgagaacaccttaaacttttctaaacataaaagaaatcatagtgtcaagaagccctagatgtgagtcatgtcacaaagcctttaaatggttgtcacacttgagtataagctaatttatcctagagaaaactatgaagaatgtggcaaaatatttaaccaatactcacaccttatcgcataggaaagcatttatacttgaaaaaaaatgtacacctatgaagaatgtggaaaagccattaatatctgctcacatcttaacatcacagagtttatacttaaaacaaatattaaaaatgcaattactgtgagaatatcttttagaaaatataaaccttagaatggtgaagagtatttcttttgatgacaaacattacaaatataaagacggttgtagtactatatttgtatcacagatcttattgtgcatattttgtgctagagaaaaaccctaaagttgctcaaactttgttcaatatcagggaatgtataatagagaaaaaaacctgcaaatgtaataaatttggaaaaaagtttataaactacagcttagaaaacagagtaagttttttttgtagatgcagtaaatatgaaaaatattcaatccaaaattaactctgtaaatgtcagagaattcacagtagaaatgataaggcactggcacttcagactacactaaatcagagtgttgagtaaaaaaaataatttcaatctaaaatttagataagttatttgcatataacttaaaaaagaggaggtgattttttggagaattataattacatttgaagtatactttttgtatacttcaaatatcaaaaaaattaacatcacaatattgaaaaaaattacagactctgaaaagcaaataaggatgtaattcaactctcaagttacttcatgctcttcattcctactttatttacatgtgaaagcatgcgatcaattgttgctgcatcagagatatgaaagattcttttttattagatgggcattatttatgacctttttcataaaagagaaaggatattaaaatataaaatgcatgataaaaatctaaatggagaggctttttgtggttaacttaaaatattgagtgatgtatgaggtaggtgttctgaggaatatatttttgtgcattatagtgagaaaaacattttaaaattttagttaaaattaaaattaaattagtgatgtattatattagttgtgcttttatgtaatgtagtacattcataaatttttagattatatgtaaacttaattttttaaacattttttgacatgttaagtctgttgtacattcaatgaagtgttattatgccactcgctttaacctatcccaccttactcaagggtgtaggtaagagatggcaacagtttactatttggtaagagtggaataacatctctagtaatctctttttttcagtggctttaacctgcaaataaattaaagaatattgttctcgtaggttacatttttatacttttaatcttatttaaacttctttttttttttgccttgacaaatttaaacttatttttcttaacttttatgggtacatagtgtgtagatatatttctgccatatatagcatattttgataccagcataaaatatgtaataatcacgtcagggtaaatgagggattcttcaccttcaacatttattccttgaattacaagcaatccaaatctacacttttagtcactttgaaatataaaactaaattgttatctttattatagcgtcatttttgtggtcataataaaaatcatataggaatgtaaataaaatctatacatatctgg

SEQ ID NO: 397 - DNA, 5259 bp, Homo Sapiens
gattcctcaaggatctagaactagaaatactgtttgacccagccatcccattactgggtatattcccaatggattataaatcatgctactataaagacacatgctcaagtatgtttattgcagcactattcactatagcaaagacttggaagcaacccaaatgtccatcaatcatagactggtttaagaaaatgtggcacatatacaccatggaatactatgcagccatataaaaggatgagttcgtgtcctttgtagggacctctatgaagctggaaaccatcattctgagcagactatcacaaggacagaaaaccaaacaccgcatattctcactcataggtgggtattggaaaataagaacacttggagacaggttggggaacatcacacaacagggcctgtcgggtggggttggggggagtgatagcatttggataaatacctaatgtaaatgactagttaatgagtgcagcaaaccaacatggcacatgtatacctatgtaacaaacctgcacattgtgcacacgtaccctaaaatttaaagtataataaaaataaaataaaaaaaaagaaagtgggcttgataagattttgacttggtagaattttaactaccggctatacaattcttgacttaggaaattaaagccttaagtcttctgaaaagccctttaattcagttatttcattaattttgatagttttgcaccatcatctgctgagaaacctatcctagattgtaagaagtttgagagtgaagactgccttatacatctttttttttttttactttagcacatcttgcacaaagtattcattcattcaagaaatattaatcagctctatgcctggccctgggaatacagtggtaaatatgagacagctacagcttatggcttcatgggtgatatatttagtagacaacaggacaatattaaataagaaaaataacttaggctacaagaattccagagagatgtgagggcatctactttagtctgggagtcagccgtactctcctgtggagagaaggttagtggaaatttgaagcaattggtctggggaaatggttgcagaagactcacttcaggcagaaagaatgtgtgtgcttaggaacacatgagcaagagcctggagactgggaaaaactgaaaggatctcataatgtacaatgcaggaaagagaatggccaaaaatattctataagtttcctctaaactaacaagtattttaccctatcagtcatgaaacacttcttggatgcagctcatggcataagcagccctgtctgttctctccaagtccaggacagcttaggtctaacccagctgtgctggccacatacatctcagaccccctacttcatggaggacagatgttattgatcaccggccataacttcgaagccacctactgcatatttgcactgaagccattcttcccagtggctcttagccagtgactgggcacagcacagacactcagacagactcattcctgggatatgagagctcttctaatgagcagctttagctgaaagatccctcttcggccttgcagaagagcacagtagtctagactcttcctacacagccttccttcctttcccctcttctcacagggtgagacctgcgggcagttccatgattccttctgcctcctccagctcctccccatttttcttcacaggcatttcccccagtaaaatgctcacacatctaatcctgtcacagcatctgcttctcagaggacccaaactaacaattccagacaaccacgtatcttatcctgtagggggagatggcacagttacagatattttttttctgttagttaggcatagacatggaatcccaaagagtatttaatgaagttttttcttaaagtagaagaaataatcatgggctgagtggtagaggatttgtaatcaaagaaatagcaagagagaaagagagagaaaagaagaaataggtgaaggtgaaaggggggaaatgagagggaggctgtggttggggaggcaaacttcaaagaatgttgctggaagagggggaaggaaaaatataatgtgctcactaattctgttggaataacaatctcttattcttggaagacccagtcttctctttaagaaccaggttccatcactctaatggaagggtactcatataatcacaagtctaagacagacagagaaacttttagcaaaattacttatagaagacaggctatatatatcatacagatttgtaaattccaagagtctaactttgggagttcaaaatatctgattttttttttttgcaggtatttctttggaggccaagtcacatgggaacctctttgtccaccttccctctcagggcccaaatatccctctccaaagattcagaagcaaaatgggaggaagttgacaatgatgacaatctatgcctgacttcagccccaaggaaggtttgacctagagaggtgtgaagatgtcaaacctacactgtccaatatggtagccagtagcacatgtgactctttacattgacttttaaatggactacaattaaataaaatttaaaaatccatttcacgggcataccagccacatttcaagtatgtcgtagctgcatgtaactaatggctactataccggaaagcacacacagaaaatgtttcatcatcacataaaattctgttgaacaaatctgtgttgaataacaacacacttaggactgtgttcaatcctaagttgaacacaatccttaggatcttgctgaatggacagagctgcagtgggaaaggagaagagtgaggctctaggaaaatcctgccctctaaaaaatgaagggctcgttctatggttggcctccatgccatgaccaaagatcatggacaggttaaatcgattaggaaagcacttctcacatatctaacctgccctgccatgggttcaatttacgtagtacactggacaatgtagcttgaatcctaaattcaaatgtgttaaatattcttagtattccgtctgtatactaacaaagaaaaaaatgttaagtgactgtgccacgctctccttccagagcagtgtttcttaatttcagcactactgacattttgggccagataagtctttgctgtgggggcttgtcccacgcactgcaggatgtttggcagcacccctggcctccaccctctagatgctgggagcactctccacctccacccccattgtaacaactaaaaatgttgccagacgttacccagtgtacgctggagggaaaaatcactccagggtgagggccactgatctagaatatgatacatggcatctgtgatatgagaaaatgaccttgggcctggtcgtaaaagaatgtgccacctcctcacctgaaacacaaccaagcagtggcccgtgactgacttggcaaaataacactttgttcagaggaagctcataaaacagttttggccgggaggatgagctaacctcataataggtacttgagagaagccaccccgctaatgcatgctgtgtaccatgattaggattgacttaactagggtgaagaaatcatataatttgctgtgtctacagatatgtaagtaatccaaatgtgtgtttcttttttaagtatcaaaggataattctagaataaaattcatagtcacagtcatattaaaaaacgtccacattttcaaaagtctaactacatttttcactctcctctaaaaatggagacacaacactgtgttctaacctgaagatttgcatactcaattctaactcaaaactttatctgctgacatccgtgcttcataaataattcccatgtgataattatgtatcttgagcagaattaccaatgcatttgtcttgaatgcttaatatatttaatgggaaatgtctcgggaattttcagttctgtcactgccaagaggaggaagtattaaccattcagaataagatactcacattagattttgtgcattaagaaagtcacaactgaggctgtaggacttaaatagatgtttctccagagaaacaatagtcactactacactccctttcctcccttaaaaggctgtccattcctaaagggtagggactatatgttcttccagtacctctactagtgttctgtgcatattaggcatttaatacaatttttgtgcatgaacagacagactcagaacaaagcctctgagtatattgccatccagcttggatgaggatataagtctcttaatccccaacttatcttgttttctaacacaagcaatatatggggaattatgcttaagaggctgtgccactttgtatttaaaaacccaactctgttttttagactccttgttccttaagttggttatgtgttaggtgaccttgctagttccctaatttttccaagtttccattttctcaccaataaatcgagactaattaataatgacacattaatttgaggtctaaatgagaaaatctacacaaggcttttagcacactgcctgacacatagaaagtgttttctaaatgctagctattatttttatggcataattctgtcatagatccaaaaagacttttttatttttaaaaaatcatagtcgcatttttttaattattacttttcttctctttgaagtcaatcctctcaacacagcttgagaattgcaatgaatttggggatctgagaaacaatcttttctaaatatttgtatgttatttggaaacaattacagtggcaaaagagaacaagaggctaccttttagtatcaatctatctgtacacttaaaaaaaaaaaaaaaaagaaaaaagcagcccatgacaagtacatgctgatttttaagaagaggtgaggtaaaagtggtacagctttattaagtacaagaacttaacaatcccttttattaaacagaacttgaatttgtattacactgaatttatagatcaatttgaggaggattgatatgggtatgatatggagtcttgttatttaataatgtggtttctcacttaggattgtcttatatctttcaataattttagaattcttttttaaaagttcttgcatatcatttctcaggtttgctttaaacggctgtacagatttttgaatggggtattattaattgttcgaattggttaaagcaagaatgctattgtttttgtatattgatcctctatccaaaaaatgtactgaattctctaactactgctagtttgcagattttcctggatttgcaaagttaaaaatcatatgcaaata

SEQ ID NO: 398 - DNA, 2433 bp, Homo Sapiens
aaagagtaaccagccacccgggcttgtaactcccgttctcgcactccagataaggcggagaccacttgaagtggctcttgtccccgccgagcccgtccttgcgccgccagctgtggcccaggccccggggcccctgattggggccgcggcggtgtaagtggggcctccacttgcgccggaggccgtggaaccactcggtctccagagtggcgttggccaggtggggtgcggaggaggacaggtcttggagcaggatgcggctctcctcgcgcgtggcctggaggaagacctgtggggccggtgcggacagcgaatcggtgctgaaggtgatggccgcccgggagatgctgggctcgccctccagaaggctccacaccagcgcctggtaccaatccaggtcgtcctgcaagttctgctcccgcgacttattgctctgcagcatcacgttgaggaagttggtggcgtgtgtcagtgtgtccagcgcccggtgcaaggaggggtgcgcgctggccagggctggccacttccccggcaggcccgccaactcgtagcggccggagcagttggctcgcttcagctggtgggagtccccggtgtagagcactattcctaggcctccaaggtgtctcctcaaagactggctgacccactttccagatggagccaacatcatcctctgtctcatccataaatcatgaacagaaggcccaggaaatgagaagcggagtccccactgggagagtagcagagcttccagcatgaggcccacaacgagatcacagaagcacagcagaattctccagaaagccagttgtgatcaatggcagcacagcctggtcccacaggaaatgttcctggattttaaaacacaaataaacagtaatgcagaaattagagaagatgtatcatttaccaaatttaatctggcacatttaataatacattatgataattatggcacctgaaagctagatataaatactcattcatttgcaattcattggcaataatagttatttctgagattccctcagaccaatgatggtaaagagaaaagataaagttaatgagcttctcctctgagagaaggaggtcacaggccactcttccggtcgtcattccctataaaggattaaaggtatgagctcagggaaggatgacttcccccagtactttcttgaagttcttttggaagaagaaatagttagataccctagagagtctgattttggtgttcatttagaagtcaaaggcatgaggtcagaccttggtctcataatagattagcagcaagagaaattattactgtgggttttgtttttgtatttatttatttatttagacatcaagaaactgtgaaactgagcagcccttcagtaggagctggtaggaaaggcagcttgatatgtaagcaatctagaaaaacagctgtactttcagtaattaataaaatttagtccaagtatttgcctaagacttttgctttttagtactcatactttttactactcattccaagtaaattaagaattgaagtcggaagggccagatcacagaatgtctcttaaatataggcaaatgattctagattttatacagtaattccttgatcactaataagtttgtctctaatattgacccaaaggtgaggaaaagagtagttctcagacaaaaaaatgcccaggaataggtgtcaacatagccgaatgacttgtgaattagtgaattcctacaagccaggacagagcttttgaaaattataataaagttattttcctctccagttttttggcattgtattacaatgtctaggaaggaagctaggtttccccaccctcacatatactcccttctatgaagaaggcagatataggacaaggaccaggacagtactggaccatagcactaaggggtaggcttttaggcattaagagtgcggaagataaaatttaaaaatcaatccatcttaatcaataaaacatcttacctctgcatagtatacctacctgaattccttttttggaatctttttccttatttaaacttgtcatttgagcagctgaagtaaaaatatgggccaggaccctcttcttagtgagaaaatcacttcctaccttcaccccaacaacatcgtcactaaaacaaatcaataaaaacagcctccaatcaaaggtcaaaggaaaccagagggagctaagggaaaatgcaccattaagtgggcagttcagcctggtcattctagctcttccttctaagagctttagttttaattcataaattatctcttcctggtttggtttggcttttgtgttttttttcttgccataaaagtgataaggcatgaaattccaagtttagggtgtgagcctgggggaaaaattgccaagaaaactatttggttgccttcaggctaggcttctaagtcttaggggc

SEQ ID NO: 399 - DNA, 1125 bp, Homo Sapiens
ctcaagcgctcttgttgtcttcctgggcaggtggtgccaataggatgtactgacagatcagaagtggtcgtgagagaaggagcaagtagccagaagagtgaagtgtgcactggctgagatgtgggagcaggtgttgttggtttccccggagtaagttaccttgagtgagttaaggttaagatatcccaggggtgaggttgagcaggcagttgtgtatgtgaccctggggaaagtctagctgaagatacaaagatgggatgagatcaccaaggagtaagtgtctttagcaaagagaagagaccaaggactgaatctggatacctcaacatttggagtcagagcctgaaaaggatccctcaaaagtgcccaagaagcagcagaatgaggaaagacagcccagggagtgtggcacagctgctcctcaccacttcaggctcccctggagtccaatgcactggggcctcattcctgggtattataattgcctcctaagtggcctctggcttatgtctcctaccccagttgatgttcatcacatcagccagagtggctctgttaacacccaagccagttcctgcccatctgctgagaatcttcaagggctttcacctcactctgagtcgaagccaatatcttcacaatggcctggccctttgccaactgctgtggtttaaatgtttgtacccttcaaaacttaggttgaaatttgcttggcaacatggtggtggcaggaggtggaacctttgggatgtgatagggccaagggctctgccctcaggggtaggattaatgctgttacaaaagagcaagtttgactttcttttgcctctttgcccttctaccttccttcctgggaggatgcagcaagaaggccctcgccagatatcaaggccttaagcttggacttcccagcctccagaactgtgagtcaataaatttgtttattaaaaatcacccagtctcaagcagcacaggtggactaagacaccacctctctgaatttacctccagctactctggtgtttactgagtccagcaatacaaaacatgatcctccctcagggcattcacaaatgctgttctccctgcatggaatgctcatcccccaaaacatttgcacagctt

SEQ ID NO: 400 - DNA, 3609 bp, Homo Sapiens
ggcaacgctgatgaaaggcaaattcctgagagaaaaatcacccagatttttcagtgccttctctagctttctagaagttgttatgagtggacctgactacctagagagagtaatacagaagctccgtgccgatcacagctacctcattaccatgttcctccaagatggccgcccctgaggagaatcatcaactgggctttacggaagagagaaatccaaacgaccatcagcaacaaatgaaagactgaagttgaaaggaaatccataatttttgaatgctggccgaggtctgtgacctctgactgaatggtttccaagctccgaattcctagttagcattttggtgtggatacagaagacgagattaacacagatcaagtaacatggaaataaaaaaggagacaatgctggatgatacaggggcagccaacaagaggagaaaacccaagcattggcaaatgcctcattatccaaagaacactgaggtgtggagcaaaactgtgttgaatgaactgtagatggaaattctctccttcccaccgaggagccgctgcaggttgcagactcccagaatgccacactgagaagaggagggctaaaattctagagcagaatccctggggcagcccctgctgaagaagggtgcatctgttgagaatctcatcaccgcccccaccccgcccagccttcaatttagaggaatttctagttcacgcagaatgaagacaagatcacataagtgaggacgacgccccatttacaagtgtgatttggaagactgaagtggaaaccttgggaaggggcctcagagtatgtcagctggggtcagacgggaacaggagtctggctcaacacacatttattgcactcctgtttcatgccaagaaatgtaccaaaatctgggactgtgtaacacagcaaaggaaaagactcatctccaggaagcccccttgtctaggaagagaaattgaatatcagcataaggtggtgaaaagctgtgaaggagatgagtgccaggagtccatggaggaaggattctagcctggacaggtgaggaatggctttctggaagaagcagatgccccagctgaactttaaaatgcccatgtgaaatgaactgtctgtatcttcaatcagcaaatggagtaggtggccactgtttaattctggaatggggaagtgtaaaggtgtggtgtgtgtgtttacccctacttagggattcaaaacagacagtaaagaacaaaagtctagccctttgagcattctccatgggacatttgaggtctagctggccccagagaaagagagacagaagcaaggtcatatccatttgagaaaatcaaagtgtctgctccaattgagtctggtgtccttattcctggaatagccatccctactgctctggtgctgatttacctccggcagttcagtgcttcctggaaggtaggctgggctttttaacaaagtgactccttacttgacatgttttacccaaacacagaggccactgcactatgtgcaagaaacaacaaaaaattaaatgagactcaatgccttccttagggatctaaaaccccagtaacacagataaacaggtaaacaaataatgtgatggtgtgattctatagcaacaggaatagagcactgcagggccaccgaaggaaaaggtgatgacctggcttggattcagtgataaaaaggggcttacctcctttctctgtttctgctaaaagccagtgattaccccctgcttttcccatgttgggcatagctgtaagtactttagacatagcggcacatttaatcatcatgcaacaataagaggaagctgaggcagacagaagtgcccaaagtcacatacttgaagccaggacttgaacctgggctatctggctcctgaatccatggctttcactaataatgacttaccctccaatgaggaacaagctccattctggcctttctttagcgaaggcaactgcctgagctcatggtctgatctggcttctgggaaagagaaagcaggggaaacgtctagagatggcatactgggagaagaaatttcttgctgtggaatcctgcccccatctccctccccaccatacacaatcccacgtgcatttacacctacacgccgtgtacacacgaacattttttctgctactcccatgggccccaactctgccttttcatcaaaatcacccagagttttaaataaaatgcagatgttgaggcttgttcctaaattataatcttgggcatctaaattttttgattaaaaaaaattgacatgcatgcttaaagtaaaaatttagacaatacagcaaagaatgtgtttgtacccctcccacctagcccttagttcttccgaaaggcaaatacttaaccgttccttgttatccttccagaaaacaatatatgcatatattcatcttttttttcttcttcctctgtaggtgattgtggtgaatagtcatgagaatctgggaactggctcctgctctgtctatcttggagatgcatcttttgtgagaagccagggcaagaatagggaggcttaggcaatgggaagtttctgagtagataaagcagatggcagagcaaagggacagagcctggcgagaggctactccctgtagcaacctgcctaagagtgagaggaaagcaaggcatggctatgagcacgtgtagtctcagctacttgggaagctgaggctgggggatcacttgagcccaggagttcaagaccagcctaggcaacatagtgagaccatgtctctttaaaaaaaaaaaaaaaaagaaaaagggagagagagaaaaaaaggtgacaattcccccaacacacataaagtacataagagttaacaaggacacagtggcagaaaatagtcagaactgagcaagcatcagtgaggaaatgttttcctgaggagacttgagaagtctcaaaaatgaaaagaaagagtatttggtgtagaaagaatggcatgagatgtgaaagctcattcatccatttattccaggtatatctttttcttcagtactttgggaggcaataggtgtaatagcaagaacattcaggttagtgggttagtgtgagtctgccatatgtatgagggttgaatacacattaggtgtggtgactgtcatatgggaggcactgcaaggtgaaggagacatgtcctcacatttggtctttgggaagcgaagcaggcagaaacccaagtgcaaagtggccatttgttttcctaatgctagataagtacctgatgtgttggaagggtggagtagaactagaaactcctggaagttcttttaagaacgaatgcaggacctcatcagcccgagtctttaaataagtcacacatttttggtcaccacattctggaagggggacaaaaagatctgtcacagacaaaatttggagatatttaaggctttgttgactttggcaaatgcttgattatagttctgtggtctgtttgttttctagagtctccatgaattgcaagggaaaacaagtggtacactggtatttctatttgataacctgttctctttggaattccggttagaaatcaaaggcttacttgagttttaatgctttcg

SEQ ID NO: 401 - DNA, 3294 bp, Homo Sapiens
cgaaccgtgtctcgggagcgttagagatggagactaacgtcttccaagggagattgcgtctccactttcaccctggtactgagaggttgagcacaaaattgattggcctggggtacatcatctaaagatcctaggattgctgcaggtcagcagtctccactggaaaaaaagatcttgaatctaggtggtgtgcatacaacagcagcaagacagttgataatgcagaaatatcaggaggagtgtgaaatactctgtagggagcaagctgtttctcttgactactggcttgccaaagcagagtcttattataataaaataatagtggaaatgatgaaagaagagacaggcaatgaaatctagaaaaaaatggaggagaaaacaacccagagcgtagaaggactaaaacagtactgtttggtacctgagagagagatgaaacacatagaaaggcacatacatcaaacaggaaaggctggagaatttaagaacaaaccatttagacaagtactacaaccccccaatgaaacaaaattaccaaaaattatgccagaagggcatggcatccagaacgcacagagaagaaagcaggtaaatgagagggaacagatgcagactaaggatcaccaggaacgcatgattcgagggagagaacttgcagaacaaagactcaaggagagaatcttgagaagaagccagagccagctacttacatatgagaagcatgagagagtaaaagagataaaggagtttgaaagagttattgcgtatcttcttttccaaccatgcagtagaagtcggattaaagtgagtattcttatggataagtctcagaatggagagaaggtgaatacaattgtgaaaccatatcaaagaaaattcttggcaatgccaccctttttaagaagtcaaataggaaaaataagagattaaagtttcaatgctgttatgataaaatcatatctcttaagtgaacccttttttttttcaaatgctcgttctctccagggttcagtgaatattcccatttgtatcagatacagatagatagttctgcacttgaaaattagcttaacttttttagttgacttgcatttgttcaagttgcatatcctttctagtgttcagtgtcctcatctttaaaatggcaataatatttgatggcatttatggaaggactgttttttttgtgaagtgtaggtatgtattagttgtttcataaatgttagtttccccacttggaaagaccggggttgggcaatggtggtgaataaagaattgttctaatcttcttctcttattctccctgttcccagccctccaaggttattttgatgagattgctatagtttagtatatggtctttaatatcataccttcatcagataactactagccagcccctaaaagtgtaacttgctctgtacaatttatttgaatgagaaacttaattttgagagcctcctacatgctaggcattatgttagttactgaaggtgaataaagagaagtctctgcccttgaataattttcaactaatggcatagatcactctataaacagataatgtagtaaataaaggttacaatagaaaggtacagggtgctttacaaaggacggattctaacctggcccaggtgagcagggtgaaaaggaggaaggttagggaagggagtattatagtctgtcatgtttcttccagctttttttgtcacttcctatcacccacttaagcaagaccttcctaatgcttggatccactcagggataatcaaactcagcctttctcaaactcatgtttttggcgctcattgataaatcagaaagcaaatttataaatttagtgagaattacagttgtcaagcagaatgaaatttgtgttttctagtcagtttattttcttcccagataccagaaagttgggaaagcaggggttcagagttggtaagcagagaagcaaataaatggaaatagatgccctcaggaatattatgcttaagttgtgataattctgatgcccaccttgctttactagcagaacaccctttaccctggatactgctaggtcagccactgatacaaatgttctgtgtctgtgctcctcagtacagtagcccttgctacacgtggctgttgaggcatttaaaatgtggctggtgcagctgtggaatggaatgtttaattgaatttcatttaaatttaaattgccacatgtggcaagtgactaccctgttgcacagtgtagcactggataaacataacttctgtgttctagattccagtcccaccattagctttctgtttttgacagtgtttgctggtatgataggtcactgttcattttacattactatcagtttagtttcctttgcatttcagaggctccctaatcccttaaagagatttaaaaatcaatgtagaccacttctgtgtgaaaataagatgactgaatttgctttgattggaattaggaactgacctctctttgctagttctggaatttggccaggatgcacatcaaaatctcattcctaccctcctgatttgcctcatggaaacttcgttgctgtgtctgttctctggtcctctattgctatgtctcagctttagattctatgttttgcatagaaatggatcatcagaatgcaacaggcagaagacttagaagtgcaaatcagtagggtaatgacaagccctttgagctgagtgggactgaaaagtaacctaacatataacctattagtaattgtttaccatgaaggttttcagtgctggacacataaattgctgagttcaactgccctctttcccctccaaatctagcataaaagcaactggtgctctcagggcaatttcacacctaatacggctaagaataaaagtctatgtttcaggaactcagtttgtccaaacctgcatccatcatctacctcaaattatatccaccttttcatttctttgcactgtgtctgcttaaatcttgagtcacacttaatgttttttttttggtcttttttctttttaatgtgaaatagaatatacaatacacaaatgaaaatgtatatttagaagaacaataataaatgtccaggtgcccgttgctcagactgagaaatggaacattactacatcccaggagcctcgtatgctctcattcatatctctctcccctgcagccagaggcaaccactatcctgaattttgtataactgtcacctagcttttatagattttactgtctgtgtatccctaacagttgcttatttatagcctttatataaatagaattatactgta

SEQ ID NO: 402 - DNA, 3272 bp, Homo Sapiens
agagatggagactaacgtcttccaagggagattgcgtctccactttcaccctggtactgagaggttgagcacaaaattgattggcctggggtacatcatctaaagatcctaggattgctgcaggtcagcagtctccactggaaaaaaagatcttgaatctaggtggtgtgcatacaacagcagcaagacagttgataatgcagaaatatcaggaggagtgtgaaatactctgtagggagcaagctgtttctcttgactactggcttgccaaagcagagtcttattataataaaataatagtggaaatgatgaaagaagagacaggcaatgaaatctagaaaaaaatggaggagaaaacaacccagagcgtagaaggactaaaacagtactgtttggtacctgagagagagatgaaacacatagaaaggcacatacatcaaacaggaaaggctggagaatttaagaacaaaccatttagacaagtactacaaccccccaatgaaacaaaattaccaaaaattatgccagaagggcatggcatccagaacgcacagagaagaaagcaggtaaatgagagggaacagatgcagactaaggatcaccaggaacgcatgattcgagggagagaacttgcagaacaaagactcaaggagagaatcttgagaagaagccagagccagctacttacatatgagaagcatgagagagtaaaagagataaaggagtttgaaagagttattgcgtatcttcttttccaaccatgcagtagaagtcggattaaagtgagtattcttatggataagtctcagaatggagagaaggtgaatacaattgtgaaaccatatcaaagaaaattcttggcaatgccaccctttttaagaagtcaaataggaaaaataagagattaaagtttcaatgctgttatgataaaatcatatctcttaagtgaacccttttttttttcaaatgctcgttctctccagggttcagtgaatattcccatttgtatcagatacagatagatagttctgcacttgaaaattagcttaacttttttagttgacttgcatttgttcaagttgcatatcctttctagtgttcagtgtcctcatctttaaaatggcaataatatttgatggcatttatggaaggactgttttttttgtgaagtgtaggtatgtattagttgtttcataaatgttagtttccccacttggaaagaccggggttgggcaatggtggtgaataaagaattgttctaatcttcttctcttattctccctgttcccagccctccaaggttattttgatgagattgctatagtttagtatatggtctttaatatcataccttcatcagataactactagccagcccctaaaagtgtaacttgctctgtacaatttatttgaatgagaaacttaattttgagagcctcctacatgctaggcattatgttagttactgaaggtgaataaagagaagtctctgcccttgaataattttcaactaatggcatagatcactctataaacagataatgtagtaaataaaggttacaatagaaaggtacagggtgctttacaaaggacggattctaacctggcccaggtgagcagggtgaaaaggaggaaggttagggaagggagtattatagtctgtcatgtttcttccagctttttttgtcacttcctatcacccacttaagcaagaccttcctaatgcttggatccactcagggataatcaaactcagcctttctcaaactcatgtttttggcgctcattgataaatcagaaagcaaatttataaatttagtgagaattacagttgtcaagcagaatgaaatttgtgttttctagtcagtttattttcttcccagataccagaaagttgggaaagcaggggttcagagttggtaagcagagaagcaaataaatggaaatagatgccctcaggaatattatgcttaagttgtgataattctgatgcccaccttgctttactagcagaacaccctttaccctggatactgctaggtcagccactgatacaaatgttctgtgtctgtgctcctcagtacagtagcccttgctacacgtggctgttgaggcatttaaaatgtggctggtgcagctgtggaatggaatgtttaattgaatttcatttaaatttaaattgccacatgtggcaagtgactaccctgttgcacagtgtagcactggataaacataacttctgtgttctagattccagtcccaccattagctttctgtttttgacagtgtttgctggtatgataggtcactgttcattttacattactatcagtttagtttcctttgcatttcagaggctccctaatcccttaaagagatttaaaaatcaatgtagaccacttctgtgtgaaaataagatgactgaatttgctttgattggaattaggaactgacctctctttgctagttctggaatttggccaggatgcacatcaaaatctcattcctaccctcctgatttgcctcatggaaacttcgttgctgtgtctgttctctggtcctctattgctatgtctcagctttagattctatgttttgcatagaaatggatcatcagaatgcaacaggcagaagacttagaagtgcaaatcagtagggtaatgacaagccctttgagctgagtgggactgaaaagtaacctaacatataacctattagtaattgtttaccatgaaggttttcagtgctggacacataaattgctgagttcaactgccctctttcccctccaaatctagcataaaagcaactggtgctctcagggcaatttcacacctaatacggctaagaataaaagtctatgtttcaggaactcagtttgtccaaacctgcatccatcatctacctcaaattatatccaccttttcatttctttgcactgtgtctgcttaaatcttgagtcacacttaatgttttttttttggtcttttttctttttaatgtgaaatagaatatacaatacacaaatgaaaatgtatatttagaagaacaataataaatgtccaggtgcccgttgctcagactgagaaatggaacattactacatcccaggagcctcgtatgctctcattcatatctctctcccctgcagccagaggcaaccactatcctgaattttgtataactgtcacctagcttttatagattttactgtctgtgtatccctaacagttgcttatttatagcctttatataaatagaattatactgta

SEQ ID NO: 403 - DNA, 2081 bp, Homo Sapiens
agtccccaggagaggctggtgcaggaaggctcagacactgtgttctctgacataatttatgtaagttataatagggggagaggctcagtctgggttgttctggagtctcagcatcttgcactttattatgagaaattttgcaagcttattactttgtagtaataactatgttctggcagagaatggaaggggagatgtgataaacaaatgtatgaaatatatgctacagaattagggagagagaagggccaggatagaaggtaaaacaggaagagggaagaagactagaggtgaggatggggtggggagacctgatttagatacagaggttagggcatctgacttatagctagaggtctgattggagggagtgaatatgagtatttaggcagtagagccaggcgtggtggtgcacacctgcaatttcagtgcttttaggaggctgaggatcgctgggggccaggaggtcaaggctgcagtgagctgtgaatgaaccactgcactccatcctgggtgacagagcaataccttatctcttaaaaaaaaaaaaaaagcatgtttaggcagcaggtgcgaaggccctgaggtcagcatgctcttggtgtatttgcaggccgtgaggaaccttgaccacaaagcatggtgaggaatggggtggtgctggcacatgaggtgggaggagagggcaggggccatgtccagtaggatctgggtgcttgtggtgaggagtgtgatgtgaggtccttggcaaggttgggcagcagcagaagataatctaacactctgtcttttgcgtgtaaaataacatacagatacacatggaagggaaagatgggtcaggagctaccgtgatgtgtccaggtgagaggtgatggtggcctggaccaggtgtggaggtgggggtggagagacatggttggattctggatgttgacttgctgatacgtgggacctgggataccaaagagagagaaggaagagttgagaatgactgcaagacttttggcccgaataactggatggaggagaaataacagatgaggaagactgtgggaagagcagatttgggggctatgggcattttggggggcagcgggggactgaattggggaatttagagacaaggaaatgtggtcctgggacatcatcactgacagttgggtattgcagagggagaaagagtgactcagatatgtccctggatgtcagttacagacttgtatcagtttcctgttggtgctgtaacaagtcaccacaatcttagtggcttaaaacaatatagatttgttatctcacaactctggagaggcaggcatccaaaatgggactcactgggctaaagttaagctgttggcagggttgggctccttctgaaggctccagggagggtctgtggcctcagcttttctggcttctagacgctgcctgaattccttggctctccttccatctccaaggccagcaatgcaggtggagtgcttctcactcagacttggaccatcttgcctcccctctccattgtaaagatctcgtgatcacagtgggcccacctggatagtccaggattctctccccatctcaggatctttatcttaaccacatctacaaagtctctttgccacgtaaggtgacacattcagggggtctggggatcaggaagtgaacatctttggggacattattctgtctaccacacagataaacctgtttcttcatgctgctccctaggatgaggtaggagtgcagctgtgcggtctcctattcatctcagacctctaaagcaccttagggaggaagatctcactgcagtaggctgataacccagtgtaacaaaaacctgtttaattacagaataacactgtctttagtagagaacaaaagggacattattgaaaaatcccttgactaacctgtaccttttggagctacacatcatgaggctttttacaaaatgcctcataaaattacctatgaattaaattgagatctatctgggagaaggctgtaaatttccctcaaacaagcagctatctctttcagctgaaacttgtctttctaggttgccccagtccccaccactc

SEQ ID NO: 404 - DNA, 5436 bp, Homo Sapiens
caggagacaaacctcggaagggctgcccctcagagacatcaagtggaatatgaatactgatttctaaccccacttccaactcctgagtgctttacgctgggctacaaggttctcaatgtctcagtgcctcagcgttctgatttatcttatggaagcctgcctcatctattcatatattgcattcttaaacacagaataacaacaacagcaatgacaacaatgctaatagcgctccaacagagcttgctgtgtgcccagccctgttcgaagtgctccccaactttggcccctaggatgctcaggacggccctctgagcaggcactgatgtcgtccccctcacatgcagagaaaccaagacatgagcgtggtcaggtcgttcgtgcagagccaccgggctggggatgggcagagctggagtgtgtgggcacaggatcggggtttgtcaccactgtgctgcactgcctctgcaccccaactaggcctcacgctgatggagacatcgcagtgcatgggagaacattcactgcgtggtgctgaggacgcagcaggcactcggtacaacctgttccttgcgtggcccgctagctttgggtcccaaaataatctgcctcctgaatctgcaactttctccccacctgctgggcattctcttaattcaaccgaagcctctccctgtccccattaggacggccactcccaacaggagttcccggcctgtgaaggccaaccggtcggggctcagcaccccattatcattctgccactttccaaaggaaattataagcactttgtgtcaaccctcatctgtcccggcagccgcaccgcaggaaagcgattgaggtcagagaaggcagacagcctacccatcacacccgccgcggccattcctcatgtagtgacatgcaatctcccgccaagggtcacctctggggaagcgattccttcaagcctagaacaagtgccgaattgcagctttgccgaatgatcatgtggaacacattgaaaatagccgcctcagtaataaatgcttaaccaaagcagccccttcctccggcataaccaggagcatatttactgtaaatatgttaaccaattcatgctgcagcacatggccgaggagtcagcttcccaggcagcaaagagcaaacccccgctgggctgagaaggagcaagccgcaaaggagaggattgtgtccgccaggaaaaggaagaggcaggaaaaggcacctgggacagaggagcctcctgcaggccccacagccccacccgacagaggagtggcgagaaggggacttggcattctgcatcttgccgtcacctctgtgccccacggaatctgtgagttaagactggctccaagagaagtggcgtttgtgtttctccttcatttcctgctcacatggtgaagtccgtagtgtgacagctctgaactccacaggatgaatcagggtcaggggagaggacaggaggaaagaaggagcgagagaaaggggagagagagagaggagacgggagagtgatggcgagagacagaaatatgaatgagaaacgggaaaaaaatcgagaagatgatgagaagcctgaaagacagagaaagcaatctaagatgagaaaaagagcactgagaaagaaaacattctggaggagagagaaggaggggcagagaggggaacaaggagggggtggagagagggagattgagagggcatgagttgtctctggaaggctgggttttgtttccactgggaagaaaaaatgttctttgttatcaaaagccttgagtgacaccagcagctcctccccacccctctctaacacactagcacctaggctggtgtacacatacacatgcatactcaagtgtgcacacacacacactaacatgcacatatttgtacacacacaaacatatgcatgcacacacatatgcacattcatgtgcacgcatgcatactcgtgcacatacacactaacatgcacacatactcaaggtacacatatattcacatgcaccacacatacacacatgcatgtgcatgcacatacaagcacacacacgcatatgcgcacacctactcaaggcacacacatacacgcacacattcacacattcatacatgcacactcatgtgtacacacacatgcataggcacacacacatacattcacacacacgtatgtgcacacacatactcacatgcacacattcacatgcacacactcgtgcacatacactcacgtgccctcatacatgcacatatatgcacacatgcatgcacacatacatcacatccaggcacacagccatctagaggcacacatacactcttacagcacacagtcaattccctccccctacccctgaacctaattcagtcccagaacagagagagcaatacaaggtctgagccaaaggaaacagaccaaagccagactgggtctgggtgtgggggaggaggaggaaaggggtcgggaggaggcagcccaggtcaggggcccagagtggaccagcaatgcaattggaatgggaaagaaccgtagagccccctgagaggctgcagcccctcaggcctggccctcaggcctgggcctcccttcatcccagtttcaggctgcattcttaatcgggccacggccccggctacctagagagacagtcacacactggcttcaagaccagagaaaccccagcaaagggcagccagcttctgggcaaagagtgaagccaccggctccctccggcttgcagcttctcctttctgaagtgggtgggcagtttccggccaaccttttgcctccttctctccagccgcccctgctaactcccagtaatttgccaaaattaacagatttatggcagcatgttggtttggatcaacttttcgtatgtactttgcaagagaaaaacattttcttctcccccgacttactgtttgcccattaatacgctccacattcactggtgcttaatgactgttcaaattttctctgttcatagagaatgttgttgttgtgattaagggtgccagggtgcttgcaagtacaaacacaccaaagccatgaaaagggcaattaattctttaaaaaaatgcaagagagtgggagagattggatgctctgtttacagaaaagcaagaaagaaaacagatatttctaagaagtgtccttccaggacagcaacgtctcctgtaaaaatgtctcctggaaaaaatgttgaaatacaaatgttcatggaaactgctgtccagcagacatttggttattcaacaaccatgtgtcaactactcattatgggcctggttctggggtaattcataaaggaagccacagggtgtgggcgaagtggacatctgggccaggactgaaatcccagctcaagataagtcatcccttgcctctgagcctcagtttacccatctgaaaattaggaggtggaaatcccaagggtggctatcaaaattcaagaggacatgtgtatcaagggcttagcttgctgctagcacatagtaagtgtacaagaactgcctggttcattattcgttcactctcctgaacaaatcagtggccgttttaatggctttggtgtgtttggacttgcaagcaccctggcacccttaatcacagcaacagcactctctagcaccagagtacgttctctgggccatgggccatgccatggggctggattttgaagttacaacttcaagaaaggcaagtttctgcccatgtatggctgatgatccaacggtgggagacagaaactactaaacatctgcaatggcaacgtgtccaacagtgataaatgcctgaagggaaataaaacaaagtaagatacaaagcagggccaaagtagataaggccctgctgagctgtgttggatgatgtcatcaggggcctggggaggccagcaaggtgacttgtgcagacacccgagtcgggtgtcgatatcttcctccataccttttatctttcctaaaaatatggttgggaagccctggtccatctgcaaaggacaggggcaagttggcctatgcgctagcaattgctacatattgtgagagctcttaaaccaaaggtcaggacacacccagtgaatgtttcccttccagataagaaaaatattctgagcacctgctatgcgccaagcgttgtgctatgtagtgggggcacaactgcagggaaaccagacatggtccctccctgcctcctggcatttagagccaagacagagggtcagattataaatgaacacaggcaccatgattatttcatctcaaactctggttggtgctatgggaaaggagcagtgatctttgagacctgagagggggtcctgatggagcagacaccagcagaaggatccttccgggaagtgacgttgaagctaagcttgaaaagaaagaagccagtggacatcttctggtgagacccagagcaccccacctgcaaggggcctgatctcccttgaaccaagagccctgccactcgccccagctgcctaaaggctgacaggagaagagggagtcagaatggtgctccaaacagagctcactggaatctcagctcagccatttacttgctctgtcaacttgggctctcgctgcaggtacctgagactgttttctcgcctgtaaaattggaaggtgttatgggttgaattgcttcccccaaaaatatgttgaggtcttaaccccttgaaatgtgacctgagttggaaatgggatctttgcagatgtcattagtgaagacgaagtcacactggagtaggctgggccctaaatcaaatggctgttagttttataagaagagggaaatttggacacagacacacacaaagaggaacaaccagcgtgtgaagacagaggcagagattggaatgaggcagccacaagccaatgaaccgctgcagctcccagaggccagaagaggcaagggaatatcctcccctagaggctgcagagggagcacagccctgccagtgccttgattcgagacttcgagacttccagcctccagaactgggaaagaataaatatctgctgttttaagcactttggtttgtggtgctttgtcactggcagccctgggagtagtccagaattataacccctaccttccccgaggactgcttgtccagagggttccccagggtcccattcttaacagatcctccttgaatgccctgcagccaccgctgatgtgctggaagtcacttctgctggctttgatgaagggaaggaagcagatgagaaagagggtgtatatgagtgactcattgaacctattgtctatccatagagagaggggacgagagagtgccttgtccccaagacctgggcccacagtggccccttaagtaagttcaggccctctcacctgggcaggggtcagaagcctagagcaacagcaaccactgaaagccctcagcactccac

SEQ ID NO: 405 - DNA, 2720 bp, Homo Sapiens
gctgtggaagctttgtccttgcagtcttcacagtaaaccttgctaccactcactctttgggtctgtgccatctttaagagctgtaacactcactgcgaaggtccacagctttattcttgaagtcagcgagaccatgaacccaccggcaggaactgactctggacacaatggcggctcctgaccagaccctcagaacctgaggacgggtgatcatttctggtccagtgtcttgactggcaccaagtcaagcattgtcctccacgtcatcagctgcaggccagataatctaagatgatgccaaacagtcactgcagaagaatttgctgcacggagctgtctgggatgcctcagacctgccagcggtagagctgcctgccttgcttcctcttgcttactcacagctctaagtctgaacttggctgcagctgtcctgaacagcccaggaggagcctaggcaggaggaggcttctctcctatgcaatttggctgaattttagttactcaaaagagcaaaggaagcacttctgaatattcgtcaggaggagccaaccaccttagcttgctccctgatgggttttgttcagcccctgccttactgttgtcagcctggactgtcttctgggcttgggttcaccatgtgtctggaccacgggagtgtctctaggtgtctcccttcctgtgcatttctcctgggcatagacacccatcctgtggaacactgggaggagggtgcaagaccccactgcacccaggcttggttcctcttgggtgcagcagcctcatccccttgcaagccttcctcccactcctcccagaaggctctgcttcctccacttgctcctctcctaggtgtgagccagcagggtttggtcacccagatatgaagtattaatgttggactcctgtctggagtcgggagtctattaaggaagacgtgtgggagaggcctgtgttcaaggcccttagaaccattctgcctgagccatcagctccttaaaaagaaatcaccaaagatcccaaacaatggcagagtccccctcccaccctttgggctacttggtaaataggcccaccaattctatctccaaaatatctcccatcaggaccatgtgtatattgacatctttatcttccatcaggtcagggttgccacaaaagcctccatccaaatttcctgaaaaagcccagtttctctaaatgtgtgcatgaacacggtgctgggcatggccctctcctctcagtccttctgcaacgcccagtgccttcacagccaaggccagacttcctagtggaagagcaaagtccctcctgacacggcttctgcttgcatctgcagccccacttcccccacaccacgctgcaccctgagctcctcacggagagccaccgtgtttcacacctgccgtgctctgggccaggtcgctgggcttgctggtccttagacttggagcacctgatgctgtttgcccatctgtgtccttgtcagcctttgagaattggatctggcagcccctcctcaggaagcccatgagagcctccgccccatactcacacagaccctgagctaggtggcccctgcctgtgtccctcagctcccagcccagcttccatgcagctttagcacagtttaccagcaccatcaagacccctctgggaggacagagagctctgggaggacagagagctctgaaggacagaacacgcatgcctttctggttgttcctctgaagcctagcacaacactgacacgtgagaaatactggctgaataaaaggtggaagtgaaaaagaacaacactgacacgtgagaaatactggctgaataaaaggcactgtgcattccctgcccatgaggaaggaagcagcttattccattttcaccccagcagaacccctgcatgcaggtttaggtcaacactagctgccagcaggatggagacccagcagcatgcggcacacgggagtctcgccgcgggtccttgacagaagagtaacgagacttttcttgaaatagtgtcctgagttgagatctgagaagaacctgttatgcatcctagaacacagtgcatttgcaagtcataagatgttagcaccgattatggagcctcgtgtgttcttaggggctatttccgtgacctcgtcgggggttcaatgagcagcttcaacagaaaactggatttccttttcctccaaggctgtcttatttccagattactctggacctaattttaatcgtgcacacctaccatggcaggctgttttcctgtcctcccaatgatctccatacaatctcactgctgggtagcacctccattcccttgcttacctaagccatcaaaacctgcaacaactcacaaaaccacaaaaagcaacagaaaatatcagaagataatcaaatgaatcaagacctccagaaaactgtgcataattcagttttcatttcatttaatgataatgtccacagttaatcaggcattccttatcatttggatctacatgttgaataaacacaacatccctagacctttgagggttttctaaataatctgctgttgattttcttaggtactgaccagattactatgaatattcctgatagaatatgctgacaagaaacaaacaggacaagcctaaaatagaggttctggtaaacattcagggaaaagtttattactgacatgtgagagctcggttttcaaggttaataaaataaagttgaca

SEQ ID NO: 406 - DNA, 2791 bp, Homo Sapiens
aagcttctccgcgagtccagcgctgccactcggcggccgccgcgggcgcggggatcctgggtcgctccgccttgacccacgcgccccacgccccgggacttacacctggggtcgctccccgcacgcgcgggcctcgcgccggtgccgccgcagcgccccctgcaggccggagccgagctggcccaggcctgagtctggcccggggttccgtggccccagtgccggccccgcggctgctgctccggcccggccaggtgccttcgtgttgaggcgaaaggactgggcctcagtgggtgaagggaccgggtggcccgcttccacctagggcagaggctggatcggccgcggcgaggctgggcccagcattactgggaggggaacttgagagccgcgggttgatgttcggagctcaggcgacgactgaccacccacccttcctcgaagaggaacaatggcttgggtttggtttttaatttttgattcccccacctcccctttcttgattccaaaggaaatatagcattcaagcgccatgtctgttgggaatatataattccttggcaaagaaagaggaaacatttctctgataaacacaagaatctcagtaagaattgcattattgagaacttttcccactgataaagtagggaagaggaaggggaaaatagggtaagggaatgctggaagacaaactttaaactttatctccttttttttttttttttttgtcgattgttggtgcatcctgttggtgttccgagaagttgtggctcagcttgctttgtctacattagtggaatctttaagtctttctggtctgtctcagcatactcactggcaggccctagactacattacccaagtcattttgccgtcttggaatcctgagtatgtcatcactctgtattggagatgagattgctcagaaacactgaattcagaatgggatctagcaagatggtatttctggagcaataagtcatttactgaatgattatgcaaagcataaattgcattgtagtcctagaataatacaaagcttccctttagttgttgccgtaaattaataactggcattttaatgcactaaatgaattttagtagttagatttatatctttgacttctaggaatttcaactacattagagttcatatacacaaaaggggcaagcccttttccacagcatttccagcttctccacagaaacctagccccacatgagcaaaagatcacactctgtgcttcatcaaagagattacacaattacagattccagcatctcccaggagtcctttgaatttggattaaggtctataattacgtgggtaagggaataactaggtaattggctttctgcacctggaatgtattctcctgggtataagaggctccttttaatcagaagtatatgggatgaaagtgaaccctgtctcttaaggggagactccttaagaggaggattggggccctgtgttttaatagatcttctccacaatctttaatacctaagctccttccccttgtccactaatttgctgtagaatttttctagcatgtttatgatggtgttcagggcacactaccccaaaatataacaccttggcatattgaatgttttaagctgatggaatttgagaaatggcaggtgtgaggactctgaccttcccatgaagcaggtcataagaccctcatgtgagagatgccctctctatacctggagaaaagaagcagtcttatttgtgaagacagagagacgccaagaggaatctaaatgaataggccttggaaccccagacgcacgggccttgtgctgtcgctgccgtggcaccccttctagaagtgtcatccccaacttaggactctattctctataacagaagtgggagccttggacaactgaacgcctatctctagctcaagaaatgtcagctctttttttttttttgagactgtcacccagtcgggagtacagtggcgccatcttggctctctgtaacctccacctcctgggttcaagcgattctcctgcctcagcctcctgagtagctggggctacaggtatgcaccatcactcctggctaattgttgtatttttagtagataatggggtttcaccatgttggccagggtggtctcaaactcctgacctcaggtgatctgcctgcctcggcctcccaaagtgctgggattacagacgtgagccaccatgcccagccaagaaatgtcaattctttatcgtagcctggctttccatatttctcactagggtttttattctctagtttgtaaatcacatttggcgtttgtagatcactccttcccttttagtggcattctctattaggtgtccatctcccaatatgaagaaacagttttctgctttttcctcctttatctgatccatttacagatttattacatttataataggctaggtattggggatacaaaaatgaataagatatggtctgttttcaaaggtatgcagaaacttttctatatattcctactgacttgtatttgtatttcttgaattaaaaacaatcctggctgtgtttttttttttttttttttgctcttagtgaatctttgtttcttcttttcattatggcattccagttgagtttcaccacgcattatcatgagaataaataatttcactgactttaataatatttgatcacttatgttgatgtcatttaactctcatttacatttcagtggtctaaaacacaactaagatactaaaagaaaaataaaagatgagattattggcaaataattaccac

SEQ ID NO: 407 - DNA, 14713 bp, Homo Sapiens
ctcctggatctgcgggtcggtctcggcgggcggattactcctcgcccacaacctcgaggccccggggtcaaccgcgccctccgggccggcaacccagggtttagtcagattcctcctgacccaccgcttctgggaaagaggcgcctcccgtcaggaggatgctgagttcctcatgactggaccagtgagtgtccactccctggtccctggcgagagaggcgggacccccacgccctcctggcgctctttgcagagatgttcctcaggcccaatccgggatttgggatgtctgtgcgtgctgtggagcagagagtttgcaacatggtctcactttgtcacccaggctggaatgcattggcatgaacacgtctcactgcagcctcaacctcccaggctgaagtgaccctccaactctgctttcacagtagctgtgatatggtttggctgtgtccccacccacatctcatcttaaaacccagtgggaggtaattgaatcatgggggcaagtctttcctgtgctgttcttgtgatagtgaataagtctcatgagatctgatggtttttaaaagagttctggctgggcatggtggtgggcacctgtaatccaaactactagggaggctgaggcagagtgaattgcttgaacctgggagaaggaggttgcagtgagccgagattgcaccgctgcactccagcctgggcaaaattgaagactctgtctccaaaaaaaaaaaaaaggagttcctctgcataagctctctctctttgcctgctgccatccatgtaagatgtgacttgctcttccttgccctatgattgtgagtctttccccagccacgtggaactgtaagtccaaataaacctctttcttttgtaaattgcccagtcttgggtatgtctatcagcagcatggaaatggactaatacagtaaattggtaccagtagagtggggtgttgctgaaaagatacctgaaaatgtgaaagtgactttggaactgggtagcaggcaaacattggaacagtttggagggctcagaagaagacaggaaaatgtaggaaagtttggaacttcctagagacttgttgaatggcattgacaaaaatgctaatagtgatacgaacaataagatccagtctgaggtggtctcagatggagatgaggaacttgttgggaactggagcaaaggtgactcttgttatgttttagcaaagagactggtgacattttgcccctgcccgagagatttgtggaactttgaacttgagggagatgatttagggtatctggtggaagacatttctttttttttttttgtgacggagtcttgcattgtcgcctggggtggagtgcaatggtctgatctcagcttactgggttcaagcaattctgtctcagcctcccgagtagctgggattacaggcgtccgccaccacgcccttctaattttttgtatttttagtagagacggtttcactatgttggccagtggaagacatttctaagcagcaaagcattcaagaggtggcttgggtgttgttaaaggcattctgttttgactgggtgcggtggtgcacacctataatcccagcactttgggaggccgaggagggtggatcaagaggtcaggagttcaagaccagcctggccaatatggtgaaaccctgtctctactggaaatacaaaaattagcttggcatggtggtgtgcgcctgtagtcccagcttctcgggaggctgaggcaggagaatcgcctggacccgggaggtggaggttccattgagccaagatcatgccactgactccagcctgggcaacagactgagactctgtctcaaaaaaaaagaaaaaaaaaaaggcattcagttttataagggaagcagagcataaaagtttgggaaatttgcagcctgacaatgtgatagtaaagaaaatcccattttctgagaggaaattcaagctggctgcaaaaatttgcataagtaccaaggagccgaatgttaatatccaagacaatggggaaaatatctcccagacatgtcagaggtcttcatggcagcccctcccatcaacaggtccagaggcctaggaggaaaaagtggttttgtgggcagcacccagggtccccatgctatgtgcagcctagggacttggtgccgtgcgtctcagctcctccagtggtgactgaaaggggccaacatagagctcgggctgctgcttcatggggtggaagtcccaaatcttggcagcttccatgtggtgttgagcctgcgagtacatagaagtcaagaattggggtttgggaacctccatctagatttcagaagatatatggaaattcctggatgcccaggcagaagtttgctgtaggggtggggccttcatggagaacctctgctagagcagtgcagaagggaaatgtggggtcggagcccccacacagagtccccgctgcggccctgcctgatggagctgtgagaagtggaccaccgttctccagaccccagaatggtagatccaccgacagcttgcaccgtgtgcctggaaaagctgcagacactcaatgccagcctatgaaagcagcctggagggaggctttaccctgcaaagccacagaagtggagctgcccaagaccatgggaatccacctcttgcatcagtgtgacctggatgtgagacatggagtcaaaggatatcattttgaagctttaagatttgactgccctgctggatttcagacttgcatgggtcctgtagcccctttgttttggccaatttctcccatttggaatggctatatttacccaatgcttataccaccattctatctaggaagtaaataacttgcttttgattttacaggctcataggcagaagggatttgccttgtctcagatgagactttggactgcggacttttgagttaatgctgaaatgagttaagacttcggaggactattgggaaggcatgattggttttgaaatgtgaggacatgagatttgggaggggccaggggtggaaggatacggttgggttctgtgtccccacccaagtcttatcttgtagctcccataacccatgtgtcttgggagggacctggtaattcaatcatgtgggctggatgcggttgctcatgcctgtaatcccagcactttgggaggccaagggggagatcacttgcgatcaggagtttgagaccagcctggccaacatggtgaaaccccatctatactaaaaatacaaaaattagccaggcacggtggtgggcacctgtaatcccagctacttgggaggctgaggcatgagaatcacttgaacctggaggcggaggttgcagtgagccgagatcgcaccactgcactccagcctgggcgtcaaagtgaaacttagtcttaaaaaaaaaaaaaaaaagaagaatgggagtgggtctttcctgtgctgtcctcatgatagagaataagtcttacaagatctgatggttttaaaaatgagagttatttctctcttctcttgtctgccaccatgtgagtcatgcctttcaccttccaccatgattgtgaggcctccccagccacgtggaactgtaagtccaataaacctctttctttttttttttttttttttttttttttgagacggagtctcactctgttgcccaggctggagtgcagtggcgcgatctcggctcactgcaagctccgcctcccaggttcacgccattctcctgcctcagcctcccgtgtagcaggcattgtcacaggcgcctgccaccacacccacctaatttttttgtatttttagtagagacggggtttcaccgtgttagccagggtggtatcgatctcctgaccttgtgatccgcccaccttgggctcccaaagtgttgagattacaggcgtaagccactgcacccggcaataaacctctttcttttgtaaattgcccaggtatgtctttatcagcagcatgaaaatggactcatacaatgatccattacctagggtaaaattctcctgaatgtcaaacagagataaactacatttgggttttgggtaagtcccctgtaatgatgaatcaagaatcctcaagtctgtcttgccacccatttaatacgtatttttgttaaggctgaagtttagagttagaatcaggacattttggcctattgagaggttctgaattccaacagaagatgccatgtaaatcagtgaatttgattcttttaaaagcaacttacaaaatttacaagatgtattcaataaagcagtttagctttggtatatcaaaccttataatgaaccatttttcccacttcatcttatgcaatgtttaatattttctatttttgtcaaggatattaaacctacacctggaaacatattaaatgccaacttaaaatgtgagaagtttggcagaactcagacccattcttccaatttccaagctgtttaatcacactgattcagacactctggatagcagctgggattgtagttatctttatgctttgagctctctagttttgtctacacatcttataaaatatcccctcctcattctcctctagctggaacactaacccaatggatgttgtggtgaactttctttgaccaggcagagaagtgcagcattgggtggaccatgcacaaccagtttgagaagcactgctctaggggttgggggagcaacaatagaaagagtgtaggttctgaatacctgaagcatacattttagctctagactgcttatattgttgttacatgaaagagaacttttaatctggtttaaaccactggatctctttattccagcaagtgaatctatatccaactaatatttactcccagtctgttctttctcacccctctttcccttactataaaccttttctatatcaatttatatcattagttgctcagcccacaaaccagatgtcacttttgttttctcttttccttcccattcatagccaggccatcgttgtgacttattggctgtacctccaaaatatatcccagatctgatctcttcttataatttgtactgctacaaccttagtcaaagccactaatatctcttatctgaactccagtggtttactagttttctgcctctcttcttgacacaattcatctttctacatagcagccagagtaagataaaatcataaatcagatcatataacttctaccccctgtaccaatggctatcttttatactcagaataaaatccaaaacctttatttggcttccaagatcctacaagatagagaccttacttctcatcttgtacccatcatttgatcttcagtcccttgaaaatgccaagtctatttccatttcagggcctttgtgcttgttactattgtttcttttctcttggaaaactgcccagatctttccttagctgaattattcagatcccaactcaaatatcatctctttagaaaattctttcagaaccaggtgtggtggtgcacacctgtaatctcagctactcgagtggctgaggctgatggatttcttgagcccagaagtctgaggccagcctgggcaatatagcaagatcctgtcaaaaagaaaaaggtatctcaccatgattatattttaatttcccttcagcaattagaagtccctgaaattaatttaccttatttgttggcatttgttggcattgtgcaagtaatgcttgcacccaggaggcagagtttgcagtgagctgagatcacgccactgcactctagcttgggcaatagggcgagactgagtctcaaaataaataaataaatacataaaataattttagagacagagtcttgctctgttgcccaggctggagtgaagtggtgggatctcggcttactgcaacctctgcctcctgggttcaagcgattctcctgcctcagcctcctgagtagctgggattacaggcgtgcaccaccacgcctggctaaattttgtatttttagtagagatggggttttgccgtgttggtcaggctggtctcgaactcctgacctctgatctgcccacctcggccttccagagtgctgggattacaggcatgagccaccatgggcccacaaagctattttacttagcattttttttcccgaggctaaattgggaactactgacaatactattgacaatactaaatatatttttaaattattttacttatttttgagacagggtctcactgtgtcacccacgctgtagtgcagtgaaccatcaccactcactgcagtctcacccttcctgaactcaggtgatcctcccacctcagcctcctgagtagctgggactacaggcatgcaccaccatgcctggctaatttttaaaattttttgtagagatggagtttcgccatgttgcccaggctggtctcaaacttctgggttcaagtgatgcaagtgtctcagcctcctaaagtgctaggattacaggcgtaagccactatgcccagccttttattttattttattttatttatttattttttgagacagagtcttgttctgttgcccaggctagagtgcagtggtgcaatctcagctcactgcaacctctgcctcccaggttcaagcgattatcatgtctcagcctccctagtagctgggattacaagtgtgcaccacacgcggctaatttttgtattttttgtagaggcagagaggcagggttttattatgttggccaagctggtcttgaactcctggcctcaagtgatctgctcaccccggcctcccaaagtgctgagattacaggtgtgagccaccatgcccaccaacctattttttattttaaaaaattgacagcatactaaatgtttgtaatgcaaatgataaaattgctacaatgaaaacaagaagttgagaattagatgaagagttgattaagggaactatgagtcactgtgttagagcatgtatattatgaaaattatagcagaagtgataaagggtgacaattgttacctatcttcaatcaaaagctctttgaatatctttcttttttttaattttatgaattttttttacagagacagggtctcactatattgcccaggttggtctcgaactcctgggctcaagggatcctcttgccttggcctcacaaagtacctggattacaggcatgagccacagtgcctggccctctttgaatatctttaatgcttttagagattagcatcagagaattattaatactagagggcacaaggaattagccattgccagtggacacctacataggtgtgactatgtgactcagttttaaaaatgtgacacaatgaaaaaattccttggatgttatggaggacgaaaattttgtaagtcctatccattctttaatggagaaactaaaatttacaatattactttatttagcccaagattttcttaagctttgtattttctaattcagctttggcttacagaatcatgcttgaagtttgagactgccagctttcaacaggcagttactagtgaaactctttggaaagatgagaagatgttgacataagtgtaatgtgagacaaagcaaagtaaaatgtaatttttaagaaaatgttgccgggtgtgatggtggctcatgttgctgttggttgctatgggagtgaacgaagggggacgaatgcagaaatgaagacaaagacaaaaagagtatttttggaagaaggggtcaggggactccttgcttctagtgggcaagggccctgagcttctacagcccttcatatttattaggtagaaagagcagggagggagaggtaacagttggtcagctgcttgatttatcacaggtacacataattgcttcctttgtacaacaggtatacataattgctttctttgtacaacaggcttcagatgttcctatagataatcacaaggaacactgtgcttggggtgtgactgccctcagcaacccttctggcagcagacacagttgttagttttccaacatcctgctttcatgagaacagttttctatttgctcatatagcctccagtggtatactgagttggtcacgaccctcattctttcggcctgtaacaggctcatgcctgtaatgccagcacttttggaggccgaggcaagaggatagcttgagctcaggagttggagaccagcctgggcaacacggtgaaaccccatctctgcaaaaattagcctggtgtggtggggtgcgcctgtagtctcagctgcttgtggggctgaggcgggagaatagcttgagctccaggggtcgaggctgcagtgagccataatggtgctgctgcattccagcctgggtgacaaagtgagactatctcaaaaaaaaaaacggctgttagataaaaatgaagacaaacaacatttgcaaggatataaatcttaacccatttattgggggtataggctctggtgtcagatttccatctgtcctgtattttgtaaccacaaaattgtcctggctggattaattgtaaggaagtccctttaaacacatctagacttccaaagtttgtttacatactaattagttgtcatgaaaagctgcattcaacccagggtctgagatgccttttgtatatgaaaagtgcttctctttctgacactgactgaattacatacataacagattcatttatttaaaaacaatttaagaggctttttctataatgctgaacctgctgtgtggtatttatgtttaattctggtcaaattttcaaaactaataaacactgcaattcaaaaccattaattatcaagcatagaccaagtatctgaggttatgagcacatatttaagaggttagactctggcattccagacattgcaaataatacttttctcatttctaaatttcctagaaacaagtggagatttgtaaaaggaaataatactctttaaaacatttatttttgactcaggatctggctctgttgccctagctagagtgcagtggtgccatcatcacagctcacacaatagcctggaactactgggctcaaaccatcctcccacctcagcctcccaagtagctgggactgcagatgcaggccatcatgtcccgctaagttttattttatttttgtagagacagagtctatgttgctcaggctggtcctgaactcccggcatcaagtgatcctcccacctcccaataaaacatgtactgatggccaggcacttggctcacgcctgtaatcccagcactttgggaggccgaggcgggcagatcatgaggtcaagagatcaagaccattctggccaacatggtgaaaccctgtctctactaaaaatacaaaaattagccaggtgtggtggcacgcgccggtagtctcagctactccggaggccgaggcaggataattgcttgaaccccagaggcggaggttgcagtgagccgagatcgtgccactgcactccagcctggcgacagagcaagactctgtctcaaaaaaaaaaaaaaaaccaaaaaccaaaaaatcaaaaccaaaaccatgtattgatatcaaagtttttttatcctggcagggcacagtggctcacgcctgtaatcccagcactttgggaggctgaggcaggtggatcacgaggtcaggagttcaagaccagcctggccaagatggtgaagacccgtctctactaaaaatacaaaaattagccaggcgcagtggcaggcgcctgtaatcccagctactcgggaggctgaggcaggagaatcgtttgaaaccaggagggtagaggttgcagtgagccaagattgtgccactgtactccagcctgggtgacagagtgatactatgtctcaaaaaaaaaaaaaaaaaaaaaagaaaaagaaaaaagaaagaaagttgctttatctttaaaactatatatattgttttcacccctacatagtccttgcctcccagacatctcctcactaacgtcagtagacaatttggcatctgatggtttgaaatagtttctgtaatcaaatcctgaataaaatccattttaaagcctatagagagttaagaaacaagtataaaaatttgttgaagtgtttattgaacgaacataatacatttgtctgagaagagatacgcacactaaagtcccctacaagcaactaatgggaaaagatcacacaggtaactccaatttttaaaaatatgatcatgaaagataattgtagttggtgtttatggagcatcttttggaggggggggaacccccaacaactctacaaattgagatccagaacagagaaagtcatcaggtgaaatgccaagaccaaaaaacttattttatttgaattccattttctgagaagaaaactagtattgcagcagagtcatttaatgaaaacttaacagtttcactgaggattcagatatccgttgacatgtacatgacaatctttagattaaatcataaaaagttgactgtctccaagaaattgttatttcacaaatttatctattttaaatataacactgaagttattacataaacactgacgtcaaaatcatgccagagcagtgttactatttttacatgtatatgagtattcatgacctttaatgtctggacacattctaggtcacagaacagaagcaaattttcacttttgtgtgtttttggtacagtgacatgtctggttccttttgagctagatatatctgcttaaataattaacactattggatattagtccctcaaagtaaatgtctattttacctggtattctaggaagagagagagaaagaaaataaccaaagaaatgtgactgcaatctaatttccaagagagaaactctacttctgaatactggccccatactgcatattttatgaatatttttctcacaacttttcttaaaacttaagttctctcttaggaatgtctttagttaggtcttacaaagaaactgtttaatacacaatgttaacatctactaggcaaaagatgcttgcttctcttcccacaaaagccaaacagaaaacacaaagtgttactaacgttttctatttattcattaataaaaagtgcatagtacaagccctttatcccaatccaagtactcagaaaaagattaacaacagaccctggatggcacagacataatttgtttggcgtgatttaaacatataaaatcagtaattaacatttagcatatcacacgaccacttttgcttttaacaaactaatcttcacacatggtaacaaatacctatgatttttcatttagaaatattataagaagactaaacttactattgcaacaacaaaaatttaacccattaaactagaaactctcttcatttttccttcttcaaattactgttttgtgtcttaaactgagttggtcaaatttgagcacataattcatgtagagtgacagactttcatttagagtgatagacttccaaggttcctttgaaaatttaagatactggtaattccataaacactcccacaccacataccacaaaaacactaaaagtagccatagaatagctgtattcaataattattttggaaaatccacattatgaaatatgacttgctgaccatggaacagtgcttggatagataacatgaaaaaaatgaaaaacatctttttttttttttttttgagacggagtttcactcttgttgcccaggctggagtgcaatggcgtgatcttggctcactgcaacctccacctcccaggttcaagtgattctcctgcctcagcttcccaagtagctgggattacaggcatgtgccaccacaccaggctacttttgtatttttagtggagatggagtttttccatgttggccaggctggtctcgaactcctgacctcaggtgatccagctccctcggtctcccaaagtgttgggattacaggcatgagccaccgtgcccagcctgaaaaaaatcttttactagaaacagttccaatgttaacttttcccacatggaaagcaaaacaaaacaaaacaaaacaaacaaacaaatgcaacaaaacaacctcccactattattgtgcataaaaacacattaaatgactctaaaacaaaataaacttttttttttttggtagagacagggtcttgctatgttgcccaggctagtctcaaactcctgggctcaagcagttcttgcctcagcctcccaaattgctgggattacaggcatgagccaccatgactggcctaaaacaaaataaattcttaatggcatttgtggaatgtgtttaagagccaaaactgtgaaaatgtaagctttatctttcttttttcctagattatttaaagaggattgtagccacacttcagatgaatgtttacaagccaaataatgatttaagagtgtgctcaataaaaaggccataggtttaagaattaaatggaataatataaattactaggtcaacaagaatatttcatgtatagtacactgtctaaggaatgcagagaaattttacaagaaacccaagactaaatacttcattaagaacactggttactaagtaaatagatggctcatgtaggaaaaagctaatatatgtagatgtaatgtcaactaagtgcatgtgacagaaatgaagaactaggaataagaatccagattttctggccaggcacggtggctcacatctgtaatcctagcactttgggaggccatagtgggtggatcacctgaggtcaggagtttgagaccagcctggcctacatggcgaaaccccatctctactaaagatacaaaaattagctgggcgtggtggtgggcacttataatcccagctactcaggaggctgaggaaggagaatcgctcgaacctgggggtggatgttgcagtgagccaaggtcgcgccacttcactccagcttgggcgaaagagcaaaactccatctcaaaacaacaaccaaaaagaatccagatttttaggtgtctaatactagacattctgtatccaagtttcagccatttcatccaataaagccttctaaagccttttttttttgagacagggtctcactctgtcactcaagctggagtgcagtggcgtgatcttggcttactgcaacctgtctcccaggctcaagcgattctcctgcctcagcctcccgagtagctaagactacaggccgtgtcaccaaacccggctaattttttgtaggcacggggtttcaccgtcttggccaggctggtctcaacctcctgacctcaagtgatccacctgccccagcctcccaaagtgctgggattacaggcatgagtcactgcgcccagctcccaaagccaattttcaattatttgtgagccatagattcagtgactacatcaatatctcttgccagggattggcctaacagctcagagaacagattgttaggatatatgggcaagccttctaagttcaagaggcaagagcagaaaatggaatgctatagggatttagctccatcttaagccattctggccctttctgctctactttaccagctatagagttaggaaggcttccagtaggccacagcaagaggaaaaacctttattctgtggggctcatttatccaggatttaacttacctgtgtcatgttaccgatctattaacacaagtaatttagagttggttatattatttcaagaaattgagcacaaagccaggatgtacaaggaggaattcaaacaatcaatattggattatataatgaaaagatgcccttacaatgtttatgatctagaatgtaatcataataaaggggggaaaataccttatgagtatcacaattgtatcagagactattaaacagtacaatgatacagagaatttattcaattcatacaagtaatttaccagatctaaacagtgaatagactgacctaaggggaaaaaaatccttacattgatagcaaaatatcttctagcccccataaataatctgcaatcatttgctaggaaaaaaacttcataaccatatgggtcatgcagacatttttatttatttatttattttgagacagagtctcgctctgtcgccctgattggagtgcagtggcacgatctcagcttactgcaacctccgtctcccaggttcaagcaatttcctgcctcagcttccccagtagctgggattataggcacacaccaccatgcctggctaatttttgcatttttagtagagataaggtttcaccatgttggtcaggctggtctcgaactcctgacctcaggtgattcgcctgcctcggcctcccaaagtgctgggattacaggcgtgagccaccgtgcccagcccatgcagacatttttaagtgctattggtattcactttatttcaaactgagcaaaacaatacaaccttttacttttttatacattttaaaatttctctcatattaacattccttcctaccccaatccatcccatcaccaaacaggaatgagataaggagtgaaaaaaagatgtatgtttctcattttccttcttttcccttgaagtaaaccagtaatttattaaaatattttataggtcagaggataacaaaagactcaatgtagtaaataagtaaataggcattcaaatatcagtaacctaacaggccctaatacagctttaagattttcttctttttttttttttgagagggagtctcgctctattgcttaggctggaatgcagtggtgcgatcttggttcactgcaacctccacctcccgggttcaagcaat

SEQ ID NO: 408 - DNA, 1690 bp, Homo Sapiens
aacatttgtgaccagcctaggcgacatagtgagacctgtctctacaaaaaatatataattagctgggcgtggtggcgcgcgcctgtggtccaagcttctccggaggctgaggtcgggggatcgcctgagccctggaggtcgttgctgcattgagccgtgaacgcaccactgcattccagcctgggcaacagagcgaactctatctcaaaacaaaacaaaacaaaacaagaaaaagaaaaaaagaagaaaattaaaaaaaaaaagaaagaaaaagaacgtcccagggtaaggtctgaggattgcgtcattaggcgattttgttgctgtacgaacaccacagaatgtactttgacgacctagatggtggagcctggacacacctcggctctgtggtgtggcctgctgcttccaggctgcaaacctgacagcatggggctgtactgaataccgcagaccattgtaattcatggggaaagcgcgaatgcagtcccccactacaacaaattatgcagtcgagttttccacatttgggaatatcacaggggtcagcacatccggagtgcaatcgatgagccccacgctgggaaaaaccaccttcgtgatcatggtatcttccctgccagagagaaaccaatcagcttcattttcaacttcttctatgactccagaggattcactttgcatcttgtgacaaatgaatatattacctgaaaaaaaaatgacaggatagatattgaagaaataattttttataggactctggagtgaagggattaatattgaccagagccaatgaggtcatctcatccttgaggggagcaggtgtgagcttcaaatgcttagggcctctggaaggaagcttccctgttggagaaatcaccaaccggctcagcatggtctgaatgaggatgacaaaagtgaagaaaaatgacgtcattgccagagtcaagtgtttctcctatcttggagttcatagggctgcttgaagaatccaggaggcagacaagccctcgctgacagactcacagctttcctgcgtgtttatcatgaagactgaggattggttcaaaataagtgaaactataatgatatttctcagttatcaatgtgatttgcaaaatgaacctagcattttgtagtaagtcattctgagaattcgttttttgtaatgctgattatcatatggaaagtaaaacacatctattacatatgaaacagtgggtagccacacctggaatgcagcacatagttctagttgtcacatctcaaagaaagtataaggggcctagaaaatattcagataaaaattattcatatcagggaagacaatattagaatttctagtcaggaaatatgagggccaagagaatttgtgagcaccacttatgatgtagggaagaatattatgttaatatagtcgttattgctggaataatagaattatgagtaaccctttcaaaatctcaaataacatagtttgagataagacatatgaaaagaacttctgcttggaagcagaggaatttgaaaatttattgaaagatgacacaggttgagagtataaatgtgctctagagagggcaaataattccataaggaatagctgtagcacagatgattgagggagataagggaaatttgggggatagctacttgacttatgaagatggtgagaagagaaggcaacctc

SEQ ID NO: 409 - DNA, 1469 bp, Homo Sapiens
gttactagtgtgagtcctaatccaaaatgactggtctcctcataagacgagaagattagggaagcacgtagaagaaataagtgaagcagagccaggagatggttcctggggagatgtaaggccaccagagaaaagtgtccaggaaataatgaagaaggaagatgaaataccaaaacctaaatctgtggttgtgtcaccatgcactcctaaaagggaaaatgcagtgtacattgcacatgtagatgctggcaattcaaccactggaagacaaatactgtatttgactgaaatgggtgaaaacagggtatttgaaatgtatgaaacagaagttaaaaaagaaacagagaaacttagtacttgtcttgactcttagacacaaatcaggaaaattgagacaaggataaaataatagaagcgggttttgcctattttgaaactgaaaataaatattttacaattctagatgcctctggtcacaagagcttcatcccaaatacaattggtggtgtctctcaagctgatttggctgcgctggtaatctcagccaggagaagagagcttgaaattggatttgataaaaggacaaacaagagaacgtgcaatgttagcaaaggcagcaagtgtgaaacacttaattctatttattaataagatgaatgatccaagagcaaattggagcaatgagagatatgaagaatataaagagaaactagtgccattttgaaaaaagttggcttcactcccaaaaactgcattcactttatgcctgctcaggactaactggaggaaatttcaaagagcaattgaatttctgtacttagtacattggattactgtttattacatatctaggtaatttgtcagacttcaatagatcagttgctgtaccaatcaggctgccaattttgggtaagtacaaggatatgggcactgttgtcctgggaaagctggaatcaggcggtctgtttgtaaaggccagcagcttgtgatgatgccagaaaagcacaatgtggaaggtcttggaacacttgccaatgatgtagaagctgatactgtagccccagatgaaaagctcaaaatcagactgaaaggagttgaagaagaggaaattcttccaggattaatactttgtgatgttaataatcgtggtcattctggaggcacattcggtgcttagatagtgattacagagcatagatctgtcatctgcccagaatttaattcagtgctgcaaattcacacctgtatcgaggaagtcaaaataacagcctaaatctgcttggtagatagaaaataagactcaaccctgttttgtgaagcaagatcaagtatgcattgctcatttaaggagagcaggaaccatctgccttgagacctttaaagacttcctcaggtgcgtcattttaccttaacagatgagggcaagacttgcaaatggaaaagttctaaaactggttccagagaataac

SEQ ID NO: 410 - DNA, 1235 bp, Homo Sapiens
attcctgtctcgctgtttcaacagtcagacgtttgttcttcaggctgcttgctccagtatcctcgtcagacaaccgcagggagcctttgtgcatttatttatttatttgcttggacttgtaatatgaacaaaacatgcagtcacttcccaccaggatgtgtccttctggacatcagcatacgtgcaagatgacaatttcagggtgaatgcttcctgctcgttggctttgctgctggctggtatatgagtagcactggctgatgtaacaaacgtacaccaacgttccagtggcttcctacaagagttctattcttcctcatgaaaaatttcagactacattcctggttgtcaggaagctcccctccacatgatgactcagggactcattttgttcctcatggctctgccctgtcttgtgcatgttgttggtgaagttgataaaggaacttagaaagccattttctgtggaggcataatccaagtgatgcctatcataccagctcctattcccttggtaggaatttactcacacaaccacctctattttagagggaagcagggagacttagtgtaactgtatgcccagaaaagaaaggtcaactgaggatttcaagtatctaccagtcttaagtgaatatagagaattctaggtggagaaaactaaagaaaacagagacagaggaacaaagtaagtgaaggttgcagagtacggaatgaaggagctggaagtggcaacgacattctacactagaggagaggatggggtagtttctcaatgcatggaaaatctattctctcggaagacctggtggtgctggaggcttgaattctcttctgtcagtagctacagaaaatcaaagaaggaaatatcaaactgtgttttcagggccactgactctgtgacttccgctgtctggccttcatgaagccaggcggtcaaatgggacacacagaaactcgaatcagtgagtccttcctcctggcctgaggccccagcttgatcccacaacagggaaaattctggaggtttctgtgttgacctgggtggtagttatgcagcggtgttccctttgtgacaattcatcaaaccattcacataatgtgttgccttttctgtaggtatttttttcttcaatgaatagtttaataaacacaaaaaagaaaatatggtcatcttatctttggacagtctctcaaatgttttataattaattaaattctttaacttatgtatt

SEQ ID NO: 411 - DNA, 10658 bp, Homo Sapiens
agggcgggtccgcggccgccaggtgagcccgccccggtagccccgcgcgtggtccggtcggcagaggcttggcgagccgccatcccgcccctgccccaggcccaccttcccccaccgcccaggccccgctggcctccccggctcatctcgcacccggcgcagaccccatgccctcccgtctcggcagcgccccccgcttcgcctcccggtccggccccagctcgacgggcggaaccgggtgcgcacagcagccccgcgccctggcccagggccagcgggttaacgcttaactacgctccaggagctgtaggctccagccgcgcctcgagtccccaacctttggccccggaagccaaaaagaggagcggacggtgaaggagtcagggtgagttccagaggccgctcccagattttccctcccgagcctggccagactgggcgtatgtccgacatctccacctctgaccccgggcgctctgggctgagctgggggcgatggtggtgggcatcgacgccgtcttacctggacgcccacagtggacctgacctggccgaggggtgggggtggggttgggaactacggaggcgctcggggttcctgggtaagttcccgcggactgctcgctccttgccgggtgctacaataggcgtatccggtgtccctggagccaagctaggggacgggatcaacgtgggggcggggcagcgtgcccgaagggcattgctgcattccaggtgttggggaacgcagtgagcgaaggcgtggaggtgagggagaatgtggaaggcgtgcgcccggccggggaaccctgggctttgtcctgtgggcagctggagcggctgggcgttcccggctgcgacaacgcccacctggccccgcacctgggcctgctcgcaatccagcggcgcctctccgcatctgccttcacggatctcagccccagcagagcccttgtgccggaccctggggcgggattgcgagttcagagggagtcaagaggcgcccttgagtatggcgggagccccaccccaagcacctggtgggaactcacttgcctagggagagagcagggcagtgagcactccgggctggctcccaggaaagaccctccggcaggagcttggattgcaaggttggggaggagggaggccaggggagggacctgcagccaggtgatccgggtgcctgtatttcttcccaaggataatgtgagttgatgctggctgagatctgctccgatgagggtttgaaagagagagctccgggtgtcaaagtcagtggatggcaaaacatgcctggagggagcaaccaggcatccaaccacaggccctgggctggagggcgggggggggggggggtggaagcagaggaaggagagagaaggaaatttgggaggaagagtgggcacgaactggctgcccaattgtgtgggtgggtaggtggcagggagggactggttgttctgggtctgcccctccggccccaccacacctgcttccaggtgagcttaggaatttcccaggcttcctcccagctggagccagacgtgtccctcagaggccccagccctgcccatcctttcctgccctacccagggcttctctaccttcttggcttggcctgctccttgttcacaccttggtaaatgacccttcacaaaagtcattttctctatttgtgcttttctttcttttgccaggacgcttgactttctcgacagggagggggaggcaagcctggtgcccagtgctctgcctgcactggtcagtgcgcgtggctgtcacttggctgggaagctaggccaggagagcagctgcagctgtggaggtcggcagttgagaggtggagagacctgagcacacttgggccagtcgtcccgtggcatttgggagcccaggaccgagccggggggcaagtgtgggcaatgcttggagccacagagtgggggtagggaattggaggggtagagaggacaactcaaaccaagccaggaacccacagaggagaccaggaaaggaaaaccaagaaggagtgagtccccaatgcccccaaattgatccatatattgaatgatccccagtaaaagtagctccatgatgattccaaagcccttaggaaactaaaggtgccaggagaatgaatagacacgtctccatagaagacacacactggtcaacaagtacatgggaaatgtccagcatcctccaggaaatgcaaagcaaaaccacagtgagatcccacctcccacccgctgggactgggcagatgcagtcctggcaaaccagtcttggtgaggagcgggggtatcagagccctgctgcactgagatacacacacacaaaatggaatagtattcagtcttaaaaaggaaagaaattccagtactggctgcaacttggatggaccctgaggatcctatgctgagttaaataagccagtcacagaagaacacgtaccatacaatcccacttatgtgaggtccctagagtagtcactttcatagagatagtagctgacaggaggagcatggggagtgactgtttaatgaatacagacttgaaatttgggaagaggtaaaagttctggagatggatggtggtgatgggtggtgatgatggacattggagatgggcaatggacatggatggtggtgatggatggtataaatggatattggatgtggacagcggacgtggacagtggagatagagggtggtgatggctggtggacatggacagtgaagatagagagtagtgatggatggtggagatagagggcggtgatggacagtggagatagagggtggtgatggacagtggagatagagggtggtgatggacagtggacatggacagtggagatagagggtggtgatggacagtggagatagagggtggtgatggacagtggacatggatagtggagacagagggtagtgatggacagtggagatagagggtggtgatggacagtggacatggacagtggagataaagggtggtgatggacagtggagatagagggtggtgatggacagtggagatagagggtggtgatggacagtggagatagagggtggtgatgaacagtggagatagagggtagtgatggacagtggacatggacagtggagatagagggtggtgatggatggtggacatggacagtggagatagagggtggtgatagacggtggacatggacagtggacatggacggtggggacagagggtggtgatggacggtggacacagacggtggagatagagggtggtgatggacggtggacacggacagtggagatagagggtggtgatggacagtggagatagagggtggtgatggtcagtggagatagagggtggtgatggacggtggagatagagggtggtgatggacagtggacatggacagtggagacagagggggtgatggacaatggacatggacagtggagatacagggtggtgatggacggtggacatggacagtggagaccgggggtgatgaacagtggacatggacagtggagacagagggtggtgatggaccctggagatagagggtggtgatggacagtggagatagagggtggtgatgggcggtggacatggacagtggagatagagggtggtgatggacagtggacatggacagtggagatagagggtagtgatagacggtggacatggatagtggagatagagggtggtgatggagggtggagatggagggtggtgatggagggtggagatgcagggtggtgatggagggtggcgatggaggttggtgatggagggtggcgatggagggtggtgatggagggtggagatggagggtggtgatggagggtggagatgcagggtggaaatggagggtggagatgcagggtggaaatggagggtggtgatggacagcagagatgaatggttgtgatggatggtggagatggagggtggaaatggtgggtgatggagggtggagatggtgagtggtgatagaaggtggagatgaatggtggcgatggacggtggaaatggaagatggagatggagggtggatggagggtggagatggtgagtggtgatacagggtggagataaatggtggtaatggacatagagatggacggtggaaatggaggatggtgatggttgtacaacaatgtgaatgcacttgatgtcactcaactgttcacttaaaaatggcaaacatagtagtttttatgttacatatattttactacaataaaaaaagaatgaaaagcctataaaattctgaaaaataaaaaagggggctttagccctgccagagagtagaatccatcatagaacatcttgctatgggcagttgactggacacacacatcagagcaggtctgtgtgatcatttagcatatgattaatggggcatttaaaatccacgaggggccgggcgcagtggctcacgcccgtaatcccagcactttgggaggccgaggcgggtggatcacctgaggtcagcagttcgagaccagcctaactaacatggggaaaccctgtctctactaaaaatacaaaaaatagctgggcatggtggtgggtggctgtaatcccagctactgaggtggctgaggtgggagaatcacttgaacctggaagcggaggttgcagtgagccaagatcgtgccacttctctccagcctgagcaacaaagcgagactctgtctcaaaaaataaattaattaataaataaataaatccatgagggaaaggatgtcatttaaaaaagggtgtggccaggcacggtggctcatgcctataaccagcactttggaggccgaggcaggtggatcacctgaggtcaggagtttgagactggcctggccagcatggtgaaactctgtctctactaaaaaaaaaggacaaaattagctggatgtggtggcgcatgcctgtaatcccagctacttgggaggctgaggcaggagaatcgcttgaacctgggaggcagagattgcagtgagcctagattacgccattgtacttcagtctgggcaacgagcgaaactccatctcaaaaaaaataaaaataataataaaataataataaagggtggtggagcaactgggcggccttggtgtctggaaaaacatgacgttggatcctgatcccactcttcacacggaaataaattccttatggagcggaaatagaaatgcaaaaacccaaaaccacaaacataatttggaaaaaacacaggagactatttaatgatctcaggatccggaaggcttttctgagcacaacaaaaaagcagaagccacagggaacattgttgaaaaatttaattaaattacaaatggcaacattttgcctagaccacatatttaaaatcaaaggatgtgcaacaaactggggagaacccatgataactcagtggttaacaaagggccgattctcccaacaaagggctactatcagtcaacgaggaaagggccaggccgccggacacgctgcacaaaggaagccccaatggctgctgactgcaagatgctgaacctccgccgtaatcagggatgagcaaattggccctaccggaagatggtattttcacctgtcagacgttttcatgagagactgggatgggaggagcggggagacaggcacttcccacaactcccagcaggagtgtgaatttggggtgtcgggggaggggattttgtttccactatagcctggtactgcgatttggtccagggctctggtgaagatgtaggagttggcctgcgtcagcgcccgtccccgctttccacagcgagcaaagaccgtgggaaccctgatgcccctttgcatttgcgcttctgtacttagctgctagtctcaggcagtgaaagcttcaagccacccgcagagccctggaactggggcattggctctagtgggaaaaggaggcttcccactggcgacccaccatgacagaccacaaaagacatgcaggtccccacagtcaggccctgacacccactcttcctgccttcttctgcctaggcttgcacagctgggcaagtgagcgggagccacgggttagctgagatcacctgcggccaggaacagggccttcctggaggtgaggacaagctctgcttcctccaggagcaggtgctggagcagagcggctcccccgttctacaagtgtcctctgtgtggcggcccaggtctgtgcgggcctgtccagcccaggagaggacagaagtcatctgtagcctgggcccctgtggcccccagcgagaggccctggtgggactggtctttctcagcctgtgcacctggggctgaaacaggactcaaagagggaaagtggcccaggcaggccctcccctcaggcctcccctctccctggctgctctcccaggcttccctgctttcccttctgagaccccgactactggacccagccttactgccaagataattatccacaacagcaggagcgcccaggcccatgaagataatcgcctgcccagcactgtgtccacatccagttcatcccagctgagacccaagtgcagctgaggggtgggggacactcctcagctctcgaatgatgccaaccctccagggcctggctgggagcagctcagtgcttcctggctccggggctgtgttccctacgtcccattcggagcttctctcctgaagaaaacagtgtctgcctgcacccttcttagaaagcaccctgacacgtggctacaaagagcagagagcacagtacccttcccagacacacaccagcacccccacccactgcatttaagccaccactgtcccgccgcattcatccctcctctaccccctaaattcatctttcagtggaactctgcgttcatccctccactccccgctccattcatccctccactccctgctccattcacccctccactcccccctccattcacccttccactcccccctccattcatccttccactaccccctaaattcatccttccacagaaccctgcgttcatccctccactccccgctccattcacctccactctccctccattcacccctccaaacccccctccattcacccctccactctcccctcccttcaccctccactccctgctcctttcacccctccactcccccccattcacccttccactcccccctccattcatccttccactaccccctaaattcatccttccacagaaccctgcgttcatccctccactccccgctccattcacctccactctccctccattcacccctccaaacccccctccattcatccctccactcccccctccattcacccctccactcccccctacattcacccctccactcccccctccattcacccctccactcccacctccattcacccctccactcccccctccattcacccctccactcccccctccattcacccctccactcccccctccattcaccctccactcccccctcccttcaacctccagtcccctctccattcacctctccactccccccattcacccctccactccccactccatccctccattcccccctccattcatccctccactcccccctacattcatccctccactcgcccctacattcatccctcccctactccttacattcatccttccactccctcactccattcatacctccacttccccctccattcattcctccactgccccctccattcctccactgccccctccattcctccctccactgccccctccgttcatccctccactgccccctacattcatccctcccctatcccctccctgccccctccgttcatccctccactgccccctccgttcatccctccactgccccctacattcatccctcccctatcccctccattcatccctccactccctcactccattcatccctccactgccccctccattcctccctccactgctcctgactgccggctctggggcagtgctctgtgtcccatggtgcagagtaggacaatgatgaggaggcagaagagcaatcgagtggagtttcggagagtactgtcataaccctgcgctgagggcggatcccatctctgcccaggtcctggatctttaccacccagcacccacacaccccctaagctctgcaggacccatggtgaacaagatgaggaagaggactgaggtggtcatctcctttctacttcagcgggaatcctttctctgcggttcatcagggaaaatggaattttttttgctcacctacagatcagctctccagcatgacgggccctgcggaccacctgcctcaaagcctttcctccttgttctttccaacagaaccaggggctttcagccatctgtggtgatctcttgatctcggggaaggggccaggtccaggactgagcaagggcacataactaatttggggccaaggagatatgaggggaagtgtgctgttgcaggggacagtgtgtggggaagggcgcttctaggaatgccgtcctcctgttaaagagttgatgtgaggtaagacattctctgtctctactcaccgcctctgctgggtgaggacatgattcttgggactgcagagccatcttgagactaagagaagaccaggagcagagcagacaagctgaccaagatccctgccacagctgaactggacccagagccatagacttcttaatcttacgaagtggatcaagctaacaaacttaaacgatgttgtttaagctactttgggttggatgttctgttagttacagctgaatcacccatgtagcagaggatgtttttatttattttagagacaagctgttgctctgtcaccccggctgaagtgcaggtgcaatcatagctcactgcagcctcaaaatcctggctgcaagtgatcctcccacctcaccctcccaagtacctgggactacaggtgcactctgccacgccagctaattttttaaatttttgtaaatatggggcctcagtatgttgcccaggctgttattgaattcccggcctcaaacgatcctcctgcttcagtctcccaaagtgctgggattacaggtgtgaaccactgtacctcgccctgcacacgtgcttagatatgctttctccaagtactgttctttggaatactggtaataaatatttctatgagctgggcacggtggctcactcctgtaatcccagcattttgggaggctgaggcgggcggatcatctaaggtcaggagtgcaagaccagcctgaccaacatggataaaccccatctctactaaagatacaaaattagctgcgcgtggtggcgcatgcctgtagtcccagctactcgggaggctgaggcaggagaattgcttgaacccgggaggcagaggttgcggtgagctgagatcgcaccactgcactccagcctggacaacaagagtgaaactccatctcaaaaaaaaaatttttttttctatggaaaaaagtctattttgtgagatatacatatatttttttttaaataaaaatgtgttggtccaccccccccacacctccacccctgcagtcaaagccactgaccatggagccaggagccacccaatgaggtgtcttttctctaaggatggtgaagttagagaaggctcctttaaacctcctccaccatgtgccagaaacccagagaacactcacggcggccctgagctctcgagaatcgttgtgcaatgcccattccagcagccatgcacatctcatggccagggtgagcctaggaaggaagggcagaggatgacacattcgacgtgagtaggactttctgtgtgtccactctgtggggctcttctttggaacgtcactgtggacacaggagtcagaggtgaacgaaggcactgagaggggatggggcactggcattggaggagtgaggagcacccagccatccttattcgctttactgcttttggcagtttttctgtttgatgtgttaattcgtgtacacgctgcatgccagccgccactgatggccgccttaacggcggtgctgaccacggctgctttgtcagcacaggtgaagctgttgaaacgcctctcagaggggcctctggtggcactgcccatctcttccctcagcctctcctgagtgaggcctgctgcggggtttccgagagttccctcaggaagcggcagaagggagcagatgcccgaggtcaggtgcctgagagacggtagcatttggacagcccagtagcctttcccatggtcacgcaaattctcctgaaactcaggcagggtctgaagaaacacaagatggcacaaagccatccccagagccgtgggtcccacgtggttaaatgtggaaaacactcgctgagggtcatagtggaaaacagcggctggagatggggtcttcctgttggctgccgagacggtgacatctacaggtgttgagtggctaaaaaaatgtattccttgcaatgcctcacagacatggtaacgtatgcacatatgcgtagtggcctgccagggctggtaagataacatcccttctatattcagggagatgaaatctgatctttttttttttttttttttttttgagacagagtcttgctctgtcacccaggctggagtgcagtggcgtgatcttggctcactgcaaccttcgcctcccagg

SEQ ID NO: 412 - DNA, 2856 bp, Homo Sapiens
aagtctatgtggcccttaccatctgcaacccagagacgtgccagctgttcaccactgagctatgccgggctgggatcagatgggaagtggaacctcgtcatgaccagaaactgtttccctacgaagagcacttggagatggcaatgctgaacctcacactgtaggactcacatacgactccaacgggattgtgagaatcaagtcactctagtgggaagagtttttatatgggaaagcggataaaactttcattggactggaatgtttggagaatgttaatttccaaatcaggaaccacaaactgccctctaataagacatcagctatctaagcatgtgggtgctccctttctgccagcagttctggttcttaagaaaatcgccatcaatcagacatgaaatctctggctccaaaaatagcattttctttgtgcaaataaaaacgtgtgtatcaagtatgatgttcccccaatgtggacacactcggttccccacaaagccaagcccgctgcagctgccacatccctggacacattcggttcctcacaaagccaagcccgctgcagctgccacatccgtggacacactcggttcttcacaaagccaagcccactgcagctgccacatccctgggcttacagtgcagcaggtgcttttttcaagacaggaatcaaaatgttaggaacacggcggaaagatgacacctggagagcaaacgcaggatgaggagtactgcagaggtcacacggaagtcgcagaacagtaatccgctagcaggggcatggggcgtgaagaacagaagaagataggaagtgtttccgagcctccagaaaagaaatcagagccaagcacagcttcccgggtcacagaaccaattcatttaccaggcggcaccactgccgtcatttcaccttctggccactgggaggcgctgctcgaaagggtttgccctgagactccgagaagaagctgcgggaaggacagcaggggtcccggggttttagcctctggcccaggagttatgtgtccataaccaaatggagcacactctgcacccagctctcatcccatcggagctgctgcgattcccgcaggttcttccagaactggtttagcttgcccgcaggatcaggaaagtttgagaaaagcatctgcaaaaaaataaagagcagagcttaactcatttcctgtccccaccccatcccaggtcaccacctggctgaccccaggtccccgacccaacaacaaaccctcccaagttcctaactccctcacttggactcgagactcttcacgccccagcagcgctccgcctccaacttgacatcacgctttctgtcccactttcccacacttcgtgccctggagcacctcccggcctctacacgctgtatgttcccctgcgagcaccctcctcttggcctctggccaagtcccacccatctgtgggtaacaagggggtgttggtgttcttttcagccttgctaaactgtctgaatcaaggatcacaaactacagcctgcaggccaaatccagcccacagcctgtgtttgtaaataaagttttattggaacaaagccacaccccttaatcgaagatgatctgtggctactttcacaccacaacagagtaccatggttctgacagagactaggagacacagtctaaatgacttctgacctggacctttactgaaaatcctgccaatcattctgttggcaagaatgatgtattacttttagcaataagaaacaagtaacctttgcagaattccacccatctttcaaggctggtcccagaagttccctttgcccatgcacctacctgatcctgatcacttccgaaactgcagcccggcccacccggctccagcatcatttgtggagtgtcagctccataaatccagagggcaggtgggggtgtgtcctaactttcccgagcctactgtaccgaaacgggacagcagagtaggccagcctctgtgacttctgctctctccctagcttttccgccagaccccacatggtcccaccctggctgtgggaagcagggatcagggagcatggctcagtgccagtctccagaaccctctccaccctcgcgtggtggcagatgtggctacctgcagctgagctgccagttcctctgagtcctcaaagaccaggccattttcttcatgtttcaccagctcatgtaaactgcagagagaaccaagggagcctgagagctgcctggagaagacaccagacccctggggtgcccacctgggcttcagcctcccaccccatgctcaagccaggctgagagttggaacagggggtgtgttttccggggggtggttcttagatttggcatctgaagggtataaaggggggtacacatctaaatggccaaaccgatttgaagagggagccttaaggggggtttgtaccttctgtgctggatgctcttcaaggactgaagaattatttttgcatgtttttcttaactccatggccatggaacaagtaaagggaacacccgggggactggctcagcacataaaagatgacttttctagggcaccaggtttgatcccgacattccctgagctcagctcacaggaggggctcacatccctggatcccatccaggagccggctcctgagcaggggccaagggctcagcttgtgctggggctactgcttctagaatctcctctaacgccgcccttccaaacacacgtctgtgctgggtagagtggggccacagcatgacactcatttaactgattcaaacccaccacgtgagcttggccaaaagggacatggtgggagagaaagaaacaaagaaaaccatgtaagcctgcaggcaattc

SEQ ID NO: 413 - DNA, 2209 bp, Homo Sapiens
tacactctttcttgcctgctgccatgtaagacgtgtttgcttctcctttgctttccaccatgattgtgaggcctccccagccatgtggatctatgtgtcctgggtttcttctttctggtgggctcatggtctcgctgacttcaggagtgaagctgcaggccttaacgctagatggaaaagttctccaagtccctacccggcccagaagcccagctggcttcacctctcactggcactggctgcaggacttcgccgcacctagcccgggcactcccgcagcctagaggaagctcctcccagacaatcaagaggaaaagaggggaagcgagaaagagacggagagccgccagcgtggccaaagaccccactaagagggaagggcggtccacgcacgggacccagcctccgatcaagcccagcaggtgtcgagatcgcgcccacccggaccccacgccggccggccagcgctgcgcgcagccccagctcctgcccgcgcctctctcttcacacttcccggagagcagagggagccggctcaggcctcagccagccccagagaagggccctcacagcgcagcggggggctgaagggctcctggagcgcggccagagcagacatggagaacgaggaggcgcggagagcgagcgagggctgctagcacgttgtcacctgtcatgatgttgtaaaataagaaagagtaaatgttattttagaattccttcctggccaggcacggtggctcacgcctgtaatcccagcactttcagaggctgaggcgggcggatcgtgaggtcaggagatccagacaggagatagagaccatcctggctaacacggtgaaaccccgtctctactaaaactccaaaaaattagccaggcgtggtggcgggtgcctgtagtcccagctactccagaggcagaggcaggagaatggcgtgaacaccggacgcggagcttgcagtgagccaagatggcgccactgcactccagactgggcgacagagcgagactccgtctcaaaaaaaaaaaaaaaaaaaaaaaaagaaaagaaaagaattccttccttgtttcctgctgtagttatttgtcaaaagatacaaaaaatctgtaagagttaagcaaagctatatttattttgctgcaacactactatgcacagtgacatggtcaagttgctttttataatgatttctagtgatattaatttgcatcagtcgttttcatgaccccaaagccaactcaataataccagaaaatacttgtttgcttgcctacattttgtaataatccaatgtcctgaaataaaaatgaatattttcttcctggaaataaagtgagataattttcttcttccgagagactcatgaaacaagaacagaatgacattatactaaactatttcacaaatattggtcaacagtggaggcttttttgttcatttatgtaaatttcatttggctctattttcctaagttgcattttatgcttctttcacctgccttgccaaatgaaaagaaaaatcatttatttattaaaacatacactaacagaagaaaataatttcactcttcacaaactttggcattatgaagtcactggttactggagatttaatttctgtaacatatctgaagtggttatttttttctttccatgaaggaaaccttttggaattaagatatggtacattgaactaaacggggattgcatttgctgtttctgtgataacattttacatctgaaattccaataaatatttctcttcttgctttgaggtggtttagttaatcattcaggtggttggctttcataagaagtaaaggcgtgccagcatttatagtttcccagagttcgtttattgcctcaagcttgtatttattcttattacactcactagcttagataccaggtgaatacctgggagaaagaaacaattaatttcaaaagtaataaaaataaaagaacaaaaaaatacaaaactattcaacatgccagcaatcctgttctcttaagaaacctacctgtttttttcaatgtgtgtaagttttagcattttatagcaattagatgagtctgtatatcattagaacttctgtccttggaattaggacaaaactattttctgcaataaatatttggctctagaaatctattttgacctgtaccataatgcatagcagcagaattaaaatattgtgtgttatcatc

SEQ ID NO: 414 - DNA, 1112 bp, Homo Sapiens
atgttccttgtgaattgcttgcatccagcattaagggctggtttttatcttttatttttccaatcctctttccttctcaaggtgtccaagacacacagagccatggaatctcacagatgtctgagaattcctcctcctgggactctcagaggatccagaactgcagccggtcctcgctttgctctccctgtccctgtccatgtgtctggtcatggtgctgaggaacctgctcagcatcctggctgtcagctctgtctctcccctccacacccccgtgtacttcttcctctctaaactgtgctgggctgacatcggtttcaccttggccacggttcccaagatggttgtggacatgcagtcgcatagcagagtcatctctcatgcgggctgtctgacgcagatgtctttcttcatcctttttgcatgtatagaaggcatgctcctgacagtgatggcctatgactgctttgtagccatctgtcgccctctgcactacccagtcatcgtgaatcctcacctctgtgtctccttccttttggtgtcctttttccttagcatgttggattcccagctgcacagttgaattgtgttacaattcacaatcatcaagaatgtggaaatctctaattttgtctgtgacccctctcaacttctcaaacttgcctgttctgacagcgtcatcaatagcatattcatatatttcaatagtactatgtttggttttcttcccatttcagggatcctatggtcttactgtaaaatcgtcccctccattctaaggatttcatcatcagatgggaagtataaagccttctccacatgtggctctcacctagcagttgtttgctgattttatagaacaggcattggcatgtacctgacttcagctgtgtcaccaccccccaggaatggtgtggtggcgtcagcgatgttctctgtggtcacccccatgctgaaccttttcatctacagcctgagaaacagggacatacaaagtgccctgcggaggctgctcagcagaacagtcgaatcttatgatctgttccatcctttttcttgtgtgggtgagaaagggcaaccacattaaatctctacatctgcaaatcctgccc

SEQ ID NO: 415 - DNA, 5855 bp, Homo Sapiens
ctttcgagccgcgacaggatggggaggaaaaagtttgcggcggaggcggcgtcatgtgggacggggcgggcggagcgtcgcgggccggatgggaaaggccgggagcgccggcgggaggcgggacggccgcgggctctgcgcccgccctcggcgcggaccctgggccccgaccccgcggtcgccggggctccccttcctctgtcccagtgcgcccagccccgcgctccgcacccgggcacccccgcggggttctcctgagttcctggagctcccggggctggcgctcacgccgtgagaggggtgcgcccttaggggggcgggacggacggggggtttctacgggaggtaggaaacgggcggcttgcaaggcgcgggcttaggccggagcctggtggtgcgaggtccccagctcggatttctccctggtggagagtcccggagcagaacaaaccagcagaggctctggaaagggtcctcctgagcacgtggctcattcattcattcgacaaacgttacctgagcgcctgcccactcattgcccgagtgtgctgggagcgccgcaccaactgcctggtaggtgggagaagggacacgtcaggtaacaaacagcacaggtaagtgccggccactcaaatggggtggaaagaggtggcacagcgctgccgagggagtgcgttccagacaggtgacctcttgcttgggtgctgaatgagtggagttttccagagagaccaagaggaagcagccgcagaaacctcagcccagctgggcttgcagaagctaatgctagaatagttgtgggactcaggatctgctgaagtcgggggaagagagaagtagggaaaggaaagcccaggccacgcgtggggctcaggaacggcatcctcgcccgaggtgggagttcttctcaggccctggtgtttcccatgacagtaaaaggtgggggcttcagatttctccaagggaaaagttaaagcaacacacacctatttatttttactgtaatttcagaaaagagaggttaaaaccaagacatggacaaagcctccgaatgaaggcagccctttaaatggaataaatttggtttcatggcacattaatggggtgtcttctctccgaagacacagagacaactacagtaggtctgggggccgtcagggattggaggaacgaaggtaagaaaaggaagaaggtaagaaaaagaggtccctacctctgtgaggtagggacagtgctgaacagcagggctgggagagcccacagggaggtggccaggatggccacagggcctggggaggaccaggtggggcaccatcctgcggtagagaatgcccgtcacctgccctaggggccacccagaatgcagattaaataagtatttgggaatggcacaggagcttttccattttcgtgggttagaggaaagctgctgcgttcaagaggataacgtgggacctgagcattctggtaagtcaaccccacattcatggaaagccacgggctctgttttactgataaggaactgaagtcccacagaggaagtggccaggctcactcacacacagcatgcacttgaagctttctgtggaaatcagaaacctccggggctcaggcgctgtagtggtggcctggtgactctgaccccttgaaggagaagcatctgtgaaggtgctgtccaggacaagtagggtgctctacggtaaaggacatggtggcctgacctgctccagagcagggaggcctcccttgaggaaataagataaacccagactttaaggataagcagaaaccagctaggtgaactggagtgggaacagcacgtgaaaaggccctggtttaggaaggagcaccactccttcagagcacagaaaggccaggatggccgaagcatagggaacaacaggaaagtgacataaattgaggctgcagaggtagaagaagggccttattggtcgtgctaggaatttggaattctgcaaagaagcctgggaaacagattttggtgacactcgccttctctttaatgtgcagtttcagttctgttggtgtgattctgcattggagatggcgtgctgtaacgaatggccaggagcttaagagtcatgcagacttgggaggcctggccttgccacgcccagctgcatggccatcctcctcctgtttctggccgttctgtttctaaaccttggggttctgatattcctacatgtaaactaggggctgtaataggaatctcacaggtgagtcttaggattataagaggagacatgactgcatgtgtaagacatcataatgatgtgcttcctcatctgaccctacctccaggttctttgataacctcatggttcccattttctagaacagttgccacttgcactcagataaaggtgactcactgaatgcataaataagtgtagtgccggatttgcatacttttggtagactgtcatataataaatttataaatcagaattttaaaactccaggtggggccgggcacagtggcccatgcttgtaatcccagccagcattttgggaggctgaggcaggcagatcacttgaggtcaggagctcgaggtcagcctggccaaccagggttttagtagaaaccctgtctgtactaaaaatacaaaaattagctgggcgtgggtgcgcatacctgtagtcccagctactcaggaggctgaggcaggagaattgtttgaacccaggaggtggagattgcagtgaagcaagatcgcaccgctgcactcctgcctgggtgacagagtgagactccatctcaaaaacaaacaaaacaaaactccaggtggaccacgggccaggtggttgtagcttcagtcccttgattgcaacatgtgcccaagtttggctgagatgtacctgtagccacggtccttgaagccctgagaagatttgtcagcatccccacggtgctccagcagtgctctcatcttgtggctctaaatcgagtccatggccctctctcactgtcctatggttgcataagctcagaactggcttcgtctccaattccaggagccctggaggttgtggcctgttgacatttttacctcctgagtcaatgtggctgggccacaggtctcagttgccctcccaggcatcttgcaggacttggatctgtgccaagcttgtgggtgtgaacaagcccaagaatgctgaggctctcagttgctcagtgctgcccatcactgggatttcagagtagtgacccccctcctccaagatacaacagaatcttgctttggggccatgaagaacacaatcaatattacagttttaaatcttgaaaagtacagttttaatttttttaattccaaaaaatttcacacatgtgcactgcaaattcaggaggtaaattcagcaaaatcttgcctggtggaggtaccagaaggcacagtgagtcaatggggcatgtttctcagtcggtggggagagatgagaatggaacagggatgtggagattttatgcaggaaaaggggcctgaccacagattttttgccctttgaaaggagaggaacaaggcctatgcccactgcctcttggattcagtgggagatctgggcatcatactggatgaccaggcatgtagtcacaatgcacaatgccacccagcccaaaagtgtatattcaagactttagacccaacttcgtgcttacaggaaatagaggaggttgaggaacaagtgacaccataagaaatacagtgaaacaggccaggcaccgtggctcatgcctgtaactctgagcactttgggaggccgagatgggcagatcacctgaggtcaggagttcaagactagtctggccaacgtggtgaaaccccatctctactaaaaaaaaatatctgggcatggtggcaggcacctgtaatcccagctactcaagaggctgaggcatgagaagcactggaacccgggaggccgaggttgcagtgaacagagatcgtgccattgcactccagcctgggggaacaagagtgaaactccatctcaaaaaaaaaaaaaaaagacactgaaacaaagccagaaggtagaatattctttcaggtagtagtctggtctcttcaatagtcaatattatagagcaagaaggggccagtggagaagagctgttctagattttaaaagatgtaagaaatacaacatttggccgggcgcggtggctcacgcctgtcatcccagcacttaggtaggccgaggtgggcggatcatgaggtcaggagatcgagaccatcctggctaacatggtgaaaccccgtctctactaaaaatagaaaaaattagccgggcatggtggcatgcacctgtagtcccagctactcaggaggttgaggcaggagaatggcgtgaacccgggaggcggagcttgcagtgagccgagatcgcgccactgcactccagcctgggtgacagagcaagactccatctcaaaaaaagaaaagaaaagaaatacaacatttaaatgcactgtgttatccttaattggaaactgctttaattatccaacactaaaaaaatgtcaagggcaagaggtggtttgaactatggactggtgttagatgatgtattttttttattttgttaagtataataatagttgttatggttaggtgggaaaagatccttaaattttagagctgcatgctggagtatttagaagtgaaccgtcattgtatttgttatttaaaatactacaggaataaacaagatgaagcaaaattgctcagtctagatatgggtctatgagtgtttcatctttctacttttttctccatgtttgaaatccttggtaaaataaagtcaaagtggaggaaggaggagcttgagattgaaaaatcagtttgagaagcagccaccttgactggcttcactctaatagcctggacgctgcctccacactccaggtgcactgctcagcattctccaagaagatcattaaggcagaccctacgtgttaaatttcaatcagtttcattgagcaaatatgctgttaaatagagactgctgtgtgctgcgtcagtgtgccttatgggcaaatgtgatggtgactataaatgcagaccaagcagtccttcccacactgtgtacacaaagaaaggagctctggaactgggagccaggacatctgcaggaggagaattctgaagtgaaaggaggcctggatattggttgcaaggccttgtccctggagcctggatgctctcataccttctacatctgggcctctgggtccaggacagtgccagggagagttcatagaaacaaatgtgttgaagaccttagcggttgtctgactctgagacagttacctggccactcttaagtttcctcattttttttttaattttactttaagttgcgggatacatgtgcagaacgtgcaggtttgttacataggtatgcatgtgccatggtggtttgctgcacctgtcaacctttcatctaggttttaagcccctcatgcattagatatttgtcctaatgctctccttccccttggccccctgtcaggtcctggtgtgtgtgttgtctggcccccaccgtgtccatgtgttcctattgttcatctcccatttatgagtgagaatatgtggtgtttggctttctcttcctgtgttagtttgctgaggatgatggtttccagcttcatccatgtccctgcagaggacatgatctcatccttttcatggctgcatagtattccgtgttgtgtatataccacattttctttatccagtctttcattggtggacatttgggttggtttcatgtctttgctattgtaaatagtgctgcaataaacattatgtgtgcatgtgtctttatagtaa

SEQ ID NO: 416 - DNA, 2069 bp, Homo Sapiens
ctgttcggtttcgccttcctgctgtgcagtcttttgacgcttgctgtccaactttggagttttcttgcctttttttctctcagagttgagcccctgcccgggccctttagtccctcggtcacgaggaacggtagagtttagaacctgtgagtacgttagaaagttcgcagtcgaggaagaacagggttcgggcaagggcagctggtccggtaccaagggaaaacaggctgggatggtgaaggcgtcagtggctacaaggctggaagtttagcaccagaagggaatttggagatcaattcaaccgcctcatttcaggcatacttaaattgaaacccagaaagatgaggtaatttgcagaaggtcacccagcaacccctgagcaggcaggactgcaacacaaatgtctgacgtgggcttccactgtgtaatgctaagcagataggacgtaaattcctttgcagacttctcatttttccttaccccctgcctctcatattacacaccttccccatttagcttttcttcttttactttgcacttgcttttgtacatctaaaaggaattaattattcaacagcagtgggaacccttgaaacataatctggaaaaaaagattaataaagttttttttatgtcgcgtagtgaaaagagcatgtgctttagagacaaacctgggctccagctatttacttgtgagagctttaggtcaattggcttttattacagctttttaaccataataaaatggggatccctgcctagcagaagattgattaaatggatcataaattgtccaactagtgcctagcaaatagtacatactcagtattttcccctttttaatccccgttttacaggcgatggaactcaccagagaccagatagctagagaatggctgagctgggttttaaatctagtcaatcttgaccccagagctctccagcctaaaggtaatgtttagacttaacttccagtggtgtcattataagagtcaaaaacagactgaagaaataaaatagcagaataaagtagtggggcattaaagaatcatctagttaattcttggtgatgataacagaaatgttgggaaaagtgtcagaagccttaattttctccccattctttctgagtatctttagatcaaccaccacttcccaagtatttgcaaacaagcagcatagatattatagccctagaaagagttggaaacattatcacaacattagcaagagagtcaaggcatttttaaggaaacagaagcttccatttcatgaactaataaagcccaaggtgccaaagacactgatgtcatactggaaagtggtgtaaaataaaattataagcataatttcaacatcaaataaaacaaatgatgaaacatgccagttaatggcagagccagcgtccaacctcaatcccaatccagctcagaagctctaattctaccatggttatctggcaggacttgacacttcaattggattgtactcaaagctgtattttcttaaacaggcaaaatattctcacagaagcaatatttaaggcagagctctttttttttttttttaaggtttgacaagatcttcaaaagattaagaatagacaggaaaccaattaagaatgttaagagttacggccaagagtttgggcaaagaaagtttgccactcaactctcaatcatttgcccccagaaaagggattaggttgggctgttcaggctaattatatgaacattttataaaaagaaatcagacacagaaaatcaagccccacaaaagcagaagctggtactccaagctgtggctcagcccttcccttcccccacaggacagaactcagctgaacatctacttccttccctactaactcagcagttctcagaaaggaaatggcaaccatatgctttctcattaaccaaaacgaaaggcagccttgagaaacaagatggtctgggcaatacagaaactgttcagcccaggctagttggtttcagctacctctaaatcactcccaaagatgtggttaataaaaagaaaaaggagatgtcaaggagacaattattgctagg

SEQ ID NO: 417 - DNA, 1112 bp, Homo Sapiens
agtcctgctgagcctctcctaggcactcacaagccacagcacccgccacttagtacttctcacaaatgccctatgagtttggtatgatgtgcttgttttatagatgtggaagctgaagcttacggggctgaagtatcttgcctcacatcacaggctgctaagaagcagagctgggattggcatccaggttgatctccctctaaaagcctcccctttcactacaacccacatagactctcattccaaccccacttcaagcatttcttcccattatcagacctgtgggacaaggtttggttgggaaaacacgaggctcttcaggaagacagacaacagattgcccatcatttcatggacaagggaccgacatgaggcgcacccagatctctgtggctttttcttggtgccaaacaaatgcagaaggagtcacttctcaaagaacacagtgtttttcttcctcttctcacctctcctgggccggtgcctgtgataattgggaagcacagagtctggtttttccgggattggaaccaatgctgtgaagagtgttctgacaataaatgttgattgacagttgatggacaatgttcttgaatcagtttttcctgtgctgggtgttaagctgagaactgcactaaacaactgctcaacaacctgcttcctgttcagatagaatttactacactctctctctgtgggcctcagtcaggcagccaggcgagatggtatctcagacgccttccagctccatcactcaatgtctctatcaagaagagaacacagatctgaaaacatttttccccctaacactgagttggggttattattcacatacaaaaacacaggcaccaacagagataactggtcaggaaataaggagctttgattctggtctcatactctttgacctagtaattctacttctgtgaatttatcttaaagaaagaatccagaggacagagctgtgtgcacgaaaaggtttgctttcgcaatatttggagttactgtcaataaaatgatgtccaatgcaagaatgcgagagactcccttggtggcacatgaggccaccgcaagtgataatttcaaagacacagaaaaacatacttggcagt

SEQ ID NO: 418 - DNA, 1160 bp, Homo Sapiens
gccacgtgaaggatgtgtttgcttccccttccaccatgattgtaagtttcctgaggcctccccagccatgtggaactgtgaattaaacttctttcctggagtgtgaaaatgaactaataaactctgtgacctcagagactccctctctgtgaccctgttctcaaatgtatgaagatgggtgctcaaagatctctctctaaacatggaacagggcctgtctgaagacataagtgattaacttctaatctataactaaggtctgagtcctgaagaccttcctctggaggctgagtagttaatctagatgggtccaggtgctgcaggtaaaatacctcttttctgacaagactaggactcttacatagactaccatgaactaaaagaagcacaacattgccagagtaacctgtgatactgtcttcatgcgaacttggtatcctgtttccatcccagccttctataacccagtaacatcttttttgaaaccagtgggtgagaaagacacctggtcaggaacgcggaccacaggacaactcaggctcacccacggcatcagactaaaggcaaacaaggactctgtataaagtaccggtggcatgtgtattagtggagatgcagcctgtgctctgcagacagggagtcacacagacacttttctataatttcttaagtgctttgaatgttcaagtagaaagtctaacattaaatttgattgaacaattgtatattcatggaatattttggaacggaataccaaaaaatggcaatagtggttctttctggatggaagacaaacttttcttgtttaaaataaattttattttatatatttgaggttgaccacatgaccttaaggatacatatagacagtaaactggttactacagtgaagcaaattaacatatctaccatcgtacatagttacatttttttgtgtgacaggaacagctaaaatctacgtatttaacaaaaatcctaaagacaatacatttttattaactatagccctcatgatgtacattagatctctaacttgatcatcctatatgtctgctttgtattttcttaatgtacgtctccccatttgctattggtcatttcctatttggctcatttttcaactgggttgttttcctgttattaaaagagttctttactga

SEQ ID NO: 419 - DNA, 1793 bp, Homo Sapiens
tgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgttcat

SEQ ID NO: 420 - DNA, 1767 bp, Homo Sapiens
gcttggcggggccccatgctgggctgtagggcgcacagctctcctttctaggtgccaggtcgaacactgagcttactattgtacaagatctaacccaggagggtgagaaaggaggagatgaggcaggacagcaagagggactggggtcccacacagcagctcagccactgccgacctcggggtcaggaaacagacacccacaagagcgtccacgacccgtatgggaagatgtctgaaccccgagacggcgtgttctgtgctggagaacaacttccagggctttatccaggtgttctaaagccacagcaccaaaaagaattctcttcggcaaaggcagcaggactcaacaggaagcagacgtttgcgttccgttacttgaggaaaaccaaatgctgctgacatttctacccagagagagtttgcatctctcctgcttcgcagccatctttcctacggttttaccaggagaatgcctagctcttctccaacctgtgccaggcctgacactcagctcctctgggagtgcctccatttccctgtgcgtacaagcccacggtgccgtaggatcaccggtccactctgcgcggcagcaccgcaccccggagccgcagctcttcctcccgcttgcccgacagccctggtgccaagccctgtctgagccccaccaggaggaagcgcgtgctggctgctctccatctgctctgggactctggcctgctgcttcctctgcctgccactccccaaccccgtttcctcctctgaaaactggagctacacctgccccaacagggcagaattaccttaaatggcacaagacaattgtacagcagacccacctcttctccaaagttttcagggcccaaacccagacacctccttgcaggactcatggctaccgtgggctcgcaccaccagcctccccatgcgttttcctgcctctgcttttgctcaatctgctcaatgacagaaacgcgacaacagaggccactttctccaaacccagctctccctcgaggctcccatcctgctgctcacgctgaggccactctaccctgccctccgcagctcacaggcagacctggagcccagtgactacagggttggcctcctcatcttgccaccactcacaatgcccagcagtgttaaaatccggcaggatgcacccgcttgggaagcagtccccaaagcagaatcgtcaccacatctgaatagtttctgccatcccactgacaggccagcatctaaaagagatgtgcgctgagcgtccgttatgtggtggcgtcgctgtggtttcttaaccagaacgcaaaatcctgtgaccaggattatcaccggctcgtttcatacatgagacgggggaagccaaagtaaccactcaggccacagcagaaaaacgcgtgctggaatctgaaacaaagtctgttggattccaagggttcaacgtcttttgtgatgatgaagacgaagcctgcccaagagcagtcagagctgaaagaagaaaagcaggagggcctgtgaatgcccccaaccccctaaaacctgcagctccaggtccgacactcccaggtttgcgttttgaatttacactacctatggggtccaggccatcacctaagtgagaaatttcacacgctcacccggggtgctcaaagccatctctctaaatgaggtgcctgatgtgcagacaacccttatatgatctacatctcttcacctgtctggaaatcaagaccctctcacgatttttttgtttgtttttccccgaga

SEQ ID NO: 421 - DNA, 1501 bp, Homo Sapiens
cttaccctgtgcaacctcacagggccgggccttcaacgtcagcactatggctctctcttctgtcgctttctctccttcaccacgcagtctgtgaacagcactttctacactcctcgccggcaagcaggctcgtgtcgagggtagcagattccactggcgattccactggtgctgtgagccatctgctggctttgcacctcttagaatctggtgtttttttgttttttgttttgttttgtttttaatccttttccgggtaaccagaaagggaagctcaattcccttaaccccgagaccactaaaggggcaatacaaaaagaggaaataaatacatttttaagcatacaagagcttcacaatccagtagatcattttgtattctggattcattttgctttgtattcatatgctaatctcttcctttccacgaagggattatagggttccacaatggggtatctgtgtaattttctaaaagggcacaaagggtttaaatcattgtttctttgtagttggaggcaagggagagcaggaggaatgaaaatttacactgaaggtttttttttttttaattaaactctgcaggtgaggtcaactgtggaaccaaaataggttttagaatgagaagtttcaagagcaaaggaaggggagaaagagcacttaaaagttattaagtgggtttgttttttttttttttggcacttatggaaaaattgaaattaaaagaaatattctgtagcgttttgtagtgtagatttaacttatcctgcattaccacatcacagtatatgattttcaaaagcaaatgttagagccatgatagtggttactcaggaaggaagagggttgtgatggggagggacacaggttactctgataatatttcattttgggggctaggtggtgattacatatatttgcttagtaattatttgttaaactgaatatacagataaaatgcacttttcccaatgtatgttatagattgggggatttttttaattgtaaaatattcataatataaaatttaccatcttaatattaagtgtatggttcaggtgcattaggtacattcgtattgttgtagaaccatgaccatcatctatctccagaactttttcatcattccaaactgaaacttcatacccaataaaaataaatgtcctttccctcctccttccatcccttgataaccactgttctgttttctgtctctacgaacttgactattctaggtacctcatataagtgggattgtactgtatttgtctttttgtgactagcttttttgcataatgtcttcagagtagcatacatcagaatttccctcttttttaaggctgactaatattccattatatgtatataccacattttgttcattcactcagcaacggacatatggactgtttcctcaatgtatgttacgtttttgaatttttaaaatgtggcttgaattcctacaacaggacaacattaaaggaacaagaagcttgaaagc

SEQ ID NO: 422 - DNA, 4038 bp, Homo Sapiens
ctcctgctccttctgccatgattgtaacttttctgaagcctccccagtcatgcttcttgtacagtctgcagaacggtcttgcaacttggcttcaatctgcacagaagaatcagttttaaaaggtgatgagaagcgagaaggagagaagagctgcggcccttcggggagcccagaccttgttgctctctgagccatggctgtgacaccctctttggagctctgtggttcctggtgtctccaagcttccaggctccaccatcacattccctggtgcctggaagctgcttgtggtactcctggtccatctacaacctcacagggaacgagcgcctatgcgggcacctgaagctgcctgccctgccacagcgtgcctggttatgtgcagtggcgggaccccaggctcactcactcacacagccgtcactgctccacgcctcgctcgcccttggcaggcgtggaatccagaccggtagcgtaagccaagcgcagcctgccaggccaactgtgtgcaatgagcccagtgggcctcagcaaaactcgggcaaaggtgccaccagccacagagtttctggccagaaaagtgacactccaaggatcctgtgacagtttcacacctaacaagctggaaagtgtgtgcctataactgttcaaaacaggtccttcctcacctacaaaaagaagtatttcttcttcatacattgagcaccacatcaacagggtctcactccattgcctacactggagtgcagtggcacgatcttgggttactgcaccctctgcctcctgggctcaagtgatcctcccacttcagcctcctgagtagttggaactacaggatctctattgagctgggtagaacttccttccttgggatggcagtaagaaccaaagcaagaaatgaaagcaacgtgtttccacacatctaagaactcaaaacatttccaaaagccaccataattggtttgaccttatccttgtcctggaattttcagtgatgtctttcttgtagaacagattaagcagcatagcttcatttaatgtatttatgatgatttctgaccatattaccaaaaggcgtaacagtggtaccaagggagttaacaattgcaaaggtgcattattgttctcttattacttggttgggctactaatttttttttttttttttttttttgagatggagtctcactctgtcacccaggctggagtgcagtggtgcaatctcggctcactgcaagctcagcctccagggttcatgccattctcctgcctcagcctcccaagtagctggggctacaggcacccgccaccacgcccggctaattgtttgtatttttagtagagacggggtttcaccgtgttagccaggatggtctcaatctcctgacctcgtgatctgccctccttggcctcccaaagtgctgggattacaggcatgagccaccacgcctggcctgggctactgatttttaaaaattagaatgtattaaagtaaacacacaaaatgaaatgtagccatataaaatatagactttaagttttgaccaatgtatgcacctttctagtcatcaacatgatcaatgttgtgtttactgtacattcagtaagatatttccatcacaataaaagtttttctcatatctatttgccatcagttccccaacctcttgcctcaggaaaccagcagtctgctttttgtcaccattgattcgtttatcttgtactagaaatcaatgtagatgaaatcatacagtatgtattctctttcatctgccttcttttcctcacaacattttttagattgatccaggccattgtgggtatcagtagctcattactctttattgctcagtaatattttgtcctagggttataccaaaatgtgtttatccattcacttaacaatggacatttaacatgtttccagttaaaggttattatgaataaagctgttataaacatttgtggaaaaatttttgtgccaagttatgtctttatttttagggtataaatacctaaaaggggaattgttgaattgtgtggtaactatatttttaattttgaaaaaattttccaaactgttttcagagggaattatgtcattttatattagtatgacagtttccattgccccgtgtctttacaaacacttgattttgtctatctctctatttttaaccatcctgaatgttgtgtaatagtatcttattttggttttcatttgtttatgcctgattactagtgatgttgagcacagtttcatgttgtcttttcatgttgccatttctatgtacttttgtgaaatatctattcaaatattgattttttttaaaaaaaatgggttatttgtctttatattatagaattgtagaaattttctatataatttgaaaatcagtgctttggctgatatacatattgacaatatttttcctagtctgcagtttgacttctcattttctgaatgatgtcttttggagggaagaagttcttagttttgatgaagtacattatattattatttacattatagtttgtgtattttatttcctatgtaagatatccttacctacctaattttattaatactttcccttatattttcttctagaagatgtatacttttagtttgtgactgcaggtgtagaatttattttgagttatttctgtatgatgcaaagtgaaggtcaaaatttatttacttattttccaaaaaagattatcctgcttttctagccccattattttaaaagattatctttctcctcaataatacattggcttacttattgaaacaaactgaccttacacgtgtaggtttatttctggacactactgtctgttctgttctactgaggtatatacctatcatgatgcaaatttcatgcttatactaagactgaaatggggtagtgagaattcttcaattttgttcttctttttcacaatggttttggtcattgtcggttctttgtattttctaaattattttagaatcttcttgacaatttctgtaaaaattatgtgctttgattttgatcagccttgtattgaaaccatagatcaattttgaagaattgccaccttattgaggtttctaatccatgagtatgtcatatttttctacacaattagatattgtataatttgtcccagcagttttctgggataaacatttatgtacaaatcttcatgccaagttatgtctttatttctttggggtaaatacttaagagtggaatagttggattgtgtggtgtgtatatgtttaattttgtaagacatttccaaagtgttttcagagggaattgtgccattttatattaatatgaaagtttatattgctccatgtctttacaaacacttgattttgcccatctctttagggggattacacatcttttttgatacatttttaataaatatattaagctttttggcactgctagaaatattttttatttcattttattattgtgtatttcttgtattagatataaaattgatatttatatgttgaccttgtatcctgtgcccattgctaaattcacttattccatctaatagatttttgagagtccttggatttttatgcgtatgtgatctcatatacgaccacaaaatatcttgacattttaatctcttcctttccaatatgtgaatttcttacttattttaatctttgtcacactgttcaggagctccagtggaatatttaatataactgataacaaggagtatctatgctttcgtttctaatcttgagttgtagaaggtcacactgacttaacagcatttcataacagtgcaggtcttttgtaagcactgttttaacagattcagtaagtgttctttttttttttttctctttttaaaattttctgttttattaaaaacaatatattttcattatataactttagaaaatgcagaaaactgtgggtaagaattaaacgtgtgtgtgtatacttttttaaaaagttggtcgtaatgtatatattgttttctttgattttgtttaatgtataaccgtttccc

SEQ ID NO: 423 - DNA, 12939 bp, Homo Sapiens
cccggcctcctgtggcactggctagccagatctctgggaaccatcccagcgcaggtggctctgcaggaggccaactcattacccagcaatggccttgcctgatgtgggtaacaagctcattacctggtgatgaccttgtttgtctgttcctggtgtcagcagcctcagctctccctgcaaggaatgtctagcctggggtgggtctgaccagtctgtgccacaggcaccagcatcccagtctgcactgcatggggtgtcgggtctgacagcatctacctatatgtgccctgagggcccagactcagcccccagtgggaagactccgggctcctgatggacccctcccaattgcacaacctgagcaggtggtttgaagaagttggctgggaaggagatggaggactccagctccctggggaattcttcatgaatggcgtcgaaccatgggactctggctcccgtgaagttgaacttgtcaaagatgtcgacagcaagaactggggggacagttcatttaatcagacatcactcccagggctttcttgaacccttgctgttatcaaaatgaccacaactgtcacactgacactggctggacatatttattaattaatttattttttattattaatttttttgaaacggtgtctcacagtgtcgctcaggctggagtgcagtggtgcaatctctgctcactgcaacctctgcctcctgggttcaagcagttcccctgcctcagcctcccgagtagctgagattacaggcacacaccaccatgcccggctaattttttgtatttttggtagagaatgggtttcaccatgttggccaggctgttctcaaactcttgatctcaagtgatctgcctccctcggcctcccaaagtgctggaattacaggcatgagccaccgtgcccagcctacttatttatatgtattttttaagacagggtctcactctgtcacccaggctggagtacagtggtgcaatctcagctcactgtagcctcaacctcctgggctcaagcgatcctcccaccttagcctcctgagtagctgggaatacaggagcatgccaccacacctggctaatttttttttaaatagagatggggtctcactatggcacccaggctggtctcgaactcctgggctcaagcaatctgcccacctcagcctcccacaatgcagggattacaggtgtgaaccgccatatccagttgactaaccatctttagaacagaagcgacttccaacttcctgcatcccatgtgtacctacacctgtctgcagtgagcctgaagtgaggcaggatcctcgacactcactcttctagagtctcacacctgagggtctggaaggcctgccaaacccccaagatcacggcctaacatctcccaagcccaggacctgtcccctgggagccatgggtgtgtcattgcagactgtcttcccaaaggctccatttacagatgaggaaatggaggccttgctgctgaaccttttttttttttttttttttttttttgagatggaatttccctctatcgcccaggctggagtgcagtggcaccatctcagctcactgcaagctccgcctcccatgttcacgccattctcctgcctcagcctcccgagtagctgggactacaggcgcctgccaccacgcccagctaatttttgtatttttagtagagacggggtttcaccatgttagccaggatggtctcgatcacctgacctcgtaatctgcccctcctcggcctcccaaagtgctgggattacaggcatgagccaccgcacccggctttttttttttttttttgacagagtctccccgtcacccaggctggaatgcaatagtgcaatcttggcccactgcaacctctgcctcccaggttcaagtgattctcctgcctcagcctcccaagtagctgggattacaggcatgcaccatcacacctggctactttttgcatttttagtagagacagggtttcaccatgttgcccaggctggtctccaactcctgactgcatgtgatctgcctgtctcggcctccaaaagttctgggattataggcgtgagccactgcgcccagcctctgaatcatttttctaagagcatggccaagtgggggccgggagcccacctgctccacccatggggacccagctcctgggcgcacccctgagggttgcaggcctccacccccaacgcagccagtgccttactcatgttggtggtgacgatgacaaagggctgcaggtacgtccactgcacgttgcgtgccacattgctgaagtagccctcgaggcgccggagcagctgtgccgtgccaccctcgctccgctggatctgctcccacgctgccctggtggccggggccaggagggcactgcccgagtggatgatgttctggtcagacagacagcgctcagtgctcagcctgcggaggcctggctcgtgggaccgagggacatcagccctgaaaggctttgctcgcctagagagctcattcattcattccagccctacactttagattgtgctctttaatattagtctccaattttttttttttttttttttgagacagactttcgctcttgttgcccaggctagaatgcagtggcacaatctcggctcactgcaacctccacctcctgggagcaattctcccgcctcaacctccggagtagctgggattacaggcacacatgtgccaccactcccagctaatttttgtatttttaatagagacagggtttcaccatgttggccaggctggtcttgaactcctgtcctcaggtgttccacctgcctaggcctcccaaagtgctgggattacaggcatgacccactgaaactggcctagttttcaatttttttttttaagtttaagaggaatagaaaaatgttactaagctcacaaagtatattaaaatccagagaattaaacgtgcttcatatttttagcttaatttattagatttacaagcactgtttaaatgcttggaaggtctgtttgctagccaaacaactgatataggaaaataaaaatcaaatatatgacgtatattaattccatttaaaatacttaagggaatttcatggtttaagttaataaataggatcaaacattaatcagagttgaattcaaagagacaaggaagtcattttttagtacttgattttcataaatcccgaaccctaccacataaactagagagactgtgggtgattcaatgtcagaggccgggactctgtcagagtgagccctgccagaggtttttccacgtacacctcaagacgctaaggcagggaagacatgtggagacatccctgttatatcagaattcctcctgaaccccacatttaaagcagtgacggaatcaccacaccctgggctgagcagagaagccacactgaggctgccatggacatgcggacagctcctctgcgggtgaccctctgcctctgcgcaccccagggtctatgtgaatgactgggtggaggtgtgaggctgtgcttaagagtttggggaccacacccaagacagaaaccagggcagacacggtggctcacgcctgtaatcccaccactttgggaggctgaggcgggtggatcacctgaggtcaggagttcgagaccatcctggccaacatggtaaaaccccatctctactaaaaatacaaaaaattagctgggcgtggtggtgggcgcctgtaatcccagctacttgggaggctgcggcaggggaattgcttgaacccgggaggtggaggttgcagtgagtcaagatcacaccactgcactccggcctgggcaacagagcaagaccatgtctcggaaaaaaaaaaaaaaaaaaaaagacagaaaccaggagggaaagctgtttacagagtcacacgtggagaacaaatgccactggcccaactcgcaggctgggactcaaattccagcgaggggatccttcctggtctctgggggccctgtgcagaccagaaggtctcgtgggggccctgcatggactggaggtcctgtgggggccctgcgtggatgagacaaccaggtttagtgttgggagcaggacaccagcatgggctagcccagtcccaccacctgaacagaggggctgtgatcctccaagctacccagggaatgtgacacctgggtgcacagctcgtcccaatggccagaatgtatggaaatccaagcgtggtggctcatgcctgtaatcccagcactttgggaggctgaggtgggtggatcaggagtttgagaccagcctggccaacatggtgaaaccccgtctctactaaaaaatacaataattagccagtgggggcgggggggtggcacgggcctgtaatcccagctactcaggaggctgaggcaagacaatcagtcgaacccgggaggcagaggttgcagtgagcctagattgagacggtaacactgcactccagcctgggcgacagagcaagattctgtctcaaaaaataaaaaaaattaaataaataaagaatgtatggaaaacgttagcacaaatggagaaagttagcttaacccttgagagcaggcaggcagggaaaggcaggcctgggtgccctcctggcccaagtgggctcaagaggccctgcatactctggtggggggtgctctgaggggcagcaggggtcctggtggagagtgctggcaggaggactcccagagccatgcagcctggatgtgggatcggatcctcttgcattgcctgctctactggctcagaacccaaatccctcaaagtgaggagtcccactcactgggaagcagtttttggttcagacttcccatggaccctgggaaacttcctcagttgtcctgaaagctctgcagggtgagaccactccttccctcccacccctgagaagggcctgcacacagtaggtgctcagtccacgcacgagagcaggtgacgctggggcccctggggcttagcagccggaagcccaggagttctctgcctggtgcatgcgtggctcaccctgggagcagggctggggtgtgccggctgctctcccagctgtggacgctcacgcccaccctaggtacaggctggcaggggctgccaggctggggaggctgtgcctgggttttccctggggtaatttcaagtaaagggtgttcttttcctgtgcgccagtagacgctttggtctcattcatgaggtttgattttttttaaacatgcaatcctacactttgggaggccgaggaaggtggatcacttgaggccaggagttcttgatcagcctggccaacatggtgaaaccccgtctctagtaaaaatacaaaaacacagcagggtgtggtggcacacacctgtaatcccagctactccggggctgaggcaggagaattgcttggacccaggaggcagaggctctagtgagccaagatcgcgccactgcactccttcccggatgacagagtgagaccctgtctcaaaacaaacaaatacgcaattctttttttttttttttttgagttggagtctcactgtcacccaggctggagtgcagtggcgcgatctcggttcactgcaagctccgcctcctgggttcatgccattctcctgcctcagcctccctaagagctaggactacaggcgcccaccaccacgcccagctatttttttttcttttctcttttgtatttttagtagagacgggatttcaccgtgttagccaggatggtctcgatctcctgacctcatgatgcacctgcctcaacctcccaaagtgctgggattacaggcgtgagccaccccacccagacagtttgcttgttttttgagacaaagtcttgctctgtcacccaagctggagtgcaatggcacgatcttggctcactgtaacctccccctcccaagttcaagcaattctcctgcctcagcctcccgagtagctgggattacaggtatccggccacctcaaccagctaatttttgtatttttagtagagacagggtttcaccatgctagccaggctggcctcaaactcctgacctcagtgatccacccccttcagcctcacaaagtgctgggattacagttgtgagccaccacacccagtcccagtctttttcctatatgtgatttacattggttttcacaaaaaatttatagctattttttttttaatttttaaattttttgtagagatgggatctcactatgttgcccaggctggtcttcagctcctggtctcatgcagtcctcccacctcagcctcccaaagtgctgggattataggcctgagccactgtgccactgtgcctgaccctgcattttcacttattgttactttttcagcactcctcctttaattcctagtacctgctaagacttctgttgaagctcacctgcttaattcctctttgtgattacacaattttatattttggaaagcgtcattgccagggctaggcatagtggttcacacctgtaatcccagtattttggggagccaaggcaggaagatcgcctgagctcaggagttcaagaccagctgggcaacatagggagactccatatcttaaaaaaaaaaaaaaaaaaaaaggaatggtggcacatgcatgttgtcccagctagttgtgaggctgaggtgggaggattgcttgaggcctggaggtcaaggctgcagtgagccatgattgtgctactgcactacagcctggatgacacagcaagaccccgtctcaaaaaagaaaagaaaaaaaaaagaaataggaaaagagtcattgcctggggttcattttttactttttaaagagtgcagagtagtttttaatgtatttaaaacatttctgaaaatggaacaaactggataatgttattttttatttgttattttaattaggggcatttcttctttcctccgttaagcatcaaaacttggagaccagatggcagatttgcacctttacaaccagaagctcagggagaagttgaaggaggagaacacagtgggtatgttcagattgcttttgggtaccttgacccagccacattgtctaccctagattggtgctcatggtacttcttggtggcatttcaataataggttgagttgtataccatctccctttacactacattatgaaaatgacattattaaataagaattttgatggagctgataagctagtagaattggcacatgaccccttttatacccagccctcttgtctggtgtgcttgaggtaataataaccccttttatacccaaccctgctgtccagtgtgcttcaggtaggagtgtcctggcagatccatatattgactaattgctactgtatgtagtacatccttagaccacccatattctagcatgtgcagcccaggcttgtactgatgctctgctgaggtctggcatttaagagaaagacaaacagctccttcaggccaaggatctctgtcaacaggctgaagaggtgagggtgctgagcctcagtatgtgaccaagtttggcttccacatggtgatgtgctgtggcttcatcccacaggtgagtgcctgggtgagggtgttccctgatgctctaatgctggtcacccactcattttttttttttttttgagatggagccttgctctgttgcccaggctggagtgcagtggcgcgatcttagctctcctgggttcatgccattctcctgcctcagcctcctgagtagctgggactacaggcacccgccaccacgcccagctaattttttgtatttttagtagagatggggtttcaccgtgttagccaggacggtctcgatctcctgacctcgtgatcctcccacctcagcctcccaaagtgctgggattacaggtgtgagccaccgcacctggcggtcacccactctttatatgtgacagaatgccagtcccctaggcaccagcaagattgactacctgatttctgaaagcagaatacaagctgtgatacctggaatggggagagcagaagccgagagtcactgagctgagccaggcaggctcatgggacatgctggggcaggcagatcagcattctaagcagaggaagcctcaagtgcaaaggtgatgttgcacaaggctcctgatgagtatgaaggactggagacagttgggtgacaggtagtgtgccaagtcagggattaagtcctgattatcagctcctctcctgaggcctttacaaattattatttatttagatacaattgagatataattcacataagatccaccactttaaagggtagaattaattggttttagtacattcacaatggtgtgcaatcatcactgctgtttaattccagaacatttttattaccctaaagcagaacccattagcagtcactccccatttccctgttccctggcccctggcaacctctaatgtatcttccgtcgctttgaattgacctattctggatatttcatatgagtggaatcacattacatgtgaccttttgtgtctggcttctttcactcaggatcatgcttcaaggttcttccatgttgtagcacgtattagaatgttatttttttatggctgagtaatattccactgtatggctaggccacatttttgtttatgtattcctttatatggctgaataatactggggcctcttgaaccatcaccttttaaacctgtgaagttccaaagaaggctttggacaacccaactgccctgtgcttccctcaaagaagccattattggaccatattttggtttcgttagggacacagtgcccattatataagagctagtccagtttaaagctactgcttcccgaagagagcatactttcaaatctgtctcctcgtggaagcccgtcctgattagttgggtccctgcagacaatgaccaagctctccctggcgcagatggagggtgagttccccagctggaggtcactcagggcaagattctcatgaaacccaagcagatttacggttcccagccaacaggcagtcctcacactgggctcgctagaactgcacaaggagtttaccagatttaccaagacccccgagatctcaaccacagctggctcccctggagtcacacagctgtccggagccagtgagcagtaccatcctcatagtccaggtgaggacggctgggtgtaggttgtggtcctgtttttcaggtcaaggggtgcaagtggtggggtctacaggtcttggtcctgttgctgaggtcaaggggtacaagtgatggggtctacaggacttggctggcccagcagagtggtgtttcaaagaaatgaagtgaaatcttacccagaacccctgtgtgtgaagcagatgagaagcgggctggtctgtttggagcacaggtagcccctcaatgtcccttcagactccaggatcaaggaaccacctcggatcagctgcagcctggctaggaagggtgaggggccagggaggacacctgccctgcttcctgcgtgtcgtgcctcggacagcaccaggttccggaggcttcccactccttgggagggctgaatgagtcctgggggagtgtgtgctgcagccactcgggggcagtgctgaagagtgggctcctcagatgcctggggcactaaggcccactggagccaccagctaggtcggctgcagtgattgccccatgctctgtacactgccacataccaggcaccgttctaagtgcttcatcggactcaactcacccacttgccccagcaggtaaccaggcagatgtcactgatcggttttacagatgaggaaactgatgtgcagagtgacactcctgagaccgtgaagcttgtaaatggggcagctgggttttgaccctcagtctggctttagagcacaggccctgaccatgacacggccctgcccctctgtcaaggggaggcctgaccattgggaccagctgtgcacccaggtggcaccttccctgggtagcttggaggatcacagcccctctgttcaggtggtgggactgggctagcccatgctggtctcctgctcccaacactaaacctggctgtcttccagaaagaggacagagctcagacactgagagcttgggcaggcaaatgggaaatgacgggaggctgcacggtgcacctctgtgccgggggtctgacagccaggctgtggggaggggacctttccatcctgctcttgaggtgcacacagcaccagagggtgagcccaggggccgagtcaccacagcacccatgtgcagggagagtctcgatggtgagggccgctgaccaggacggtcctcctcaaaagagttttacaaaataaccctttgcataaaataagcattgtatttttctctgttgaggtgtaattgacataaattgcacccatttaaaacgtataatttggtaccttttgacatgtttgtacctgtgaacctctgaccacagttgaggtggttacccccaaaaggttccccgtgcccttccctgccccgggcaaccattcttctatattgtcactgtagattagtttacatcttgtggaatttaatctaaacagaaacatacagtatgtactcctttttgtctgacttctttcactcagcataatcattctgatatttatccatgtctaaaatcctttgatattcatccatgatacacatccacgttgcatgtgtcaaaagtcaattccactgtattgatatcacatagcctgtttatccattcacatgtggacagacttctgggtcatttccagtttttgcttatacgaataaagctgctataaacctttgtatacaaatctttgtctggacaaatgcttccacttatcttgggtaaatacctaggaggggaatgactgtcatatggtaggttcatatttaactctttaagaaactaccaaactattttccaaagtggttgcatcatgttatattcccaccaacagcgtatgagagttccagttcctccacatccttcctaacacttgatattttctgttttaaattacagccatcctagtgggtgtgaaatattatctcactgaggttctattttgcatttccataatgactaaagatgtggagcatctattcaggtgcctgtttgctgacaaaatgtcttctttggtgaaccatctgttcaattattttgcccaatttgtgaataggtttttttcttattattgagttttgagagttattatttgtatatttaggatataagtcttttaccagatatatgatttgcaaatagtttctcctgatttgttgtttgtgtattctcttgaaagtgtccttcagaggccaggcacggtggctcacgcttgtaatcccagcactctgggaggttgaggtgggtggatcacttggggtcaagagttcaagaccagcctggccaacatggtgaaaccccatctctactaaaaatacaaaaaaattagcttggtggtgggcacctgtaatcccagctactcaggaggctgaggcaggagaatcgcttgaacccaggaggcagggaggttgcaggggccagctgtggccacaggctggggacagaggccaggtctgaggctggtcctcagtgaggagtaaaggggatggaccgggagacagggtgcaggtttgacactgattttgcttttggggatgggtcgagggaagaggctgagactctgggcttggacattgggtacggaggatgtgacactagcagacaggctggatctggaggcctaaggtgtgcagtgtggggagctgtgtgtgcaggagagatgcagagcactagggagcctgaacccctgctccagtgcacaggcctggcacacggcagggaggaggcagtcaccattccctgacccgcccgggcctgggaggcagggcagagctggtgacgggccagcgtggggccttggaatgacatctggcatgtggcggtggaggggggacatgtaactggggactgtggactcccagctggaatccacctccaccttccacatccacgcactgccttttggtctttactgagcacctgctgtgtgcaggggctgctctagcccctgggaccaccaagggccagccctccgcaaccccagccctgcattcagcccccacccacttcctccagagccccacaccccacatactgaggactctaggcgttttcccactcttgaaggcactgagctgggaacaccacctctggccaccagctgtggactgcagagaggcctacggtgaccaggaagggtggagctgcccaaggtcatacagcaagccggcactgcacaagctgatcccatggctgcccagccttggggaatgggggacttctggcatgtccccgagctggcctcatctgggccctggtagaaggcaaataaaggcaacatctcaacaaggttgtgatagctgggacaaattgaggacacagtgccggggatccaggcaagcaagggacaatccaggaaggctcccaggaggaggtgaggggcctgaagcccaccctggcctgagcccctcctcggtactctagcctgcctagccctacccgcttcctcgacgggcccctcacccagcctcagccttggcctgacatttcccgtgacatttgctacaaagaaattgagtcataaatccaaaggttaaatttgcacatcgcctcaaactgctgggggaagcagtggtccctccacccactgggcgccccgtgggtgcggggtttgtgtggcagggtctacccatcctggggcacttgctggaggcccacaggtctcctctggtcctccgaggcacttcaaccactgtttcccaaaacaggttcctgggcacaccaggccctgaggtacatcgcataggggtgcctctcagagaaggtgctgcccacccctctccaaaacagagcccaagatgccctgcgggaaaggagcaccatcagcacc

SEQ ID NO: 424 - DNA, 1208 bp, Homo Sapiens
gctactacaaagatatcaataaccatccaaaaatcacttaaaatttaatatcccttaatttccaaagacactttgtgatctgactgttcttgaaggaaagcctagaactgaaactactagaacttggctcctctctaggaatgtggagacaggtattctgcaaaggagaacttgacaaggaatgctacaaaataccagtcacctctttagaagctcctcccacctctcctgctccatttgatggaatggcaggctggattcagagaggcacgtgccaaaggagctgtttaaatccctctagacatcccttttcaatggatatctcttttgagtataaagagagctttcaatgtgtcttgctatcattttcctgaccctaatcccagattaactagaatcacctttagcatctaagtgagtgggtgctatgaccttccatcaacgcatgtggcatagatgctaaagcaccagtcttacatggtgggaaccatgttaaaaatcaatggataaagtagcagagcctctaaactaagaagaaagagacatagcttaattacagaacactgtattttcataatcactatttcattgtgagtatgaagttctcctcttttccttaaaactaaattccatcttccctgagaatagggttaagagaaatattaaaacgcaaaatgtcaagggccttttaaaagataacacaatgggatgtctatagctaactgcaacgtaaatgtgtttctactctaaaagcttttccattactcaggttttaacctcacctcccctctggactctaggaatacatgtagagatgggaaaagtcaatggggaaaatgtgcgaatgatcgatttcttcgattgtcggattgagggtggcacaatgtcttaggcggcggcgggtaagtgactcaagcgaacctgttcgttccctaggcgcccctgtctccaagaggcggccccgaaggtgatccgccccccagagcaggaaaccagcccaccagtcccagcaaactctcctccgagcctgggatgaggaaaggagtcctgcaggtctctaacgatgggtcctaggggttcagcagcaaagttgacacaaagctgtctctgccctatacccggtgctgcccatggtactgcactcgaccgggccttgacccggagtcgccgatactacagctgccatggccgccaagtggcatctcttc

SEQ ID NO: 425 - DNA, 1114 bp, Homo Sapiens
catctgcgtcagcctcccaaagtgctgggattacaggtgtgagccaccacacccagacattcatctttatttttaaaggacatttttactgaacataaaattctctgagttggcagttttttctttcagcaatcttaagatgtttatgccttctggcttcaacagttggagcaagaagattgctgtaattcttatcttggttcctctggatatttttaaggttttctttctatcagcaatttgattacgatgtgcctcataaggatttatttgtgtttatcctgcttggggtttattgagctttgtggacttgtacatttatagttgtcactacagttggaaatttttaagccattatttctttaaatacgtttctatctcaagaagtacagttatctccaaatgagcgtcatctacatgtccacaactctgatcagaccactcttagagccagtaatgattattttaatacctaccatactttgtgtatatttactcctcagtaaatatttgtagagctgcacatagggaatttctttaacacctttaaagtttatttatttaaataagaaatacatgcccatggtaaatatttcaaatagtacaaaaatatttcaaatagtacaaaaaaggaggtattctgtgaaaagtaagtctttgtttcaccaaagataccaatccctgccccctccccgtcctaaggccatcactgttagcatttccttttttctcctcccaaaattgtctgtgcatgttcaagtatatatggatatatatccttgtgctagcatactatatacactgttctgcatctttttaaagtttaataatcttggcgatcattctatatcagtacatataaagtgggctttttatgaatggcctaacattacatcatacagatgtatcataatttaattaagtggtgccctgttggtggatattcaagtcgtctggtcttttgctattgcaaataatgttgcagtaaagtaaaatgtaaaataaaagtaaatgtcttacttacttaaaaacctattttaaaagtaaatgatggactttaggaggttaagaattaaaaattaataaacatataaataaatgaggtactctagca

SEQ ID NO: 426 - DNA, 1464 bp, Homo Sapiens
tgactgtatttcaaaggcagtgactgtaaacaaacttggttgaagaaataagaaccacatgacaaaatgcttgaattaaatcttttttttttttttttttttttttgccacatttcacatttgagaacccagaattcagctcctgttatacaaaatttgtaaaaatttattgccttggcgtaaagtgacaatcatgccttggcgtaaagtgaaaatcttcacagaagggtatgctttgtgtcaccaaatgggggtgcagctgtgtgatatctgtgcagtttgtgataaaattaaaaattttctgtgaaagattcttaactggaaattggaagggaaaacaagaagaaacaatgtaatgtagcagtggaaacaaaattctcacaatgaatagcagtctttccagcttctttgacacggatttcctcatcatcaatggcggctctcctgaactagggatgagtgtgaatctccatttgaggaaggggaagaagagcttggagggtgacagcctccccctgagagagccagttgtgttcatgattttggttccttcttcctcctaattaagcatctgcccaggagcccaggagccagggcttagcttcctggctattttcaactcttcttagtgaagaccagcattgccagcccactgaccccagtagggtcacccctgcccactgagaaccagccaccccctcaccccccaccagagttccctgaaggaaccagctgcctctagtgggagacagagtaaaggcagaggggcccctcctttctcaggtgccctgtgctagtgttgggcagctctaaggttggaaactgctttccccactgagctgaaggctgcctcctgggatatgcacccggcggtccccattcagccccgggagccactcggatcaagtctggctgtatcccgagggcgaccaggacagccctgtgagcagcagttcccctcctggaacactgcttcaccagcccatcaccccagccctgtggactgctcctccctcacctggtttctacgtggacccaccattcttgccctcctggacccctaaactggcccatgtgtttagttgtagaatgggggccaggactggacatgtggtttgattgctaaggacctagcagaggctcatcatgtggtagactctgtattttatcgtgtgtgtatgtgtgtgtatatttacacacacatacacacaagatagatatatatattaagtggacactgtatgtgtatatatacacatacatatattatagatgtatgcatatatgtatatatgtatacatatatgtatatgtgcatacatatagaggtatacatatagatgcatatctgtatacatgtgtatatatatacatatatggatacatacatatttatgtgtacacatatatgtatatgtgtatatgtgtacacatatatgtatgtgtatacatacataagtatat

SEQ ID NO: 427 - DNA, 2631 bp, Homo Sapiens
gagtgtgccaggcagtggagatacagtgataaatgcttgctgaagagcgctaagggacaatgtccagaaaaagagcaggcctaacggcatctttttagcaagtttcctggcagtaaagtgaaaaaggatgaatgacagcaacttagtttacttgcagcttcctgtaaatttagtcatctgaacaagaggggactgaactgtttcaaaacagaaagcaattgtttcatggacactggccagtctacaagcagagcactctcatggggagcaccagatgagttccagccgcagttcttttataagctttaagtgcctcatgaagacgcgaggatctcttccaagtgcaacctggtcacatcagggcacattcagcagcagaagtctgtttccagtatagtccttggtatggctaaattccactgtccctttctcagcagtcaataatccatgataaattctgtacaacactgtagtcaataacagcagcaccagacagcatattaattcttttaccataaatttgtgtgtaattataatgttctatgtgtggtgttatcaaaagaatcactgtgtctctaaatatcatatatgtatgtctggataaatacattgctgtacaacatctccaacatgcaggtcatgctctaggacttggggatatagagtaatacatgtttcgtggccaataataaaagtgacaattgtcttcctaacaaaaaataaacatgagaaataggaattaatcagcagtctcaaggctcccaaatgccttagtgatattatttatccctctatttatattacggtctttttcttccctcacatgctcaatacatgagacacgctattgctgttgaattcataggaatgcataaatagactttcttccactcagactgaatatgactccctaaggattttgttggagtgtagtaatgaatgctggttgctaggtagtagaaactgacactgcagcaggcaaccaagtgcaatggtgaaattgctgcttaaaccctgcttatcaaaaagattcacagtgccgattaacttaggtagtctacagagcatcattaatttatacacaaagcagagaggctgctccaaatagcaaaaaatggtatggagtcgggtttggagggagtaaatattaaaatcataaacatcttacagaggcatttctgtgcttcatggagacagatggcatatacaggaaagacagggagctaagacagacaagaacaacatacaggacaaagcacctgattaaacactgcctgaaaatctgattaatcttttgactcaggaatttaaggctagtcaaaaaagccttctgtgaacaccagtgacatttgatgtttgcacaaaaaattaataaataaaaataaaataagggggtaaaaaaaagacacaagagctttgggtgatatttggcactctgcctctgaaaatgatgacaaaccctgggtattttttttttttaaagagtctagaaccaagcagcaatttctggctaaacaatgcaagcctggctggcagttacctttctctcatgttttgtgccttccccaagtcattaagtaagagatctggcctcggcttgcgtgtaaccagtaatgacaacctctttgcagttatctgtgtgcaaacaaccagagacattcagaactccaatacagcatttttgaagaaaagtaaatcaatcaagaaattaaactatttaaaacatatatttctttcaaataataagaaaaaaatgtcaaggagaaaagtgccctccctgccccacaattcaacatgcagaacagtcgaccaatgctttcatatcagcaggatggttcgatgcaagtacacatatcctgagctatccacagtccccgaactctgcaacattgctttcaggtgatagagacaagatggtccatgcaaatgagctgacacaagtcatgtcgtgtgcaatcaagataggatcccagacatcttcagaatggtttacagtcacaagaaataaagttccaatgaagtggttggcatttggaagcacactgttttaaatatatctccctgaaggtatgtttatatattagtgcactggtcaatatctgacactatctgtcattttattgcaaaaggatatcagggcaattaataggagggatcttagcactactttagacaatctttaaagcctgggtaagattcattagctacccaagtggcatttctgacttcaaattgtagtatcatgcaagatttatactgtattaatggagcctggagtaactctacatttaattatttccattatggggtaaacagcacttgaattaatacaatttagccgactgatgcagtttggttgtttggtttacaagatagatgggatgggagatcgagagcgcctcagaggacaaggagagttgtagggtgatgttactggagagagcctcagagcattgcctgccaagcccgctatgttgtttaagcttcgggatttttcatatccttttatgaaaaaatgcacagacatcagttgaattcaaccagaatatagacagacaaataataccatgcagggcaatcaaaagtgctactttcaagctcaaagaagaatttgtttacaaagaatttaat

SEQ ID NO: 428 - DNA, 1864 bp, Homo Sapiens
ctcttatgaagaaaccgttcttacggaagcccagatgagacaacttgagacaggattcagaaacgctgattttagtaaccttaaccctcggcccttggtgggaacttcggctctgtgggaattagtctttgggggactgatggtcatgctgaaatcttattgcgtaggaaattaagtacaacaaagaagacccgtcgtgagaggagagtgcggaagaaatgcgaagtctacgggaggtggcagctgcagaagcttggtgttggatttggcgttaggagaccgggaggagcccagcttccggtccagacggttatcttgttgacttgcacgactgcaaacgccctgagctgcttttgcagtctgaaacatcagcgatcccatcaaaatattctgtttcttgggatataagaaacatcccaaggcgggctgtagagcgagagatttggactcgatttaaatacagacaaaatagtatgcatttactaacaccacatctcacccccacgaaacttggtaagggcagcaacagaactttatctgccatatgcactcctgtattcctattaccaaatagtgccagggactaagtgaatatttgtccaatgaatgagttttaagtaggaaacgtttgcatagaatcattttgtttcttttggagttcaaatcttcggatattttacccttcccaatccaaagaaaagtctctgagtgaagagatgggaacaaaatgtaagttaaatatgttgctttaacaactgtttattgaactcgtgctatagactatagaatgatgagcaaaaccaggcacagtttcggccctggaagaggaaaggcaggcatatatttatcaagtaagtacattaatggcggcacttatcagttgagagaagtgcgctaaggaaaggaatatgattctatgatagcgtataataaaagatccttgaccggggaggggaaacgtaccagtgattaactgatctgaagaatcagtataaattgactttgtagaaagtataggtggatggctgagtgggaccatcattcaggaagcaaatgcctgcagaaaaaaacatcaattttaacaagaaacggtgtatcagagatgaaactgaacctattccttgtcttttcttcttgcttcagacataactttaaaaaattgcttacgctgtctttagccacatctcttccccaaactccacactgttcggcgttttagccgtctcaaatttccttttcttaaagacccatgacaatcttcagtgttgtgtctttttctacgtcgtgatccttttttaaagctgagctcttcttgtttttcgtctcctttctctttttttttttttttttttgtgatggagtctcgctctgtcgcccaggctggagtgcagttgcacaatttcggctcactgcaaactccacctcccacgttcaagcaattctctgcctcagcctcccaagcagctgggattacaggcgtctgccagcaggcccggctaatttttgtatgtttagtagagacggtgtttcaccattttggccaggctggtcctgaactcctgacctcgtgatccacccgcctcggcctcccaaagtgctgggattacaggtgtgagccaccacatccggcccttcctttctcttaagatgaaaatattggttcttttttcctacacacaaggaggcaatgaaaatattggttcttttcattgccttattattaatgttactattaataaatattaatattaacataatggttatttgcttcatctacctatattcacaggtatataaacacaacaatagcaataacaggataaagaataaaaacagaataacaatagagatattgctaacagat

SEQ ID NO: 429 - DNA, 5339 bp, Homo Sapiens
tcaacttgcctctgcttcctcctgggaacctttcctggccctttagctaagataagaaaatggaatcacagcaaatataagcaacatacccaggagcacgcagctggcaaacagctgagctagcacttggactcaggcaaactggctcccgagcctgcacgtgtaaccactgtgtgacactgcctctcagagcagcttcgtgttgccttcggaacaggtcttcggaagagtgtctggaaaatgccttgacacattctaattatttgttcctttatcatgggaatgtttttgaaatcttggaaccagaaaactgccaagctatcttcttaattcttgtttcgtgacacttaacttcgaatacagaatttattatggctggttaacttagaactctcttgattctaaaaacagcttcctgacttattcttcagtctgccagagctgttctttgcagcagtattttaaccccttcacatctttctttatgtcaccatgacattaacttataccacaaccacatctctggaaggggtagccattcatatgcaaaagcatatcacagatgacaccttagaagcccttcttgactggattcacaaaacactgacaaaaaccctcttttctacatccaatggggcattcaggcccaccaaagttttttttttttttttcaaattcctcagaggtaatattctcacagtcactctgactttgactttcagttcccattgaagtgttgatctcccttgccatctgcttccctatgctccatagtgacccatacctggcttccttctcctcctagacttccctgtggattgcacacacacaaggcatttttaggtataacagactttattgaatgtttggggcaacagggatcagttagcagttccatcaccacaacacaacctcaaactgaatttagaattttctgtttctaaatgtcctccagtcatcccatcacagaattctcttaggtcacccttgtagcaagctccagtctcttgcagcttcatcctgctccagttctagctatactttaaatacagtttttctcgcattttatgcacagttgtctagctggcaactccttatttgacttcatgcctgcctttgtctaaaaatttgttaatatcttgctaaacaaaatgaccattgattctttaccagtatagcagaactggcagtgacttttttctcaatgacaggaattttaactttcccctctgatataagaagtggccatagtcattttgagttttaaacacatttattatttaggctaaactagtaacaaaaatgtattagtgttgcttttaaaaatatgataagaaacacagtgtactatggagtgtatataacttcctcatcttctggtaaatgaacattaatatgaaagtaaaccagtaccactggttacattaactgcaggaggtagtggtgggtctgcggccagctttacctttggggagaaattcttgaataaggcagtggttgctaatcaaatctcatttctgcttgttaatggtgcccagtagagaacattacccatacctcagtacagggctcaggtagaaacaaggggagagaatggatccagaccaagtgaggctgtgacagttgactactataagggtgcattagtctgttctcacactgctacaagagatacctgaggctgggtaatttataaagaaaaagagatttagtggactgacagtttcacgtggctgggaggcctcacaatcatggtggaaggcaaaggaggagcaaaggcatatcttacatggcagcaggcaagagaacgtgtgtaggggaactgccctttatgaaaccatcagatattgtgagacttattcactatcatgagaacagcatgggaaaaacccacccccttgattcaattacctcccaccaggtccttcccatgacatgtggggattataggagctacaattcaagatgagatttgggtggggacacagccaaaccatatcaaagggcatctgaacaatccacagacctatcccaagaatgggtgtggtgaaggcagttcatggtaacagaggctgacaatctggcacatggtaccagaggctgacaatctggcacattgggggttccaggtggagcacagagtgcaaagtcaggcatagctaatccacagcagaggcacctgcttcttcacagcagcatggcaaccactgaccggaggatggcagcaagaccctgagagaggggcttagatgggtctttggctagggttctagtcctacaaggagtcaaagttattggtcagcatgtccacaaagattatggaaaaaaatgtttcaacacagtaactggaaaagttgccattggaaggcctgagggacctctactgcttgtcccttgcagggtctgattgacagcacaatttaattcctaagtctgtgtatgggaggcagtttgtgtcttctgatctaattcttgccattttcatgattagctcaggagccttggcagtcctgggcatatgaggaccttggaaggcaaagtcagggaaatgtgtcagggccagtgatcatagaacatcattcagcacacactgggatacagaagaccctggctttcctcctggggcataggcagctagaaggagcattgtttctattcttataatgcaaaaattaaaaagtgtatcaaactataagttatgaattgtctggaactcatagaggaccttggttgtaggacaaccaactgactcagaatctaagaagagaatggggcctccagaaagagacaagacacacatgctggcttggtagggggtagacgctgttgggtaaattgatggaggctgagagtgaactgataggaaactgaagaacctgaggagagacagaattgtgggagtgcgtgtactctctagggctttcctccatgaaccccaatgggtacttacagaagatattggagaaagacttttaaatgtgtcctttctggataaaataaaacaggaaagggaggtactttagttgaaaggctggaccttatggatgaggaagcaaggcatgtggacttttgagggatgagcattccaggcagaaggagcagcaagtacacaggccctgagttgggagtggcctggctggtgagaggagtagaaaggagaccagtgtggctggagctggatgatcagggagaagaggaatagagatgaagctagagcgggatcaggggctgggttgtatagggtctttgggatgactgaatgacagactttggcttttggtttgagtaagatgctgaaaccattggagggttttgaataagaggtgatttaacatgacctttgatttaaaatgatcttgaaaatatttggcaatttccaatgaggtttaacgtacattaaccctttgactctgcaatcacattgctgggtatttatcctagagaaataagaatgtatgtttgcacaaaatcttatgtattcatgttcataaaagctttatttgtaatagtcccaaatcagaaataaccccaaatgtctttcagtgctcaatgggtaaatggaaaaacaaactttggtatatcagtatgatggaaaactactcaagaataaaaacagccttgtgcagtggctcacacctgtattcccagcactttgggaggccaaggcaggaggattgcttgagcataggagttctagattagcttgggcaacatggtgagaccccatctctagcaggaaaaaaaattagtcgggtgtggtggtgtatacctgtagttccagctacttaggaggctgaggtgggaggatctcttgagcctgggaggctgtgtgaaacatgatcgcaccactgtactcagcctgggcaacagagcagactctttctcaaaaaataataaaaataaagagatatcaaatacatttaacagcttgcatggatctcaaggacattatgctaactgaaaaaaaaagccaattccaaaaggttttatactgtatggttccacttatataacatgttcaaaatggaaaaatcatagtgatggagaacagatcagtggttgttggggtttagggttggggaagggtatacctgtaaatgagtggcataggatgtttctttgtggtgatggaacagttctgcatccattttgttttttgtttttgtctttgttttgttttgtttatgaggcagcgtcttgctctatcacctaggctggactgcattggtgctatttggctcactgtagccttgacctcctaggctccagcaatcctcccgactcagcctcccaagtagctcagaccacaggtgtgcaccaccatacctggcttatttaaaataaaatgaaatttttgtagagatggggtctcatgttgcctaggcttgcctcaaagttgtaggctcaagcagtcctcctgccttggcctcccaaaatgcagggattgcacgtgtgagctaccacatccattccagttttgtatcctgattgtaataatgattgcacaaatccatatgtgtgataacatttcatagcaaaaatgtgtatatatgtgtatatatatatataagtgagtaaatgaaaagagtggtagactcctgaaaaggtctctcatttagataaagtattgtaccaatgccagctgtgtgatgtactatggttatgtaacttgctctcattggtgagacctgggagaaggatacacagaatttctctgtattgtttttgccatttcttgtgagtctaaaattatttctaaataaaacattttttaaaaaaggttctctctggaagttatgttgaatcaacactgaagggacaaaggggaagcagggagaccaattaggaggctgctgtagtcatccaggtaagagatgatggtggctgggaccaaggtggaattggtgatggaattcctacctgtcccttccaggctgtgcaatgggacaactttaagagccagagtctccagctgtcactaccctgtcaccatccctactatcatctctggaccccatatttcacctgtgctcaccctgacaccacttctgcccttgtgtctcctcacagcaagtgtgggtgctacttcccctgagatgccatgagtttctttttccttattgccaggattgccctgagccatcacaggcccttgatttttactatctaagctgtatttcctctgcccatccattaggaagaagattgctgtctggtttgaactggaatttctcgctatgtcccactggaggtatgtcatagtctgctcttctcactcctctgtctcaggaaacatggtggaattttcttaagaggcttcgaattccttttcctcctta

SEQ ID NO: 430 - DNA, 4970 bp, Homo Sapiens
gaggaagagctgtttttctgttccaagtccagcacttccacccttgcctgtctacttcactggactttcttccaacaactcctcctctttacccctccccagcttctgtctccctgtccactagctcctcttcctcaacctacaaacatgctcaaattcctttcagtcaaaaaataaacttctcttctatactaccttgaacctagttactgccatctagtctgtcaaacttccatgtgctctcatactaccctgttttagtactgattctgtcacattgtaattgtttatttccttgttttccttctatatcagactgtaagcttctgagaaatctgtctcttgatcctggttgattcaccgaagcccaagctagttcctagtgcatcgtacgcattcagtaaatattttttgaatgaatgaacaatgttagagccatgcctctgccattcactttgtgaactacctgtaatttttttctacccctacatttcggttgaaagttcacttgaaggtcaccacataaatgtgaaatctagtggcttctctctttacatcatgcttgacctctgcaaccattagtgcttacaaatttaccttttccacacattcatggtcacgtatacctgggtcattttgggccagtctcagtattgcattcaaaagaagcagacaagccccgaacctttggaaagtaatgaacttctgtaatatattagtgaaatcttctaatgagatagaaatatacaattacataaagctcagcaaacttcaaataagttctttttacccaccttcccatatccttacacagcttggcaccttcaatctctcttttgtaacagttcacccaaaacttgtacacttttggccaaaaaccccttgtcctttgtccccttttttcatcttctatgtttattttcttccaagaatagattattctttccagtttaaatcactttagcctcttttggctccttccaaccaagttctttcctaaaccagttatcttactcagtattttagaagtccaggagcattgtcttgatttcatttggtttgcccttaccaactttctttgcatcattttatttaatcttaatgcctcacatcagtgagtattccctgacctcctgggtgtctcccttctgtgtctctgtggtgccccgtttataactctctggaaataatctatttctatctcttctctaggctatacatttcttaagggtaggagtcctgtcttttttttgtacccccatatctagcatagtacctggaacatggtgggtgttgataaatgtttattggactgatgcttctgtgaaatttaatactttctcttttgccactggcttttgttttgttactaggtcttcaaatatggattaaggtttccttaatgtctttttttctttttatatactcttagtgattcctctattcccgaggtatcacttatcacttccataaagatgactccaggtccgttttctagtctggctgttctccttattataagaccatttgttttcaaagttgaatgtcagacatctccacatgaatgtgtcaccagtatcttaaatgcaacaaaaaactcagtaatccaaacttatcttccttttaaaatttcttcctatgtgctccatgtctcagttgttctaacccctacccttccggttacctatgctagttggaatcctggcaaatgccttaacttctttcttttatactctccctaatctgtgatcaatgcctatccatcctgcctctgaatgtttttcacgtttgcttccccttcccatctccacttttagtagttttgttatcacttaccttcactattgcagtagtctcttaactgacctcttttctaatctgtcttccgtgctgttgttagaaatatcttcctaaaacacagatctgttgttactgtatgttcatcgcttgactaatttacttatctttcaggtctctgccaaatgtcacttctaaataaagtatgtctgtcttctttgttgtttgtttcatgttcctttcctactgtcatctaatactgtttgtaattgtgtttatatttgtgcattgatttgtttaatgtctttcttcccactggagagatttatgtaagggactggggagagttatgtagaccctgggcctagcacaatgctcgggacatagtaacacttaaaacatatctgttgaatgagtggatggataatagcaaagtacaggcagtgcaggcaaacagataccaagtagcaaaggcagggaaattacagggtcctagactcttagtacattctcacagaccttaatctgtagtttaaaatagtaatgggcttctctcttttgctttttgcatttatttccctaaggatgagagtgaacaacttactaccccacactgacacttcagtgagggcactgtggaacctttctaatcagaagatgggaccaggcttgacaatgattcaatcaaagcagttttagtgtcacacttgtctcatggaggctatttgtatttctgaagaaattccaatcaaataacagcttactagatttttttcctggtctaaatattatttttgggcattttccacaaaaagctttttgggaaaggtggttcttacactggggcttggaataattgtatctctatgcttggccttggaataattctgtctctgttggaattgtgcacacgttgaggcctgaggccttatcttttatagggccttcactatgtagcttctcatatattcagcatcttaggagagaatcatattcaacatagttttgctttaagctttttacttggtatcagcagttttgccttaagttctaaagcttaataatgaaactctgttgaatgagaacctttccaaaagatatacttttctacataagctgagtttattcatccagagtcatcaagaatagattatatttagaacatatggaatgaataaatattagtgaattcatctttattggacttttaaatttctttacatataattccattcactcatttattcagccatctacacttgagcaactactttatgccaaggactgtagtaaacatttaggatctgaagaaaaatatgacttgattactcttaagaattttataagtctaggctttttttcatgtctgaggccagattgatttttcttttcctttttttcactcaggatgaagtacatagtggtataatcctagttgactgcagcctcgaactcctgggctcaggtgattctccttcctcagcttcctgagtagctgggatacaagcctgtaccaccacaccttgctaatttttattatttattttctgtagagatgaggtctctctatgttgctcaggctggtgtcgaatcctggcctcaagcaatcctcctgacttggcttcacaaagcgatgggattacaggcatgcaccaccacacctggccttagagtgatttttcttaagtgcaaattcgtgctcttttttctaaggcctcagcttggaatgtcctcttgtattacccacctctcttctttcaggactcatctcttaggaaccttccctgtccaaggcagctgagtacccttcagtatactcatcctaccctctccctctcctgttgtggcagttagtaccatgttttgtaactacctgtttatttgggtctccccaactagactgaaaaaggcgcttgaaggcagggctgtttccgtccttgtgtcctgagtgctgagcacaatactgagtacagtttgtgacctatagaatttgtggagggaaggcattttggatggaggctgttggttaagtgacctgcaaaactgctccagtatcatgccaggatcagtcttctttgctcattattgatgagaagcaacactaacttatgtctttattcctaacttaattatactccaagtacacatttgcatgcttcattacatgcctgtagtgatatcagtgacactgataaagtattttttcatattttagttctcatgtttttgactctttattttaactttgttgttgattgaattgagtatttgagttgctgttagtataaataaagtttccatcttggatgacttaccatgttaacaaaaaaaaaatcacaagcagtattatgtgctagtgataccttgtgatttaaaatgtattttgttccagcaaagaaccagtttgggtctctttggagaatgggcatacatctgagttgacctcaacttttctgtaggagagattattgaatctcctataaaggattatatgtaaatatataaattaacatttgtctgttttacaaaatagagtgtctgaaacaagaatacataaaatgttattttcaatgtactagagtagaggagtttggtatttaaaggagttctgtactttggtaaagccaaaattcctttgattacactagtggttggttatttaatcaggatgtgaattcaaattgcctacaaaattttgaaaaaatgcagatgtttggctgactccacatctatcagattgcaatttctagtggtagtgtccaagctcctatatattttgtaccaactacctgggtaatttgatgggttttcagaactactcaactatataaaccaaagaacctcaaaccttaacatatatatgatcatgtgggaccttgttaaaatgcagattctgagtcaggagctctgggtgtgacctgagattttccagttccagcgagctccatgtgatgtccgtgctgatggtgtgtgatccacactttgaacaataaggctataaataataaccatctacattttaaaagatttcctttttttttttcatttaagtgtggtgtatctgtttcctactcttgcttattctataagagaagtgtaatgggctttagatccagtctaaaatagttttggtttggatattgtcttccattaaagtttcagtacgcagagga

SEQ ID NO: 431 - DNA, 1811 bp, Homo Sapiens
tgggccatgggtaacaattaaatcagaacatagaaaacaattaaaggccaattgtaagatgtcaaagaactttgaatttcagattttcaataggttgaatatagttatcaaggatgcatcgttttaacattccttcatgtctaccattacgtcaataagaaaatcagttgtgtaaaaaatctacttaatgatacaaggagtttctatctggaaaaacaattctaaaaattttcaggaaattagaaataaaatgcctgaaataactgaaataataataattttggactacagctctttaaaataaaactgtagctaataaattattatctactcactcaaaataagtttcaagaaaggataaaatatacctgaaaattagagttgaaaatatttatttcttgtaaacctgtgattgccagtaataagtttttgttttcccaaaaaaagaaaaaaacaaaccttttgtgaattattagaaatttaccaaaggttaaaggagaagaaagagctctaatgatgagctcaatttgacttctatgaaaatatccaaagttctataatcaatcatagcatatctatttatttactaatgctgtgtagcaaattaccacaaaacacagtggcttaaagtaaccacagtcattttttatctctcttggattctgtgggccatcaattcaagagcagcttgattttatgattctggctctgagtttctcacggagctgagtcagatttcaactggagctgccatcatccgaaggcttgatgggggctggagaatccaattccaagatggctcactcatatgcctggcaggccagttttggcaagtcttcttctccccatgtggacttcaccatagggttatttgagtgtcctcacaacctgatgctagcctcccccagggcaagtgaccccagagagcaaggtgaaacctgaaatacctcctatgtcccagccccagagttcacacattgtcacttctgccacatactatgaggcgcaaaaaaccagcaccaattcagtgtgggtggggatacaaaatggcataagaaatgagaatcattaagggccatcttgtagctagttattacagaacactatggactaagatatcatgggtgggatcatcattatctaagcatataagataacacacaataatatatcttttagtgcaatgaattaacagcagccaatctagtactttatattttctatggctgttttactaaaatcagtgttgctattttttcattaataaataggtaaacaaaataatgataaaagtatttttgccaatcataaaagtatttctacaaaaaatcaaaattcattttaataaaatgtggcatggcctgtgatagaacgggcaaaagaccaggctatgcaaatacaaaggagtcttagcaaacttcctgaaataaatgccaatcactgtatgcatatgatcaccatgcacatgtgtatgtgtatacataaatatatgtacctacacctataatatatctgtatatttttatgcatatagtttgaggtttttgaggatttgaattatttacaaaatgatatcactattgttgtattacttaggattagtttatgttatacataacaaaaaaatagactgggcgccgtggcttacgcctgtaatcccaggactttaggaagccaaggtgggtggatcacctgagatcaggagttcaagatcagcctggccaacatggcaaaacctcatctctactaaaaatacaaaaaaattacctgggcgtggtggcaggcacctgtaatcccagctgctcagaagg

SEQ ID NO: 432 - DNA, 3759 bp, Homo Sapiens
gctcagcagggagaagggctcttgactctgtggcagtgtggccacgtttccatgtgtccatgtgtccatgtgggctgctgtaggccctggctcactggtcccaggacctgtggctaaaaggaggcattgctggaggcctctcttgagaggtgggtacgtgggccatgctgcctatgccctcctcaggtccccagaaggagcacttccaaggggtgctgagtcgggggaggtgggcaggaaaagatgccagggaaagttctgagcccaggtaggagtgacagtgatgtgtggtggagatcctacagccaaacgaggagcagttaacaatgccacttcaaaaacagcgcctgaggctcagaaagaaggtgtatcttgccaaccatcacacagcaagtcaccagcagagctgagaccagaacccaagctcctggtccagggctcagtcattgattgttccagccacacgtggctggtgccaggggcccgtccggtctactccctgcggtgactctttctcctgcctcccaactccagaaaaggatcctgctggggagcctggggtgagatcccaagagcctttccgtgtggacgtggacatagtggggtaggtcgagagaccaaagcaggattctaacaggcctggacatatgtcatgggccatcaagaccatctgcatgaaggtcttttgctacagaagtgaggtggctttttgcagctgctcaggagaacaatctggcgtagaagtgggaagggaccagagaatggggcgttggaagacctaggttggagcctcacctctgccctatcttcgctgtgtgaccttgagcaggtcactctaactcttgccgcctcagcttcctaacagcgcccctgcccggcctctcttgcaggcccacagaatgaaaagagaggagttccaggaaagggtttggcagatggcatccctgcaggactgcctcgcggcgctctgccccatccagcccctacgtactggccatgtgacctcaatgtttgatggactcacttggcctctctgaggctcgctttctccatctctaaaatggaggatgaagcaggttcagccccacgggcaggcagcactatgccagggacatggcgagccctctggaaaagttcacctgatccagacgttgctgggtcaacgggaaggaatgactttcactcctctgcttcaaaccaccagactgtccttggccctccctaatgaaggagcagagaacagcagagtgggcagggaccttggaggtcagcagggtggctgctcagcccagaggcaaccgggagctcgtcccagggtgtgacaattcagtcagccctttactgaacactcggctttaaaccgcctcatgcctggcatgaggaaggcaccgtgctggagggtttcaccacggttctctgtgtgtctccggggagctcactgtcctgtctgaggcccgtccggggtccggacagtggagctttcaggttcgtgcgcaccctctgcctgcctcttctccctgtcagtaaggacgtgggtgtggctgggaggcagatcctgggtggagaacggagctcctggttctgaacagtttgagggtctggaagtcctttaagaagatggtgaaaactatggaccttctccccaaagagaagcacacatccacatccagaggcaaaaaccccatcgctcagaaccccgtggatgaggcagtcattatccagtggtgctgtcactatggctggggctggccttgatctctgttgctggattccacatgttcattctctctggccacattatcagatctctagctccaacatcctgtgtgataccaggatggccattgccatgatcttgtccacgggtccactttcagcagctgggccctggagggcagcacacagctcatgattgggttggagatgggggagtcaggggcagatggtgggagctgtccccagccctgcctctcttaggaccctcctgggactcaggtacatagggtccctgagaaagacccagtttgatgagacaggcaggaggaataaggaagagtgtagtttaagaaagttttctccagctctggttcatgcatccgtcctgaaagaaggcagggaaaggattattcacccatttcacagatgaagaaattgaggcttggagaggtcacggagcacacagagcaaagaagtcaaaaccaggatttgaatctactctgattacctccagagcccatgtcttgtcccaatggatggaaaattcttaactatttaactcaatattgagcagctactgtctacagaattctgtgccagacagcttgggagacacagacctacagggagatatagttcccactggaagcacccagggcagtaataattatcatcataacaaaggaataataatagctaacattttggagcacttactagggaccagcattatgctacacagttttcatggattatctcatttaagctctcaaatattttggggtgtaaataacagtatgcccacaatttttgtttgttgttggtgttcagaagtgtatatccgtttttgagaatggaggctcagcgagattaggagccttgctctcaacgagggaggaattctggctgcgactctgtcccttactacctgggcatcacctctgtcaaacctggacaggtgccacttagacctggctgaggttggctgaggcggggaggatggggaggttgtgggtaggcagcacctattcatacccacagtccagggactgttccagaagaatagtattccctgtgcccttgccgcctctgagccttggtgtcccagcctttcgatcctctcacttctgatgtccttgagccataatctgagccattctctaggataaggagatgcttgaggttgagtgaaaggttgacatttctgcaggagcaaagaatgacttgatgcaggagagaaaggctgtggggggaaagtgagtgaggcaaatccccaaggcagagcagagccttccaaagggtgcaggggagagtcttggtggagggggccagccttgctcagcagccccaacctcaacaaggacccctacccaagaaggcctgcaaaatagcaaatcaatgaagacagcaatgaaagcaatgaggagggaagagggaccagaatcccagtcacatcatcacccctcacccctttttctggcctcagttttccttctgtgaacagagggagctggcccttctgtcatttgcaggattttcatctcaggctggcagcaggagctggaaaagtgagggaggtccctcccttccccggcccggggtctgtgattggcagcacctcctcctctcttcctctcctgtcccttccttccccttccctcccctgctttcctttcccttcccctcctccccttcccttccccagtcttcccctcccactctttcaagcccccagcgtgctgtgcagttattagtttaggttcatttagaatcggcttagcaaccccacacccctggaacctggaagcttaaagcacaagatgtctggcaaatggaaattcaattgctttaatatagagactattttgctgcagtcgaactggagcctcttattaagaatctgatggaatttctaaacagggagagaggccccaaggagggggcatcgcccatcacacaccaacattgctcttgacatatttatggctccaataaaatctcacatctggtatattttaaaataaaattgaaaatttatcactt

SEQ ID NO: 433 - DNA, 1784 bp, Homo Sapiens
gggacagtattctgcctactgtaaataccataatcattcgtgaaaatgaaccaagatggcagcaagagaaactccacagagaagaagcctattactggtttattaatgaacatggtgttggttgccagaggaaaaccataagcttccaagcactactggagaaataacatcagttgcttccaatcaatcactgttcgatggatccaggcacatgccccacctcagcctgacctgagaatagggtaattgggacatatgtcagaggctcaggagtccctaaaaaaatttcaaatagagaatctttttaaaatgtctgaacaccttttattgcacataaaatgcaccttaaagtggacaagatgggaaccaaacattgaaatctgtgagttgaataaatccagtgaagagtgttggcttcagccagaaatcaatataaatcatgaaaataagtggattttaaattcctggtataggaaagattagaaatgaaatttggaatcaataggcaagttctagacctattgctctgcatgctaatttacttagtggttatgcaagccaatcagatagtagtgaattcaggcaaaagaaggaaaaccatttggagaagcacatatttggggaaaatagtgctagaatcattattacaatgagaaacacagttcagagactagagccaacaaggttacattataccttaaataatcaaagttgttggccaattcagaaacaactatactgcttattctgaggaatataattcacagagggaaaaaagatctttacacagactttagaaggtctatcaggagaacagctatagctctttcttcttaagagacagagaacacagaaaagtttcattccttaattcaagacttgagtcaagtaaagcagtggaagaagaaaaagaatacagcaggtccaaactgctaccaacaccatccaactatcacactagactgtcaagttgaggggatagagattgggacagtgttacaaatggatctgagcccagagcaaaactgtcagaaaatgcaaataccaatgaaagcagcagcgggggcttttgtcaaaccacttcttgttcagagcagacaagtaccaggacttctgtcataataatctatctttcttcgtcggacttcagagagccaggctaacaagcccttcatcggtggcttttatatcaattttaaaccaatcatgactgagtttggagagctgaagtctcttcagggagactacatctcagtcagagactcaaaggaacatcagcactgaccagcagtgtgatcagaactgagggaagcagggtcagttactgagggcagcaaacgcaaggcagattcaagagagcacatccagaaggcagcactgaaatgcaaggtgaaaatgagcttgcctcaactcattctaaaacctatgaaaacagagtcgacaaagagagaaggaatttagtgggaactgaaactttccctattcttagcattatccacttggttttactagatgacaataatgatgatcatattgatgattacacacaggttgaattacagagcagactgaccatctttcccccaggaactaggaagcatcagtattcagagcgaatcaagtaaaatctgcagtgtttgtttcagtagctgactggcaggaactaagctcaggcaattcctcacatgcacgcgttttacagccatcgtattgctcagtagctgcgagacacctacagtcatcctgtatgttggcagcctgtttgagaatccaggatggctaac

SEQ ID NO: 434 - DNA, 1877 bp, Homo Sapiens
tcgggaggctgaggcaggagaatcgcttgaacatgggaggcggaggatgtggtgagccgagatcatgccattgcactccagcctgggcaacaagagtaaatctccatctcaccaaaaaaaaaaaaaaaaaccttgtaatatatgtatggatacatggaatcactgtcaggaaaaaaaaacaagtgaaatggcattatattatgcatagaaaaccagaaatccgcagatcttcgcatagagtaagttgatttctgacacccttttccccccacctcaccattataagagtctctgggagttctccttccctgcagacctctgcctccctgatagacaaataataagcatcaattaataaatatatctcagttatctggcttccctattccctatttatctatagctacacattcaagcatatattgttctactgcagtgggcatactagtcaaagaaagatccatactttactccttccaaaatgaacaccatggacactgttgattgagtccttaaacactttcactatttccacccctatttattctctgtcagtttctaatatcaggtctccattgccaaaagaaaatagggtccagtatgacatcagataatttatgccaaaaccaatataaatttaagttcttgataaacctttgctttcatttagcattagaaacttcaatctggaaagataaggtgaacattacttacttgtcccaagctaccaaagccagcctctctataaggaatagattccgctgaggaggaccgactgtataaggtgaaacaaaaagaaaaaaaaggcaaaaaacctagttttactttttattgttgttgtttttttgttttggtttttttcagacagagtctcactctgttgcccaggctagagcacaatggcacaagcttagctcactgcagcctccgcatcctgggttcaagtgattctcatgcctcagcctcccaagtagctaggactacaggcgtgcaccaccatgcccagctaagttttgtatttttagtagagacagggtttcaccatgttggccacactggtctcgaactcctgacctcaaatgatccactcgcctcagcctcccaaagtgctgggattacaggcataagctactgtacccagcctcagaaaacctagctttatatgttgttagcacacagaacactcgttttttttgggggaaggggcacatgtcactaatagaaagtctccgaagctggattgatgggaggaaaacacctttcccttctagttttgagagacttcctcttggctcccaagaggagggattccctgactttgacacacatggccaccttggcacaaaagccttgtggtatgaaaaaacaaattcgtttttatgtcctcttctccttttccatctttcagcataaacttaactcccttaagccgagacatctgttaggacctgacccccagtcattgattaccagtttgtctggcaatctggactttccagtgatgccactgagatggcacctgtcaaaagagcagtggttccatttctagattgtggatcttcagataaattctgccattttcatttcattccctgaaagtcagggttggcttgtgaaaagttgttaaacaatatgctaaatgtgaaatgtcaaccctcactctcaactttccctgttcggagcatgagatgaagacttcattgggttttatagtggctttctgatttttggtaatccattgaagaagggagtttgagagttgttgtatactgttaatgattgtctgcccatgtcctgcctgaatggacagtatctttaataaagctggatacagtttggcttagggaaaaaaaaaaaccctagctttaaacttctac

SEQ ID NO: 435 - DNA, 1077 bp, Homo Sapiens
atgccattacaggagttggtgtcctttgaggatgtggctgtgggcttcacctgggaagagtggcaggacttggatgatgctcaaaggactctgtacagggacatgatgctggagacctacagcagcttggtgtccttgggtgatgcagggagatggagaagaggaaaacccagcagatgttgactttttaaaggaaagagatctgaggagtttaatgtatttcagaacatacttctttctggtgatcctgatgagatggaagcttgacctgtaatgagtcagctactattgctcaagagctaactcaggtagggaggaaaacttttgaacgtcatgtatgtgggaaaatattcagtaagaagcataaagtcactgaacataagaaaatacactcaggaaagaaaccttataaatatagtgaatatgagaaagccttcattagccaatcatgtgttacaaaacatcagagaacacatacagaagagaaaccctatccatgtgccatatgtgagaaatccttctgtcagaaatcaaatctaagcccctcccagtatgtcaaagaactcacacaggtgaacaaccgtatgaatgtaaagaatgtaggaaaactttctatgagaaggcaaatctcaatgtacatcaaagaactcacataggggaaaaaaccctatgaacataatgaatgtggaaaaaagtttcatcacaagtcatacctcagggtgcatcagggttttcatataggcaagaaaccctatgaatgtaacgaatgtgggaaaacctatgagaaaggaatcctcactagccatcagagaaatcacacgggggaaaaaccctatgaatgtaatcaatgtggaaaaccctttggctggaagtcaagccttaggtcgcatcagagtattcacagagggcagaaaacctatggatgtaatgtatgtagtaaaagcttccaccagaagtcagacctcactaaacatgaaagaattcacactggggaaaatccctatgaatgtaatgagtgtggaaaatcctttggctggaagtcaaggctcagccaacatcagagatctcacatagggt

SEQ ID NO: 436 - DNA, 2177 bp, Homo Sapiens
ccccactatccctcctcctcagatacagcaactctgtagggccagggatgtgcttgtgaatgggactggcttcccgggaaaggcaaacagagcaggcagtggtgactgtgggcaaattaacctgtttggcctttccttcttcttcttgaaaagagagagagagaaatgatagaccaggtgtggtggctcatacctgtaatcccagtgcttcgggaggccaaggtgggaggatcacttgaggccaggagtttgagaccagccatagcaagactccatctgtacaaaaaaacttggtaacttgctagaaatgcagactcttgggccccactccagacctgctgaatcagaaactctggggctgggcccagcaatctgtgtgttaacaggccttcagataacgctgatgcacactcgagtttgagaatataaagggctgacatgaagggcttaccactgtgcttgtcctgtgcacgtgagaagccctcctaaaaattgtctttcgtctttggaggggataagctggaccctgaagagtaagtaaaatatggcagcatctttgcatctcatccacaaatttgagttgctcagaaatacatcacttcttaaaaatgttcggtgactcactgaatctccgactcatatcctccacgttgctgcgctggcataaaagtaaacttcagtccttcttgacttttccatgcctttctggggttgggtgttggttcttgggtttcacacagtgctgagaggcgtctaggtcctccatccacttgggtgaccattcagctcttcatccttccggtccacatgaccccttccaaattagaagcctcggctgctctcagagctcgcttggggccccaggctcttcactgaagctgccttgagcaccatcatccagagccacagactcatatgcccaaagggaccaggttcatcaaggagacaaagtggactggctggccaggtgcggtggctgacgcctgtaatctcagcactttggaaggccgaggcgggcggatcacctgaggccaggagttcaagactcgcatggctaacatggtgaaaccccgtctctactacaaaaattagccaggcacggtggcgcgcggctgtagtcccagctactcaggaggccgaggcaggagaatgaacccgggaggtggagactgcagtgagctgagatcgcgccactgcactccagcctgggtgacagagcgagactccatctcaaaaacaaacaaagtggactggctgtgacccagcagcaagaggtggggactgtggggacgtatcatgtttgtgccaggctcacaggcgtgcctctggaaacacaggcctagcgctaccagatctctttatccagacaagctgcaaatctaaatctgaactttcaagagaaatttgaaataatctatcttttattttcgatgttgttgttgttgttgttttggttttctgagacagggtctttctctgttgcccaggctggagtgcagtggcatgatcatagctcactgggctcaagtgattctcccgcctcagcctcctaagtagctgggactacagatgagtgccaccacgcctggctaattttttattttcgtagagatgggggtcttgctatgctgtccaggctagcctcaaacacctggcctcaagcaatcctcccacctcagcctcccaaagtgctgggattacaggtgtgagccaccacacccagcctcagtcttttaaattttggaaatccatcagaaaaaattaaaacactacatgggccaaaccaaacggctgtgagcaggattcagctcaagtggggatgagttagggtttccgggcttggaggcagcctcttctccagggtcctgcttcctccccagggaggtgccaggaagcacaaccccaagacccacagcccaggatcccactactccctctctctcttctctctcccccagccacaggaagtctctctgcaactgggagaggagttctgttctccccactgtggctccaaaacccttggtggtacctcaaatcccctccaaccccttagttcttctgaggactctctaaattctcctaaaagagaagaaaagccagaaagatgtatgagctatttcttgttccccttctgctatatccctcccctgaggcaacagctgcctgttttgatg

SEQ ID NO: 437 - DNA, 2120 bp, Homo Sapiens
ctaattttaaaattctatattcttaacacttttgccattggcccacacaactttgcttttcaccagtgtctaaagtggctgaaacatcagcatcgggtggtggcaatgccttgagggatatcttatcatatgcagcatggcatctctgggcttcgtggaaccagacatagtgatcaaacatggagcatatttctactgcagataactagaaactggatcatggcgataaagctaatccaactggatggatcctagctctgtgacatggctgacttccagaagcacaggcttttttgctctcgaatatcaggatgatacctggagttctgagtctgatgacctggaagatttggggtaattccgtttagtagacacagctatggactcacacaaaattcattcatttttgagtctactttatttacagttatttatcctttcttgaaaacttttagcatcgccttgattaaaataagttcataaaataatcttcactgtatttgttacatatggcacagaataatttagcactttataaatatgtctcattgatgcacaaatgggaggagcaccctttgctgaaagcagtacagtgacttagttcaatttggctacggtagcactttaaaaaattaccatgagatggcgctgtggccaagtaaatgcagtatgctttaaacagttttccctaattatggcagttaattgcttttttttgaatatagaggaatctatcattcaacttaaagtagagcaaggtttgttactccgttttaatagtattcattaaaagtgaatcctttaatcacagatccataaatcatttgacaactgtgtttcacttaggtgtgagtctgtttaaaaagccatagtagtcagaaaattgccagactaaacaaagggcccaaaggtaccattttatttaggatcaagaaactatatatgtggaccattgttttcgccatcctcatagacttgtcttaaagttcttccacaaaattagattaatttccagtttatttaaagagctgatatttttgttacactttaatctgctttgcagcaatggaaggtcatagaaatattagaacatgaattcacatttaaataaacatgatacaaacatgcacacatgtgtatatactgagtgttttcattgacttgcttttcgtccatataaatatataaatattgaataaagtgcatgagaacatgtctgtacatatatacagctacacatttgcctatacagtatacacttgaatagatacttatggaagaaaaaaacacatacacatttgtaatatataggtagtcaaaagacatctatcaggcaacattaatgtacattctgatcaagattgagtatatgggggtagaatctgtaatcttttccctaatatataatgaaatgtgcagagttacaagtgaaggcaaaatacattagagtggagacattttaacatttatattttcatcagttagtatggtatatcataaggagtagttcagttcaaatgcagccttggtactagcagcatattatacattctatctttgaaacagtgaaccatctttcaacatatctatgaggacataatgagaattttatgcatttccaaattacacaatgacacttcccacattctttagttttcaaatctgtatttttttcccaaaggtttagggcaaacactatttctcattcaatagaaatgcttcagcattgtaatcatatatataacattgattctaataacaacatgcaatttaaccttgagtgttataatatcaaggtggattaactgttgttaatctctttttctctttagtaaccatttcaatgaaatattataatatctgcttttctattagggagcccagtgtcaatgagtaatactgaaatgagtgagtttttggagaaatagaagaaaaattttgctcaaaactatggtagttataaactggcttgagattgaggtgcgtatttctaaattaattgcaatgttaagcctcaagtgatattttccccctcctttatttgtttggtgtttattggtaaccaatcaggaaaacttatttttaaaactactctcacagttgaaacaaacttgtttctg

SEQ ID NO: 438 - DNA, 1025 bp, Homo Sapiens
cttggctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctggttcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacacagcatacgtggagaacgtgcttaagaatccactatgatgggaaacatttcattctcaaaaaaaaaaaaatttctcttcttcctgttattggtagttctgaacgttagataatttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgcttgtagcatttttatcatacagtagattccatccattcactatacttttctaactgagttgtcctacatgcaagtacatgtttttaatgttgtctgtcttctgtgctgttcctgtaagtttgctattaaaatacattaaactattaaaagaaaaa

SEQ ID NO: 439 - DNA, 3210 bp, Homo Sapiens
tttttccaccttatggataaatataaaactatattatagtttgacagacctaattattttgtaggtgctttagaagtagaagaactaggattggtggttggtcagttaaaatggaaagtcacaaagtctagatactttgattgcttgtattagatgtatgcttattttccatacaatcttttaatgaaggactacaccatttctttgagatgtctgctgcctagattctattacatatgcatcatatatagttttcagttttgtcttaaagaaatctgaatagagaattcccttgaactttcacagataccttccctcagttttccagctttcttcatacccctaatttgaccacagtttttacagtaaaaattgtagaaatcaagtaatattgacaaccacctactagctaatagtcatcagtcaacttatattaccttggaagtggttaaatagagtttggttaagagccacaaatttacttcatattgtaatgtaattatttttttaaaaacttccctcaacagaaaggaataatgtgctacaggaaaaggaaaacttacctgaggtagagagtttaagcaagaggtgaatctggtgtaatcaggcaaggagtcaagtattaactctgtatgtgtcaggtgctgggaatatagaggacagtttcttaacacagtctggggtgtaggtggagatacatggggtggctttgaggcctttcaggttttcatcactgatagatacctagcccttatttcatggatgcctcaaaccccattttccagtctaagctttcgcccctaatctatttgcctgtactgcataaccttctaaatatgattaaaatcttccagaagtttttagtcagccctgatctggccttctcaccatttcttcacatactagctaatatttaataagtagaattatgtgtaaatttgggtcttcctggtatatgagcaaaaaaagcaatagtttccttatctgagctgaaaaagacactaatgttcagtggagaacagaggaagagaattccaataagcagagcctgtggttccaggtgaataagtcttaagttcaaggatggtgtagagggacagagatgcattctggccctccagggttagatttgtcaagaggcgaaatagttaatttcagacagttctctggaactgatgtaatctggtttacttagggcagtggttttcagattggaagtacacactattaaacagaagcaattccactttaaaattttgcttggctaaaggattcagtggctattttttttttttttttaattaccaatgtgaataaggtttattggttccggggaggagacaccctctctagtatgagaagctgcaaagaaggttgtacttggagtaaaaaccacactcttcacagaagctgatcgtgatacccattgaggagactgattgggcctcagctttctataacctgggaatataaatgggtgttataaagtttcgtgttacatgactcagttatcagaattgtatctccagcttagaaccttacagggaaaaactggaaattacacataaatatcacccacttgccccctccaccccccaactttataaggtaggtaatattatttacacatgcagagaatgaggtgtggtaacctgcccaatgatacacagtaagcagaggaggcagggttttttggtccagacagtctaattcttaagtgtaagctctttactaagctgcactgttgtgaaagcactgtacttgaagttacaggcataccttgttttactgcactttgcagatattgcaagattttttcttcaaaataacgaaggtttgtggcaaccccatgttgagcaagttcattagtgctattttctaacagtgtgtgctcatttcctgtctgtgtcacatttgataactcttaaaattatttcaggcttaaattatcatgttatggtgatccgggatcttgaatgttactagtgtaatttggagcctcatgaaccacacccatacgatggtgaacataaatgcacgtgttctgattgctccacaaacaggctgttccctctctccgtctccttaggcctctgtattcccggagacacaacattgaaattaggccaattaatagccctacagtggcctctaagtgttcaagtaaaaggaagagtcgcacgtctcagtttaaatcaaaagctgaaaatgattaagcttaatgaggaaggcatggcaaaatctgagatgggccagaaagataggcttcttgggcccattagacaagttgtgaatgcaaaagataaatcttgaaggaaattaaaagtgctactccagtgactacacaatgataagaaaacaaaagaaccctatttctgatataaagttttagtggtctggataaaagattgaaacaggcccaacattctcttaagccaaaaccgtatccagagcaaagccgtaactccaattccgtgaagtcagagaggtgaagaagttgtggaagaaaagtttgaagctagcagaggctggttcatgagatttaaggaaaacacccatctccataacattaaagtgcaaagtgaagcagcaagagttgatgtacgaactgcagcaagttgtctggaagatctagctgagataattgatgaaggggctatgctaaatagcaagtatttaaggtagacaaaatagccttctattggaagcagatgccatctaggcctttcataggctagagagaagtcaatgcctggcttcaaagcttcaaaaaagactgacttgtgaggggtttatgcagctggtgactttaagctgaagccaatactcatttaccatttcgaaaatcctagggcccttaaaaattaagctaaatctactctgcctgtgctctagaaatagaacagcaaagcatggatgacagcacatctctatagcataacgcatctaatattttaaacccactgttgagacctattgctcagggacggaaaaaacctaaagctttcaaaatatgataagctcattgacaatgcacctagtcactcaagagttgtgatggagatgtacaagaagattgatgttttcatgcctgctaacatgacatccattctacaacctatggatcaaagagtaattttgactttcaagtcttatttaagaaatattaggccagacgcggtagatcacgcttgtaatcccagcactttg

SEQ ID NO: 440 - DNA, 1298 bp, Homo Sapiens
gttctggaaacaggaaaaggacccatcttattccaaaagtgtttgtacttttttctggactccaagttggatgccttcaccaaagtggtttcaaagactggaacaaaaaagcctccatcgaggccctggctagcacagtccctgttactttaagagtagcattccacctccccctcacacccacatacttgtcctctctttgcacagcaagtgccaagcagtgacatctactatagtttctaggacacgatggtctctgctctacagggaaaaagagcgagcgggacagaaagaaggcgggtggtgagggagaaggagcacaagcccagctatgttcccagaggaggagtcacttcctcgcaataatcctgagatgctgtttatggctgttctgctgatatgaagcctggagccgcaggatgcagcctccccctggctgtccattaatcacgaggggctgttacagagtgtacagagtgggagttctgcctacaagtggcctctaactgtctccagctcaatgaaatgaacctgtgtgaaaacttgttttatgagagattggtttatttgtaactaaactacttcctctgttatttgataagatcaaatatttgctactgataatctgagagtgtcacatttattatcctgtttcagccgttgcctaactcctttggaactgactccgttaactctttgagggacagcagtaggttttagaggaccggtttctattttctttcagcaaagccaatgctatctttcagacactgagtcagcattattttagaacagctatgacatgtgaatcaaaaagaagcctttctcttccaaaacagaaagcagacaaccatagtaacaggaggctctgataaattccctggaggttctgaagccaccatgaaaaggaaggaaaggtattctgacttactaatataaaaatggttttgcacgtgctaggatttctgaaatcacacattttcaatatgttcaggatgactttctatagtttgttagaccctcaaatatctatgtggggcatgatctctaaatccggcagcattctgcatcttgacacttggccttttggagtctgagctcatttgcatttggcaggacttgatttcctgctttgacagaacggcggtaaggtggtggtgaaagcctttacagtgctccctcgaagggctcaaaggactttctggatatataaaattatgtttccaagaattaaatggaccagaatgaggcagattttgtttgaaaccaggctctgttacatgcaacacatctgaaaa

SEQ ID NO: 441 - DNA, 8880 bp, Homo Sapiens
agagcttcctgtaagcgaacccgtgaaggttccaggaggatggcgcacccggaaagggcgtggaagctccgcgccccttcccacagactttcccccatccatctcttcatctggtgttcatcgatagcctttgtaatgtccttaatagtaaaccggaaaacgagaaagatgtgcaaggatgcacaccaaactgttgtcgtcgtcactggtttcctaatgggaaggataagaggaagaggagatggagtctcactctgttgcccagacgagtgcagtggcacaatcttggctcactgcaaccttcacctcctggttcaagcaattctcctgcctcagcctcccaaagtggaggaagaagagaatcaccacatatcgtatttagaggtcctgcagaaagggcagagcgagtttcatgtttgagtgcagcggatgcatgggcaaagcattacacagccgctccatggaagtgacaatgagccttgtctttcacacgtaactccaggaaccaggggaaacaaaaccaattccacccagaggtacagacaaagaagagcaccctcccaaaggagcccgcatgataagtggccacggcgaacatcactgtgatcagtcagaaaggcaggcgagttattagcttagccctgaacctcctacttaatgtagaaccagtggtgatggttaacagaccctggctgcagtgacaagcctgggacctgctcgaggaaatccaattgaaaagcagccaagaggaacaacaagctagaaacagatgttccagctaccaggatgtgcacgcatttaacctgaacatgtagttggggtgggatggtagcattcgtttctaaatatagtgatttcacttcttcccccatatagatattgtcaagtttaattatagccatccacattagttttgtcaaattttcagcaatttctttaaaataagaagatgtcagaatgataactgctattaagggaattcagggtgtttggtttatctacccagtcttactaaaacatttcagttaaatcatccactcttaaactccagtctcatagcaattaaaaattatcttttaaaaaattgcccaaatgaaattccaacagttcatgtaattatttgatttaatattaccatgttagtaaaatatctttaagatagttatattttcatgagtcactttcttagtcacttctagttcctaaataggggagtttgggttgacagaggtgtgataaccatgcgaacaggggctagaatataagcttaacagaatcagttaattagatttggaagagagttgagtcttgtgaaccacagtgatatgtcatgtacattaggaaacattctcctttacgtcaacacaattctggttttctctaatgggctttatacgaggagagagaccatctcactgtgttgatttttctcaagaaaaaaatcaatactctcaatggattttaagtagatctaatgtagtactgcactatgctcataagaagataagcatatgtaaaagattttaaaatgtgaattaatgcatgccacactgaaaccagatcataccccacactcatgttgttattatgtgtacctaaagcaaagaacagctgcagagtattttctctggtaacacttcattttttattggtaggttttaatccgatacatttttggggtcactgaattcttatttgctttagaatgcccgattatatcattctgcaaaggataaaagggcttgagccatcatcctgtgctgaaatttattgaaggtatttatgaagagggtgatcttgaggaatgcaagcttttaaaatctaagaacagcagcaaaaataaattaatcaggaatccatcactaatttatacatgagtcacttacgaggaaggtaaaacggttcagtaaattatggatttacaaataaacttgattctagggccttggaaaatacttcgattggaatatagatccatttttcctcaaaacaattttcacttcaacttcagatgtaggggacataaaaccaaatcccctctctgaaaattcaaggggaactcttttctggtaacgtgaggcatgagtggtgatggttcacagggattcatctgctctccacaaactcaggggtgggacccatctatcgtttttctaactcattcccatgaattctaaattgtcaacacctaaggttaatgatacctgtctttttgctgtcataaacagttagggtggtttagcaagagataaatcatctttacacagaggattgtgctattgttctcagcaaacaaaggacaaagcttatttctgtataatgttaaacactgttctaatgaaataggcttttttttcttttatgcattaatgaaattattagcctacaacacatttctttcttgatttggaacatctgttcttcaaaagtgtgtagagtaataatggagagtttctacacatcatggctcactctcatctcaaaatatacactgatttttaaggaatgtgtagaaggaaaagccaaccatccttttgattattggattaaccaccagagctgccttcatctgaaacatactccactcgattgaggatgatacttttagctactaaataaatacacagaggaggtgtggaataacaactttaccaagaatagccaacaagttcatcttacaactactatgagcaaaaagcgttcataaaaaatatcttttttttttttttcttgagatggagtttcactctttttgcccaggctggagtgcagtggcatgatcccagctcactgcaacctctgcctcctggcttcaagagattctcctgcctcagcctccaagtagctgggattacaggcacccaccaccacacctggctaattttgtatttttagtagagacggggttttgccatactgatctcgaactcctgacctcatgtgatccacccacctctgccttccaaagtgctgggattacaggcatgacccaccacgcctggcccaaaaaaatatcagaaaaaaaaattgttttcacccctttaaatattaaataattgatttttttctgaaaatatttcttatacaattcaataagcacactaattttagaatggagggtcattaatgctgtaacaaaattggaaatatttgctattatatgtttttaatacacactaggtacatattaaatactatatctgtgtaatagttaaacatattaggtagttcattaggttcatttaaaattggccaagctcagtagctcacgcctgtaatcccagcatttttggaggctgaggcaggcaaatcacttgaggtcaggagttcaagacctgcctggccaacatggtgaaaccccgtctctacagaaaatacaaaaattagctgcgcatggtggcatgtgcctgtggtcctagctacttgggaggctgaggcaggagaactgcttgaatccaggaggcagaggttgcagtgagacgagactgtgcactgcactccagcctgggtgacagagttagactccgtctcaaaaaaataaaataatataatgtaaggccaagggctcagcaacaacgtaatgtaaggtgcttaggtataattttacaattttaagagagaatgtgcttgagctaggaaccattgagagagagtagatggtggcaatagtcagtcaattgtgctacaaatacattgcaatggaaaatatacactacaaaattttacaaaagtagcaaacaaaaaactttttttttttaattttttttgaccaagtcttgctctatcacgcaggctggagtgcagtggcatgatctcagctcactgcaacctctgcctcccagcttcaaacgattctcatgcctcagccttccaagtagctgggactataagcgtgcaccaccacacccagctaatttttatatttttagtagagacagggtttctccatattggccaggctggtcttgaactcctggacttgagtgatccaccctcctcagccttccaaagtgctaggattacagacgtgagccaccgcgcccagccggcaaacaaaaatttacctatgattcaataaatggttttcccctaccagccttcccccaccacacatatacactttttctgattctgttttaccataatgatgacacaggtgcttaaccagctccgtgagctattggggtggctccttgccttgatttagtcttgtgcccacacactgacccatgcagacttagccatgcatccagcacaaattacgctattttacatgtttggtttaatgtattcgtacctgctagacattgtagccaaaagattgtttgctgcctaatcctagccagctcttagggtgactgcctaagcctgtattgctggcttcacaagtttttttgtttcaggtaaataaaaatcaaagagcgttcgaggcagccgcattgactcaccttgcagacaagcaagcagagccgcagagcagtgacccgtgcccagcgcctcgcagctagagctggattggaatccagggctttgcaggcttcctgcttcactcaatcctctttctgttgcctctggcctcaaggtgttggcctgggaggaagtagcagattaaattccatgggcacgaagtccgtagctgacgaatacttaatatgttgcagtttcacagtgaaagttggcaagtccagggtgggaacatgccccaagcagctgagtcttctggattttacttctgttctttgcctctcaatttttgattttgttatataaaaagcaaatcagtaactattgcattatattctgcagtgactcaacagcgacacttaattcagccaaccaaggtttactgaactgctcgtggtgccgggaaccgtgctgggataggatacagggaccaaccagtcctgatcattagcttagccagagaggtaaactgactgacaatcaatctgccagggatcaattactatggaagctcatagtgtgggcccctaacccagactgtgggtctgaggaggtctcctggaggtagtgctatcctaacagagacctgaagggtacttggaatccagccacagaatactatttaccatctcattttactctcatgagaattctccccactgtaggcaggatgggtgttgatttaaaagaaaaaaaaaaaagtagcctggcggggtggctcacgcctgtaatcccagcactttgagaggccaaggcgggcagatcatctgaggtcaggagttcgagaccagcctgaccaacatggagaaaccccatctctactaaaaatacaaaattagccggacatggtggtgcatgcctgtagtcccagctacttgggaggctgaggcaggagaatcgcttgaacccgggaggcagaggttgcggtgagccaagatcatgccattgtactccagcctgggcaacaagagcgaaactccgtctcaaaaaaaaagtaaacagaataacaaacttaagggtggccagcattagagctggaatggaaccctgatgtccaatgagctccctgtagagtggactttgtacaggaccatgttctcctaaagtgactagagagcaggagccacctgtcactcaatgcagcagcattggaccctcccagccaaaccccactcccacctcccatcctactggagtctctttcccttcgtcttggtctacttgagtagatagggtcctcgttggtgcaaacaatctgtgatttatgacccagatagtcctgccaggtcacagagaagtgtactctgcacccagcagtcctcaagacagacttaggctctcggttcctgcaaggcacccctagaggacagcctctcagcagtacccagcaccctgcacagggccacttttgtagcctccacctgcctgctcactccctttttctctccttggccttctccaccctgaatgcttgtgcaagcatgctcactctccttccccagcccctctgcacacactgacacacactcagctcccagctttcatcctctctcccacctcttgtggtgagttctgagcctctccatggccatcctcccagcccaggccatcctcccaacccagcctctccatggccatcctcccagcccagaccatcctcccagcccagcctctccagcccatggccagcctcccagcccagcctttccatggccatcctcccagcccaggccatcctcccagcctagcctctccagcccgtgaccagcctcccagcccagcctctccagcccaggccatcttcccagcccagcctctctagcccatggccatcctcccagtccagcctctccatggccatcttcccagcccagccccacctctccagcccatggccatccctcccagcccaggtcaggctctgagcccaggctctccagcccatggctatacttccagcccagcctctccatggccatcctcccagcccaggccattctcccagcccaggagtatttctggaaatgctcccagcccagcatttccagaaaaggaaaatacagccaatgctgagagtctcaaaggtcactcagttcagacctgcagaaatgtttttgttttatttttttacttgggatctttcaaccagtcagcctgatgctcttgtttgatttccatgtttgttgtagtgaaatactgataatcaaaaagttattctacatgatgagctgttcctcctacttctttacagtttctccattttccaaaatttctacaatcaagatgtattgcttttataatcataaaaagttaaaatgttaacatattctgacagaaatataggaattattaagacttttttctaggtggtggaattatgggtaactgttttttctttgttctgtatatttccaaatcatctaaaatcaacatatattgcatttaggtttgtgtgtgaggggttttttcccccatttttaaatttgtgtgtggttttttgtttgtttgtttgtttgtttttttctttttttcagatgggggatcttgctatgttgtccaggctggtctcgaactcctaggctcaagcaaccctcccatctcagcctcccaagcacctggtgaggtttttctctaaaaaggaaaaacatgtggaagacaatcagagatgatttttgagtaatgcagaacaactccaaaagaataagcagaatgaatgctcataaggtgaaagcatttcagaaaacctattacaagcaacaatggaagaaaattgattgaaactgtgcctaccttccctaacactctccaccttcatctgaggtttgtgatccacagactcaagccatcatggaccacgtcttcatagtcccacactattgtctgcatgatttatacaaatgcaaagcctaccattacttaaatggtaaaagaaatacaggaagcagagactgtgctatatcaaaatgtatctttctctactaccactgttttgcttcgtgctgtgcagaactgccactaagcattttcatagtcgagagagccagagacacagaaagagagaaattatggtcaaattatggcaccataccattaacgtacgagagattggtgccgctagtgtatgattactgcttttaatatgattttcgctttctatcttgtaaaatactgtgaatttactgctgagcctgtgtactgctactctcccaaagagaaaattacttcttccagaggatctgcttgcacaagcgtaaaatctttgcagctctctgagcagcaagagaaccacatcagacttgatatgctgatttggctcttttgagttacctgttccagagaattttgggcaaggatttttccaagatgtcattttctttatatgttattttctttatatttgtatccattcacatcatcaagtgtcttattgagtacctcctaattgcaaatgatcttagtggctgctgtgagagacacatggattctaatacagggtgcttggtttagagagacttgtaagcaccaactgatatcgagggggaaaacaagcagagggaacaggaagtgcaaaggccctcaggaagaaatgagcaaggccaacagggctgggaagatgaaggtagaggagatgagaataaagaggtgggtaggggtgcggtcttgtaacatttgaggagctgaattatattctaaatgtgataagaagccatttgaaagctttgagcaagagaataagggcatctgatttttttttttatccctctagctatgagaataggctataggggactaaaagcagaagcgagtaggccagttagtaggacgcaactgcagacatttaggctggagaagacagtgacttggacgagggtggtggtgtgaaggtcactgaggtgtgtggagactggaaggcacagagtcagaggacttgtcttctaactccatgatactgctccagatgatgaacaggcactcagaaggaacccaataaacatgtcttcctgaatgtatggctgaatgaagagtaccgaccccctcacttataagtaggagctaagttatgagtataaaaaggcgtaagaatgagataatgggctttggggattcagggggaaaggggtgagggaggtgaggaataaaaaacaacacactgggtacagcatatactgctcaggtgacaggtgcagcaaaatctcagaaatcaccactaaagaactgatccatggaacaaaaaaatcacctgttccccaaaaactattgaaaattaaaaaaaaaaattaagcaaccgaataggaatgctccactgattgtagatattttctttctttctttcttttttttttttttttttgagatggagtttcactcttgtcgcccagattggaatgcaggggcacgatctcagctcaccacaac

SEQ ID NO: 442 - DNA, 16818 bp, Homo Sapiens
atacctcacattccccagcacggttccgacaggcccatgagtggggagtcctcatggcctgggaaggtggccgagaaagtttgaacagctgcagagcctgcccgtccactctctccagccacatttgtgtgtgtgtgtgtgtgtgtgtgtgtgtgttgtgttttgaccaacctcttaggcttatgtaacacacttggaagtcaagaagtaaggactcattactgacagcctcagagaggcttgcgaaacacttgctgtgaagaaatctttccattgagaaaaagttccctggtgctcatgctcccagtggctcaggtatgtggctgggggtgacggtggtgtgagaagcaggggtccccagggctccagagcccagcgccccctgccggagctgtgtcgcgcccggaaatggaattgagcatcgcttttgtcctctatgtcactgctcacgtcaccaccaacaaccgacgtcggtgactaaactctcgccgcgtatcaggcactatgctgggcccctgcgtttgtgattttcctgggcgcgtgcatgaccaagggctaggtgctcctacgcccattttatagaggaggacacaggcaaggcggtggggtcggggcccttgtcagcaggctgccaccccacacctccctgaggtacatgcaaaagcagacccctcccctccccacaggtatagctctatgtgggccctttgcatgagtgtatttttaagctacttgctagatcccaagaggaaatgagtgctcatcctgcagggagaggccagcattccactgggccatttcccttttcagagagctgatgtggaggattctgcgccgttcttggccatgccgtcatctggggccccaggaaccttacagacccgagggccagggtttggggcccagagcccagcagatagccatcttagaagcattctccccaggaccagggctgctaaacccaaccccacatctcccacacaaatgcgtctttcactggggctctggaaaccggagaccatgtaaatccaagaagatgaaattgtgtgggtctgggccgcagctacagactgagactcagcagccgaggggccccagcctcagagggaactcaatgaatttgtcagggaactgaaaacagatgatttcaatcagcaggggaaaaaaatgacttcatggccacagttgaccgaagcaagcggcgttcggctgccaggccctgcctgggaggcgcttccagaaagcctggcctcttccgcagcctctggccggggtcttccctgcgaggagccagcgccgctcgagccgcagcatggcccggcagaaggcacggcggccgtgatggggctggcggggcgcggtgataacccgggctccccgcccccgcgcttcctctccgctgcgctttcatgaatggccccgcttcccaaacagccgattggctgaacccccggccgcgacgcccaatcagcggctgtggccgcctggtctccgctccgcgtggggcctcggtcctgcagccatgaatggcgcagcctcagctgcctgcagccaccgcctaccttgcgggggccgcctccccccgagggaggaggagcaggggattttttctttcccccagactgttcagggttctggtgcaattgtgtcaatctgaggcttggctggagctcctgacaatagcccttgggcttccaaggttgacattcaaggtcttgtgacagtgaaagggcttgcatagttagaaatgaatttctttgcctatagcccgggctgattccagttccagggaaagaacggcagcctttccgtgtaagcaggcagccctgctggggacaaagacagggccgtgggaggaggtggggccccttcctggccagtgctggggggggcggacacgtgcaaactgctgggaacttcgcctgcaaaccagagggctttggccacccctcttggtcactggccttgtcctagcttcatatgccacgtgcatgaagcggctggggcccctgtcggggaacccagccattccgctgcatttcctgttaagtaggaaaacatgttctgtttgctgatgttataaagaaggcatgtgtttacaaatgctcattggggagagcgtggttaatgggccagcttccggcctcacctccccagatgaagtgattgtgtggctgacagaatgggcctgctcttcaggggaagaccccctactcgggaaaattagactcagcagaagccagaattcaaagctgtctagaaagtgcttttgcaaggtgggttgaggccaggatgaggaaggcctcgaatgccaaagtgaggaggtgtcccaagccctggggagtcatggaaggctggtgagatgcagagtgagattccggagtgtttcagaagcttgactcttccccggcagggacttctctgccaacacacctaccctgagcatggctggggtgaccttttatggaacttccaaattagaactgtgcaaacagcttcctgtgaccccttgatgagccccattttaaagatgagaaaactgaggttcagagtaatctgcaaagggtcccacaatttgggagtggcgagaccaggactggaccctatctctgcctgatgccataggggaaaggcacacccaggtgctgcacgcccacagggactggtgtgaggaggcttcagcaaaaaaatgcgggcagatcactaaacactggggcaggcactgactcattgctgcagtggttaggatcagaactggtgagaaatgtacctgctcccaaatttctatgagccagactctggtctcccaggtagattcgtgaggccatgagtatgcagcagggggcggcctgacaaattcatgtagatttccagttgtagcatctattttttttttctttttttttgagatggagtttcgctcttgttacccaggctggagtgcagtggtgtgatctcagctcaccgcaacctccgcctcccaggctcaagtgattctcctgcctcagcctcccaagtagctgggattgcaggcttgcgccatcacatctggctaatttcgtatttttagtagagacggggtttctccatgttggtcaggctggtctcaaactcctaacctcaggtgatccgcctgccttgagatggagtctcactctgtcgcccaggctggagtgcagtggtgtgatctccattcactgcaacctccacctcctgggttcaagcgattcttctacctcagcctcctgagtatctgggattacaggcatgcgccaccacacccagctaatttttgtatttttagtagagacggggtttcaacatgttggccaggctggtctcaaactcctgacctcagttgatccacccacctcggcctcctggagttctgggattacaggcatgagccaccttgcctggcctgtagcatctatttctgccagcctaatgcccagtatctgtttttaaccttctagttcagcagtttgtaaaatttctggtcttgggacccatttgcctcttaaaagttatcgaggaccccagagagattttgttgatatgggttttatctactgatatttactgagttagaaatgaaaacatagaaatttgtaaaatgcatgattctgcaagcatacattctgttagctctcagagtgacagtgtcatcatgggtcctatggcctctgggaaactccactgcacagtcatgagagaatgaagagagaatgaaaggaaaaaagacaattcatgcctcagtgtcttcatgaaattaactgcaacctctcagacctcctgaaaccacactttgagaactgctctacagagagcagattgagctgggcggcgggtgcctggcgaaagcttcatttcccagccttcttgtggctaggtccggccatgccataccctggctgaatggactgtgagccatcctccatggtgctgggcaacatgatagatctgtgagtgaaggagtcattgcagtggccacatcctgcctctgaccaatgagcttttcccttcttctccgccttccacaggctggggtataaatgaggcatgggtcaatttggccctcgtagacagggcaaccctcaggtgtgacagagcctgggtgaccagtatcatgctgccatatttgttttttgttttttgtttgtttggtttttgttgttgttgttttggagatggagtttcgctcttgttgcccaggctagagtgcaatggcgcgaactcggctcactgcaacctccgcctcccaggttcaagcgattctcctgcctcagcctcccaagtagctgggattacaggtgcctgcccccacgctcggctaattttttgtatttttagtagagataaggtttcgccatgttggcaggctggcctggaactcctgacctcaggtaattcacctgcctcagccgcccaaagtgccgggattacaggcgtgagccaccatgcccagcccatgctgccatatttgtcctggattgactatgtgggctcctgtgggaaaaagaaatcaacagccaggcttctgctactgtattttgcagtctttgctataatagcctaaccagaatcctgatcagtacatcattcttacacacctggcttcctgctcttattatgcttgcaagaagttggatgaaccatccagataagcccttgggaggagctgagtcttcagatggaagcatgaggtggtgaagcacccctgacagatcattcctttaacatgcgtttattgagatattcttgccatgagtccaacagagtccaggagaggaacatgaggtcacagctgatgggaggaggggacgctgggatggagcttgccagagtgtcgggggctgccatacaaatcaccacaccctgggtggtttcctacagaaagaggcagaaacgtactcttgcacagttctggaggctaggaatggagatccaggtgtcagcggggttggcgcctctgagggctgtaaggcaaagaacccatccctggttcctctcctggctcttctggtagcttcagccgcccttggcgttccctggtttgtggcctcatcgcttcaccctctgcctccatcatcatgtggccttgctcttcatgggcctctctgaggaaagcaagaggtgggagcagtgggcctgggccggggtcaacagccaaggtgtggccaaggtccacccaaggtcattggctccttgctcggcctcaaagccagcttgacgcagcagaccctctccccggtctctctttgtcctttcttcttcttataaggacacttgttattggatttagggcccaccctagtccaggatgatctcatctcaagatcttttgccttccctgcatgcacaacgattccttttgcaaataaggtcacactcacgggtttccctggccgtactctttggtgttgcgggggcgaatgggtgcagcattcagccactccagggctctaagtaggagggacaggcagaagccaccaccaggacaactggaagacttcctggaggagggggtgctaatttgggtcttaaggggagtcattgctgcgagaaaggggagtccacgtgggaagctcagatgcagggaggtgcaggaccttggcagggtgtggggcctccaggggaaagatgacaagtgtgctggaggccttgggggtggagggctgagtgcctcaggatgaggctgggagggccaggtgtgggaggtctcagggctttgttctgcagacagcaggagccagcaggggctctagggctgggagtgagagagttccctgcaggacaaaggtgggctaatggattcccactaggttcagggatgcagaggtggtcctgggagggggtgtaaatatgtgtcttgcaaggggtggagggggagatggagccttggggtggtccctgggaggaccctgggggcgtgtggggacgtctgtacagagtgcagcaggaaatcaggctggtctgtcttgctgtgtttccaaagaaaagaggcaaacccaaggggtaaggggcttccttagacgcagggcccagtgcacccgggcgctggcggtgggtctgggggctgactgtgtctgtactctctcctttgtctgcaggcctggtctgcactcagcggctgccaggacctcccgggagcgcccacacaccccacagcccgcctgtcctgggaatacctctccaggccctgaatacctgtcccccactccctgcctaggacaacgggggctgtcagggccatgggcaggcccaccccaccaaccagaccctacgtgggccccgccttggtcccggagccaatgtctggctgatcagggaacaagaggagccttcaacacctcaattctgggacggttgaggttttcacaccgggccacacctgagccactaggagccgggaggctctgatcgtctctccgcctgtctctctctggcatcgccagggctgacttcattccacgtccgcgcggaaacagcagggctatctcagtgcaatcctggttttgtattcagagcctcctctgagtgagtgccagggcgcaccgtgcaaggagcctggctttgcccactgcaatcccgtgccctcaccctagtcttttaacctctcacgactcaggttcctcatctgtgaaatggagctgtcttctttgtggggttagtggaagcaataagcgagaagtgtgtccacacaggcccagcctttctggggcctcactgtgaccagacactgcgctttggactaggggatgggatgcgacttaggggagctgcggccacctgtctctggaggctgaagtctccctgcggaccacccttcctcaggaccacccttcctcacttgcacgtctcccctgcagtcaggactcgcctgcccccacgccaggctctccctagtggatcaggctgtacaacctggtttgtatgaggaaaggcagccgctggggccccagtgcagcaagagaggggaggaggaggtgttcagagggaagacccctccccacccccgttggccccttgtcttcaaaggaagggcgtgacctttctgccccccagacccaccctgagggtcactgtggcggtgaagcctggtgccggcacttgtgcccgccctctgacttgcagtgtcccgagacatattcaggggagccaggtattcaatcagcaaggctcccaacaagatggggtgggtgggagaagcacccacaattctctagaaggctttcagggcattcttcactaaagagacacattggagtctggaacccctcccctagcagggggacacctccaagctgtgctcaaaactgggacaggatatttgggttggagtgttctccgtctctgcctctctgtctctctctctccctttctctctgtctctctctctctctccctctctccctgtctctctctctctctctctctctcactctctcttgctctctctttcctcctgtctctctaaaggtctcctttcctctaagggcaaagcagcagctgtcaggtccttagagcaggatccctggttggtgcaggcccagggccagcccctggtcccggcctttcttcccctgggggatgaacagtgaatgcagccgccctgggagttgggcgacctgcggggcttggagggaagggcaggagggcccagggctgacacagcacgcctggctggggtgggggcagtggtgtgggtggctgaccacattcctgggatgccgggctgcagggctgggcggctgtgtctacacctgtctgcccctgtcggctgtgagcaatgcagccagggacagggcagctagagccatgctgtggtctggccagtgggccaggcacgtgagctggttcatgccctgctgcaccaacaacgttcacctggagaggtcagtggcctcattgaggggaagaagggctctgtccctagagtctagcaagcctgggccatggtctgtggggcttgtcagggtgacttcacctctgtgagcctcagtttccctccctggaaagtggagcataacatgggtggggtccccggtgctggcctgcagagccctgggagacgtgtggagtacaagccccatacgctaggccaaaagatccgcagaccaggcagcttaactgatagaaatgaaagtccaagatcaaggtgtcagcagggcaggctccttctgaggctgcggggaaggaactggcccaggtttctctccttggcttgcaggtggcccatgcctctccacatcagcttccctcccatgcggcctctgtgcctgaacttcctcttttagtaggactgcggtcatattggattagggcccaccctaatggcctcctcagaacttggtgaccactgtaaaggccctatctccaaatcaggaaatgttccggggtcctgggggttaagacttcaacacaaacatcttgttggaggggggttgcaattcagtccacacccgcttccctcgtctcacttcgtccagcactcagcaccctctggccctgcccttagctgtgggtctggatttcccatctcttccacggtaagccctgtgagggcggcgtctttatcccatttgctgttacacctgcaattcctggggtgccggcttgttctcatcatttagcagaccattgctgaatggctaacaaatccaggatacaatttgtaggtgcaccaagccaggcaaggtatctgcgtcacctgcccgtcagtggccccaggctgggaagaccccttgggtcatgcttggacactctgcaccatgggcagccagaactcctggccgagtggtcagcggccgccacaccttgctggagcagaggcacccctgccatcccacaggcaagacggacctagctcggtttcccaacactctgttgagatggggctgcccagaagcccacacaagcccacacctgggggaatcccagccccacgttctggttcaagtcgctgctggtttgggttcagagcccaaacatgagctcctgctcttcttggtgtgatctgaggctgtggatatcctgagaacatctgtctcaacagaacaccttcctccatgttgcctatatcccaaattcactcccaagtggcttttgtctggcagattccggtggattatgcaaagagggactgccagagaatctgagctgttggaagacttctgaaacgtcactgcggtggcggaggcactgccccggggggacaaaagtcttgtctcttcctccaaatgtggaggatcaaattagagttgacttgtgtgtttccaaacccgttgtcgtcccagcattcaactaatttgaagataccaaaagcctcagaagagggtggcagaagaagaaagggacaaacacaaaaggggaaggacaagagggcagaccgttaaaaaaaaaaaaaacctacaagaatgcagtttgctcctgggtggaccctcccaccccgtgcctgccccgagctggcccctgacctgtgccggcagctcaaattcctaacatctggcccagggtaaggatatgggcaactctttaaggaagcgtgtcctcgctaggtgctgatcactcactccaagggactttgctcctggatgcccaggctcagagagggctgtgagcctcccatggtcacacagcagcagtccaagtgcctggggcagtccgatgcccacatcccccttgaggtcccaggtgagggcatggtcacaggatgcagacccctgcctgggtaggtctctggtcttctatggcacctacttgtaagcctccccagcaagttcaatgtggggctcccagcaccggtccttgggatttgggggttccttggtttcttctcttttctctctacccttcttctccctgggtgacctcatctgttcccctggatgaggtgtggtcccctcctcagttcaatgctgggagccctgcactgaacctggagggaaccagcaggctctaggtcccgacttttggagtagggcctgccccttccttcctgcccctttctctagggagtgctgtgaagggtgcatttgggccctgggggcccatgagtttgggcctccaggatagctgagagcacgtgggcctggcctgcccactcttcctgaagccccccagcttcgccccactcctgggccctgaccagcctcctgcctttgcctttgtctggccttgggtttcccaggcagtggcagctttgctctttttctcgcaggtctcaggtgtcacctcttgaaaattcaaaggaggatccttcgaattcatgaaccagcaacctcccaggaggtgggtcttcccaccctgcaccatccggccttaggaattcagtctggagccctccctccccagggcctggggcctggaagtcggagccagccagagcagggaagggtcgggccctggaaatccagagtggcctgcctgggccggggtggggctgggcatggggaggcgtgggtcctgtcggggttgggaccagcgctccagcttccctagctgatttgagcatttaattttaattccacaaatagagaaaaagaaagaaaactcctgaaagtcgcggcagatcctcacggctctgcagatgtcctgcggaggttgagcctctgcactttggcctcagctgcccaggtaccagtctcagctactgtcactggcggtgtggcctgggcagccatgtcccctccccaggcctcagtctcccagtgtgtcaaatatctgccccgtctcaggtctcattctgctgcttcccccttgtgatcataccctgcccctccccactccccaaggacttcttggccttagcccacaaacctatgcaggtggttccatcagagactgtcccccccagccaccccagccctcatcctaagtcccatgctcccctcccctgcaggaggccactccgtcctcctagtactctcttctcccagcatctccagttctccactgcccgcttttcctgctgccccacttgctggtcccctggagtcccccagacatcatcgctcctgcagtcagcaaggatttggtgggtgcctgttgagggggccgctcctctggggctggagtgcagcgatgcgtgaaacattatgatccctgatcgcctggggcttctggtcccatgggatttgagggttccttggtttttttctctttcaacccttcttctccctgggtgacctcatcagttcccatggattgaaatatccttatgccaatgacttccaaatttgtctcttcagccatgacctctcctccaaactctggacccatatatccggccatccacttgacatctccctttggggtctcccagacatgtcaagcagatcgtgtccaagctggtgtccaatcctttcccaggcaactcaactcccatcttccccatctcagtaaatcccactgccacccctccactagctccatccagaaacctctacaatctccttgcttctccctgtccatatccacgatcaggaatccatccacagacctgtgcatcctgtctctgcagatccacagcctcacccccatcagcaccccggtccatagagagagacctggtgacacagatggtacttcagagagaggacatgaatggtgtctctagtcatgagagtcagggtttaggttgaagctactccgccagggagaagtggagatccagggcccatccagggacacgcagggagaaaccgcttcccccagcctcagggtggagcccctggttaccctctgagccccagagccttgtgtccccagggaggcagagggtggaaaagactgatgggtagagagagtgagagcatcaagacccctctacactgcagtacaagaggctcccttttgggtgggcgtgacaggagacatcccagtacgtggatcccagcctttggacttggtgactgtgatcagctaagagtaaaactgttcttgctttattcttctgggaaagggctacacctgctgggttccacaccaggtgaagaccgggcaggtattctattcaaaagggtgtggctttgccacccatttgacaggagagaaaacggaggcatggagttaccaggatgtgagcagcacagcagagcagtcctgttcagggcctcacactccctccccacagcccccttcctgaccctacagcccccgttccaggcagttcctagcaccataaggtaagtggacaagcctcactctggaaggagagcacagggccctgtccctcctgggggcccgctgagaagcacagtggagttctccagggaccaccatcacaccgaggacacgttaccataaagaaagggcccctgctcacacacatttcccagtcactagcagtgagcacgtggcagcctccagcagctcggattcctccaggccacaccctagacctggccacccacattctggcttctcagggcacatggagcagccattcccctgggctctgggccccaggcacaagagacccaggcttgcagctgttttgcagagagtaagggcaaaatggaagctgcagtgatgagggagaaggtgctggggagagggagagagatagctggatgggcagggccgctgttgctgggacctcagccccaggacgggcatcctttcagcaaaatctttgctgggcagctatggtgggctagacactgtgaggtgatggcgtctgggcaagacctacaggacaggggacgcgcagcccagtgggaaagacagggaatcagctcaaccgtccaccatgggccatgtcagatccagttatcctaccatccagaagcagggggccaggaggttaaatgacgtgctggtggccatggtgtgggggcagaagggccagggttcaaagccatacccctttgaacagaacaggtgtagcctatttacccgcctctccctccatccatctgcacattaattcattcattcattcattcattcattcgctgagcacctgctatgtgctgggccctgctctcaagaagtttggattctggtggggaggaaagaaaaaatatccaggttcatcagacaagcaaataatacaactacaaaagttgtcaagagtctcctggaagagaaggagctggctatgtggggcctgcacacacacgtatgcatatattcacatgcatgttcatccatgtacacatgtgtgcatgcatgtctgtgtgtgctttgagcatgactgtacctgtgtatctgtgtgtgcacagatgtgcatgtgcacgtgtctatctgagtgtgtctgtgtgcaggcaggtttcatggatgtttctgtgcctgcatacatgtgtgtgagtgtgtgtgcatgtgtgaatgtgaatgtaattcccaacagaggtatgaacatagctcagaggtgggtggactcagtgggatgtgctttagggaggaaaagaggcccagtgtgccaggggtcagggcgtggggcattgaggggtttcgggaggaaggagcacgtggaggccaagctgtgaaaaccctgtagaccatgagaggaatttgagttttattcaaaatgcaaagggagccaacagaggaatttccacatggctagaaaaaagcacacagccatgggactgtggggagcacggagtggagggggtgtgagtggaggcagatggccaggccagaggccagcactgcacctgcccaggtgagaaaggctgggagatgagaaggaaacccacactgaccaagattaaaaacaatacgatacaaggaattaacagcagatgagacagtgtaaaaaaaaataataataatgaacttaaaaacacagtcatagaaattctccaaaatggaatacaaggagaaaaaagacttaaaaaaaagacaaggaagaacagaacagcagtgagttctgggacatcaagtagcctagcataggtaactggagtccccaatgaaccccagtgagcgtgacccagtatccgcctagtaggacgctgaaataaaaatgactgaccgactcagtgccagcgaggacatggggccactggacccctcccacaccacgggtaccagctctttggaaacctcttctgcagattcttccaaagctaaatatccatctatgtgtgactcagccattccactcctgggtattctccaaagggagattaaagtgcacagcctccccaaatctcgtacacaaaggttcccagcggctttatttgtaacagccccaagctggaaaccacccaaatgcccatcagcaggtgcttgggtaagcagaggcctggggtcaccgttggttcagctgttggcctctccttctgtctctccaagcgccctagggcaagtggcatcttcaagctgagccttggtttcctttcctgtgaagtgggtctagtgagtgggcctgatttgaggtggtgggcaggatcagcgtggcatcactggggaagctcgcagccgagtgtgaagggcccggcatggaggggtggaagatgtcaggctccaagcagcccccgacgctggcagtgctcaggctgacccttggctgcctcagctctgggaaccccatgcagcacgaggcgtcggggcaggtagtggggccataggaggcggcagggcctgggctgtggccccgttccctgaagggctccgtgtgttccatgcagcgggcagggtcaggggtcatgtttaaacgcgggggagcccagggcagtacctccaggccgcatgctatccaagtggcgtgggcaggcggccccttggatggtctcgggacagcacagcaaggccctgggcactcacctgaccagtcacgttggggccgcctgagggaacaggcaggcagatccaacccatggtggggggctgggacttaggatggtttgaggggtgcgccgaaagcctgggaaggagcctgggtgggagagtggatgcccggcacacacactcgagtggaccagaggcggttggctaggccacagctatcccgtgcccagcaccctggtagccagttcagagtgactgtcccagccctagctgagggtatgcagccaaagcagggcacacctggtgtttctggaaacccctctccccatgccactgcgtgccagctccagtggcccccgtgtcggtccttaggactctggccacccacacgctgagctcccacagggcaggtccaatgcccagcacacaggggaagctcagcccatgtgccggcggaacggtgagatgggtgtgaatgaacaaatgaagcatctctctccccctcccctccccagcttctcaaccacagaatctgtgcctggctcaggaaatgtacccttcgtgtgggttttctattgctgcgtaacaaatggtcaccaattgaaaagcttaaaatggcatttatctattgtcttaaagtttgggcaggtcaggagccaggacatggcatagctgggtcttctgtctcatggggctgcagtcaaggtgccaaccggagctggggtctcctctgaggtttgggaccctcttccaagctctctcggttgtggaagattgcatttccttgcccctgttcctcatggggctggatctccaaatcctgcaggagagtctctgacttcaaggccattttgaaagggctcacctgattagcttgggcccacccaggatcatctccattttgattaactcaaggtcagctggttaggaccttaattacacctgcagaagtccggcacctttgcgatataaagtaacctcaccacgggagcacatccaccctctttgcagccctgccacactccaagttggggagtacacaggtgtgtagacacctgggggcagggatgctggaaagcgtctgagtctcctcccaaccacgctctccttggctctgagactgagtcctggccccaggtaggtaatgagtgaagctttgcggaatgaatacacgagggaatgagtgagtgagtgaatgtgtgagtctggcatcttccatcaaactgtgaccttcccagggccagggtccacattggactcacctctgaaatcgccatgccaactagtgctcctggttacctatgacgctttgaatgctcacctgagcgagtggaggagggagtggcgcccctgtctctcctcaaggtcagtgtctgtgcagagcagctccaagacccattcctctgggagccaggtacagggccgcaagctctgtcctcggcaccatctcctctggctcctccatgcagctgaccctccagtgcacagcagcagcccccagggcagcactggccacacagggaccagtggaggcaggctcctggctgtgagaccttgggcaaggccttctgtcccgaccctcctggtctccatcagcaagagaggggtggcaacacctggctggcgtaaggatggagcattccccgcatggccagctctcagggcaatgcctggtgccgtccagatgcccacaccgttgcctcctttcatccctccaagagcatcaccaggcaggtgctgtcattatgcccattttatagcttggtaaactgaggcacagagaggttaggtaatacatacaaagctggggattgggcccagacagtctggctctagccatattggaagggcattccccctcacccctgactactgggttcctgagtagtgagttgaagaccctgctcgtcagtgtgctgtgtgacgttagcaagccagctgtcctctctgttttggccactgtgttgggcttcctggggctgctataaccaagtgccacaggctacacggcttaaaccacagaagtgtatcgtctcacagctctggaggccagaagttcaaaatgaaggttgggca

SEQ ID NO: 443 - DNA, 2058 bp, Homo Sapiens
atgggatttttctagaaggccacgtgcatatgcaccctccccttccattaccccagtatccgccatcaagtagtaacatgttgtaacagaaagaatcccattaagtcctagttctggtagcccggtacaaattttagattttcccccaaaaatgaaaaaaaattatttaaaaaatttagatttgaaatgcttagaaaacaatcatttatttttttatgtcaaaatgtccaagtaaattaatggattaatttccatgcttctggtgatgtaacaccacttggtggtggcgctgaggaaaccctgggaagtgtttttctcttctgtgtaatgaaagactcactgacaaagccgtcggtatccagaatgactgctcttgaaatgatattttgatgatgatgatcagggaagtagcctatgctgatttatttatcatccccccaccccaaccccacttttgtgtcacaaacatttgaaacacccagtgctcaagaatgctgcttttccaattctgctaatatcctctctccccatctggaaacaaagttactaaacctagttttgaaaaagcaatggaaatgaaagtgtccagtgaacttactggcagttgtgcaagttgaaagcttattccttacatcctgagcctaaaagccttattccttatatccggagcctaaaagtttgctcaaaagtagaaaactttccagacaagatcacatacaaaatggttaacatgaaatgctaatgaagaaacaaggcaagaatgaatacaagagaaatggaatctggggaaaaaagtaggttctctaactggggcagggatcttgcttcttgggggcatatggttggatcccaggtgggccacgaaaatcatcttggatatttgtttacaggctgattcctgagtttccctccaaagattctgagtccacagatctagggtgtggaccgagaatcctcattgtaacaagcaccctctgcccccgggacattttaaggtagatggagaactaaggtgagagtgtgccagctaaatactctttcctttgtccctgtgcctcagtcttttttgtttgttttttttcatgtgacactcagtaggaaagtctagttcaagaaccggaaactgagccgggcatggtggtgcgcacctgtagtcccagctactcaggaggctgaggcaggaggatggcttgagcctgacgcccatgccgctgtgagctatgattgcaccactgccctgagcctggacgacagagcaagttcctgtcttaaaaaaaaaagtaataaaaaagacatttaaaaaaaaattagagctcagtgacctgtgactcactttgccactttgtcattttcttgacttctgtcccaacgccagccctgtaatatggagataaagagtggggaggacagaactctgaaacctaaaaggcaagatttttgctaaaccggagaacgtaaaaatacattcctagaggcaatctaaccagccagataaccagaagtttactcttcaaagccaagaatcagtacccccacctcaccttccattctctcttaggctttgtctatgtctctaaggggagtttttcagttgactgatgaggtcctgactggtagggaaagcctgcagggaaatcctgtggcaaagcacactcttgatcacctacttaacaagaaggtctagcaggacattcttgatccaggtcagcttcttccctgaaaataatacatatttttaatttctgtttgaaaaaactccactgtgaaattactctgcttatattagaaggtatgaagacagtagttatgtactgttcgtttgcatacggtcattttgagatagaaaaattaaatttttttaggaaaagaatttcaagcaactttctacgaaaatacagcttgtggttaaatttcctaatgaaagaggaattattcactgaaaaatttgtctaatctgtgccacctcaaaataagaattgtgcctcttcaatgaatgttgtatatgagaatgttacatttgtaacagcacaggaaactcaataaattataaatgaatta

SEQ ID NO: 444 - DNA, 2724 bp, Homo Sapiens
tatgtaacctataatcttaattaaatttagcaaattgttttactgtaatttcctgtttctgctccagaattccatccagaattacactttgcattttgcttacatgtctccttactctcctttaatgtggatcagtcttgttttagtctttgcctctaatgattttggaacttttttcaagagtactggctggttattttgtagaatgtctctcagtttcgatttgtctggtgatcctttttgtttgtttgtttgttttgagatggagtctcactctgtcccccaggctggacttcagtggcgagctatcctggctcactttgcaacctctgcctcccaggttcaagcgattcacctgcctcagcctccccagtagctggaattacaggcacccgccaccatgcctggctaatttttgtgtttttagtagaggtggggtttcaccatgttggccaggctgatctcaaactcctgacctcaagtgatttggccgccttagcctcccaaggagtgagccaccgtgcccggcctgtctggtgattcttcatgattaaatttaggttgccagtttttggtgagaactcctggaagtgatatggtgtcctcctcactgcattatattaggaggcatgtggtgttgtcctgttacttaaccaattatatttagatagtgcattatgctgttaggacttctgaaaacacaccccatggtgcaaaatacccattgaatcttttttaaggtatatgccttaagattatgattactttgtcaaaggttacaaactaaattattttgccaaagtgctttttaaataagctgcctctgtttatactgaataggttgcttcttcaaaggggaaaataggatcccagctctgtaacttgtaattttttttcgaatttattttcattagttggcttcttgtgttctagttggcaagcccaaatctcagcacatagcacggtggtttgagtgtatagtggcaggttggctattcttcaggactgaggtgaatgtacaaatacttaatgattgagttcttgttcataattttggggtttggtctaaggacccttagtttataaattctctgattactttttaagaaaaaaagtgatcttgaatttaaagaaatgtaagggatagtggtggggtgggaaattcattatgttagaggagatttcctggcattggaagggagattttgaaattaatgctgtagtgaaacacaagaagattaaggtgaggaggaggctggtcatagttttgtatttgaaatgcctgtcttgcctcttagttagtagaattagtaccataatctaggacccttgacttcttaacaagtttactctgccttgcaacctcacactctcttccagttctctctgcaggatttttcttaggttcttctttgttcattacatagaaacctggagcttatccatattaggaggtgcttagcctgcccctttgctgctgtttctgaatatatgtgtttagttcagcactcacatattttaaatgagcaatctcttaggttttcagagaagtagaacattgttgtgtctcttacagcagaatattcattattgaatgtagtgtcaacctgaatttctatcaggttttgtcttaactatttaggaatttggtaaggtaatacactcttgatgatgaagactttctgaaaaatagtttttaggatgttgagctattaaaatatcctccaagatagttttaaaatgttttatttaaatgaagctattacagttatgcgtatattattcagtcagggagtttaatatttttgagtgcttaaaatgtgtagaacgtgcctttattagagcctatgagtaggttaagagtatatatgtgtgtgaaaagttaaaggtgcaaaaccataattgtttgttttatttgagatggagtctaactcattggagtgcagtggcacaatgtcggctcactgcaacctctgcctcccgggttcattcaagcaattctcctggctcagcctcccgagtagctgggattacagtcgtgtgccaccacatccaatttttttttttttcccagtagagacggggtgtcacccaggctggtaatctttattttaaattgtacttgctcctaagaatttaggtgttaagagcatagcatgtagaaggaaaaaataaagctgctgtaacctcatcctgccttcttggaggtaatctctgttagtcctttgtgtatcctgggaatttatgtgcaaagtaaacaattctgtccttgaagaataaggatcatatacttagtttggtaaattgtacaaaactacacactttgatgtatatcttatgtttcattttgacaggtacctccttactcttttgttttttggagacagtctcgccctatcgcccaggttggagtgcagatggcacaacctctgcctcctgggttcaagtgattcttctgtctcagtctcctgagtagctgggattacaggcgcctgccaccacacccagctaatttttgtatttttagtagagacggagtttcgccatgttagccaggctggtctcgaactcctgacctcaggtgatccacccaccttggcctcctaaagtgtgggattacaggcgtgagccaccacaaccagcccgtacctcctcactcttaatgtctgtatagtattctattatttgggtatgtagcaacttacttagccagaccctcctttt

SEQ ID NO: 445 - DNA, 2321 bp, Homo Sapiens
tttggacaggaaagttccaggcttcagctcccagaaaccaccttccttcatgtggagggacgcagcctcataagggctggagtgctgtggtgccatcatggttcactgcagccttgacctccagggctcaaatgatcctcccatctcggcctcccaaagtgctgggattacagatgtgagccactgcacctggcaagaaacttttccattaaaacacaatgctccgaaaggtttgttgcaggtaacgcgttccttgtattcagcaagggcggtatatctgcagtgtcttcttcctgggcctacactctgtgaaggtcaatctcatactcaacccagtgtgctgagaaacaggagagtgactgatacaaacaacttatttgagcatatttacctgaaacagtatttaaaaaactgagcatatcttatgacaagaatctcatgctttaaaactctaaactatatccctatgcaaattactgacaatatacgttttaacatcagcattgtacttttaaccttaggtctagggttaccaagtgctgtggcactgctttgataccttatagtttccagttctagtttacaaacataacatgcctttatagttctcagcgctccttaaatatgtggattggaattctaattcctttaaatttcatgttgagttctcagtttctctgcagctactatagctgctctgagttgatgtaattcaaagtctctttaaaagaagctagggcatttctctgttatgcaattccttctgttgcattggagaaacaccgagtaatgcagccacgttgggaaatgctgtcattcccaaatctaagtatcctttaatgggacctactgaaaaaagaagaagaagaagaagaaatgccagtacctttcttccactgaattgctttggacacatgctgctgctgttgttgaactcactgcttttgtatacgaataataagtttccaagctgtggggaggaagacccccctgatgacttacaacccctctcagatcccatgaccctactgcctccaccatcagatcccacagcagcggacttcggggatgccgtgagatccaggggtgcctgggaacggtttgcctctccctctgtgccctgcccagccctgcggcccacgcgtgtgcgtgtagcacagtttgttcttctaaggacacgttccagaattactggagtctcctgaatgctgagatgaatagactgggtgagctttaggtgctgcacctgtccttcaaaatgaaactgaacggaggcccgcagagtctccccgggaaatagggactgaggatgcgttccatctgggttatgctttcatccctgcagcccctggtctgcccccctgtcctcagaaacagctcagtcctttcggtgaaatcggtgaaatcggtggttctcatcttctgtttcttgaacacacgtcttgttcccacccatcggttatggttggagaagcatttcaagaaaacacctgttagggctttttgtgtgtgttaagccgctgtgctggtgtgctttagaatcatccggaaggtttgttaaaaccagagtgctgggtctcttccctggagtttctgagtgtgcaggtgtggaatagagctcaagatctgcgtttctaacatgttctgagctgctggtcccagtactacgctcagccaaccagccctccagacttatatgcaatgagccctgtggctttacacggtatcttgatgaagaaaatgttatgtaaatcatgctctaaaacaacgattggatttcagtgcaattacagaaaaccttttcatcaagatgtctatgaatgaaatactgattttaacaggctgcccattttcaacagcataaaatcacgcattcaaaaccatgatgagccccttaaattttaggattgagtttcacttcctcactgacattttgtgaaaaataacacccgcaagaggcctaaacagggcgatcggaaccaagaaaacttaaggaagtatttgcacgttttgatgtgtttatttatttgggatgcgcggaggctctgaatggagaaagtcgtcgatgcctgcactggtcttggcctgttctttatgttccgcgcggtgacagctttaagatgaaggaggaacataaagggtttcatcacaggaaatagaactattgctttattcaaacatttaaaaaataaatacaataaatcagggatttttcccctttccgagtattaaatacagatgtactgtatgcatatgaaatttttgattaaaatgtctttcaccagtctgtctctttaattaaataaagcctgtttggtatt

SEQ ID NO: 446 - DNA, 13477 bp, Homo Sapiens
acagaagtggttgggcgtcgtgaggaacgcatcggcggcagaacactcaagcggctggttgttgagagcacgccagctgaagagcacccctgcacactggcaggccatccacaggtgtcagaaactcagctcagctggaagaaacttgatgtaccaggtatcagagtagcaagtaaagccacaagccaaaaatgaaagagaatcttttaagtgcttatcgtgatggtgtaagtaattgtccaaaagaaacgccgattccttctgttccatttttacctgtggattgtggattgaaataaccattggaccatgaggagagactctgaagagagagactgcaatgtgctgactgtgcaccaagtctgttccagagagggtgactaccttccttgaggactgtcaggctagtgatatgtgatataatactcttttgtgacgttggaccatggcagtgagccgcagctcccagtcagcaatgcgatcccaagaataaacaaccgattcttgacagtgtcctatgttgccagtcgattttgttcaacagtaggtacatgcaagtacaccccactcccaaattaaaaagattgaccttagccaaacataacacgagagagaggcagaatctcactctgtcacccaggatggagtgtggtggcgtgatcatagcttactgtaacctcaaactcctgggatcaagcagtcctcccacctcagcctccaaagtagctacgactacaggcaagcaccacctaatttaatctttttatttttttaaagacaagctcttgctatgttaaccaggatggtgtagaaatcttggcctcaagcaatcattttgcctccacctccctaaatgttgggattacaggtgtgggctaccacacttgtcaaatgatttcctttcttttggacatataaacatcaatgggatttctgaataatatggtagctctatttttacatgtttacaggaaccttatactgttctccatagtggctgccttaatttacatttctaccgtcagtgtacaagaattccccttttctacctcctcaccggtatctgttatttttgatacctttttgatataaaccatttcgatacaagccattttaactgggatgagatgatatttgattgtggttttgatttgcacttctttgatgattagtgatgttgaacatttttccatatatgtatgggccatttgtatgtcttcttttgagaaatatctgctcagatcttttgccaatttttaaaatcagattatttgctttttttaaaaaaaactattgagttgtctgagctccttatatattctggttattagttccttgtcagatagatagtttgcaaatattttctcttactctgtgtgttgtctattcacttctctaattgtttcctttgctgtgcagaagctttgttagattgatgtaatcacagctgtctacttttgctttggttgcctggggttttcaggtcttaaacacacacaaaaaatctttttccagagcaatatcctggagttttcccccagtgttttcctccagtagttttatagtttcagatcctacatttcagtttttaaaccatgttttactttcatttattggttggtgagatacaggtgtctagttttattcttttgcataaagttatacaaaagtctatatataccagtaccatttactgaaagtacttgcctgttcttggtgcctttgtcaaagatgagtgggttgtaaatgtatggatatatatctgggttctctattctgccccattggtctatgtgcctgttttcagtccaatgccatgatactttggttattatagctttatagtaaattttaaagtcagatagtgtgatgcctccagctttgttcttttggttcagaattactttagctatttggggtttctttcttatggttccatataaatttggggattttttttctctttctgtgaagaatgtcatgaatattttgataagattgcactgaatctgtaaactgattttgatagtgttgccatttgaacattaatttttttaattcatgagcatgtaatatcttttcatttttctctgatgaaaaagtgctcaacatcactcatcatcaaagaaatgaaaatcaaaccacaacgaaatatcaacccaccccagttaaagtggctcatatcaaaaagacaggcaataatagatactggtgaggagatggaaaaaggggaatccttgtacactgttggtagaaatgtaaattagtaaatccactgtggagaacagtaaattccattgacatattttatctatgttcatcaggaatgttggcctgtaattttctttttgttttgaagaaattatatttctttcatctgagttttatagtttttcttggatagatctttcacatcattagttagattcctacatattttatatttttgtaactattgtaaatgtgattgctatcttgatttctttttcaaattgttccctattggtgtgtataaatgcaactgtttttgtatgttaattttgtatcctgcaactttactgaatttatcagttttaacaggtttttgcttttgttttttctggaatctttaggtttttctagaagatcatgtcatcttcaaatcaggctaatttgacttcttcctttccaatttcgatgcccttatttccttttttgcctagttgctctgccaaagacttccagggttatgttgggtaacagtggtgaaaagtgagcttccttgtctccttccactatttataggaaaggccttcaatttttccctattcaaaatgatgttaaccatgggttcatcatatatgacctctattattttgatgtattttccttgtctttccattttgatgaggatttttatgataaaatgtgttgaattttatcaaatgctttctgatggcatatattgaaatagaaatcatatgatttttgttcttgattctgttaatgtggtgtattatatttattgatttgcatatattgaaacatccttgcatctctgggacgaatcccacttgatcatggtgagtaatctttttaatgtgttgttgaatttggtttggtagtattttgttgagaatttttgtatctatgttcatcagggatattgacctgtagttttcttttgttgttgtgtccttgtctggttttggtatcagagtatgctgatctttttgaatgagtttggaagtgttccttccttttcaattgttttggtaaatttgaggtagaattagtattggttcttctttaaatgtttggtggaattaatcagtgaatctaccaggtactggatttttctttgagattttaacatcaggcttaaatctcctcattattggcgttcgttttctatttcttcatggctcaatcttggtaggttgtatgcattcaggaattcattcgtttcttctaggttttcaagtttgttggcatacagttgatcattataatctcttagcctcttataatgattctttgtatttctgaggtctcagttgtttgtgtctccttttttgtttctaattttaattatttggatctctcttctcttttttagtctatataagggttcatctcttttgtttatctttttagaaaaacaacttttcattttattgatcttttctttggagaagacaagatgtttattggtgcttctccttgcacctctatttatgaaagcattcaaaattgctttgctgatatgaaagattaatttattggtttctctgacgtaagcttataatttatttaaatctaaattgtgcaaagacaatccaaccttcgatgaacttttaaaatgaagttgtttgaggtccggttttcctagatacaaaggatacatttctcaggaatattttaataatggtttaatgaaatagcgtcacttaattcttatgttttatataagatattttaattaagatgtgccaaaacagttgaagacaataattaacacaggaaaactacttcaaatatatctaacatacataaaaccaattttaaacatgtagacatttatgtttcatagtttacaaaagtgatggtcatgtgaaagaaagtgtaatgtaattaaattttcactttagtttaggagaatagtatctataatattgaaatctttgtctaaaaatgctcagtaccaagtaaaattaaatatctgtaaaattatctcaaatatcttaatattgtctgcaaagcaaaaggtgattaactctgcatatcatttttatttttaaattctaacttgtaaagcgtagtaaaattttcctgtgcaacacacacatatattgtcatgcaatgtaatatttattcaaaaacttagagagattcatcttttattccttgaggcagaaaaatgaattatttgaactaaaagaaaaatggacatgtgctcctgtatgaggaatatttaaccccatgtctctgagggtgtttctgtttaaattacatcactacagttaaacatatataatataccatggtaattgtgaaacacaaaattcatacctactgaaccatttccttgataatttttctctttgtacccctatatatgaaattctaaattctcttacagatattagagattaatttattaatttgtctgccaaacctgagtttataatttattcaaatcaaaatcaatattactatatattactttgttgtctttcagagatcagtaattatctgtgagagtatagtatttagttttaggattattatacatatagttaatcataatctttaattaggtgcagaaaattgtgtagttttaaattcatatatttggctgcattagttaaaaggcgctaggcattattttgttcaggtactttaggaaaatatcacaaatgattactttggaggatgataattgagtaggcacagtgtgaagacaatcagaacagtagtaatagaaactagaagggcctccctataaagggagagtatgagggactgcctggagatcatgcttggtcatagtgccctgggaagactccctaactacacaaaaggtacacacttacgaaattacataattactgaaatgacagtaaattcaaagagaaatgaattgcattctatgacaaaatgcatatgaagtcgagcatcctatccaacagggaaagggggcttctttatattaattcaagcatcaatagcatttagggtactctttccttttattatttatttaaggtttgctattttttttctttctgatatactctataatttgtctaacatacaaagaaagattatacagttttctacctctttgactatgaattatttatatcattttacaaacaatttaaattacaactgacagctgctaaattacatagatatatcttgatagaaacaaaatgctccttgaaataaatgacatacttagatgtatttctttttcaatacaaacatatgttttgtagtacttttcgtataatcttatctgttaaacttgagcaagtagaagtgccttttattatagtagtagaaatacttgtattttgtgaaattctcatacattgatgaaagtatcatagttgtctattatttttattataatctttctattctagcataaggctaagcccaatatctgtgctcagttaattactgttaattttttgttgataggtaaaatttgtaaattcaattttggttttatttttagaaaacaagtttctcaatgtctgtggttaattgcgttatacttgtcttaaaataagtttatgataacactgatgtataatacataattaatattttacttcagcttgagtggaaaaatgaaaatcattatatagtttaaacattgttttggtagtcttgattaactgacatcttgccattatcacaattacaatagtaacagtaaaatttttgcaaaaagttacaatttatattttcaactataattattcctgtggtttaataggttttactacctctccctgaactgaaagagaaactcactaataaaaagtttgcagtgattaattagaaacctgttgtaacccatcttttgaagacagataaattgtcttttcattttcctcaagataaagttttatagtaatttattttttcttccatggcaattcatggcttggaaagttacttttcttgttttaatatagttcaagtttacagataaaaataaaaagttcaatttggttttatatatgtgtatatatgtgtatgcatatacacaaacacacagacacacacacatatatatatttatttatttatagagatatccatttatgtagaataaactcactcaagcttatgttctgttaacttgccagaatatctgagagcaaagaatgtccagtgctccctaaaacttttcacaaagtcattcactggaagagggtctttaggaaatgagttatggtgctaaagaaaaaatgtgagcagcaaatcctctctcaaatctctacctatatttatatccatatggtcattaataagaaggattccagttgtctttctcatcatcagtcttaagtaattgtatctaaatttaaatgtaaagcccttttaaattattttcaagcttttctgtttttcaaaattatggtgtcagatggtaaattcattacacttacatggagaatacattataaacgttaattactgtattttgctttacatgaaaccaaaggttttgcatgccttggttgatatataatggcacttcagtgatgaaaaagataattatacaaatctgctggccccgacctcaacgtctgcactgaattatttttctagatacaataccatgtaaatacaaacaaacaaagcaaacacatcaggtatgatattgaaaaaaacaaagaaaacaaaagacaaaaaatagacaccttccaaatattttattctctctaaagaatactttattctctcccaaaacatttgggagagaataaaatatgtttcttggttggatcacaaattacagttcaagtatcttgtcccaatgcctaaaataacttttttttgaaatttttatttatatgtactcttgacaaaattgtcaaaatcaaacacataactcattaaagacaaggactcaaattgtgtatactgatttaatctcaataggtgtgttactaatttaatgttcacttcatcatctacataagctttttaaagtggctaacatcaagaataaaataaaatatgagacaaatttcttgaaagaattatattatgtgaagccaatcttgcttttcttcgaaacaaactggtattttagtgagactttccacatatttcacattgaaaaactgactttataaaggcaaatgttttgacatttaaaatatgatcaggaagagatgtgggtaattcactgagcattctgtgtctcaggtttttctctgtaaaatcagaacattaagtaaaattatcttatgtttttttgccagcactcttccaattatggaacagaccagttgagtagctctaggaaatccaaattgtttctcagttttctcttttgcaaatccctgttccatcaatgtcaaaaacattttgtgaagataattatgattaaataagtgttaacaattttttaatgcctaaagatgtgataggaaatggtaacaaaattattttctataaatttatttataatttttatacttataagttaattatgttatttaactttttaatataaaacaataactccaaatatatttttccattttactcagtaaatttaatgctatttaataacaaccatgttctgtttgttatgctagttatctccatttgcccccaaaacaatgtatctagaaatacagtgatacaagaacaatttatttcttcaacaagaagaatgatctactgtttgtatcaactgtttaccgtctataatcacttaattttccatctatgtttctcatgcaaattaaagttaatttccaacagtttatttctgggccagacctctctcctgtatttcagattcatatgtccaaatacctatttaacatctccaattaaatatttaatggatagcttatatttaatataaccacaactgtcaacattttcacctgtatcatccaccattttactaagataattccatttttgcagttgttcagtctaataaatttagagtcatgcataattcttcttaagcattcaataatcaatcaatctatgggggaatcttgttaatgcaaaactatgtacaatctattttttgtccctctacatctccatctacccccatgtttcaaactaccatcatctcttacttagataatgtcatatttttcaactttcacactggcccacctcaatcgattatcaacaaagaaaccaaagtgctgatgatattattcaatcggtactccctacttactttccatctcactcaaagtaaaatccaagattcctggaaaaactcataagttcttctccacaatctgacatagcgcatgtctcatttcctctctgccatcactcttgagatttttccttcacttggtccactgaagcctcagccttgcttttcaaattttccagacttgctaccctgtactcgtttcctatgagtgcaatgttctttctgatatccacatgtctcaccaattttccttgtagtactctctacttactttccatctcactcaaagtaaaatccaagaatcttacgatgactcataagttcctctccacaatctgacatagcccatgtctcatttgctctctgctatcactggagatttttccttcatttggtccactgaagcctcagccttggttttcaaattttccagacttgcttccctgtactcatttcctatgagtgcaatgtcctttctgaaagccacatgtctcaccaatttaccttgttcatcattttgttcaaatgttttctcaaattgttgccttccttaatcatattactagaaatattccaagcactccctgtttttcttccctgcttcattttcctccttagaatcatctaatatcctgtatatttttactaaaacatagtttattgtttctctcacccaccagaatataaattctatgagactagaaatttttaactatcatgcttacctctaatgccagaaccgagatcagtgcctggcactgaaacaaagagagattattctaattatttttcttttaaaattcttctgttgattactagaactgcaaaactcatctcaataaaaagtctatggcagttaaaattatattcatattgctttttcttcttagtcacttacagtgatttctaatataacaaaatcattttaaatgtgtattagaatatggatatactttctgtagcagcccgaaaagaaatagaaaaatatcacagtttgaaaccatataggtcgttttggttgttttgtaatttttattcttaaaagacattacattattataaagacattgtaaactttacccataaagcttgcagaatgttgtgcattaattcgtaggatcagaattaacaataaaactcaagcaccatatttgtctagaaaaaccacctctcagctaaccagtgaacatggatataaatagaccctgaaatctgctcttggttaattcactgacttaaagcactgtgacagataaaacaagttaaacataattaagaaggctagcatattatctgggattctagtgcaaaagaaatatgaagataacctcaagaggatgacctaggaggaagacaagactctagccaggattttgagtgcttactttataaagctgtctgtaacatctgtagcagcaatgttcacaatagcaaagacttggaaccaacccaaatgcccatcaatgatagactggataaagaaaatgtggtacacatacaccatggaatactatgctgccataaaaaaggatgagttcctgttctttgcagggacatggatgaaactggaaaccatcattctcagcaaactaacacatgaacagaaaatcaaacaccgcatgttttccctcataagtgggagttgaagaatgagaacacatggacacagagaggggaacatcacacactagggcctgtcagggggtgtgggtctaggggagggatagcatttgcagaaatacctaatgtagacgacaggttgatgggtgcagcaaaccaccatggcacgtgtatatatgtaacaaacctgcacattctccacatgtatcccagaacttaaagtataattttaaaaagccatctttagaagaacttatgaatggtaatattatcagaagataagcctaaaaagcttaaatgtcttaaattcatttttagttgtattgtatgttatatactctggggaaagaaggatggagatcatgtaaaatggactaacgattttccttctctgcctcaaacactttttgtcagcattatcacaataagtatagttagttgtatgttgtgctaaacacattaaagtcttcttattaatacccattttaaccttatgtggtaggttttattgtcagtataaatctaggttaaactttttaaccagagtagatgatggtttcagggccaacactagtctgttgtcctcctaagccctcttgaatattatagtatattcttcccatgggagtccaagaaaagcctggaaaaaacaagggatcaagggaatggaggaagatgttttgtgggaagaagatatatgagttgtacttgagtataaatcatgcatagtggtgtgctatgaagtctctccacacatgaccgagtttacctcatagagccttcaacaaaatttcatatctgattttctttgaagtagtctgagtattaaagaaaagaatggaaatttgatccagggttaattgcagagataaccagagatggctataaaaatactataactatttttaagctagacagctatttgtcttttaatataaactcagtaattgatatgcctaaacattctgtccaatatcagtgaatatttttctgacttatgatttattattttaactgacagataaaattctatacattatatgtcttaaattatatatacatgtggaatgactgaatctagctaatagaaatatgcattacctcacatacttgtcatttatgtggtgagaacacaagtgttttaaatatgtttgccaaatttcagttaaaaaacagaattaaatttaaaatgcctataattcacaatgtggccataaaaattaatcggatcaaatggatcaaagccattcaaatatatccttattaactgttcttgatatggtaaaatgtagctcatattgtttcagaatttgattttttagatgtggttataattctgccatacaaagaaagctgcatggttgagagagatttcaattccaaacttgcagtacaaaaacaacactgccacttaccagccctgccacaacttgcaaatcacttaagctttctgagctccattatattcatctaggaagtaggatcaatgcacaaaatattttcagtgaatgcagagtaggagatgacaaaaagagccatgctctaattccactccacatgaacacttaagatatttctctccagaaatcacctgtagacaatagaaaaataaattcatacccacttagttaactgtgtgagaatgtaaatttaaagcatttttgactagggaaactttatcataataaaatgctttaatttccctgcgcatgaaatatttcccccaaggaatgtatctattaatggcatgctatgattaattaattggttctgggaactattataccatattagtcactttcacattagtgttcccaagagtggtgaataaataagacagtcactgcacttctacatgtccattttctgccaagacgttttgctgatgtgcagtttctgtgcagtttcccacagtgtacttctcggctgacttagttcaagctttgttagtttaatgcttagaaaagcctcatgttcttgcagaaaatcttttgctctcattacttttttgtgatattatggacaacaatttccctagggagcatggcaattgatcccagcaggattatttacggtgacatggtggcactgttgccaatgggggcattgtcaaagggtaggctccttcaatgtcaattttaacccagcagcaaattctgcagtactaaataattctgtctattttctttctagtcaggtaactgctgtcaaattaaagaggtcttcaaaactcacagcacagttttgctttttcattactacatctgcaatttgattggtgttatatattttcttgcatgaatgaacatcaattaaaggagatgaacatttataggaaatttattcaactagagagggttgcaatttttacatgtcaaccatctgaattcatattgcagtgatatttttggaaaacaagaacttgtagattaaataagttttattagtatttcaaataaaataaaataattttcttaaaatattaaagcaaaatcactgatatatgcctattaaaatattaaattaagtaaatatggtattactactaaaataacttacatttctgacacgtcacttacattttaattcagccttcctaataatccaactatataccacatattgttatgatgaggtaactaatcctcagagatacagataaccttttcgaattagtgtatatattaagtttatgatggaagtttttgacactacatttaacattttttttctatgctacgttggtcctttcccttcaaaagctcttgaagaacattgaaagaaggcaacggccttcatctgcatttcaaccatcaaagcaaccatcacccttgttcacatacctatcgtgagacaaaaagaaatacttacattaatttctaacatcatctcacagagttaatattttatttgtgaacattttacatccactgtcagcatttttcaagaacacaatatattggtaactaaagtcaccatgttgtaccatagatctcttaaaattttattcctcctatctaactgtagttttctatcctttgatgaacatctttcaaatctcatttccaaccactccaacctctggtaattacccttctactgtctacttatataagttaaactcttttagattccacatatgacagagtttatgtggtatttgtcttcctgtggctggatttttgacttaacgtaatgtcttccaagttcacacttgtcacaaatgccagaatttccttcttttctgtggttgaatagtattccattgtgtatatatgtcatgttttctttatccattaacctgttcatggacacaggttgactccagatcttggctactgtgaatagtgctacaataaacatgggagtgtggatatctcttcaatacactggttttgtactctctctctctctctctctctctctctc

SEQ ID NO: 447 - DNA, 8098 bp, Homo Sapiens
agacttttgagatggacttttgaaagagtgtttgagggaactgttaatgctggctgtactgacctgcagaagatggtgcaactgggtctgaaaggtggacactgctgcctccggaccgctgtcaaagcaagaatatcaccgtgaagcaggctgaaagaaatgctctgaagggaaagctaagacattttgatgaggactatgtttctttctgctataaggaaaagccgtggaaacacacccggattgaaatgcccctggcccgcctgacccgaccctaggagaagcagccgagttacccgacatcgtggtcagcaggagctgggtcggtggctggatgctgcagcagcagggactcagcgcctgggagggctcctggggcagggagagaagcagagatgcaacatttttaaaatttcacaaagcatccggctgcacccaggtccctggaacaggagacaaacagaattaatgttttataccttcgggtataggtttgagttttttccccctcatgccaagtatttaaaacctctagaaacccatgatttgacaatcaatgattgcgcgatactttcaatttgaatattcaaaggcttaacaaaatggactatcttctgcagaaatcctgcacacaggcaccccacagagagtccagagaaacagggagtgagacccctttgggtcctggcccttgcttttattatagtttgagcattttgtcctccttcccacagatagagcagatgtcctcaaagatgctctgtatttcagccttcagggcagctaagaagccatgagtgacttaggctgccctggccatgaacaccggagccagactggctggccagactgattcccgcatcccccatctgtgttttgaggggaaatctcaggttttgaggaatgaacatggcagctagtgggtgtggcacagcaagaagtcgctctgggcccaggtggcaggccagcggcctagcagaggccttcgctctgcacctcctatttttctggctccgcctggctaccagcgggcttccctccccctttcatcccgctcttcctgggcccgacactggggtttctgctcagaatgactgcccattaagaccctttcctcctccccacagagctggggatgccaggagcctcatcctctggagactttctgactctgggtttcaccaccgcactgcgaagtgccctctttgctttttcgccttctagagccacccctgcctttttgctgtaggagcacatgttaggaaacaatgacaagtttggctcctgctcattttaactgaaaggatgtggacttaggttcaagccttctcccattggggtgagaagggggagggacttgggatcaggcttcccccttggtccaggcccaagcccctcactaatgacttgggattctactgggtcatcttctgtgagtacttactgtgcctcttccatgtgatttggaaggtgaggagacaggaatggtccacagagggagagagtgccaggccaagtcctctcatagccacccgccccctccacagaaggggacagcaagagaagagagaggcatggtgaggttccttttgcaaataaccaagatatttccaggattcaagaccagtccatggttttaggcctctgctgtttattctctgagttctcagaaatgcaaaaagtgtagtttagccccagaggcctcaagaaaaagattggggtgcccccaaatgtgtcaaatacagagggaaacacacagagcttagggaaagggcaactgagaatgacaagactgataggaattgcttggcagctgaagccacatctctgggggagaggagcaggcctgggaacacctgaggtggcacctggcagtggagggcaggatggatgtattgaaatctgacagcttctggaacttctttctacaaatgcccctgagcctgtgtcctaggtttccctgatggaccagacctgaggaggggaaggacaatgggggtggagatggcacctcccctccctgcatgccttcttcctcgctgtgcctaggccttgccccctctgaaggaacagtgaaccaagcagcttggaatctagggatggtctcttgtcctcatagcgtcttccattacttcttttcttcgctgctctcctcctttttgttatactcttattttttgatttgcttttaaaaaccttctttgttgcatttttgtttatttctttctgtgtttctttgtctctcttcctgtcattgctttcttccatttcttatctgtactactggttttctccctggcttcacgtgtctctgtgttcccctatgctggggtgtcctcccagtgctttcaggcttcatctccttcctaacctctcctttctattttttttttttttttttttgagatggagtcttgctcagtcgcccaggctggagtgctaacctctcctttcatgtggagatggacagggatggcaggagcactgagtgctcttgacaacaccattgaagatgatgctgacgatcagctaccctgtggagaaggcaggccaggctgggtgagaggggagctccttggaagtcagggggtctgtaaggacagcaaggatctctttgtcccaacctccagcagcctttatgggtgcttctgtgttggccttgtttctgggatggccatctcagtgctgttgctggctagcgatttcagaaaactagatttttctaggcctgagccctgttttgagaaagaagcttccctctggtttgtagctcaacattaatgagttttggttcctgttgtttctataattacaaaaccccagcacaggtatttaagagccaaaggccatgcttgtggaagtaagggaggatctttctaaatggatcctgcaaatcctccttacagatctgagtggatgatcaggcccagagcaaccctgagaccccaggtacccacagcattggctgttcttcataggagactcagagaagacttcataggagactcattattgtttactggacatcaggtgctatattgtatagcattcacattccacaggtgaggaaacaggctcagaggaataagtggcatgccaagatcactgagtatatcagtagcagaattaggattcagactttgttaggcctaactccaaagccctggctttttttttttttgagatggaatcttactctgtcaccgggctggagtgcagtggcatgatctcagctcactgcaatctctgcctcctgggttcaagtgattcccctgccttagcctcctgagtagctgggactacaggcatgcaccaccacgcccagctaatttttgtgtttttagtagagaggaggtttcaccgtgttggccaggatggtctcaatctcttgaccttgtgatctgcctgcctcggcctcccaaagtactgggattataggcatgagccaccatgcccggcctttgctcttaactactgatgttgtcttcctgatcttttctacaagaagcttttaaactttttggactttaacctacaataagaaatccattttacatgttcacatgtatctataacaacatttatatttctaaaacaaacttttcatgaaacaagatatacctacatatgtcaggcactctgatattttctattctagtccaccttttccatttcattctatttatgggaaatatatgttggttgggagtcactgagttaatttaatgacccactaataggctgtgagtggcattggaaaaatacctgcttgtaagatatgcgaacacacgtttcaaggttgtttgtgcatgtggaaatattttggggtgctatctgttttaccatcagtttgtacaaggacactaagacagtgtagcctgctgacttgagaatgttctgtaaggactggaaacactagaatcttgaagaaacgcctggctagaggtgagggtaagctgttaattacactgattacagtttgtgcctctcagactgagaactcttttcttcttgctgggggcattgctatctctaggatgtttgccctgaagtcctgatagtctctttggggttttaataaatggctgaaaaaattgttgtggggtttcaacaggcgttcataggcacccttgcttggcaatataacatggcttttgatgtttgggtgttggaagggatctttgaagtgctgagagggactcagtctttttccaaaatctctgcttgtgtctgtccagcctctggctccactgcttggctgagatcctggcccatagtagaatctgtgtagaggaaacgagagctcactatttgtgaggcagcctgttccactattggactgctttaaatgtagtgatcagtgattatgctataatccaatcatgtattaattgggcaccaactatgcactaggcatggtatcaagtaccaggagtacaaaaataagtaaaccttgatttctgctatcaattactctcttctcctacttctgtactactgcttttctattgtgagtttgtttagttcattaattggtttattcattcattcaacaatcatatactgattagctactctgaccaggtccagtactaactctgaagaagttatgcccatcccatcttcaccccaagccttctccttttgagactcctcatccagtttctttagttcttcatatatcactgtttttcagatctctggctatccttgccattgacctcagaaatcctgtatttgaccttaaccttcttatacccagtccatacccaaagtgatggaaatggaatagatttctttttaaagttttaaacgaatattttgactgaaaaattttggcagtcttgtatgcaaatgacactgcagagcattgttttctcccccccacgtaggagattttattcaactaaggcacaggcatattaaaagactttcagtataaggaaaaggggtagtttattccctccaaatttgactacagctcgaaattgtctttattaatgcaaagttcttttgtcaccttgactttgggacactgttaccaaacctcgtgggaaatatcaagttccagaagattgaatacatgcaggaaacaaatgttttttgggccctagagtgaacatttggtccatatgaaaatgaccaggaagacaattaggtgaaggttttttaatgatttgtgctacgtcagtctcttcccataagacatattcaaagttttaacttttccttaagaggcttccatggggagcaagcatttgataattcatcctttaagaaaaacaccaccgtacactgcttgaagagttcctcttctattacttaaaacgtttttattgtgcaacatttaaggcatacaaaaacatataaagaataccatgatgaaaatctatgactgtattaccaagcttaagaaataaaacagttgagtgatctctcatttatgactaaattaacttattaaaaccattaaaacttttggattattcctgttaagatattttcttttttttattattatgctttaagttctagggtacatgtgcacaatgtgcaggtttgttacatatgtatacatgcaccatgttggtgtgctgcacccattaactcgtcatttacattaggtatatatcctaatgctatccctcccccctccacccaccccatgacaggtcccggtgtgtgatgttccccactctgtgtccaagtgttctcattgttcaattcccacctatgagtgagaacatgcggtgtttggttttttgtccttgcaatagtttgctgagaaagatggtgtccagcttcatccatgtccctgcaaaggacatgaactcatccttttttatggctgcatagtattccatggtgtatatgtgccacattttcttaatccagtctatcattattggacatttgggttggttccaagtctttgctattgtgaatagtgcctcaataaacatatatgtgcatgtgtctttatagcagcatgatttataatccttgggtatatacccagtaatgggatggctgggtcaaatggtgtttctagttctagatccctgaggaatcgccacactgtcttccacaatggttgaactagtttacagtcccactaacagtgtaaaagtgttcttatttctccacatcctctccagcacctgttgtttcctgactttttaatgattgccattctaactggtgtgagatggtatcttattgtggttttgatttgcttttctctgatggccagtgatgatgagcattttttcatgtgtctgttggctgcataaatgtcttctttcgagaagtgtctgttcatatcctttgcccacttgttgatggggttgttttgtttttttttcttgtaaatttgtttgagttctttgtagattctggatattatccctttgtcagatgagtagattgcaaaaatgttctcccattctgtaggttacctgttcactctgatggtagtttcttttgctgtgtagaagctctttagtttaattagatcccatttgtcaattttggcttttgttgccattgcttttggtgttttagacatgaagtccttgcccatgcttattcctgttaagatattttcttagggggaagtttagcaggtatatctatcaattttcctaatccaaaagagctaattcctagatactgtatgtttggtccacatttcattcctcttggaacttctaacattttttactgttcttttttttaattgtactaacaatgacattgcatattacaaatgcacgtatgttatttatcagagattataattagaggatactttttttttcttttttgagacagggtctcattctgtctcccaggctggagtgcagtggtgcaatgatggttcactgcagccttgacctcctgggcttgagcaatccttccgcttcggcctcccaaagtgctgggattacaggcggcgtgaactgccacacctggtcagaggatacttccatatcaaaaatcaaatataatataatgccatcatttgcaaataactatagaatattttaatgtttatttagcttgacctttggggattcttgttcctgatttatcatacttgttttagtcacaccagagataatgatcaaacattaaataacttttatttataagatttcttagcaacagatcatagtacatgtacatactaaatgaatatatcaacatttttctgtgctatttcaaaggttcagtaattttatttcataaaggtatctaaaaagactaaaccagtcatcttaaatatattaccactaaagcccaatatccacctactgtctgaatttggagagagtatggctaatgttagatactaaacatggtgagaatcctctcagatactggtttcagagagctgtcacccatagaaccaagggctaaaaagttactcatctttatggtataattttacttcaatctaacaaaaatttactgagcatctacagtgttctgggcctcgagccaggtgctgggacacagaggtgagccactcatgagtcctccccatgagtctctttagctggagaaccactttgtctagagtgtgtgattttgcacttaacctctctagagtctatggtgtgtgagatgaacagtgtaatattgttttgcatagagaggatactgtagacagaacccagtgatggagccttaagtaaagagtataattttggtgtgtggttggtagaatcactataatgtaatgtgacttaaaccttagacatcaatcattattttggtactttaaatataactgatgttttattccttgtgactacactatttagatatttacattaaatatcgaaaaactgatcacaaagatactataatacttttatacatgtgtgtacgtatgtatatatgtatgtatgtatgtcaatgtatgttttactattggcattagtaattattttccctttatgcaatttcttttagagtgcttctgtcttctcctcctacccaatagtaccatgaaattgtattattaactgagctatagcaagtcataatgatcatttgaaatcatttattaaataaatgaggtaaagatgta

SEQ ID NO: 448 - DNA, 1453 bp, Homo Sapiens
gacgactgccgttcagcacctgcgtaagcacctctcggccaggactggcaacactccagaaatgatggagacaggatacatcaacctgtatcactgaagatgatgtggagcagagcctttgtggtcctaagaaacatgtataagataaaaacttttgtggtttttcaatcatttgaggttttaggattgttcattgtatcaacacaacttgcctattctgactgctaaggttgttcactgggttattcataaaggcaaaatgaggttgtgagccacagaaagagaggacaggatggttccatggtgtccccagcttattttttattgtttcctgtttattgatctcatccattggagaactccatgaaagcacatatctatgccacactcaccactgtattatagaactcaaatgtcggttgcatgaataaaatatgtaacaggaaggccactatacctggccctgaccaattacaaatttagtttttcatgaggttttttaaagggcatccagcacaccacagaaccctgtgcacaacaaactacccccaaagttagcggcttaaaacactttctcccaattctgaattccgctgggtcgttctgcttagtgtagtatctactaagtctgggacatcccagataatttcttcatgcatgtctggtgctcagttggcatgtctgaaaaagctgggtttggccagacatctttctgtccacctagtttctccagcagagtaaccagacctctctacacagtagcttagggtgccaagagcaaatgttccaagagggcaagccctgatgtgcaaatccttaagcctctgcttgacaaatgtcctctgggccaaatcacatcggcccagagtcagtgtgggagaggactaactacacaagagtgcaaataccaggtatggttcatgggggcccccagtgttaacagtctacccaatctggtgatcataaggcagacaactgaagtcatgatgcttcgttttacaaataaaaaagcaaaggctcagaaatgaaatcacttgcccaggataacacatgttgtaaatggaaaacaaatatttgtttactggtaataagtcaaaggctagttaagcctttcactatatctcattgcccctaatctttaaactccactttccttttccttattcttagccaactgtgaatatctgtgttcaagaagttaacaatgtagataatccaaaatgaagtgtgttttgtagcattatctgagcagtagatattagatgactaatgtagtatgctctggaaactcgtaacagttcaaaggaaataaagccattttataatgaaaccactttaaaaatcctccactgttttcatcttcacgagaatgacaaagcaccaacttaaagtaaaccaactctttccccttctctgagcttgctgtatttcctaagaaggaaggaaaaagtca

SEQ ID NO: 449 - DNA, 2074 bp, Homo Sapiens
atatatgtaacgtttcccccccatcgattgctttgcatcgcttgtccctcaaactattttataagcatccgatgttttggctgcagggacgatttccagattagtctcgattacatttatttctaaaggatctcggtgtgttctgagcacacgcctgagagcggagccgggtagagctgagcagagcgcggcgagctaagttttctcacgggctcctgtccccctgaagcccccttggcgcctgccctgagcgttcgcaggcaaccgaggcagcgttcttcgggatgtgccaagcgccgcccgcccgctcgctcctccagctcggccccttcccctgcaacagaccacacggttcaagacgacgatgtgacagagagaaaacaagccgctctcttgtctgtgacccgcgaggcgaccgcggcgagcgggcaccagctccccactccgattaggcaattagctgattgctgcctgcccgcagcccgagcgagcggtgcgcggggatctcgctgcctgcccacctctcctgcaaacagaggcacgttctccgactttgatagctccctgggttcctgtgaaaaacaaccacagcgtttccagagtgtgtttctcaaataccagcgtcaggggatcgcagaattacagcagcaaatgttacgaggttgacactgctgttcaggtgaaggagagttcagagtctcagagagcagcagcagcttgtgcttctgggaaaatggaaggatgactcccaggcagccgatcctgccactccgtaaaatggaagaaccttggctccccgtgtgaattctctttgtgatttggaagacaaatacctctgctgagttgtctatgaacagatgctaagataagagtcgatggtgccgtgaaccaaggtactgacatagcagctggagagaagtgaatggatttcaatgatgtaagggagatgaactgacaacaaaataattgttgataagatctggagattgagagaagaatgacagaatgactgtaggatcttgatttgcgccaagtgaatggatgctgctcacttagaagaagatttttgttttggaaaaattctttttagatgaagcagtagagacggagtttcaccatgttagccaggatggtcttgatctcctgacctcgtgatccacctgccttggcctcccaaagtgctgggattacaggcgtgagccaccgcccccagctggatggtatcccctcaagcattactggccttgttccactatgtcaaatgtatgcagcagagaaaggggatacaccagcagctggagtggctgagcggaaggaaggacactagaacatattaatcccattttaagcaacaggcactgtgttaagtgatttcagatacaataccacatttaatcctcataacaagcttgcaaggagaacattgtcacgactgtattcatacatgaagaaactgaggctcggagacattaagatttgagccaggatctgtgttcttccaaagcccatgggtcagaaatgccagctgattctggttccagctagaactaccagacatcttaggccaggtctcaggaatccttgaggcaaaaatctgcataacattgaggccaaagatgagcctaatggagttggacctacccatttagtggtagacttctttattggcaaaatattctgtcaagatctcccctgatggacaagtcaaaattctttccaacataacaaagacctattgtcatcatgggaatgctgcgatcttgctctttcagctcaaaaatctactttctggaaccaggtcatggacttgcaggactttccatctacaattttgtttagggaattgagatcagatgaacagggccgaggaagctgtaggcagacagaattagtgataattctttcccacaatactgcactccattcttctaacatacctcaagtgcatgccctcggccaaaacagatctggcaagaggaagattaacaatgatgacaaaaatagttcctgacttgataaaacaaatatcaactgggacaagaacaagaactgcccataaaccaaccttgggatc

SEQ ID NO: 450 - DNA, 962 bp, Homo Sapiens
atggtaaaggtccaagtcaccagatttgtccacatagagcacctggactctagggcggctttaaaacttcaacaaagagtcatcatcaatgactccttcattgtataaacaacatggtgtacatattccagtatgatttaatacatggcaatttcagtggcactgttgaggctgagaacaagaagcttgtccacaatgggaaggccatctctattttccagaagccatatgctgcctacatcaaatgggttgatgctgtgctgaatatgttgtggagtccattggtcctggggctcacttaaatggtggagccaaaggggtcatcacatctgtcccttctactgatgccctcacatttttgatattcccaacttcaacacagtttccctcccagactccaagaaccatgagaagtatgacagctccctcaagattgtcagcaatgcctcaagtatcaccaattgccttcgccctctgataagtcatccaggataactttggcatcatgaagggagcaaagttcttatgatcactgataccagaagactggtaatggtccatctgaggaactggcatgacagggtggggctgcccagcacatcatctctgtgtctcctgaatctgccaggattgtgagcaaggttacgccagctgaatgggaagttctccaacttggctttctgtgtccgtgtcccaactgtgttggttgtggacctagcctgccatctggagaaagctccaattgtgatggcatcaagaaaatagtacagcaggtatcagagggcctgtaaggagcatccagggctacactgagaaccagattgtctcctttgacgttaacagtggtgcctactatttatcttttcatgctggggctgaattgttctcaaggaccactttatccagctcatttcctggtataataatgaatttgattacagcaagagtggcaaaccttatag

SEQ ID NO: 451 - DNA, 3968 bp, Homo Sapiens
tcacccacttaaatgctggcagtaactggacctcctgctcagctgggtgggtgcattgactaacagaaggggattgtctgggctcctccaggagcagaggggagaggggtctatccaggctgcctgctttgagcaactgcctaactccttcctcagtccctcggccccactcacctccagactgcagtctcctttttcattttaaagacaaaacttcccatcgacaaacagcatgtttatttgcagcttttacagctagcaaatcctttggtaccagggagcgcaggacccagtgggggaagagttcaggcttgggctgaatgcccaggactcagctttgcaaccagccaagagcctggaggcccaactccctgaaagggccttttctgggttgctctgatctgcctggtacccataactgtctgtgttttatattatgggcagacaaacactcagatgacgcatggcagcccaagttatgcttgtttgaaaatgcgtggcatttcataatcctgccggaacacactcttcttgctgcattaggatccaactggaaaacataaagatgaattgctgtaggctggaaaatcaattaggaaaaagaggtaaaacatctggtgttactcttagaatatgaaaattcattttgcacatttaaaataaatgtgttgagttgatttaattgcctgttgaactgtttcgtggaaaatactgggaagttgcattgatcctgggcattttgcagtaaggggcattgtcttgagttctcctttaatcttaatctttaatcaatctggattgtatttctaaggtctttttcacgtgagtttcagtagacttggaacttcagttttcaaagtcaagtgtgtattagaattacacggagggctggttaaaacacagatggctgggcctaaccccacagtttctgatccagtaggtctgggctagggcttaagaatttgaatttgtagcaaggttctaagtgatgacaagctgctggttgggaccacactttgagaactactggcttcgaataagggagagtccttgtcagtgtacagagtagggaggtggtttcctatgaaaatagattaaattccacagacttatggtgctatgccctgcagtcttgacttccttacacaacggagtacatagcttccagagagctttccttctaagataagccacacataactcctatcttctcttccctacattcttctgcaaaaatgggtttaatgcccttctagagattcatttctttctttcctttttaaggctggcagtaactggacctcctgctcagctgggtgggtgcattgactaacagaaggggattgtctgggctcctccaggagcagaggggagaggggtctatccaggctgcctgctttgagcaactgcctaactccttcctcagtccctcggccccactcacctccagactgcagtctcctttttcattttaaagacaaaacttcccatcgacaaacagcatgtttatttgcagcttttacagctagcaaatcctttggtaccagggagcgcaggacccagtgggggaagagttcaggcttgggctgaatgcccaggactcagctttgcaaccagccaagagcctggaggcccaactccctgaaagggccttttctgggttgctctgatctgcctggtacccataactgtctgtgttttatattatgggcagacaaacactcagatgacgcatggcagcccaagttatgcttgtttgaaaatgcgtggcatttcataatcctgccggaacacactcttcttgctgcattaggatccaactggaaaacataaagatgaattgctgtaggctggaaaatcaattaggaaaaagaggtaaaacatctggtgttactcttagaatatgaaaattcattttgcacatttaaaataaatgtgttgagttgatttaattgcctgttgaactgtttcgtggaaaatactgggaagttgcattgatcctgggcattttgcagtaaggggcattgtcttgagttctcctttaatcttaatctttaatcaatctggattgtatttctaaggtctttttcacgtgagtttcagtagacttggaacttcagttttcaaagtcaagtgtgtattagaattacacggagggctggttaaaacacagatggctgggcctaaccccacagtttctgatccagtaggtctgggctagggcttaagaatttgaatttgtagcaaggttctaagtgatgacaagctgctggttgggaccacactttgagaactactggcttcgaataagggagagtccttgtcagtgtacagagtagggaggtggtttcctatgaaaatagattaaattccacagacttatggtgctatgccctgcagtcttgacttccttacacaacggagtacatagcttccagagagctttccttctaagataagccacacataactcctatcttctcttccctacattcttctgcaaaaatgggtttaatgcccttctagagattcatttctttctttcctttttaagagacagggtcttgctctgtcgcccaggctggagtgcagtggtgccatcatagctcactgaagcctcaacctcctgggctcaagcaatcctcccacctcagtctcctgagtaggtgggactacaggtgtgcccagctaacttttaaatttttttttgtagagacaaagtcttgctattttgcccaggatggtctcgaactccagggctcaagcagtcctgttatatcctcctccgaaagtgttgggattacaggtatgagccaccaggccccaacctatttctgccattcctgaattcagaatgcaacagcactctaatttaatcagcgttggcacctactttgtgaactctgatgaggtgggaatacaaaagcaataaaacacagtcctccccctccaggagctcattcacagcctggtggccccctggcagttgcaagaaggcatccaccaagaccacaattatagcatgatgtaatggaggcattaggcaagggcacgacaggagcctagggcacaggtacctatttttgcccgggaagatggggaaggtgtcatggaggaggaatcatttgagctaaatcttaagcaggagtgggtgatgtgtaggtggaaaaaatcttgggggtggggtggggagggagataattgggccattggcacatcgaggatacatacagcttctttatgttactgtagggcctcgcctctgggaataaagctgtcttgggtgagaactactttctacttttagtccctctagcgtatatttcttcagtcaagaagagtggtattacctagccaagtaaaacacagcctctcctcttcgctccctgttcacaaaacaaggagcatctatctggcaggccaggagagggggttggtgatgaagatttcattgtttcctctgtgccttccagggatgtgattcagacacaggactagctttgtgatccctgtgctccggagaaacctccaccctggcctcaaggaggctgtgaaaccaaaagggaccttgggtgccagcttgctgggtccttacttacttggtccatcttctggctggaaggagcacctgggctctcagagtgccccccgactctcagcagctccttttctggcccaagaggtaagagtctggaggaccccagttcagtttcttcctgtttattcttttatcgttgactataagattgtgaacctagcacaatgctaagagcttgagatacagcagctaaacagacagccactatccttacccttttggagtttttagcatagtggtgtgcctaaacaagtcataatcatgatgatgatgagagggtattacacagggcatgactaccagaaggtgggctcattggaagccattttagaagcagctgaccacagtctctctggggcgggcaccatta

SEQ ID NO: 452 - DNA, 1380 bp, Homo Sapiens
ttcaaattcagagaatccttctggatttttggacttttttctccctcaacgtggattaaatgttggacttttctcactcaacttggattgaatgttgtcatagagatctaacagcaagtgaactaatgctgattcaaagacaccaagagagggggcgaaatggaaggtgtgaaatcacagaaaccaagggaatgaaaaactgcaaataaataagccatcacttgatatcctgctacatctccaggaataaaaagctggaaataaataagccagccaagaagattgatacatgactggagcctgaatggtagaactttttcagaagtgaggagtctgttggcccagaagatctgcggtaagatctgcctcaacataccttactcatttttttcaaagagactctagagtctaaaatgaacaaccaatcaattctacaaacattgcatcatgaggagttgctgcacctcttctccaggatttgcaaaacgtgtagtccaaatcgagttcggctagaactggtctgtcatcaagatatggctcatgaaagagattggtgtttaggaggctgggaaaaggaaatattttgagagacttcatgtgctccgcacatggaggtggcttccttttgcctcaggtgaagggagcttcaacaagatcactcagagtttgatcaatgatcttagaatttgcagaacatagggactgccatttgactcaccctttagaagtcaggaggaaaggttacgtggctggcacttctcatgtctgggaaggaacaactgtgaagtgctgacctagacgaatgttgcacttccgctgatgagtaggcaatggcgaatgttttccagggtccaaatgtggacccggcaacagagaggctgtctgtaatcactttataagagacactaacaacaatgaccactgggactaaagagagcacaacggaagtagttctgccagaagggctgaggagagggctgagcaaccaccctcaggggaggcagacccacatcaaagacatctcagcagtccctttcccatgaaagaaagagctagaaattgtccatttgacacacacacaaaccagatcccagattgcaattgattcagataatgaaaagcttgttcttttcacttgctgttctagcctaaccatgtaggtgtcagaagcagttgtaggctaggagagaagtcggagcaatacagaagccagttctgcctttgcctcaagatccactgtccactcagaggcaggctggcacatgggggatgagaacattccaagaaagatgtgaatctggaattttcatttatgcagtagatggggatttactactgaaaggaacatgttttggcaactaatagtgaccaaaagaattt

SEQ ID NO: 453 - DNA, 2042 bp, Homo Sapiens
tctcccacctgtgttaagacagttaaatatttcttgatgttagcttgaggaccaagtgagccatcttgccagttaagcaagtcttatttcagaggaccaaatggttaaaagaggagaatttgtacatttgttgagcttccccatctgaagcttgggttccgtactatcctattactatccatcttcatactgaatgaaacaaactgaaagggaattcataatcttttttcttaactgaacaggaaaacttatgaaaatcaacaataaatctgaattttaattttcattcaacagctgaaaaaccatgtctgttgaccacattggactattgcctagttaaaatccataaaattctctataaaccaatgaaaagaaagtagtctggcaataatttccaactttttaaatcctaatttttagttacaaagaaaaaggatagaacgaggcttttcaaggaattcttgctcatcccttcaataatttggtaggcaacacagtcctagaattcagcttcctttttggttttattactattaaatagatactttcatataaatggaaacatttttcctcaaaacatcaattcaaaacatactccttatattaatggctatggcaccacatttttggtaaattccctatgtgtaactttttcctgttggtatgtgatttttttcatttaatatgactatctgctggtgttgggggcaataggtttgtgaatattctgtggatatgtccatgcataggtgtatatatatacctatatttttccagctaatacctcaaatgtgtgattgtttaatatataccacactatgtttgcacagagcagggcttctattagcagtggatatttttatttcttttttttttttttttttttttgttttgagacggagtctctctctgttgcccaggctggagtgcagtggcgcgatctccgctcactgcaagctctgcctcccgggttcacgccattctcctacctcagcctcccgagtagctgggactacaggcgcccgccactacgcctggctaattttttgtattttttgtagagacagggtttcaccgtgttagccaggatggtctcgatctcctgacctcgtgatccacccgcctcggcctcccaaagtgctggaattacaggcatgagccaccacgcccagtggatatttttatttctaactttgaaaatcagtccacacaatttcattggtgtgaattctttctgttgctctttttcatattttaatgcagagattcctcttacaaggcccatgcttcaaacacaattatatctttctatatccagccagctggaaatatataggggtaagaagtatttcttgaaaagtccttgtttagtaagttagtaacaactgggatgactagttgccaagatgtcttgtaactgcctagcagatgacacctgccgtggcaagtctcattcacttcagtacaagactctgtacatttcaatctgatattctattttgccatttaagtacgccattaaaatcatagagattttcagtgacattggagtactgtaaatattagtttcaaaaagaattattttgaataggatgattaaaccaataagaagaaagaaacacacagaaatgatattttgcagtttatctgtattaagaaatgcttcttgccaatttctggttttggtttttggattgctacataagactttctttccatttactttatgtgtttttaaaagctgcaggtgatttttaaggtttgatggaattataatgggagccttgtataagttaaatgaaactggtaaaggagagcttactttgtctataatgctttcaggattataacttagatttaaaaatgaaatgtctgacttgtaaaatatttaatgttatatcagacttcaataaaattttctgcgagaactcaaagtaaatgcattagatttttaatgaatgttctgaatgaaatatgaatttttgtctttcagtctctgtagtttatctcaatatattaataaaaaggtctgttctcactgt

SEQ ID NO: 454 - DNA, 1588 bp, Homo Sapiens
tgtatgtctgtagtcctgactacttgggagactgaggtgggaggattgattgaaccctggaggttgaggctgcaatgagccattattgtaccttgcactccagcctaggtgacagaaggagaccctgtctcaaaaaaaaaaaaaaaaaaaaattcagtctcttctttttgacctccttaatcacttcagagaaattgatgcagcttttatgacttacctacccatcccctatttaaacttgcagaaagttagagtggaggcataaaaaaataagaaaatattttggagtagctaggtacctggaaaaaatcaatgagttacttagtctaatttttaggtgaccagagcctagaatggtaatagaataattttctgcagaaaggacatttaaaaataatctgtttttgaatgccagacaggaattattttgtagcaatcagttttcaactgttgttttcaaagctcctttaccaggggaagctgtctgatcatctcccatctctagccagtttcaccctacatcatgagctgtctttgcctttccgtacaccattacatgtaactcttgccctaagttgttccatgcatgtaaacaactttttcctcctgcttttcacacctcaactcaatcttcaagttttgatttattttcacttgattcctttatttagtctcccattgggttataatctcatcaagagaagagagttagtactacttactattagttcaaaaataattcctattccctttaagttttagacttttcagagcactttcatttttgtcagagcattataacattcatgtgttagtttttagagagctcactatcctcattttccaatgaggtcactgaggcagaggcagccacacttctccaaggttacatgtaatccaaaactaaatgcctagactctgggcccatgattttttttttttttttctaaatgaaagtcttcgcccattggccaggtgcagtggctcatgcctgtaatcctagtactttgggaggctgaggcaggcagatcacttgaggtcaggagtttgagaccaccctggccaacatggtgaaaccccgtctaaaaatacaaaaattaggcgggtgtggtggcgcacttgtaatcccagctactcaggaggctgaggcaggagaatcgcttgaacccaggaagcagagattgcagtgatccgagatcgcgccactgcactccagcctgggtgacagagcaaggctccatcttaaaaaaaaaaaaaaaaagcaagtctttgtccacatagtattctatatcctgaagatgataggtaatgtctagctttaatgaactcagaaagcatttgtaaatgatattgcaatattttaaaagactgttgatataggactgtaaaaataggggaataagaaaggaggccaggtgcggtggctcacgcctgtaatcccagcactttgggatgctgaggtggacagatcacctgaggtcaggagttcgagaccagcctggacaacatgatgaaaccctgtctctactaaaaatataaaaaaagtggtggggtgtggtggcgcatgcctgtagtcccagttacttgg

SEQ ID NO: 455 - DNA, 6275 bp, Homo Sapiens
agaggctgcgggccctgagccgctcggcgcccgcgccggctccccaccgcggcgctgccccgcccccaccccgtcgcccgtgcaggctccgagtgaatgaacttgattccagggattttgaagaaggcggttcgccttgcaccctttctgcaccccccgcccacatacacacaccgccccccaaatccagttttctgcttggggtggatggggacgagggggaagcaaaggcctcccagacaatggagggaggaaaagtgagcgcctggggctccgagtctacctagctgggggatccggggggcgctggggctaccgggtcctcgcgggcccatccccagggcggggccgccccgcttccacgggtactgctggggcgtttcgaggctcgcccccgattccccggtcctctttccaccgcttcccagctcgtgatctgtcccctcaactttagcccctctcactccctctggtttctgtccaccgtcccctcttccctcccccagcggacctggaggaaccagtgactttttccttcaccaagtgggagttatccacatcaagcatttcacaacgacacatcaagaaaagtaggcaggttcaagtcaaccatgaaatggtcactttttaaccccgtcctgtcctcattagggaaatgctcaaacacagtccgttttcaaagagcgctcttaatgaggcgagcttgccaagtttaccagctgcagcccccgtaaacccagagcccaaagaagaaaggcgctggggggtggggagttcgggaggccggggacgggggctgctgggactaggaagacaggtaaagtcggggagatcgcgcggacccctgcgagttaaccctttcggccacacgccctgggagcggcctccctgcggtccccgcccctgccccggcaaatcctggagtcagcgttctgacaacgttaatttcctttgtgcgggtcatttcttctttttgaaaagctgggataaagttggcagtctttatggatgaaagaaatgaggtgacagggttaatccaagtaaatactcatttctctcagaaattttaggcaacctcatcttagattaaacacacacagacacacacacacagagaaaccaccagcacgaaagcatcactttgtattgcacattacactgcatcccctttctcaccctcaccagattctgaggggagggggtggggaagctctactgataataccagctttaactactgcagtttccctttgaacaaatattcaatttaactggagttaatttaccataaaagacattccccttggcaggaatgcactaatatccttgaacacacctctttgaatgcctggactctcatagaagccattatttcggggtctctttaaaaatcgagcgcccatctctccttctctccctccctcccttcttccctccctcctcaccacaccacccccagtgaaatcctggcacccagagagcactcctttcagcctgagagcccagaaccagccgttgtcccctggcaaaaagaggcccagggctgagccctgggcaagtgtctcccgacatcgctacccctcctccctttattagtttccctttcccaacagaaaccatttccttctgccaccaaaactaggttgcatccaaaagtttttcacaagcttaaaaaagaaaaacgaaaaattgacaagtattacacagaagagcccacaaaagcttcagcaacaccaagggcgaagaagcagcgtcagatccagaaaaaggaaaatgagataggagtatggtgaggcgaggaaaaccaaaaaggaatgaagagtgagcaacagagacttcctgaaaaagaaggtttatgggggtgctcagtttctatggctttgactgtcttctcaggccttgcagccatgtggagaatggctgacaccccccaaaacacttcttcttgtccagccaatgccaaggtcattgcaggccttccctggaagaactctagggagttgtttggaaagagggactggtggatttcggtgcatgggatgcctggcttctcttaacacaacacttgtccaccacctttggtttgaaaatctcaatcttttaaatcccaggtagaaggaggaactgagaaagtgcctgcattgtattcactttccattttttctagcacgtctgtgtcgtggtattaagagtggaaatatctctgaaaagcttctgatagtatcaaaatgggccaaacacttcttaaactttggtacttaccaatcctaaactcttcatctctccctcccacactgagagggttaaaagcactggtgtgacaggccactttcattcaccccaaaacctggctgaggaggcagaaagaagtgaatgattctctcagcaacaggaaactctgttatttcagtattcttaaagatctcctccctagatctccttgctgccttataagggaaaaaaaaaagtttcctttctaactaacagaaagtttattgatttctaaatagaatgccagtgcttcagctcactggatttttcaaaacccagttgtatatttgaaataagcaacgctaccacatttgagcctttcactacggatctccagagaggagcttgacatctcaagtatctaatattgtttttcttttaaccttttccttcctaaagaaattgcagcgacaggttgcaaatcctgggcagtttcatgaaagatttcttggaacttaacaaagctgtcatttccaatacactcgatgcctttttttttttttttttttttttttggctcttgcatgtggtttgcaagaaggttcaactattctacacaccctggctgcatcaccaatatcaatatttaaaaactaaatgcaaaagagacagatgacctcctgaccccagaaagcaggcctgcaaaactgcaagtatctactgcaccatgccctgggatctttcctttttccaaatgaaccacaaaaatcatacatgtgtagtctggaaaacacaaatttatatccacaaggaggaacaccaaaaatccactcataaatgcatatataaacaatcaagaagtattgaaagtgcctgtacttgatgagaattgcaaaatcaattttaccagctcaggtaatcaaattacccagctcttaaactactactgagtactactactactgtctactactcttaaacaaaaaacaaaatcatacccagcccttaacgtactactgtcaaattagggtagtaattttttccccaccagagaattcacaactggttagtttccccacccccattgctagccctttgcactgaaatgaataaataaccttggacctttttctcctcctctgggagctatttggtgtcccctgaggacaaaagtaaatgagaaaaatgacgctgttaataatgtcactgccgaaatgcctctactccactgtttaaaaaaaaaaaaaaagcatcccactaagtgtgtctacatttctagcatatttacaagttataatacagttctgatctcaacaccaactgagccagattcctccactaaggttatccggttttcacttctcaacagagatgaggccagtgcatcaacagagattcccaacactgtaagacacttgcttcacagattacaaagtcagcagttgccctgtaacttttgcatgatgtattttaaactttgaaaatagaggtaatagttgcctcacttatccacaatgttacaaaggttccatatactctctcacacagtgtctcttgtctgctgatattgagagagttgcagttattgctctttttcaaaatagctgacctataaagtaaaactatatgaccattttatttctacaggtaaactggcttctattacccatatacacatgccttgtaacataggaaaacagatgggtttttaagacaggtatagaaagctctgtccaaaatggctaagtagtctttacattctgtattaagtataaaaagtgcatggcagagcaactcaaactttctgcacccctttctctcatttcttctttgaaaactgcataacaatgcataacaacaaaatttcaaagtcaaagcaatgcataacaacagaattgtgcattttaattttcaaattaaaatttaagaaacaattttgtaattacaaagaaaaaacacaaacaattgggcctaaacaaaatatatgttcagtaaactttatctctgagtgtatctgaaattttaactacacaagccaataaatttcaaagcagtaatattatcaaattgtgtaatgtcaaaaactccaaaaacaaagttacagatgttcatgacatcacattcactcaaaattatgctgctgttcagtctgaccatattaaaattaaagggatgcctatgtctgctaaagaataaaaatttattttggacctcaaacaatgaaaccgtcaccatttcttgtatggaacactcagctaatcaatttcctattaaaatagctttcaacaatacttggctttaaaattcatcagggccagtaaaaacgttttcccagtgcacaagaatgcagtcccaaccaccgatgataattactgttctaataattttattgccaaagtactttttcctgtgttcctcatcacttaggcaggaatctgtagtatattgcgtcagtgagttggagtgcttgacctttgcccacatatgatttaatagggacttttcagcgctagagctttctccatctctcataccattaaatgaaaacatcaaacctcaaatgtaaaactggaaaccacaacgttttgtgtttcacaaactctttgcagtttttacttaggatgcttaaaggtcagtttctttgcctcacaatgcttttcttcatattgtaaatacactggaaagtcacactaattctgattttgattaaatcttgaactcctcagtcatatacacacatacaccctgcttatttacacgtgcattcttttctaaccacataagcatgcgtgtgttactttctggacttattccattttagggctgatttaaatgtctgttcaagtgtgggatcaaaagttaactttttcccgcctattggaagttaaagttacaaggatggtgctataagatccgttcaaagaaagtcagagttaatcttgtgtattttggcgccttttccctgccagctactgtacttggggggtgggggaaaaatacttagagatcttgtctgtcctgtctcaagttcagtggcagttcttccaacccgagcagaagatggccatgttcacagccctaataataattctgatcacgccacttcagcatcttgtgtcaaagtcgaaactggcttccccgcccccttcaatctgaaagctgccaagtcctcacacacttcacattcaaccacaacttaatggatgggatattgtgcattaaaatgtgtctcagacgtattggggaaaagaagacaaggagaacgagagatagagacacacataggaagaggaaaaaaatcggcagcaaaaatagcggggttggggggaaactattaacaggagtggaaagaaatccatcaaaatcggttttaaaaagttggtggggggtgcggaagaaaggctaacaataggatgccacaaattcagggatgaggggatgggggttaggactaaactttagaatgaatactgactttaaacattccaacacaccaatcagagttaaatagtacttctttcacttaaaaatgtatttttaaatgagaatatctgtgaattaaaatggagaaaagaatgcttcaagaggagagaatggcctacaaggtagaactaaagtatcatttgaacagtaatttttttccaccactgaggggagaggggcataaagcagagagttaaagcagaacaaaatgctagattctgcaccgtttggaccacaatgttactcactgattcccgtcataagagtgtgtcacatgtactaaagttgccaacgctaaataataatgcatatttgcaaattagttctgcaaatgcagcactatagcccacaacctgtaaaacaaaaatgacatttaggaaaggggtaaaacagccactttgcaatccacaaacaggaaaagaaaaactgtgccagggataggagggggtgcaaagaacgaataaaagaagcaaacaaaacccatcagttcaaagccacataccatcgcactgtattgcattaaataaaagagatcttgagtctgtaacagaaccctgggccgctgacttgacgtgtctcag

SEQ ID NO: 456 - DNA, 1601 bp, Homo Sapiens
tgcccctttcattttgggcctctgacaatgcttcagaagttgtagtccaagcacacacaaatagtgccaggagtcgagtttccaataacttctggctaaaagcctcagagtcagtcagcctttcccagtttctcatgcaaaacgtttaaaattaacaaaagccacctcaaactacaattttcagaatctgggaactcttatatccaagagcaagatggatacacttggattgaaaaatgcagccaagacccacaaatgccaagtccttgccacagaacaagctgtccagctggaagaaactagaggaatccccaaaccatttgtcctctgactcaagaacaccagaattataccaagacaaaactgtgcagctatcactgttctgcacaggtgtaccgccttgtgaagtgatccgggagacttctgtgttaccaaaccctcctcacatacactcactcccactaaaacatctccttctatacaaattagaaactgaggctcccagaaaacaacttgaaaggaatgtagagaaacttatgattgtcagatttagcaaataaaaatacaaggatgcccagttgaacttgaatttcatacaaactacaagtaatttttaatataagtatgtcccaagtcttaaaagaggactacaaataatttgttagtgtgagtgtgcccgtaagtatttgggacatactcacactaacaaattatttgtcatttatctgagattcaaacttaactgggcattctatacttaacttggcaatttgaggaagggtgaaaaaagagaatacattattacattgcatcatggagatacagaccttaaaaataaaaatgttgtaggctgaggccaagacacagaagcctttgcagcagtgctaattgggcattataagtttatatttattaactcttttcagaaatcataatcttgaaggaaaatatcccaaatcatctcaatacagacaatatccgtacaaggatactacttgacatattcaatcaaaacaatatgaattcttacaaactaagaattggactagaatttagaatgtatgctcattggccttttagctatttatagctggagtcccacagataccaaatgtcatgaatggaaatccacatgcccatcattgacaatctaaacagaacttgtttgattaagaataaaggaggaggaaaacaacaaaggaaactatatttcagaatatgggaacgtgattactatcccaagaatataaaaaagtatttttatactatctgacataaccaaaagaatatgaattacatgaaacaagagccagaaggtacaaggatgaattaagaagcttgttaggcgagttaaagacatttcaagaaattgaaaatataggagtattagagtctttattgaaatcagtgaaggaattgacaatgtctatcatcgaattagagtttaaatatcagatgctgtctcagaactcataagaaaaatcaatgataaagagatgatagctctaaaatggtaaaaaaaaaaaaataaagtacacgagttaatttaaaaaggaaaaaaaggtttgcataagatttgccttctgcaacaataaattcca

SEQ ID NO: 457 - DNA, 1933 bp, Homo Sapiens
gtaaaaagcgaggacgtgaccgttttggaagcattgttcttttcactgttagtgaggagcggtcaaggatgcgtattaagaaattactcttagaagaaaggaagcattgagagtaaggaacaaatgccaatgatgacaacccaaacactatgcctcatcggagcacaaagttccaagtgacttcaaagggttttctgtacttggagcagctctatgggacatggaagatgagaaatgaaccgacaccagaggtgcaatgaaaggtaaaactcatagcatcaccacagctcttagggctggtgaattaccagatctccgtcaagtgcagtaaccagttcaagttggaagtgtgtcttttgaatgcagaaaacaaggtcgtggacaaccaggctgggacccagggccagctgaaggtgctgggtgccaacctctggtggccgtacctgatgcacgaacaccccgcctacctgtactcgtgggaggtgtggctgactgcacagaagtcactggggcctttgacttctacacactccctgtggggctccgcactgtggccgtcaccgagagccagttcctcatcagcgggaaacctttctatttccacggcgtcaacaagcatgaggatgcggacatccaagggaagggcttcgactgtccgctgctggtgaaggacttcaacctgctttgctggcttggcgccaacaccttctgccccagccactatccctacacggaggagatgctgcagatatgttaccgagtcagggtctcactctgttgcccaggctggagggcagtggtgcaatcacagctcgttgccatctcgacctcctgggcttaagcgatcctccccactcagcctcccaaatagctgggaccacagacgtgcgctgcctttccagggtaaattttaatatttttttccccacgagtcagagtcttgctctgttgcccaggctggagagcagtgttgcgatcttggctcactgcatcctctacctcctgggttcaaacagttctcctgcctcaccctcccgagtagctgggattacaggctcatgccaccatgcccagatagttttcttctttattttttgttgagatggggtttcaccacggccaggctggtctcgaactcttgacgtcgtgatccacctgcctcggcctcgcaaagtgctcacaggcttgagccaccatgcccagccctaatttttaaatttgttgtagaaactaggtcttgctatgttgcccaggctggtctcaagcgcctggtctcaagcctcccaaagtggtggggttctaggcgtgagccacctcgcctggcacttgcactgttttcctgtgcatgcatctctactcccactgcccaggacctgtggacttagatttgagtcattactgagcacctagcacccagccccgtgcctacttcccacctcgcactacctgtttgcttgatgcattgataaatattccacctgaatccacagcccattcactcctgtgttcaagagctatttcaggaagtgaacctcattttcggcagtgttcagtccagtgacctcagctgtgtgtacctggcagggtggctacgcctctgggggaattggattcagaggtgggggagaaagagtgttgttagagagctcggtctaggactagaggaacgtgcccttatgtaaaacacatctcaagttagggaagaaagcagcggctctgtgctttgtgttttttttttcttttctttctttcttttttgtttgtttgtttgtttgtttgttttgaggcagggtcttgctctgtggcccaggctggagtgcagtagcctgatttcggctcactgcaaccttcacctcccgggttcaagcaattcttgtgcctcagcctcccgagtagctggagttacagatgcgtgccactatgcctggctaat

SEQ ID NO: 458 - DNA, 2109 bp, Homo Sapiens
gctgtgggacttccaggagtccgagtcccatgctctgcctctgaggctggtggctggggtaaagctgggcagggctgagccaggcagggctgtactcaggctccccaatggtaggtacaagcaacggccataacatggatcagaaggcagtgctcaggccactggggcaatgcttcaaggaggagcataacaacttattttgtgccaaagagtcagcatgggaaaagagaagcagtttgtgttccacaacctagcagatggtagtgacacctgcctcactcccacacccttgacccagcaaggctccctcccataacccactcctggcagcaagctgaaacagtaagtcaagacacaagcaatctgtcttcagattacaaaactgtcctatgccacaaaactccctgccagggacaaaaacttggactcccaggccacacccctccgactccagtcctgcatcctgcagtgggactgcccaacgcttatgcccgtgtttcaaacccatgctacactcatctctcagatctggccatggggctcttcctcctcttaagactagattgcaaatctcattcttgagattctctaaaccgatgactaatgcttgttctggatgacagatttccgcacagccccctatgagttaagatcaggaatgatctcctattagcatcaaggtctgggagcatgtgcaaagtacttcctgctgcctcttctcacagtctcttcactgatcccagaattgtatcagttggaagagtcaaggagctcctctgtggcctggattgcctgactcccaagtggaaatgtatactgtgaagatactcttcccctctcaggaacttggaactcacagttttccgtcagacccacagtgtggtctgctgcccaccatatttttcaaagtatccaaagtttgtttcatttttatgttgagcttcctattctttccttgatcacaatgtgaatctctgcacactattttgctatttccaagtgaatgaggttcgctaacaaagcctctatgcctccatcttggagaaaaaaaagctaagtatcgatatattttgttttcatttttatttacttcaaaattttaaatttttactgagacttctattttgacctctcacttatttagaaatgtgtcaattttcagatatttggagctatctcagttatctacatgttactgacttctatttgaacttcattgtagtatgagaacatactttgtattaattctattattttatatttttaagatgtcttttatggcccaaatgtggtcaaccttgaagaacgttccatgtgatcatgaaaaaaatatatatatattctgccattgtggatgtactttgctaaacatgtcaactagataagttagtgatagagatgttcagtttaaatatattttcattttctgcttgttgcatctgtcaattactaatgggtaagtgctgaaatctacaggtataatagtgcctctgttagcctatttctccttcagttttatcaatattactgcatgtattttaatgttctcttgtatgaggcatacacatttaggattgttatgtctttttggaaaattaacccttttatcattagataaagctctgtagccctaataatctctatctttcctgatgtctgctttgtctgaaattaatgtagctcctttgctttcttttgattagcactttgtgtgtttatctttttacttttaacccagatgtatctttatatatttaaaatgggtttcttgtaagtgacatatagctaggtttggttttgttatcctcttcaacaatttctatctttaactggtatatttagaacattaacatctaaagagattattgagtgatatagttggataactatctactatgtttataactgtattctatttcttgtagttttttcctagtttattttttccttccaatttttctgaattctgtgattttaactgaccatgtataatatttaatttatatcatatattagtgtattaattgtacttctttttttaaaaaaaaaaatgatcactgtagaatttaccaaataaaatgtaagttaatctgtctttacctcaaacaa

SEQ ID NO: 459 - DNA, 1691 bp, Homo Sapiens
actatgttgcccaggctggtttcaaactcctgggctcaagtgatcctcccatctcagcttcccaaagttctgggattttaggcatgagccactgcgcccagcccaatattgtattatataagcaaatcttgagatcaactctcacttctttaatataggaacaatgacaatgacagtttcctaactgaatacctgaccacaggggctagactacatgatcgcctaaaatctgttccagctctaagatctggaatttattatctgatccttcacacctgattataaagcttctgcttgaacatgtccatctacttcaaattctattgtttgaaagctttaatcattttttttttttttagctgaaactgtcatccttgaatttctcctcaggacagttctcctattctccaggagaccttcaaagtcccttccaactctgaaattttaagattctatgaaatgtagacgtatggagtgaggtttcaggcagttttgaaaggatcataactgtagtttccatttgcattaagtgtgaattgtactgaagtgggtgttctttggtgtaccccataatatctcaaacattatttggtatacagtacatactcattaagaattatagcctcattagactatgatatagattagtcaatctcaattctgatcatttaaactccattatatgctattaccaaatattaatcttttaaacaacagaaataattcatatatttgtaaaataaaatcaaaaacatagataggaaattgttaaaggtttaaattaaactctaaattccacgagagttgttgggcaagtcttcctttttctatgcacaactccctctggagtttttaaccctgtaccatgaaaattcctgatgagcaaaaacttgaaagcaaggtatgggaaagagttacaaatactctggtccaagctaaaatcacttgtggggatgatgcaacctcaatttaacagaaactacaacatcttccccttagtatgacaataaacttccagagaaaaatgcaagaaacaagaatgcctagagctgagagggagagttgggttaggagtgatggctaaggagtgcatggtttctttttgaggttattaaaatgttctaagagtgactgtggtgatgaatatataactctgaatatcctaatgaatatataactgtgaatttactaaaagtcactgaatttgtacacttcaagtggcaaattatatggtatgtgaattatatctcaaagctgatttaaaaaaaaaaaaaaaaagaaaaagaaagaaagaaagaaagaaaagcaaatatcctttaagaggtacttgaaacttacctccttctccagatccagatccattatctgagaagaaaaacaaagaatgaatatgaacatttttcccggaaatttcatcttatcaaataataaaatttcctatcaaaaataaaactgtgatatccattctcaaagagtccttttctcatatttttgatatcttatttattcttacatacttattttatgctgctcttaaaatataaattgcttagatacataatcatctatatttcatacatctttgtatcccattaaggacatacccagatgctttgcacagagtaaagacaataaatactgtaaagtaaaaggctaaatataaataattaattttaatccactcatttaaa

SEQ ID NO: 460 - DNA, 2669 bp, Homo Sapiens
aaatatttttaaagcgtatgattaatacacttgcctattgctgcgtggactgtgctgggggggtcagggggcagataaatgaaagaggatagctgcacgcggcgttgactggctgattaatcactgcctgttttctataactcatggcagatggcaggagctggctgcaggccctcgttgggaatgaggtgctgcaggcaggatgaacaggggtcgggggagaccctggaaggccccagttgtgtcgtgttttttttcctcggccctacagacctccgtgtccaccccaccccctgcacttcgtggcaattcccaagttcaagagcagtggcgtagcttctgggaagacacaggaaatctcatttctcccttggattttttaggacctagataacgacactgtcaattttgggaatggtcaactttggggtggggagagtcaggtccagtgcaatacttgtatatattttatcttcaattctcccaacaaccccattttctagataggaattgtgaggcttggcaaggcagacacaggtattgttcccagctggtcccacccaaagcctgctcctcgctgtcctcccttttgccctccccaggggagcatcatcagcccaaggcccagaagtgaaggccctggagctggcacagctgccccctccccgggacctcggccctctccatccctgggggccactgcagtcttcccctggtacgggacacattctccccgtcaggcctgcatggctattgcccacctcaccgtgcacattcaatggtgtttttgtctcttgacttgtctttcccaggagatgatggatttcctggaggcaggaagtgtggccaccaccgggagtagctccaggacccggcatgggttaggctctggggtggtgtgacagatgtgtgtccggtcagcctagctgagctgaactgcagcacccagaactcccttccctgcacaggcttgggttatctggggccccaggggaggggcagagggagcagcagtcatgtcttccttttacactcagaaggcgagaggggccagtgcctcccaacacacaggggactcgcaggtgctgctgatctcaggagatggatttggtgtccaggcagctggggcatagctcttccagcccagccagagcctcctgtggccttcttgactcccaggccaggtatatgcttagttcatgaaagtgccggcttcttccacggggtgcccatcctcgaaggtagaggcttagagcaggggacagattgacttggggtctgccacttcccggtgggagttccagctcagcctgtcaggttccgtttgtcctcctaccccacttcatggtcatccccttttccccacgcccgccctgccagctccacgcaccggagaagcagcagttcccttagacggggtggccagtgcccaaggtttcacaaggccaagtccctgtaataggtcgtgtgtgtgtgtgtctgtgtgtgtctgtgtgtgtgtgtctacgtgtttgtgtgtctgcatgtgtctgtgtgtatctgtgtgtgcgtgcgtgtctatgtatctgtgtgtgtctgtgcgtatctgtgtgtgtgtgcgtgtctatatatgtatgtgtgtgtgtctgtgtgtgtgtctgtgggtgtgtctgtgtgtctgtgtgtgtgtctgtgtgtatacgtgtctgtgtctgcgtgtgtctgtgtgtctgtgtgtgtctgcgtgtgtgtctgtgtctgtgtgtctgtgggtgtctgcgtgtgtgtgtctctgtgtgtttgtgtctgtgtgttggtgtccgcgtgtctgtccgtgtagtgcgtgtgtgtgtctgtgtatgtctgtatgtctgtgtatgtttctgtatgttcctgcatgtgtgtgtctctgtgtgtgtgtttgtgtctatgtgtgtgtgtctttgtgtgtctgtgtgtttctgtgtgtgcgtgtgtgtctctgtgtgtttgtgtctgtgtctgtgtgtgtgtgtctgtgtgtgtgtctctgtgtctgtgcgtgtgtgtctgtgtgtctgtgtgtgtgtctgtgtgtgtctctgtgtctgtgtgtctgtgtgtgtgtgtgtgtctgtgtgtgtgtgcgcgtgcatgtcctctcacgtcccaatgttccacttctctgaactctgactggtgcaggtggcagagcctgtaggaacggaatgggaggagatgggaaacccttgtgggatgggaactgtcaggtcgggttctgcagactacgtgggaaagtggaacacagtgatcctggcagagggaacagcatgtgcaaagaccagggggtagtggggcacagtgcctgagcagccgtgggttcctgtcccgcccagaagagaaaaggtctgcagaggaagcagcggctgcctgagtggagcccagcccggcaatgggcagtgggagccaggctgggctttcctgcaggaggcaccacgtggttgctgcagatgagagagggtgatgcccccaggaactccaggctggcaggggttagggacggaattgacgtgggctgtacggcgttggcctagttccttgttggggatacaatcaggcgggagcggcctgtcccttaggatacaatgactgggctatagcagtcgtgctcttgatcaagttaaaaagtggctgctggtatcactggcccc

SEQ ID NO: 461 - DNA, 6804 bp, Homo Sapiens
cggagagagcgcagcgcggggcacagcgggcggtctccgtgccgcgcgcgcgactggaaacggcgtgcagatcctaaaacgagggttccacagagggccacgaggggcaggagagagtccccggagaactctagctccccgacacggctacctcttggcaaacgagcgagaattggggcgcagagccttgggagggccgttccctcggcgggagcggcccgagcacagcctcacagcagatgcgagcgcggcgggcgctttggtgacgaagtagcgggacctgcaggaggcagaggcctggtggggccgtggacgccacgccgagctgcccagacccttccagaagacagtggggactattcaacggtttccagcagaaactaagccaggtgttcgttttacggagattgctcggctgcagggtggaggctggatgagaacaggcgtcctctcaggtaggcgctcgtggtggtaacgctgcccaggaggagggcacgggttccgggaagacttgcgaggttaaaccggcagctccggagaactgagcgcaagaggtcggtgacacagagaggagtccgggaggccgcatgtttcaggctgaagtcacttggcggggacgtttattgagatgcgaaacacaggaagggatagaggctgcgcagagggaaaaggcgatggactcggttttggaaacgctgatgtgaagtccctacgatgaaaaaagaaatcttccgatttctccctttgaagtctttgcttcttccgttgcaaagaacacagcctatgacatcaggttgaaaccaagaatgtagttctctgaaaatactgtgtgtgggggagggagtttatcttgtctcattccttacaaggatactttgctctccgacaccttagctccctgaaagtttcctagatcgtccatcttttcctcattttttcgactgcaagcaatgaactgttaattttttacagtttggttttacagccacacactttattcttctttgtcaagtttaaagtattctagggcttgtgccttcccacataaaatttagaataaacttgtctgtttctacaaaaagccatgttggtatttcgagaggaattgcaatcaacctatggatcaaattgagaattgtatccttattatgttgaatcttccaacccacgaacatgggtggagagagagttagaatgaaggcgaagtttcctacgcacataaagctcagtgagaaagcaattccaagagtaatggaaggaaaacgactctcgggaattcagtttgaacactggcgactgagcccataaacatctttctggaatgaggtttgcagaagaaagcagcggtctaacctgtggtagcctgtgactctgacattaacaccagagcggtgggtctcaaagtgtggttctcagacaagctgtggcagcctcacttgaagacttgttgcagatacaaattcccaggcccacactagaccctctggagcagaagctctggggttgaggcccgcaatctgcgctcccatgccctccaggcgattccagcacaggctgaggtttgagaagggtgctgtgaaaggggcagggaagccccattatataatgtttccagcaaggcagcctcacgttgcttcaccgaagtcactcaaagaagcctctgcccctcctgcttttccaagagtcgtgtcatttcaagacttccgcactggctgtagagagtggagacagccaggctccgagcccgaccccaacggcttccatgtttcctcgatagaatgtctgtgactaccaagaagatacccatatagtgatggtttattttattgaaaaatacactagtaatattgagacaggtatcttttaggccatctggctgataatcaatatagagctactgatgaccatactggctcacatttgccttgtccatcactgttcttggatccctgagaaccacgtactcgataaccttagagaaaagccccggctgtggttttcaacatgctttctcatccattatctcagttcacccttctcgcagatctccagaggaaaagggcagcagcagagcgatctgaggccccccgaaagggacgaagctgcggctctggactccaggcccctgccagaacagctctgcggaacgggagggaggaggaagcctcgagacagacagggcttgactgcaccctgaggcccaggaggcatggggacagagagtggggaaagcagcgatcccgcccccgttctgaagggaagagaataacctctggcaatttttaccttctagaatctggtggaccctggagtcccgcacgtactgctgaacagcgtaatccttcaggtagccgtagcccccgtgcatctgcaaggcctggttgcagatctgcagggagacagggactagacgtcttggactctgggaagactgtggagcaagcagcttcccttcctaccccagcccacgatctggcagcccgccataaacccatgaaagaaccacaaacagccaagctcaaagagggcctccacattctgtatggttagagacaagggaagttcacctactaaacttgtcagttccccccagacaggcgactcaaagccctctgcccctctcccttattacctgccaggcagaagctgcccacagccaccctggctgggatgataaaaagctatggttccccctagtggcaatgcagcctgacaatgtaaacatggcagagtgctaaattggggctgctgtgaaccttccaaaggtggtttctcgcctagaacacaaccaaacaacagtgacataatgaagtgtataatggcatgcagcaggcctaaaagccagcgatgagagctcccacataggccgctcatgagttcatttatatccttaagcttaaggtgatccttgtgggattccaggagggctgggttccaaatctgactcatgtctctcaagacccctgggcctagcagctgttccctgtccatcccaggagagccagaggaatcacttacggcaaagcattcatctgtagcaaagagcttggccatggagcacaaggccactgcatccttcctctcctcctgcagagccactgctgcattgcggaccatcagccgcgcggccaccagccttgttgccatatcagccagtgtgaattgcaagtactgcagcacagggagcagagaaccagacaagactgaggggcttagaccagcacctggtgcaggagcctcggtaagacatctcggaggcgccttttctaagtgatccaaagcttcaaagtctcttgctttttctatagaggaaatttattgcttttaagtgctaagtccacttcactcacccgacactttaatatcgttaaagatatcccaagaaaagatggacagaaataaagcacaagctctggctaggacagtggtgggactgacagaggaatttcctggcttctctcctggaaatgtgggccctagagcaggtcccgggctgcaaatagtgcaaagccatgtggaggcaaggcagaggttacctggttactggccagaggctctccaaactgcttccggacattgaggtggtctcgggtgaggatgacagaggcgtgggcagcccccagggagcaggaagctagaggggaagagcgccgacgttccaaccaagctggaaaacagcagtgcctgtcccggaccgctacctccctgccacacccctgcgtatctcaccaatattgatcctccctccgttcagtcctctcacggcaatgaggaagccctgcccctcgctcccaattctgttggccacagggacagcacagtcttcgaagatcacagctcgtgttggctgggagttccaccccacctggcaaaaatcagggactgcgtggttgcccaacaatccagcaggtagggcggccttccctggggacgggagcctgtgaggtatgggtttcagcacccaagacttagacccacaagaacttaaaatgaggaaaaagaaaaagttcaggtttaaaggcctgtcagcactcagaaagatacctgtttcagctaaacattttctaacttattaagagaatctactaatgtctactctacctgactaacctacaaacacttctcacaacttcttttaggattgtgacaccaactgcccccaatttcagtgcctctaattgaaaaccacaaactatctacaatctcccagttcctctctggctctgaaaatagactgcctttacatcatttccttgctctcttttgttgataggataaactccatttctaagccttttactgaaggtcttcctgcccaggagttagcatgggcttcacacacagtagaagcctaggaaatggttgctgtgttaccaaagagaaggggatgctaaaatgcataatgccttacagttacagaggatcaggaaggatcctgtaggaaaatacagaaacccgaggagctgtgagaaagaggtacacttaggggtcatttcattacctgccttctctcacaaagtccccccataacagtacaaactagagagagatgactgctttgagcatctggtctaaaaaatctgaatgggtcttgagcccttattaccaattacggttacatgatcacaagtctcctgttcatgccctggccatggcggctcttaatcctagaagtatcttacttttcaaattacttacagtacctaagtgtccttcttgggttgctgaaatacccacaatcatctccaatgagttttactttatttttaatcaaagaagcaaaagggaccacacgccttccattactgagacttgtggccaacaccaggtcttctctaagcgtctcttcctggagcaacaaagtgcaccaacgtaagcagctggataaggaacacaggccaaaagcagaggcaggagaggtcagaacactcacaggtggcttgaagaatttactggcaaacattgtcactttccccagaggcctagtgtttaataatgccctgttgtatttcatatgctcctgttgaaaatcctaatagaagcaactgcttcaaaggtaggttagcaagtatgcaaacctgttttctgaaatagagcaggagttgggctggcaggtggcagagtctcataacctgaattgtttcctgtccaacagccactcacctttttctccttcttgccaaagctgaggccaggggtccccttctcaacaactatgcatgagatgcccttggggcctggtcctcctgttcggcacatgaccacatagatgtctgactcaccagcaccactgatgaaggcctgtgggggtaaaaggggtgcaaaaggaccagggaatgcttgagttctcacagcgtctgggaacaccactgggtcctcctgacaataaggtccaatggcacagagactgacaataaggtccaatggcacagagactgacaataaggtccaatggcacagagactgacaataaggtccaatggcacagagactgacaataaggtccaatggcacagagactgacaataaggtccaatggcacagagactgaggtgaggtaaaaggtcgctgcagtgactgcagatcagagaggcagtccaagagagtataaaaaggatagacaaaagtcaacgaaatgatctggaatcagattaggagagatacaaacagtgagaataaagaaagagaaatgggtcagaggttctcttcccaacacataaaaatcctatgggagtattaacccgcggatgtgaaggaaccagaggatgtcaggaggaagctgggaacaatctccaaagtgctctgggaggacgcacgctagtaccttggagccattgaggatgtaatgatctccctgtttcttagcggaggtcagaagagaggcagcatcactcccacttcctgaggagggatcaaaaggcagcagagagaaggtgagaaagtcagtgaggtcgagggagcccagcacaattctatcttctaggaaatcttctctaaacagaccctgctcagagtgtgtcactgcaaaacccaagtggccaaaggaactctctgtacttggtggaaactgctcataccagtcaggccactgcctacctcccaacacaccagataggcttcttggtccttgtgacatcaggtcacaggactctattactcctcaaccaaacagctagataaacagtggctcgacatgtcaagaggctggaaggagtgctcggtaatgccatctgagcaggaagcatctctccctgctatatctcagtgcagtgtggcaaattcacctggttcagtgaggcagtaggaagcaaacttctccatggtacagagcggtgggcaaaatttgtgcctctgttcctcatttccgaagctatcaatcatccaggcacacatgctgataggtacaccaagaagaaaagacaatgacagaaataaagatggaaaagaaaaaaaaatgggggagaaggggaaagagaacaaagggcagggcagtggagtaaagcagaagagtgggaaggggagagtcacaattgggaagactctttaaaggcaaacggtggattaaaacatattcctggaataaggactacccagagataaccaggctgaggtacttctcaccagcacgtttgtactacttctagttaggttacacgagcctctaaaaatcagagttatatgtgctttctattagtagtttctattacttcctcaaatcactggcagttccatctttggattgaggaaaagggtgagaggggccgggtgcggtggctcacatctgtaatcccagcactatgggag

SEQ ID NO: 462 - DNA, 3341 bp, Homo Sapiens
gtccggctgaggcgctctgtcccggctgggtgggtccctgagtgctcatttttcgttttccgtcagaggccgacctttttctctggaacgcacaagccaggtccaaaagttccttcagggcctccaggaaccactaaccaacgtccctgttgacctcagtttctcgcctgtgaaataaattggaactggaagttctggaggctgcctcggctctaaaaaagcccatttctggatgtcggacgtttatcctcagtctcttgcaatttcctttgagaacagccagttaaaaagaagtgagtggcaggtagggcaacttttttcagaaagtcataaatagttcgagtccactgctttcctcatcaataaagaggattcagttcaaccagctttcaatatttgttttttttttccaaaaagatcattactattcatccaaaaaaaaaaaagcttgcctttctttgatttcaacctaatactgtaggctctaactaatccttttcaaggctgaatcacgctactttttgtttcttaaaaagattttggccaaagatgctttgagattcttcttgttttaaacggctcatcagctgatgtctttaaaatgtttaattacataagaccttaaaaaacaaaaaacaaaaaaaaccaaaggccgcacggtggcttaagcctttataatcccagcactttgggaggctgaggtaggacgataatttgagtttaggagtttgagaccagactgggcaataaagcaagacccgcatctcaaaaacaacaacaaaaaacgcttcattctttatactgctgcacagttttatttggtattgttaaattaatagtttattttcctattgatgggcatttattaccaatttttctgctattacaacaaaaaagagctgtagtaaaccttattcaagccttgtttggataggattagtaggctgcatataaaagaaaactgactttttaaggtggtttaaacaagataaaaggttttattgtgattgacttttctttcacagaagcagtgtaaactcgaaactagggctggtatagtggcttctcagccatctggtactcagcctcttcctcatccttctatcatattagcctgtggcttccaccctcaaggtcagaaattccaggatggctcctggagctccagtcatcaagatgacattcaaccagaggaagggagaaggcaggccaaaccaagcacacctttcaagtggagtcaacttcttttaagcagcctacttgaacattgcatacatttctgtttacatctcattggctggaacctagctctccaagggaggctgagaaattgtcttctagctgtatacattgtcatctcaaatgaaattaggattgttataaagggaaaagaataaagtggaggttgagtaggcaactacgcctgctttccttcactcttaggaccagtgcaatttaaattctctcacaccgtaggagtggctgatattctacatattcatgcatgcatctgtatgtaaacacgctaagctatgacctttcctattgacgttgagcagaaacaactcataagaaaaagattttttcttttgtgaaatcataggggaaatgtcatgagctttctccccagagcacattgctccacccagtggcttggagccctatcctagtgcagtcatactaaaaaacatgcacagctgtggctgatcatgtgctctactgggaggggtcaccctggtaattcatattgccagcttcaaagttaaggggcaaacgtgttgggattcttggcccacatatctagttatagagaataagatcattgaaagttttacagaaattgttgggaatgtgtagaaagtttcagggctactgactttcctctaaggaggaaatcaattcggcatataatccactgatatgaaaacatctggatcaattgcattttcaacatttggatatttgaaacttactttagtgtttggaacttgattccattcaacttggggggaattttatttaccaaagacctattgttaaccaagaatcaggtgaggcactgatgcaaaaatgaatataacaatatccttactctggcagagcagataaacaatatgcagtaaatttcatgcagattacaggagatccgggcccaaagggatgatgtgatgatgatgataatctctccaatttaaataagaggaaatcctggttttacaattacacaatttgtctgaggctgcacagctagtgcagcggcaaggcaagaatctaagccgaggtgtactggataacaaggtccagtcttcttggagtccttcttccgccacagcaccatctaggttaatcagtgaggcactcaggatggttaaattgggagccaaatggaaaatgcattgaaaagtctggagcgaggagcactcagatgggacaagagtctgtgccaggtaccaggtggtgcagtgtagactggagaggacagatgtgaaagattgtgtgctcatggcctaagtgaagccacaagtctcttcagtgctctggggttaatactaaccccacctctaagtgattcagtgactgtggatggtaaagttgaatctcagatctaattagtgtcttaacctgagctcatcctggcatgcatcattccacaacagaggagggtgaagcaagactttctagtactatttggaagcaggcgggggtaatattcaaaatgttgaaaaactggagtagcacaattaccagttaatcagaactgaggcagatgagctgatgggtacagtcaccattgtgccaaacattaaccctctaatgactgactcatgggaaggcataggaggagaggcctggggatgggctgagagaggtaatgagtatttaccattttgcacttttgttgctttttaatccaatgtaagaatagacgtactgcatacttcctgggttttaccagcccctaaatttactcacttaaaaaatttaattacatagacacgaatcattcattgtagttgctaaatattggtagcaactaactcgttgccttttgttggaatttcagattttcagtagagaatgtgactggcccagtctgaggcaggtgtccattcctggtcaccaccattatttttgggcagaagagcatactcacagagttaaacataataattaaaattgtgttttcctggctgggcatggtggctcatgcctataatcccagcactttgggaggctgaggcgggcagatcgcctgaggtcaggagtttgagaccagcctggccaagatggtgaaaccccgtctctactaaaaatacaaaaattagctgggtgtggtggca

SEQ ID NO: 463 - DNA, 5191 bp, Homo Sapiens
tgatgacaagatcaaatccgcacatatcaatactaactttgaatgtaaataggaaatgacccaattaaaaggcacagggtgggctgggcatggtggctcacacctgtaatcccagcactttgggaggcccaggtgggcagatcacttgaggccaggagtttgagaccagcctggccaacatggagaaagcccaaatctactaaaaatacaaaaaattagccaggcatggtggcgtgtgcctgtagttccagctactcaggaggttgaggtgggtgaatcacttgaacctgggagccagaggttgcactgaactgagactgtgccactgcactccagcctgggtgacagtgcaagaccctgtttaaaaagaaaaaaaaaatgtcacagaatggcaacctggataaagaagcaagacccaatgacccaatggtatgctgtcttcaagggacccatctcgcatgcagtgacacccataggctcaaaatgaagtgatggagaaaaatctaccaagcaaatggaaaacagaataaaagcaggggttgctattcctaatttcagacaaaacagactttaaaccaacagagatcaaaaaagacaaagaagggcattacataatggcaaagcattcaattcaataagaagacctaactatcctaaatatatatgcattaacacaggagcacctagattaataaagcaagctgttagagacccacaaagagacttagactcccacacaataatagtgagagatctcaacaccccactgacagtattagatcattgaggcagaaaattaacaaagatattcaggacctgaattcaatactggaccaaatggacctagcacaaacatctacagaactctctaccccaaaacaagagaatatacattcttctgattgccacatagcacgtactcttaaattgaccacacaatcagacataaaacaatcctcagcaaattaaaaaaaaaaaacataccaactacactttcaagccatagcacaagaaaaataaaaaatccatactaaaaaaattgctcaaaacgatacgattacattgaaaattaaacacctgttcctgaatgactttggggtaaataatgaaatcaaggcagaaatcaagaagttctttgcaactaatgagaacaaagatccaacataccagaatctctgggacacagctaaggtagtgttcagatggaagtttatagcactaaatggccacatgaaaaagtaagaaggatctcaaattaacaacctaacatcataactagaggaattagagaagcaagggaaaaccaatcctaaagctactagatgacagaaataaccagaatcagtgctgaactgaagggaattaagaaacaaacaaaaaacatataaaacatcaacaaatccaggagttggttctttgaaaaaattaataagatagactgctagctagactaataaaaaaaggagggaaatccaaattaacacaattagaaatggcaaagggggcattaccacttacccccagagaaatacaaagaaaaaaacacacacacacacacacacacaaaacacaaaaaacccagacagtactatgaacacctctatgcagacaaactagaaaatctagaagaaatggataaattcctggacacatacaatctccaaagactgaaccaggaagaaactgaatccctgaacagattagtaatgagttccaaaatttaagcagtaataaaaagcttactaaccaagaaaagcccaggaccagatggattcacagccgaattctaccagatatataaagagctggtaccattcctactgaaactgttccaaaaaaatgagcagggactcttccccaactaattctgaggccagcatcatcctgatacaaaaccaggcagagatgcaacaaaaaaagaaaaccccaggccaatatcccaaatgaatatagaagcaaaaatcctcaagaaaatactaataaactgaatctagcagcacatcaaaaagttaatccaccaagatcaagtagactttatccttgggatgcaaggctggttcaacatacatagatcagtaaatgtgattaatcacataaacagaactaaaaaatttcccaaaaccacataattatctcaataggtgcagaaataaaagagatgtgaataaaattcaacatctcttcctgttaaaaaccctcaataaactaggcattgaaggaatatacttcaaaataacaagagccatctatgacaaacccacagctgacatcatactgaatgggcaaaagctagaagcattcgccttgaaagctggcacaagacaaggatgccctctcttaccactcctattcaacatagtactggaagtcctgtccagagcagtcaggaggaagaaataaaaggcattcagataagaatagaggaggaagtcaaactctccctgtttgcggatgacataattctatatctggaaaaccccagagtctctgcccaaaagctccttgatctgataaacaacttcagcaaagtttcaggatataaaattaatgtatggaaatcagtagcattcctatacaccaacaacatccaaaccaagagccaaatcaggaacacaatcccattcacagttgccacaaaaataattaaaaacctaggcatacagctaaaccagggaggtgaaagatttctacgataagagttacaaaacactgccagaaatcagtgatgacacatacaaatggaaaaacattccatgtttatgggtagaaagaataaatattggctgggcatggtggctcatgcctgtaatcccagcactttgggaggctgaggtgggcggatcacgaggtcagcagattgagaccatcctggctaacatggtgaaaccccttgtctactaaaaatacaaaaaattagctgggcgtggtggcaggcacctgtagtcccagctgcttcggaggctgaggcaggagaatggcatgaacccgggaggcagagcttgcagtgagccgagatcgcgccactgcactccagcctgggcgacagagtgagactccatccaaaaaaaaaaaaaaaaaaaaaaaaaacacagaatcaatatcattaaaatggccatagtgccaaaagcaatttacagattcaacactatttctatcaaagtaccaatgacattcttcacaaaattcaaaaactattttaaaattcatatagaactaaaaaagagccagaatagccaaggcaatcctaagcaaaaagaacaaagctggaagcatcacattacctgacttcaaactatactacaaggctattgtatccaaaacaacatggtactggtataaaaacagacccattgtattagtccattctcacactgctaggaagaaataaccaagactaggtaatttataaaggaaagaggtttaattgactcacagttccacatgactggaaaagcctcaggaaatttacaatcatggtggaaggcaaagagaagcaggcaccttcttcacagggcagcaggacacagtgagtgcaagcaggggaaatgccagccacttataaaaccatcagatctcgtgagactcacccactatcacgagaacagcataggggaaaccacccccatgattcaatcacctccacctggtcctgcccttgacacatggggattatggggattacaattcaagatgagatttgggtggggccacaaaacctaaccatatcacacatagaccaatggaacagaatagagatcccagaaataatggtacacacctacaaccatctgatcattgacaaacctgacaaaaacaatgggggaaaggattccctattcaataaatggtgctggactaactggctagtcatagacagaagattgaaactgggccccttccttacaccacatatgaaatcaacttaagatggattaaagacttaaatgtaaaacctaaaactataaaaactctgggagataacttaggaaatgtcattctggacataggacctggcaaagatttatgatgaagacaccaatagcaattgcaacaaaaacagaaattgacaaatgagacctaattaaactaagagttgttttactgaaaagaaactatcaacagactaaacagacaacctacagaattggagaaaatatgtgcaaactaggcatctgacaaagttgtaatatccataatctgtaaggagcttaaatgaatttacaagaaaaaaaaacaaccccattaaaaagtgggcaaaggacatgaacagacacttttcaaaagaagatatacatgtggttaacaagcatatgaaaaaaatgctcaacagcattaatcattagagaaatgcaaatgaaaaccacaatgagataccatctcacacagcagaatggctattattaaaaagtaaaaaaataacagatgcaggctggctgctgtggctcacgcctgtaatcccagcactttgggaggccaaggcaggcagatcagctgaggttcaggagtttgagaccatcctggccaacgtggtaaaaccccatctctactaaaaatacaaaaattagccaggtgtggtgccaggtgcctgtaatcccagctacttgggaggctgaagcatgagaatcacttgaacctgggaggtggaggttgcagtgagcctagatcatgccattgagctccagcctaggcaacaagagtgaaactctgtctcaaaaacaaaacaaaacaaacaaacaaaaaaacagaggctggagaggttgccaagaaaagggaatgaagggactgcttatacactgttggtgggagtgtaaattagttcagccactgtggaaagcagcatggtgattcctcaaagaacttaaaatagaattaccattcagcccagcaatcccatttttgggtatatacccaaagaaatataaatcattctaccataaggacacatgcacatgtatgttcactgtagcactattcacaatagcaaaggcatggaattaatctcaatgttcatcagtggtagagtggatgaagaaaatgtggtacatatacaccatggaatactatgcagccttaaaaaagaatgaaatcatgttcactgtagcaacatggatagagctggaggtcattaccctaagcaatctaatgtgggaacagaaggccaagtactacatgttttcacttacaagtggga

SEQ ID NO: 464 - DNA, 1951 bp, Homo Sapiens
ttgagagaaggttataggacaccattttaaaaattctaatagatactagtacaagccagttgaaagtaagctattgtgaatgtgaatttccatctttttctttacatgttgattgatggagtttgaagatgaaatcccaaacaaacaaaggagtatcaaaatgttctgattccactatgtcatcatcagatcactggcaaatatccagtcactgttccaaagtactattgagtgccagctgactttatagaatgtgaaaaaataaagcaactcttatagtcaaatgtaatttcttagccaccataagcatgacagaaaactattcttttaatcattgaaaaactcttgatcaatgagccctaaagacattgatccaatccagtgctaaatcctcctacaggaaaatgtgaacatgagatttttccaataagggtccactggaaaaaaaataatagtaatagttcatgaagcgctagtagcagaaagctaacactgtcgagtttttctcaacatacatggtatgtaactctgtctcccctcagtgaacccattcagacatggcctcaacagaaatttgtggaagtatatttccacctaggcatcactgaaaagctagtactcttcattgtctatttcagcgcatcaaagatatattacattatttgacctaagcaattactacatgtttcaggatgttttactgctgatagattatataaagaacaccctgcaattcactaggcagtattggaaaatgcatgggtatccactattctgtgtgtttatagggaaaacaatataagaggtagcaagttcaacttcatattagatatgctggcatctttttaaaaatgtttggaggattcaggctcatgttcataatatatagatactaatatctcaagtgataatgaaacaacatgacttcctacaaatcagcaacatagaaagattaaaagttgtaggaaattggaacttccccaaaattcaaaagtcaaagataaaccagttcctccagtgttcctggcttaatagagtggctttatataacaactgctcaacagaaaaacaaactcaatgcattaaatctcaacaactgcagttttctggctttaccatcttgctgggtatacttctcaaaagacaaagcctaaacttcatctcaaagcaaggtggtctttctgatcacgttgaaatattctatcaaagagcaaaaagcttttgaaggctgcagtaagttttaaaagtaaaagagtgaacaacctggtactatccattattgttttaatgtagggcaagcaggtaactcttgctgctggtgggcatgaagaaaagatcatttttaatcctttgtttcaaagaatgtataagaatgccatttattacaatagccatgataaaaggaaagtggtcctccagtaagaactggtcatctctttgactgaatcattttcaatattcttgaatattgtgtcatgctgaaaatacagatcatgtgggttatccacgctgtggtataaaagcaagaaatctgtaatagagacaggccagctgtagacctaaatcagctgtctctcaatgatattaagcatcttctgtgggatattcgccaggtttaactgaatgggagatggtgggtgaacaagcaccaaataggtgagtctttgactataaccccctctgggctctatggccaagtgtggcagatcccagagtgaacacacaatgataatgttgtagctggggatcatttgccacagcaaacaaccctgtcgtatttgacaatgtttgagataaatttctctccctttattgaaatatgttgagaaagactgaccagtttaaggacacacagaacattgtgtaattcctaaaggttgtatcctttgtactggaaagaaaccctgagctagaatttcaagaaaaagtgaatctagacaaaatgacaaaa

SEQ ID NO: 465 - DNA, 6164 bp, Homo Sapiens
gggttcatggatctgtcctgagaggaggacgaggtgtctccaatgccaagcttcggcagcagaagcagcagccacagcgtacacaaaagcccgaactgttgggaggcggagggtggagggatcctgagagagggactgcggccggatgcccagctgtcggagccccggccagtgtcttctgcagttacattgccttcactggtcatgagaggaggggctgtggtagggccttgaaggacgcctgtggagccagaggccattggattgcaggcagccaagagctacctcgcccctgctatctgctgtggccctcgccgggatgcgatgccctgacatgggttgcctggagctgtgcgcaatgagcaaggggacggctgatggccctcccagatctgcatggcctggaaaccataaaactcttgggaactatcacatcttccccagctacaggaagaatagaagtagtgttggagaagtcaaggggtcagaagtactgggggcgttcccaggttcagccagaaacagttcacaagagagttttaaataaagtgtacctgtggctaaatatgacctactgattactcttaattttttcgccacatttattgagctatgatttacatattgaaaagtatgtatgtttagggtgtacaatagagtgcttttagatgtgtatatatctttaaattacctcaagctggttaacatatctatccccacacatagttaccttatacgtttctgtgtatgtggtgagggcacctgagatctacttttgtaaacaaatttcaagtacaggttattattagctatagtcaccattctgcacataaggtccccagaagttttttattatgtaactgaaggtatgcacccttcgatgggtatctccccacttttccccaattcttagcccatggtaactaccattctagtctctgtttcattttttctttctttctttctttttctttctttctttaagatttcacattaaaatgagatcaagcagtatttgtctttctgtatttcgcttatttcacttagcataatgtcttcaaggttcatcaacattgttgtaaatgaaacaatttcattctttattaaagctgaaattatctctttctcacagtttacctatttatttgtatcagaggagtgcaggtacgcttggtgatactaattttatgtctattggctgtatactccaaattgggattaaagatacttctagtttaaaaattttaaggaacctccctactggttttcttgtttgtttttttgtgttgtttttttgtttataatggctgcaccagtgagcatgttcagcaatggtggacaaatattctcctttctctgcaccctaacactttttgtattttgaatttttgataatagctgtgctaacaccacgatgaggtgatatctcattgtgattttgattttcattactttgataattagcaatgttgagaatctttttatatacctgctggccacttgtatgtctttgggaaaacatctattcagatattttgcccagtttatcaggaaattggtttttgttttgttctgctgtgagtttttttttccacattgactagtgttatgtatattttggatagcaacatcttatcctacatatggtttacaaatattttcttccatcccatatattgtctttatattttgttgattgttttctttattgtggagaaagtttttactttgatatagctccacttttttatttttgcattagttgcttgtgttctttctgtcaaagccaaaacatcgttgccaccaccagtgtcaaggagctttctccctgtttttttttttagaggattcattatttcagttctaatgtttatgtctttattttaaactcatttttgtgataagagaaggctttacttttttgtgtgtgcatagctagttttttctaacaccatttcttgatgtgtctatcttttcctaatttggtgggatcagtttactgtatatgtgtgaatttatttctgggtcctctattctattccatttgtttctatgtaggtactatactttcttgatgagtatagctttgtaatattgtttgaaatcaagaagtttgaggctttcagcctttttattcttctcaatatttggctatttggggtcttttgtggctccatactaattttacaaatgtttgttttacatttattttaatggcattaaaattttgatagaaatttatttaactgtagataactttatgtagtatagatattttaacaatgttaatttttagaatcgatgaacacaggatatattttccattttgtattcttcaattttttatcatcattttatagttttcagtatgcagatctttactattcttcgttaaactcattctatttaatgacttaagtatttaattctatttgataatattgtaaatggaattgttttctttattcctttctcagatactttgttgttactgtacaaaaatgcaactgattttcatgttaatattgtatcctgtaagtttattgaatttgtttttcagctataacatggttttgttgttgtttttggcaaagtggtgggtatttttaaggctagttatactttacatggatagttgctactatcattctttaaaatatgaccacaagggtttctgttgtcatgacttcagtggaattcagatcttcccatttgaaataattttgtcggttttgcctgggccccgggatgggtgggggggccaccccacgggagtcgggagattcaggataaggagggagaagcggtcagggaggaggctgagcgcggaaagcagacaggctccagggacagcagggaggagagggattcctgtcagtgacccagtggggagagagaatgggccagaagaggggaaagggtgggagtgggcatcaggactgcttcctgacacgggtggggggcagggaactttgctaaaactgcaggccccagggaacagtgcaggtagggtgggagggagtagagaagaccaggcggaccccaaagtcatttgagaaaggggtatttcccagttccttcacctctgcccagcgttctgtgggcatggaccccagggccagggtaggggaggaggcggctcctggcatgcagggagagctgaggagcgcacacccgctttgtagggcggtgtgatggtggaagcaagtgaaggctgaggataccgttggctcagtggatgggctcggggggcaggggtggggtcgagctcacagggcccagcacccggacctgcaggtggccctggaggaatccacccgcccgtgccttccaagagaccagtgtgcgaggcgccgcggacacgccttttctagctggaacatttgtgaggctggaatttaagctctggcagacaggcggcagaagaaggactggaagaaacccaagtgcaaagtccagcccaaggagaggaagcggaaatgcctggcctggtcaaactgtgctctgactagaagattctgggctggatggtcaccgtcctatagagacgcaggctcagtgggacttcgaggagcaccagggacccagtgcagcaaagcagagcgggcggtgaggacccacagctactgcttccctgcacagttcgccttctccaaggcccagcccccagctgagcccagcagtgagttgcatggagcctcctggaacactgcctcgggtgaccggtggaagaccccacctcccagggagaggaccgtactatgtcctcagacaataaagcagctcctccgaccagaaaaataaataaataaataaaatataaaaatgttgtttgcttttcgaaaataatttgtatcctgtttactggtcaacatactgcccatttctctatatgcctaattagtcaaacttttaaatgaaattatttaacattacgatttttattatgaaacaaaacagtaaattttgtaatggttttaatatcatctaataggattgaaaatatgtcaatttgtcattgccaatgaatatttgtgttatttattttatactgttagatattctgtctacaaatgtctaatggcttagaatcttgcttaacatattgtatgtgctaagtcctaactattccaattcatcaaattatctttttataccattcttaaaaatacaatattattttttatttttattaaagttatttttctaatataaatatttatgaaaattataaagtctattcagtctgccctcttgtcagttgccctcttgtcaaaactgaaaaaaagtcagtttttttctctttattaatacactagagggtataaatgtagcttcattacagggacatgttgcatagggatgaagtgtgggcttctgtgcaacaatcatctgaacggtgctcattttcccagttaggtattttctcattcctaacccctctaccaacctcccatatttgtgagtctccagtgtctatttttccaatctctatgtccaagtgtatgcattattgagctcccacttgtaagtaagaaaatgtagtgctttatgttctgtttctgaattatttcacttacaataatggcctccagttgcattcatgttgctgcaaaagacatgattttattctttatggctgagtagttttccatggaataaatgtatagtacattttctttatccaatcattgactgataaatttaaactgactccatatcgttgctattgtgaatagtgctgcaataaacatatgagtgtgggtatcttctttatgtaatgaattattttccttcgggtagatacccagtagaggaagtgcaggatcaaatggaaattccatttttagtttttctgaaaaatctttatactgtttgccatagaggttgtagaaatttacactccctcgaacaatgaataagtgttctcttttctctgtatccttgccagtatctgtcatttttctgctttttaataattagccattatgaatggtataaaatggtacttcattgcgatttttaattggaatttctctgatcattggcaatgtttaacattttttacatgcttcttggcaatcattgtcttctatttgaaaaatatctgttctcattctttgcctgctttatagtgaggttacttgttttattcttgttgtttgatttccttgtatattgtagacattagttctttgtcacatgtatagttcacaaacatttttctcatttcatgggttgtctgctcacctgctaattaaaagctccttttcaggaactttttagtttaattaagttccatttgtctatttttgttattgctacatctgcttttgagatcttggtcatgaattatttgcccaggccaatgtccagaagcatttatcattgggtttcttctagaatttttatcatttcaggtctaacattttagtcttttaatccatgttgagttgatttttttacatggtgagagtcacgggttccatttcatacttctgcatgtggtaatataatttttcaagcacaacatgttgaatagaatgtcatttttccatgtatgcttttattgattttgtaaatgatcagtacgtggctttatttctaggttctctattctcttacattgatctgggtgtctatttgtatcagtaccatgttgtgttggttattcaagctttctagtataattttaagtcaggtagtgtaatatctccaactttgttctctttgcttaaatgtgctttggctattcagactttgctatggttacaaataaatttaattcttttgctaattctatgaaaaataacattggcattttggtaggaattgcatttaatatgtagatttttggagggcaatatggtcattttaatgataattcttccaatccattagcagggatgtttttctcatttgtttgtattatgtacaatttttttcatcaatgttttgtagttttccttgtagatatctttcacctgtttgattaattgtatttccaggtacttttgtagctattgtaaaaggaattgactttttaatttggttctcagcttgatcattattagtgtataaaaatgctactaatttttctacattgatttttaataatcctgaaacattattaaatttcatttatccaatctaaaaggtttttg

SEQ ID NO: 466 - DNA, 3231 bp, Homo Sapiens
tgaaagtttgactcggtcttttccttccaacagttataaatctgtgaaatgaaagtctttgtttccttaaagggatttcaagaatttaacaaaagggttggggaatggaacctttgctgtcactatgcctgtctctcaattctaccctaaaggtaaactaaatggaatccttttatggtgactaggattaggatgttgattccaaagcctttccctaaaatctattccttgctccctggaaaggataatacaggttctggcccccactgtaggtactgacagcccaaggcagaataggttttgctaggctttagccttttattctttgacataggtcagtcctgcaggcttcttttttctaagtctcctgcctatccaaaaccagaccttttctcccacctccttctgcttcaagcctcttaataatccatatttctattttctagcaatagtaatagtttattatttagtgatgtatacttgcaccccatttactccttttcaatatttcaggatacatctttgtcctgtatttctgtaccagttcacagaatttctacagcaagatccctttaaatgtatggctttccttcataggttgcaaggattactttatacaagtgctactgtaactatatcttttgtggagtacaattggtatgacatgctgtgttcatagatgaaaatgctaagtgaggcactctgaagcaagttaaagttcacagacattcttgcttgcccaccacccccccgaaccccgccatggaatcatcaaataagaaaaataagacagattttcagattggtgatggcaaagtaagacgctggtattttgcactggcgcagtccatttagttgttgaatttgttcagcatacctggatggtgagtgagttagctttatttttcattctcagcagggaaactgatagactaggcagtttggggaattttcccattgtctactgtcatgggtccatagtatttaagtttacagactacaacattgtccacagaagccatatttatccccttggagggaagggaaaggtgtgctaacttagatcataaaaacaactgaattttaaaacaaggcaaatgccacagttcaacttctccataaaaaagttaagttcatctctccattcttttgcatgcctacaatatttccatataacaactgtaaaatactcttgcctgctgcaatccaaatgttatccggatcacagttcttgctgtcatttcacaggcatgcaatgtatctatagataggtcatatcatacctgaggaagatcagagacagcaagggaacattttccccacacttgagatggaaataataacaggtcagtggctaataaaaagaaacatgtatgactttgtaaaaccctaaaagtgatgttttcaagaaatttaggtttcttttttttattttataaaaaaaatgttgacatgcaatttaattctatttcaatttaggtgctgcaacctgtactggatgtttggggatagaaagatgaatgggacatgatttgtgtgctccaatgagctcagtccagtgtaagtgtaaaagttaaagtgccatattgtttattcagagtatatgttatagtttgtgaaccttatatcatttgttaaatgaaaggtttttataaatcaacagtaatattgccatcccatgtaaaaatcctttgatattgccaggaaacaactttaaatcaccagaaagctttaacatcaaataatacttttagaaggaggggaaaagccttccacctcgacatcgagcctatgaagtattccctaaaaaagaggaactaatctgagaaaagtttacacatttttaatactctaagttgtagataatgaaattgatttaaatcaaagttaactagaataggattcatgtgtcatgaattatattgtctattgtctcataagcaacaagtgacacttattatcttggctgacaaaatcagctaccatttaatgaaccaagttaagaataactcaggtgactgataccaaaaataaatctctaatacagctgagaatccagaaacacaaataatatgttgagtaagtaataaaagtgacatttcaaattagtaaggaaaaaatggattattcaacaaatagtatgggatagcataacaatttagaagaaatataaagttagatctttcacaaaaattaattctagctagactagcagttagtcttctactttttggttactcccttttagaaattggaagctatgaagctatataccctgtccatttgaaaatgcacataagcaaagaactttacaaataggttataaagagaagctcaatctcagcaaaataagggaagtgcacattaaaacacaagaaaccatctcagatccaactaatatttagcgtgcatacaaatcaaaagctggaaagggtgtggaaaaacaggaatacattgctagtgagcatacaaattggcacagcctcttttaaagacaattgtgtatcacccattaaattttaaaagtcacataccctgtgacctaacaattccaacttttaatgtcctaaagaaacatacatgtgttcacaagatagcctgtacaatgatgtcaattgcacctttgcttgtacagtagacccccttatctgcattttcactttttgaggtttcagtcatccaaggtcaaccacaatacaaaaatattaaatggaaaattccagaaacgaacataagttttaaacttcaaacctttctgcatagtataataaaaatctctcactatccctctccatcctgcctgggacaggaatcatccctttgtccagtgtatccacaatgtatacactcattatatacccattttataatgcccattagtcatttctattatcagatcataaaaaaacatagtacatagagggtttggtattattcatggtttcaggcattcagtgagggtcttggaaaatatcctccatgatgggggagctactgtaatactatgaaattggaaaaaccaaaatactcatcaagaggatggactatggtacacatgatgaagtattaagtatcaatgaaaaagagagagtcctacatgtccggcatggaaggatctccaggagacaatgttaaaagtttgggggaaaaattgaaagacaatacctgtaatacatatgatactagtgatgttaaatcacatcacacacacacacacacacacacacacac

SEQ ID NO: 467 - DNA, 8083 bp, Homo Sapiens
actcactgggatttctgttccagcagcctctccgttctagttgtgtatccactacacacatttttggttggtgtctacaatgcctcggctccatgctgggcactgaggacactgcaatgcaccagaaatgatccctgccctgcaggagctgcaattgcctcttggtgactgtttctgacacactttatgtggaagttggttcaatcaggaaagagacacctctttggacccccatctctcacccagtccacacttcctggtggtgactggtcggctccctagtttcctggtctggcctgagcagccggatcttctcctacgtacctgcttcatttttcctgctgcctgaagagagcccttgggacccatcctcccccgtcctttatttgtgtagtcttatgaagaatccgcagcgtaagaattactttctaacaatggcatctaagagtggaaagtttaactcatccagcaaaacagaacatggagactgaggacagaaaagagaaagaagcgtagggcaagacccctcctccaaattgcagtcctttaggaatttctggagaggtaacctggggtctccccaagcttcctgcagcccaaccaaccaacccaccaacctggctgatgcatatgtggaatatcggcttcctgttctctgaagggcaaaaaggacactgaagtatagcctacaggctctgcggcccaaagctcattaagaagataatagatttaggccagccgcagtggctcacgcctgtaatcctagcattttaggaggcctaggtgggtggattgcctgagctcaggagttcgagatcagcctgggcaacatggtgaaacctcgtctctactgaaatacaaaaaattagccaggcctgatggtgtacgcctgtagttctagctactcggggggctgaggcaggagaattgcttgaactggggagacggaggtttcagtgagctgagactgcatcactgcactccagcctgggtgacagagcaagactctgtctcaaaaaaaaaaaaaaaaaaaagaagaagaagataatagatttagaagacacacaaataattgtttaaaagaatggccctaatgtgctgcagtctgaggtggaaggttagtaaggtctggacttcctcggaatatgactgagttttcagatcacgtgagacgtcttcatggaagacattgaggtagttaccacatcttctggatgtcccacagccaacagcatatcaatttgggctccttcagacattaaaagcaggaattggattagtgtagctgccggaggtttcccactgtctccactcccagtttccacgtgcatttcctctggtgctcatcaagtgtacagtgctgctgtggtgagaatttgtcaaatgagtctccagtctcagaaggtctatgtaaatggggtttcaagtcatcacagggactgaatttagtctcaagtaccataaagaaaatacttttaaagctcttctaaaaataaagctcctctgaagagatgtttggcctgtggctaatgtgtttggaaacatgttttctgtaaaactcaaccttattcatctacttgcaaatccagaaagacaactttcactacacacatcagggcttgtcccaaattttccctactcacagtggaagatgccggggtgtgaaccattggcttaaggtgcctctgcctccctttccccaaaacagtttaggaagggagggtttgggtctagtgtccagcctgggctcagctttggatgctggcaacctggacctaggcacaccagggaggctgctttctttgcccttgtcttgccacttcccatctcccatgtcataggaggagcttggaaggagctgaaggccgtcaccttcctacaaagcagagagatcctctctccaagaacggcttttgctgccctctgggtcctgctatttccatggctcctgaagaatcagcctctgatatttcaattgccccttcatcagaactgtcaaacctggtgaatctcttctctttttctctggctcactctctctaaaacacgcatcttaaacaagttttaaaatccctgaagaatggcagaaatacaaagaactcaattccaaataatattgtcatgttctgctgcatagttgaggtaatcaccgttaagtaagtgcaggtatgggtgactctctaagacaaggatgaaagtacagtggacaggtgagcccatggcccaggactcaggcactcacagcctcccacgtttcttctctatttcacaattgctgatccaaggcgggaggggtgccattcatgtgtggcattcacatgagagaggtgggcattgtgggtcctcagtgcagggcctgttgtgtcctcaatgaacccaggattgagtcccacagtggacagactttgccaacttttataaatctctctcaagacactctcctccaatattgcaccttgaactgatgtaatttcttgtagcgaaaaaattaaaatctatcctttttgaccttcatatgcaacatgcatatcaagagagttgtcttagcagcagcaattttatattgggagatttgagcatggactggctgttgggagagctttatgaggcattccatgatgtcttggctttaattttgcttttattttgatgtgacaagatgtgttggactgagatgcctttgggctctagccctggaatttacaaaaagagaatactgcagggttatggtgggggtgaggctggaagatgttacccactcacaaagcttcagcacagcaacatatgttagaagaataaactaacattggaacagtaaatacacacatacacacacacacacacacacatacacacacacacacacagagtgggagagagtgagagagagtgcaaagccagtgttaaatcctggacatccctgcagggtcctcatgcctgcctttttctcttagtcttgtgggggtggggaaactctttggtattctcctttctcacttgtaggaatataaggaggaaaggaaccagaagtaaagtgtctgggcctctctcagccatgcttttcatttccacttattatctaaagtaattcattactacttctgtgctctcttttcatcttttccttgagcctcccctgagctcccttgaaggtggcaggtgacaggctggcttgaccagaacaaagacagttatccctggctgccgcctgtttcccaatgggtgcctgccctgtcttgttacacttcctctgtgtgtctaatttacactgcaagccctctgggcagtggctttttttttcttttttaaaaaattatctgctcttctctgcttacgactgaagtttaacttctgcaccccaactcctcctcattcttaagaaaatgccaacagaaaaatattaaaatgattgctgctgtatgtaaagacagaagggtaaaaccgaggcactggaggctttgggtgggtattgatggaggtctgggagcagctggtgattgacagggagaagagctgaattagttaaggaagggtctcctgggttttgctgggagtggtggccagacacagacaaggacaaggaagaaggccaggacctctgattgcttttctcagaacagaaaagatattattatttgaacctagaggctgggcagtttcctgtcatagaaaaactgactggcctcatggccagagaaaggtaccaactactttctttggtatttatggttctcgtatccaacgtaggaagttagggctagacaacatctggaagtatctggtagaagtatctatttatttaaatcatccatccattcatctatccatccattcatccactgatccatccatccacaatgattaactgcagtgaaagagaagacatttttagaagataaatgtggtcaaatgtcctaaagttttattcgcttgcatgcaagtaaccgtgatgtgtctggaggactggagggctggaaatgaaaggagaaaagcaattatctgggcccatggatttgggaagcagatatggggatcctctcactgctgacagagccccagtaaagcatctggaagggttttaaacagaatgagggtgtaacaatgacagacgtattcttcctccttcaaaatccacaacaaaataaacaaccaccaccaaaaaaaaaaaaaaaaaaaaaaaaaaaataggagaggtcaattcaggaaactttcctagaaaagtacatgaggtagaagagaaaggatagggaggagaccaagcattctaggttgcaaggaagacctaggggatgcctgagggtggggatgaagggactgacaaacatgttccatgggccatctatgggtagggcactcggtcgtgagagtagtgatggcacctgaggcagggctacaggaatagatgaggtagggagccctgtcagggtgcagtaagcatcccatggagaaggcacgcactgtgggcctggagcttactggggaggtggaacaagcagggaagcagtccttggtgcaagcaaggatgcacattccacatcaggctgcccgcccacgaggagggcctacacttgtggctctgaatccatgtggaggcggaaacggtctggttaagatagtgacaatgtgctttgtgtttgtgcctgaagggccagggaccacgctgtggcacaatgaaggcattgagagtcagcagtccccaagactaggtgtcctaacaagatgccaagacccagagagacaagagctgagcccttgccatgaaggtgccgagagctgtggtctcagcccttggaaatatcatcaaaagaagctgttccgagcaaaatgcattccatgtgttggccttgcccatgtgtttcttgtcaatgaggccgatcttcctgggttcagaagggtttctgtttgaaattttatgagccttggctgggaagcagaacttatccctgagtttgtgggagttaatggccttttctggcggcacaactctgggggcctcagggaattcccaaatgccaggaaagaagaaacccatagcccgtatttcaactgaaaattatgctttatttataggcagccatggagaaaagactccccagaacacttctccagcgtcacctcagtgtggtgtgtctgggctcacaggcccttccttggggtgacccttacagctcatgccagcactctgtggaaaagatatgcctcactccccagtgccaaataaagacatcagcctacatccagagcagaaacagcatttgttcctgagtcttccatttttgccatttaaatagagaagtcaaactattccttgatacactcttgtccccctaatttacttcaaccaacacgtatggggcacagactgggaactggtcattttattgggcatcattatgagcacaaagggacagatatgagatgggcaatccagaaggtcttggttcaagccatttccttccattgtctatcaagttctgtcaccgggacaaatcatttcccctccctggacctctgcctcctcatttgtcaaatgaggagcttggaccaatgaatatgaattctgaagaaattcagtgtaagaggaagagtcttaaaatactagtcctaaaaggttaattgaaggagattcatggaagtgatgcaaatattggtgttttgtatgagtgacacttaactgcttcttgtctatggcaaatgatattcctggggtagctaagaaagaccctttcgctgcctggcgtggccctctgtgaaccctgctagcctgacatgtcatatcagagctccctgcagaggagttgctgttcacagcaatcatctgggccaggctcttgacctgtacccctgtcagtgctttgctgtcttggcctgacccttggccttagctgttctctgccctttggacttggggttgctattttctcttcccatcttgattctcagttttccctcaaggtcttggctgagacccacccatggactcacctttcttttttcaaactacctcagataggatttgagtgccctgtttgatcccttgtgactcaatttctgttgctggacaaagaaaaaagaaaggcaagggaattggaaactttacagtataatactctgctcagcagtaagtattgcaccagaattttagtcaaaaggagtatgtataaaataaaccatgttagatcgagctaaaatatgactcactgagaattccaactctaggtcttagatttttcctttgaggttacacatgaacaagcctaattccttctcatatgatagatcttcacatatttaagtataatgatcgagcccccagccttcggtgaccaccccctctcctgccaagtcagttcttctctaggcaaaacaagtcaatttctctagcattcctcagatattttggttttgaatccttttgccgacgtgacggctcttcctaatccagttcaactgatttctgttcctcttcctttgaggtgcctgcagcttcatgcaacactctagacaggctccagtcaacccagggaactgaaatcttttgccttaaattgatgcttcccaaagtgtgttccattcatccaagcccctgtgacatgctctggaggtcaagggtaggtggtcacttagtttcacagtcaaatatgtttgggaaatcctgcagactaatatccctcttggagatttcagaatctgtgttagagtactaaaggatctgagtagtcctgtttacctttacttcatctaatttttcccgaattattcgaccactgagccgtttgttaaagtattactcattaacctccctagtgtgccatgaagctttgggtggcactgttcaacttccatttaagccatctgaaatcatttatttttttcctctttccctccctttctccgttcttttcttccttcttctatcacactattattacatattgattttagtgtcaatcaaacctcctacatatttttcaaacctgttgctgataaatcatatgtaaagtccttcacccttcttccctttatttgggcagctgttatttgatattcatcacttatgtattaagcatgcctttatttaagcccttaataaaaatgaaacttcataaatatttgttgaataagtacaggactgaggcctataccctttggacatggtaattcaattagctattaattatcctaatcacactaatattcagcccatgtttctctatgcttgtccgtgaggctatcttgaaatgcttgtcaaatgctttgctgcaatcagattcactatgaagttagatttcataatctaccagtctagagccatcttgttgaagcaggagatgaaattaatatggtaggactttgtacttcaggttcctgcgcaggagtttagaaacacaggtgagccttgatgggagggtaggatttaaaaaatggaggggatcataaaaaggattgtgggctggttggggtaagcatgagtaacggactacaggcaagtgtaaacatgttgggaatggttaggataaatttaacaatatttatccagtgttcactattgtgaggttttatgcagggagctggcagcaagggggttggttgagatggataaatagctaataattaactttataagtaccacttaaaagataaaatgtgatgagtgttacataaaaggaaggagtaaagtaacatagaacatttgttctgcagagtcagggaaggcttcacaatacaggtggcccctgagcagctatgaagattgggcagggctctgccagagaatgatagagggcttcaggattcaaaactttgatgatggaacagatctgtgaatggaggtgtcaatggattaacatgacttccagattcatgacctctttcttggacctgggcaaagccttgtggcattttagatggagctgggtgactggcactatgaccttgggctctgcctgaacctcacgtggatcatctataacataaaggtagtagtatgacagtgggggtgaggattgcataaacagtggaagtaaatctcccacatatcaggggtgcttactgaacctccttcctctcatctctcccagcc

SEQ ID NO: 468 - DNA, 7975 bp, Homo Sapiens
actcactgggatttctgttccagcagcctctccgttctagttgtgtatccactacacacatttttggttggtgtctacaatgcctcggctccatgctgggcactgaggacactgcaatgcaccagaaatgatccctgccctgcaggagctgcaattgcctcttggtgactgtttctgacacactttatgtggaagttggttcaatcaggaaagagacacctctttggacccccatctctcacccagtccacacttcctggtggtgactggtcggctccctagtttcctggtctggcctgagcagccggatcttctcctacgtacctgcttcatttttcctgctgcctgaagagacatccagcaaaacagaacatggagactgaggacagaaaagagaaagaagcgtagggcaagacccctcctccaaattgcagtcctttaggaatttctggagaggtaacctggggtctccccaagcttcctgcagcccaaccaaccaacccaccaacctggctgatgcatatgtggaatatcggcttcctgttctctgaagggcaaaaaggacactgaagtatagcctacaggctctgcggcccaaagctcattaagaagataatagatttaggccagccgcagtggctcacgcctgtaatcctagcattttaggaggcctaggtgggtggattgcctgagctcaggagttcgagatcagcctgggcaacatggtgaaacctcgtctctactgaaatacaaaaaattagccaggcctgatggtgtacgcctgtagttctagctactcggggggctgaggcaggagaattgcttgaactggggagacggaggtttcagtgagctgagactgcatcactgcactccagcctgggtgacagagcaagactctgtctcaaaaaaaaaaaaaaaaaaaagaagaagaagataatagatttagaagacacacaaataattgtttaaaagaatggccctaatgtgctgcagtctgaggtggaaggttagtaaggtctggacttcctcggaatatgactgagttttcagatcacgtgagacgtcttcatggaagacattgaggtagttaccacatcttctggatgtcccacagccaacagcatatcaatttgggctccttcagacattaaaagcaggaattggattagtgtagctgccggaggtttcccactgtctccactcccagtttccacgtgcatttcctctggtgctcatcaagtgtacagtgctgctgtggtgagaatttgtcaaatgagtctccagtctcagaaggtctatgtaaatggggtttcaagtcatcacagggactgaatttagtctcaagtaccataaagaaaatacttttaaagctcttctaaaaataaagctcctctgaagagatgtttggcctgtggctaatgtgtttggaaacatgttttctgtaaaactcaaccttattcatctacttgcaaatccagaaagacaactttcactacacacatcagggcttgtcccaaattttccctactcacagtggaagatgccggggtgtgaaccattggcttaaggtgcctctgcctccctttccccaaaacagtttaggaagggagggtttgggtctagtgtccagcctgggctcagctttggatgctggcaacctggacctaggcacaccagggaggctgctttctttgcccttgtcttgccacttcccatctcccatgtcataggaggagcttggaaggagctgaaggccgtcaccttcctacaaagcagagagatcctctctccaagaacggcttttgctgccctctgggtcctgctatttccatggctcctgaagaatcagcctctgatatttcaattgccccttcatcagaactgtcaaacctggtgaatctcttctctttttctctggctcactctctctaaaacacgcatcttaaacaagttttaaaatccctgaagaatggcagaaatacaaagaactcaattccaaataatattgtcatgttctgctgcatagttgaggtaatcaccgttaagtaagtgcaggtatgggtgactctctaagacaaggatgaaagtacagtggacaggtgagcccatggcccaggactcaggcactcacagcctcccacgtttcttctctatttcacaattgctgatccaaggcgggaggggtgccattcatgtgtggcattcacatgagagaggtgggcattgtgggtcctcagtgcagggcctgttgtgtcctcaatgaacccaggattgagtcccacagtggacagactttgccaacttttataaatctctctcaagacactctcctccaatattgcaccttgaactgatgtaatttcttgtagcgaaaaaattaaaatctatcctttttgaccttcatatgcaacatgcatatcaagagagttgtcttagcagcagcaattttatattgggagatttgagcatggactggctgttgggagagctttatgaggcattccatgatgtcttggctttaattttgcttttattttgatgtgacaagatgtgttggactgagatgcctttgggctctagccctggaatttacaaaaagagaatactgcagggttatggtgggggtgaggctggaagatgttacccactcacaaagcttcagcacagcaacatatgttagaagaataaactaacattggaacagtaaatacacacatacacacacacacacacacacatacacacacacacacacagagtgggagagagtgagagagagtgcaaagccagtgttaaatcctggacatccctgcagggtcctcatgcctgcctttttctcttagtcttgtgggggtggggaaactctttggtattctcctttctcacttgtaggaatataaggaggaaaggaaccagaagtaaagtgtctgggcctctctcagccatgcttttcatttccacttattatctaaagtaattcattactacttctgtgctctcttttcatcttttccttgagcctcccctgagctcccttgaaggtggcaggtgacaggctggcttgaccagaacaaagacagttatccctggctgccgcctgtttcccaatgggtgcctgccctgtcttgttacacttcctctgtgtgtctaatttacactgcaagccctctgggcagtggctttttttttcttttttaaaaaattatctgctcttctctgcttacgactgaagtttaacttctgcaccccaactcctcctcattcttaagaaaatgccaacagaaaaatattaaaatgattgctgctgtatgtaaagacagaagggtaaaaccgaggcactggaggctttgggtgggtattgatggaggtctgggagcagctggtgattgacagggagaagagctgaattagttaaggaagggtctcctgggttttgctgggagtggtggccagacacagacaaggacaaggaagaaggccaggacctctgattgcttttctcagaacagaaaagatattattatttgaacctagaggctgggcagtttcctgtcatagaaaaactgactggcctcatggccagagaaaggtaccaactactttctttggtatttatggttctcgtatccaacgtaggaagttagggctagacaacatctggaagtatctggtagaagtatctatttatttaaatcatccatccattcatctatccatccattcatccactgatccatccatccacaatgattaactgcagtgaaagagaagacatttttagaagataaatgtggtcaaatgtcctaaagttttattcgcttgcatgcaagtaaccgtgatgtgtctggaggactggagggctggaaatgaaaggagaaaagcaattatctgggcccatggatttgggaagcagatatggggatcctctcactgctgacagagccccagtaaagcatctggaagggttttaaacagaatgagggtgtaacaatgacagacgtattcttcctccttcaaaatccacaacaaaataaacaaccaccaccaaaaaaaaaaaaaaaaaaaaaaaaaaaataggagaggtcaattcaggaaactttcctagaaaagtacatgaggtagaagagaaaggatagggaggagaccaagcattctaggttgcaaggaagacctaggggatgcctgagggtggggatgaagggactgacaaacatgttccatgggccatctatgggtagggcactcggtcgtgagagtagtgatggcacctgaggcagggctacaggaatagatgaggtagggagccctgtcagggtgcagtaagcatcccatggagaaggcacgcactgtgggcctggagcttactggggaggtggaacaagcagggaagcagtccttggtgcaagcaaggatgcacattccacatcaggctgcccgcccacgaggagggcctacacttgtggctctgaatccatgtggaggcggaaacggtctggttaagatagtgacaatgtgctttgtgtttgtgcctgaagggccagggaccacgctgtggcacaatgaaggcattgagagtcagcagtccccaagactaggtgtcctaacaagatgccaagacccagagagacaagagctgagcccttgccatgaaggtgccgagagctgtggtctcagcccttggaaatatcatcaaaagaagctgttccgagcaaaatgcattccatgtgttggccttgcccatgtgtttcttgtcaatgaggccgatcttcctgggttcagaagggtttctgtttgaaattttatgagccttggctgggaagcagaacttatccctgagtttgtgggagttaatggccttttctggcggcacaactctgggggcctcagggaattcccaaatgccaggaaagaagaaacccatagcccgtatttcaactgaaaattatgctttatttataggcagccatggagaaaagactccccagaacacttctccagcgtcacctcagtgtggtgtgtctgggctcacaggcccttccttggggtgacccttacagctcatgccagcactctgtggaaaagatatgcctcactccccagtgccaaataaagacatcagcctacatccagagcagaaacagcatttgttcctgagtcttccatttttgccatttaaatagagaagtcaaactattccttgatacactcttgtccccctaatttacttcaaccaacacgtatggggcacagactgggaactggtcattttattgggcatcattatgagcacaaagggacagatatgagatgggcaatccagaaggtcttggttcaagccatttccttccattgtctatcaagttctgtcaccgggacaaatcatttcccctccctggacctctgcctcctcatttgtcaaatgaggagcttggaccaatgaatatgaattctgaagaaattcagtgtaagaggaagagtcttaaaatactagtcctaaaaggttaattgaaggagattcatggaagtgatgcaaatattggtgttttgtatgagtgacacttaactgcttcttgtctatggcaaatgatattcctggggtagctaagaaagaccctttcgctgcctggcgtggccctctgtgaaccctgctagcctgacatgtcatatcagagctccctgcagaggagttgctgttcacagcaatcatctgggccaggctcttgacctgtacccctgtcagtgctttgctgtcttggcctgacccttggccttagctgttctctgccctttggacttggggttgctattttctcttcccatcttgattctcagttttccctcaaggtcttggctgagacccacccatggactcacctttcttttttcaaactacctcagataggatttgagtgccctgtttgatcccttgtgactcaatttctgttgctggacaaagaaaaaagaaaggcaagggaattggaaactttacagtataatactctgctcagcagtaagtattgcaccagaattttagtcaaaaggagtatgtataaaataaaccatgttagatcgagctaaaatatgactcactgagaattccaactctaggtcttagatttttcctttgaggttacacatgaacaagcctaattccttctcatatgatagatcttcacatatttaagtataatgatcgagcccccagccttcggtgaccaccccctctcctgccaagtcagttcttctctaggcaaaacaagtcaatttctctagcattcctcagatattttggttttgaatccttttgccgacgtgacggctcttcctaatccagttcaactgatttctgttcctcttcctttgaggtgcctgcagcttcatgcaacactctagacaggctccagtcaacccagggaactgaaatcttttgccttaaattgatgcttcccaaagtgtgttccattcatccaagcccctgtgacatgctctggaggtcaagggtaggtggtcacttagtttcacagtcaaatatgtttgggaaatcctgcagactaatatccctcttggagatttcagaatctgtgttagagtactaaaggatctgagtagtcctgtttacctttacttcatctaatttttcccgaattattcgaccactgagccgtttgttaaagtattactcattaacctccctagtgtgccatgaagctttgggtggcactgttcaacttccatttaagccatctgaaatcatttatttttttcctctttccctccctttctccgttcttttcttccttcttctatcacactattattacatattgattttagtgtcaatcaaacctcctacatatttttcaaacctgttgctgataaatcatatgtaaagtccttcacccttcttccctttatttgggcagctgttatttgatattcatcacttatgtattaagcatgcctttatttaagcccttaataaaaatgaaacttcataaatatttgttgaataagtacaggactgaggcctataccctttggacatggtaattcaattagctattaattatcctaatcacactaatattcagcccatgtttctctatgcttgtccgtgaggctatcttgaaatgcttgtcaaatgctttgctgcaatcagattcactatgaagttagatttcataatctaccagtctagagccatcttgttgaagcaggagatgaaattaatatggtaggactttgtacttcaggttcctgcgcaggagtttagaaacacaggtgagccttgatgggagggtaggatttaaaaaatggaggggatcataaaaaggattgtgggctggttggggtaagcatgagtaacggactacaggcaagtgtaaacatgttgggaatggttaggataaatttaacaatatttatccagtgttcactattgtgaggttttatgcagggagctggcagcaagggggttggttgagatggataaatagctaataattaactttataagtaccacttaaaagataaaatgtgatgagtgttacataaaaggaaggagtaaagtaacatagaacatttgttctgcagagtcagggaaggcttcacaatacaggtggcccctgagcagctatgaagattgggcagggctctgccagagaatgatagagggcttcaggattcaaaactttgatgatggaacagatctgtgaatggaggtgtcaatggattaacatgacttccagattcatgacctctttcttggacctgggcaaagccttgtggcattttagatggagctgggtgactggcactatgaccttgggctctgcctgaacctcacgtggatcatctataacataaaggtagtagtatgacagtgggggtgaggattgcataaacagtggaagtaaatctcccacatatcaggggtgcttactgaacctccttcctctcatctctcccagcc

(The sequence listing continues in the following parts.)

The invention claimed is:

1. A method of detecting the levels of expression of lncRNAs in a lncRNA signature in a subject, comprising:
   (a) isolating a biological sample from the subject, wherein the biological sample is selected from blood, plasma, or serum;
   (b) detecting the levels of expression of lncRNAs in a lncRNA signature in a biological sample from said subject;
   wherein the lncRNA signature comprises the 2 lncRNA of TCONS_00035093 and lnc-OCM-3:4, wherein the lncRNA of TCONS 00035093 consists of the nucleotide sequence SEQ ID NO: 1570 and the lncRNA of lnc-OCM-3:4 consist of the nucleotide sequence SEQ ID NO: 5076.

2. A method for treating a subject suffering from Alzheimer disease, said method comprising:
   (i) performing the method of claim 1;
   (ii) comparing the level of expression of lncRNAs of TCONS 00035093 and lnc-OCM-3:4 in the sample to the level of expression of TCONS 00035093 and lnc-OCM-3:4 in a reference sample, wherein the reference sample is a sample from a normal, healthy subject;
   (iii) identifying the subject as having Alzheimer's disease based on detecting a decreased level of TCONS_00035093 and lnc-OCM-3:4 in the sample as compared to that in a reference sample; and
   (iv) administering a treatment to the subject identified as having Alzheimer's disease in step (iii), wherein the treatment is selected from cholinesterase inhibitors, NMDA receptor antagonists, beta-secretase inhibitors, anti-beta-amyloid monoclonal antibodies, modulators of kinases or phosphatases that regulate tau phosphorylation status and anti-tau antibodies.

3. The method of claim 2, wherein the treatment is selected from donepezil, rivastigmine, galantamine, and memantine.

* * * * *